United States Patent 7,868,149 (PLANT GENOME SEQUENCE AND USES THEREOF) - sequence listing, part 6

SEQ ID NO: 2628 - DNA, 16604 bp, Oryza sativa
  unsure (1)..(16604): unsure at all n locations
gtatccctttccatgacttctaatctcaatatttgaattaaagtgcaggtataaatgccgcaccacaaagttactctaaaatttcaccctttaatttcattccttaaaattggaagaatcatcaagagcctactacaatttaaaaaatcaccaagtagtaactcctaccccatcttaactgccatcttagcaaaccttttgcatcatgtcctattggcaggaaaatgtttttgataaggacggaatatatggattattggagcatcatcgatctcttgcaccaaaaaatgctcaaggcttgctgttttcgtttccatttcatgaataaatgaaagtcatgcagtccttcaaacctacttgttctgtcgaatttttttctgcttgtttccatttctaaaatacttgtggactatgatacctgtttcggttgtagactagtactgagtactgactacggagtactaaggcttttgtctgatcactaccatgctctattatatcccacaaaaattctatgtgctgatctgttttcaaatagccctattggtttgcaaaaatatggttatataattgttagctatttattttaaagcttcatactttcataaacttttattgtagcttcatatctacatttatagttagatctttatttcaggttaactatttgtttaagtttagattcaaaattacagctaatgtctccaatggcgaaaaaacataatatccacactattttcttgtaactattaatcaaggattaaatttctgggatgttaaaatcccttaaaaacttgatgtacataaaaggcactgacaaggtagtcaccttctgacaggttgaaactacggagtttaagaatcaagattttgtttgtcgaaacttgtgcaatgaagaaaggttatatcttccatcaaataaaaaaagaagggttatatctctctggactatacatgccatttattgatccaattcagaatttgggaggaatatataaatccatcctaaaagaaggccacacagcaggaaaaactgaagccgtcccatactcagagttggattcaaaaactgataacttgtaatacatccatgctgttcagaaatttccatagacatcacttacgttattatccaactatgttaactgattaagcaaaagcatacacaactctgtccagaaagaagcagcccagtagcagcacgggccgaacgaaacactcagccagccaaaacgaagaaaccacgtcagaggtaaatagcatatacaagggcaagaccactaagttcagagaacactaataaagttaggagaaattgataaaatagaattcagagaaagaaattctgatacctgagccttcatggcctcatcagcgtgttgatgcttattccgatagttggcccattcctgtaaggctggaatcaaagcaaacatcaccggagccatcatgggcgtcttgatgctcaatataatcacagaaaccatattacccaaagcgcaaaccatgctctcaaaacgaacaataaagaatagggagccagctattcagcttagcacgacttgctgatctctgaatggaagcaacataagtcaacataattttagtttcatgtacctgagctcaacataaaacaaacagtaactgaaatgtgccagacatgttagactgcttacagttcatggtcggtaggatgaatttgacacaacaaccacatttgaacatcagacttggcattgttcgtacttgtactgcccaacaaaaaataaacagcttagtagtagtagtagttctggaagaagtcagtggcagcagattcaagagtcaagacaatggatttgtccattttgcaacaagttactcttgagcatgacatcaaagatcagtgagtccttgctagcgataacaatgtgccacgatctgaaaagacaccaaacaggcaagtgaacaactcataaccaactgtttccagctcaaagtatacaatttaacgagctatgcacttagaactaactagtttcaaaggttgtaaaattgggtttgagttgtgagcttcagctatgctagagagcaacataatactttgtaaagaaaacccgaaacaatacgataggataatattatatcaagaaggttctttaaatatttagcaatatccattttagcgtagtagccacttcatgttttatcaattacatcaactattccatgaatcaactgagcctgagaagttagcttcagctatgccagataattaacagaaacctttgtagcagctaacagataccagatgcatggtcatggttatttcacaagtcgaatctcaataataaaatttaggttcttatttccaatgccatatattcagtattctctagcatacacaaaacagcctttgtcaatccatataacaaatgttgcagttatattatgactaataagatatatagaagctgtaaagaaaatgcatacagcagataagcaaagtcttagtacaataccaggagtgtagaagctcatgtagggtaagatgctaaagtagacctcaggctctgcaaccttcttcaccctccttgacttgagctcgatcgtgaacaagccaacacctgtgctcacgaatatggcacccataccctccccagagccaaccacaaatgcttcatcactgagattggcaacaggtatcattttgtccagcttgatcaccctgcattgtacccattctgctgccccttctgaattcaccttccgtgaccacacataaaggctggaatcctcaatgcaggcaaaacccagtgaaccgttctccatctccatgagggcaatgccatacacgtctggcgacggcgagtcaatttcagataagcagtgcatgccccagttgtacttgatgatggcattatcctcccgaagtgtgaagtagatttcatctccgacaagggcaactcgcctaggcatgacataaggtacgcggtagaattcacctctactctgtgcatctcgccatcgctgttcccaggaatcaagaccatcatcaagaactaccggggtgctccacgccccggtctccgatgagtacatgctcgccttaacgagatctttgtactcatcacgggtggatcagaaacaaaaaattagggaggctcaattacacagttttttcaacctccagccatttagggacttttagttcattcatagtgaaaaaatcgaagggggtgctccggggtatccatgagttttgtgggtgtaggtgttggatccgccccgtcatcggtggccacaaagaccactcggaagggaccgccgtggcagtcgaggtggtcacagccgctcacggcacagaacacagcgctggagtagatcagccacgggatgccgggctctggcacgcggtgctgttcgccggtgacggggtcccagacaatgagataccaatcatcgtccgaagcgtggaggagggcacggccatggcggcaatcgagggcccggcgaaaggtgggatcgggcgagaggggcactgcggtggtgcgggcgaggtggggggcgggggctccctgtagaacttggcggcgtaaaggaggccgagcaggggaggggatcggtggaaggcgcggtagcggcggaggaagccggggtcgcagatggcgcggagccattccttgcagactagggcagcgcggaagagttgctcgggctcgtccggcgggaggcggaggaggatctcggagaggagctccggcgcgagcgaggcggtgaggtcgtccatgacctccggcgtcggtggcggcagcgccatggtgcgcccgtggtcggcggagcgggggcaggcgagccgcgcgacacgagagggtttgggtggggattgggaaagagagagtgagagaccaagaatgggcaaggggggaccgaccgcacgcccgcacccgcgctgccttctacccggtccggttcgaccctatcctatactacaaatttgggtttgcgaaccttcgattttgagtaaacaaggcaatattcgtttctgttgaattttgatctgctttaagatctgcattggatggtgggcctgcatcatggactgtaacgtgatactcccttcatccacaaaagttacacatattatttttgacaccaagacgtaatctttcacattccgccaaagaagaaattagaaaaaaactataggctgacgccaaagattccatccaaaaaaaaccatattttgactgtgcttcaactatatcaactgtacttgaactgttggataatcatagtcgacgataacatcacagttcccaccgctattccaaaaccgtacatgaaaccttagtttcatacggctcctctatgatcagaaaaaaggaaagtactttttcatttcattattatcttcttgggcgtagttagaattatctaagataaaatcgatttcaacgtcctaaattagaccaaaggaattctgtctgctagaataataaaaaacgcttcggaattcatctcatcctttataatataatggtatttttttctttgttcagcaataacttaatcttgaaatgaaacactcgttataacaattaataaacgaagaaattaaatcatcttagatgttacaaaatcaagtagtaaatgtaaacatgcaaccaatgagtatttcgaggactccttaggatctaataaaaacatttaatttatctcttcatttaagtcctgaatgtataaagactacaaataggaacaacttatttggaaaaactcaaatatgaaataggtgtaactgttgtggatggagggagtagttttattctcaaaataagtagtctgcaaaacaatgtgaagatgatatttatcatggaatttgacgatgtgtttggcacgacaagaaacattttagcatagcaacccatgagatggcccactacctagtaccacagtgagaaaggtgtaagactgtctccaacagagaaggcaaaacgcaaaatagctcgtgcacagttttttttgcatgtcagaaacagcctccaacagacgacgcaaacagaggaggcattttgcgtatgaggagagagagaacgcaaaattgcgtcgtctctctccaagacgcaatcgtctgcacggcgtggtggtgggcctgaagattcgcgtaggggcgcggtggccagcggacgatgacatcgaggcgagcccgcggccggcgtttccaggcatgtccgcgacggggcgaggagggccgatgacggatcctcgtcggggggcggcggcgcggcgcggtgagcctgcgggcggtgcttgcacggcggatccatgtcggcgaggcgtccacgtcgacgaggcgaggaggatccgcgtcggtgcgaggcgcggcggcgaggcgaggcggatctacgtcggtgcgaggcgcggcggatgcgcgtcgacgtgcgtcagggcgaggcggcttgtcgggcacggcgggtgcgaggaggaagacggaggatttgcgttcgtttgttggagttggctttgttttgggtgcccaccttttcctttcaacgcgaggcataccaggtataggtctcctattttgcatcgtattgttggagacagtctaatagtcggtgaggcaccttgctactagttccattgagaaagaagacgtgataggcgctagccgatgaggcaacaaaatgttttgtacggtgtcaacgatatcaagtggattgtgttaagacgaccacttaatctaaagcggggtgtggcaatatagccatagcttctcgcagtgttagtggtagggattctttttttttttttacttgatgtagggtgactaggagcacctaatttgtgggcatcgtttttattttgttgcacgtacaaatcaaaatgatgttttataatgattgattaaaaattgagtggatataagttgataggcaaaaaaaaaatatgttagggtttagctagttccgtgatcagtgtcggatggttaactggttatatcgtttgtaaatattacggttccttaaaactcctctctattttctgttgttcctttgttacaatgttttggtatatgttcgcaaattctacacatgcatcattatgttaattgtcatcaatgaattatatagtaagttgctcattaatattgcagcaaaacaaaggacaattatacacttattagaccctcttttatattaatatattagcatataggctaggccatctaacaaacctccaataagaggttactcaactgtctatttttttcagccaacaggtaaatactattatccggttatttggaaaaaaataaaagataagtaataaggtctttaaaaaacagaaataagttacgaaaagaaaagactgggaacaccagctcaatataaatgttctccaattccatcagaggttgtaaacgatgagacgctcatcctttaaccctaccacgattcaaagaaacaaacatagacaaattggagcagcaaaactagtcacatcctcatatcctctggcagtacataaccgctccaacttcttcaccagcttctcgtggacaatgtctagacaggcgcggtctttttgttttataagcactttccaactcatatgaaaaactatcaagacaatttctgtctatttagaactatatatataaatttcaaatttcaatactctcatgaaacaacattatacaatcgctaagttataagatagaatatggtgccaaacaatctagtatcaatacgattgacaaggagtgaaaaagaaaaactatgcagatggtccagttagccacgtaactatactgtagttgtacaaaagatgaagatgttctatcaggacatatttagctatgggaggggatgatttgtcactcgtagtcagtcactctcaccacaacttcatcttcatatcagcagcaggccagttagacaacatcttcagttcatctgttcttattgcatttacacatttggacaaacgaacaaatccaattcagtatgtacaagttcttcagcaagcggaccaaccttccgaggcaaagcatgtttgcagagcatagcatagtacatcctgtaaccttgatggtttttcatatgctgtatgagaacgatgaggtcagggagtaagggatccgcgtcaccgtggcaggctgctgctggagcttgtggatgtccttcacgatgtcgaacacggcttctggctgcgctagcttcagcgcgttgagggagtatctccggagctcgtttgtgtgtgtggtgaaccatctggcaacctgtctcgcggcttccctcgggtccttggagaacacaccggcaccattgtccacgacgtaaggcacattcccgacttcctgtgcgacgacaagagggacgatatttgtttagcctcaatatcttggccatcccttctttcaaaaaatattttggcccactcacgtgtatatataaccatggcccatatacatgcattccggtccatctaaacaagggctccatttgattttttttttctgagagcgatgtaattgccagactccacttaactaaaacagggactggatgactctttttttccaaaataaagtggagagcgctacggctcggacgtccgatatctcaccaaatattggacgcccagccgcagcgagcgtatgtgtgtgtatattgctgcacttcattcttcactcctcaatcatgaggaatcttcccatctaacgtcctatgtcccaaagaaaattggttggtcaaatgttctagttgaccaatgagtgaaacatcaaattatatatggtgaaacaaaaaatcagcaactgaaacatttaaaaattttatgaaacatgaaaaagatacatgttgaaacatatcgctatcacatataaaacaactagtgttaacggattgaaacatatgtttttctttcatcaaaatataatcatatgatatcttgttgtaaagatttaattacaacgaatataccgatgtgttcggatcatagattggataattagtttacgagaaaagttgttttgaagctcgctaaaatgcatgcatgtatgtatgaggtggagagaggagagagagtagtgagatgtagttccacgaaatttgtgaaacatgctgaagagacatattgaaacatattactattgcgtatgaaacaaagagtgttaatggattgaaacatatgattatttttaatcagaatataatcatgtgacatcttgttgtaaagatttaattacaacgaatacaacggtgtgatcagattgtagattggataagtaatttaagagaaaaattgttttgaatatcgttaaaggtatatgtgtataggcttgataggatgtgtgtcagactcagtccatccgatttttctccttcagtcggacgtccgaggagaagcattttcgaaataaagtacgcacgcatgttgtcatattgggcctgttcggtcggcattactgtgaatgcagttgcagttgctgcaacaacagtgtacacacgttttgactactttaaatttgactatgtttatgcacaaatatagtaatatttataataccaaattagttttattaaattaataattgaaatatattttcataataaatttgtgttgagtatagtcttaaaatcagaaaaacaattttgttactctaacgaattcagtatagttgcatccgcacacacctgtccaggtatgaagtcgttgagaataattgggagtcctcttatcagggcctctgcaattgtaccaggaccagcctgcaaacaggacacaaacattcctaagtaaaaacagtaaaaaaaaaaaaaccatcaactcctccatcagtccaagaaccaacctttgtgatgatgcaatcgcaagcgcccatccacttctccatctgcttttcgaaccctctaatctgagatcaaaacaaaaagagaaaagaaaatgtaaaaatgtcagccagtggtcactaccaaacgcagtaagagcagaaatgcgcatctagcacggcatcatcctccccagattcggcatatacatggtaccttgacagggacattccaccgtgacgactgcagcgtggaccgcagcacctggttcctgccacagatgacaacgatctgcccgacaggccggcgtctccggcgatcgtagagctcgtcgctgagtgctctcgccgtctcctccaccggacccatcccctcgccgccgcccatcagtagcactgcaggcaggtcgggatccatgtccagctctttcctcagctcatcctgtcaccccaaaccccgagcagagttcagttcagctctgcgtcagtgcaatgcagcaatgtgcggctcatgaagattatctgaaaatgcgcggcaaccggatcgaccgaccttgtcgagcacggcgcggcagaaggacggcctgatcggcaacccgtacacacggatttgggacggctcgagcccccggagcagtgccctcttggccacctccgccgacgggcagtagcacctcgtcacgccatggtggaacctgcacaaataagctctatcgatcaatctgagatcgcgccgcgccgtggcgaggccggcgagagtgcgtggctccggtgaactgaactggttaccatgtcgggtggcaggtgttgaggtcggtgatgacggtgacgaatggcaccttggggtggaggctctgccacttgagcacccacagcgggatgtgctgcatcagcgggtgcacgctgatgataatgtcggggttgtacctcatgatcccggccaccacctcgctgaaatcaaccatgtcagttttcgcgaatcgatcggatgaacagagacggaaacagaacgtgatttggattggacgatcaagttgtgatggctgcgtgcgtgcgtacttggcgtagaaataggccagcgcggcgaggtacatgccgtgcacccagcgcggcgaagtgccgtggaacgccaccttccagagccggacatggcggatcatgaacttgtacgaccgctccatgtcgttcagtggccacccgccgtactccttccccaaatctctcacgaacacctgcgcgaaagcaattcagttgtgattggagttcaattttttttcgcgagaaatcaagagattcatcaaaccagtttacaaacaattcatgtgattgtgagttcaaatgttttggcgagcaaattgaatttgggggcggctgtaatttcggagcggggaggagaggaccgaggcttggagcgcaaggaacagcgggcattgagcggacggaccgaccgacctggtaggcgtcgccgaactcgaggcggaaggcgtcgcggagggcctcggcggatgcgcggtggccgccgccggtgtcgctcatgaggatgagcacgttcttcgccgccgccgtcttcctcccgcacgggagggggacgccgccctcggctccatcctccgagagcgcggcggtgaggccgcccccggcggcgccgtcgtagaaggcgcagcggaggggctggtagagctggcggcctccggcgccgagcacgccacccagcacggcgtcgcggatggagcggcggggggtggcgaccgagatcaccatggcggcggcggcgggggcggcggcttctcctcctcgtctcgtggatcgagcctacgaaaggtttgccggcgaagagagagagacagagagagaaggcagggaggcgagaaggtggcgaggaagggaagggcggatacgccatttatcagtgctctcatatggattacttcaaattgccccttatcctttacatatttcttgttccaagccatttcaagttttgttccaaaatattcctctggctagattattaataagtatatagtcgagaaaattttcatgataacatttactcatctctactctatccaaatttcaaattcttaactagtcgtcattcgtagttacagagaaatataggcatttatgcgacaaagctgggttacacggtgcccaggcaaagtacaagcgggcaaggcaactcgggcaggcagtgcaaaaccacgaaaaagccccagagcgtccggtccacgtggcgaaatgctagtggccgaacgaattgcttttggggggttgggcacgcgcggctagcgggcgaaaggggatgattccgtcggagatgctgggattatgcttggaggattgcttcgttagcctcatgtctgttgctcaatgagtcgatcgagtagtcttttaccacacgcttaaaaaggataagagacagaaactggtgacaaatttctgatgttactaaacctatttgcacttgcatgtgctttacatttgtgggaatcagaatttaaaccttgatggggtggagtcatacacgtttaacgtctttaccaccacagaatcagtgcttctttgtctttggcttattttatttgactagtacatgataattatgagtatatgagttaaaggccctgtttagatcctccaaaatggtaaaagttttgccattttgaagcactttttgctattttggatctaaacactagtaacaaaacttagcaatttggcatttggcatttgctagtccatagtagcaaatgtgccaaaaagtgctttgggaccactccctctctctttctctctctcactttagtgctagaatggtaaaagtttaggatgcatctaaacaccaactaatacttttgcaataccaaaacttttgccaccaaaacttttgccatttaccatttgctattccaaatggacctaaacagagcctaagtattatgtggaaataatatagtaattctaaagaacccgtttaacaataattgatgaaaccatttgaattttcaatacttcaaaatctatagaatagctattacatgttacaacatgctcccttactccacaaataaaagaacttaagtttttttattttcaaaattaggatggaactatgatgcactccctccatttcattataagtcacttctcttttttttctaatcaaacttgttaagtttgaccaattttatagaaaaatttagcaacatctaaattatctaattaattttattaaatttaatattaaatatattttgataatatgtatgttttgtgttgaaaatactattatatttttatataatcttgatcaaaattaaagaaatttgactaagaaaaaagtcagacaacttataatatgaagcgaagggagtacccattaaattaggggtgtgtgggaggataatattggctaaatattacatgaggataatgaaaggtggttgggtgataaagtaatactctaagtacttatatttgtgaacagatggagtggtaaatatcagtaacaaggttagtacaacactacacaaatttcagattaacaaataagttttagactaacacactcttgtagtcttgtgttccttcctcctgcatctagaactcctagaccctaaaccctcatcatataatcaaataaaaatgacatttttcatatttctatgtttacaattgaagttggctattatactttttatgtaactgtatatgcatgactttagctaccagtattttagttatgatatttataattagatggatatgtgcattcacttttttttaataatggaatataacatccctgtctttgctcaagagagttacaaccaattattacagagaatgtgcattcacttattataatacaagttttctcaatatttacgaattagaacataaagaaaatatattctcattcgttgcagcccaagtgatgaggacatcctacaattgatacaaacatacctagtgcataacaaagaccaatgcatgacttgagcttgaacacaactaaaattgttccctgttattcaaacaaattctttttcgaatgatgattttattatgcttaggaacttgggacacgaaccatgtgggtgaaggaacagccacgacaatgaacaagtggaggccggcatgagcaaaggaaggattagaccaaatgattgtactacaagttcggatagcacgtttggacctccaagcaatggtaactttaattggacatagctctttactctggagggtgttgaggtccatgagtacttgttgaaaatgtcttgatgtcttctttgtagatggatcaagaaacactactacaaaaataatttttttacgagaacctctttatctgccaccgtaactggttgcatctgcaaaaatcatcctctatttttacgtgaggctacttaagaagactgcacggaaaaatcgattttcgcagacgggccttttaagtagaccgtacacgaaaatgagcctattttcgtagacgggcctcataaatggaccacgcacaaaaatatcactatcctttacagatttttttatcccatcatttctctcttttccctctcactcacgtcaaaattttcacctcctctctctcactttcccttttattttcactcttctctctctcttgctctcctctcctctcctctcctcttctccgagcgcgcggctagccctaccgcatgcgaaaacccctttcgggttgtccgcaaaaatctcttttataatagtgaaacaccaataaattccatcaatgttgcctagaaactacagaagagatgttcaagactctaacccgcgagttgggcctcttgtatctagaagagcccatcaagggagtgtcttagctagggtttcccatacctcctactattccccccatatataagatagcagcaaccaccaagaacacttccttaccttttatttagatgcaagtttcgcttcagctacttccttttactcacgtgtattggctagaccacccggatgcttgatttagaaccccaactttgtgtgtttgttttatcatctggcaagtgatgtaatcgtttccttgtcaattggttcttgatgcctattcttttattgcttgcaggttcaaggttgtcggggcccaccctgtcttgataggtaaggaaactccggcgatcgaattctatactattacatttagcattccaccttctatttccagccagatagctgcgatttttagcaacaactatttggattttcaacagtgctgtcatggaatgtagaaaggctacccaacagccctgtcaagcaccttactgctgacaatactatcacaattgacccatatatgccaacaaccttgtcacagttagtaccatgatgccatttccacttcaatggatgataggcttgttgggaatgtaccatgacaactagacactagcaatctgtcggagatatgggcccgggggtatgtggagtagaggggaattactttccctccggccacgtgactccgcaggctggcccactcgcgtgccacgcgagtcgtagaagcgcgcgggggggggggggggaggggnntngtccntntttatatgacgttactttntngggcgntncgnaccgtcnccccgaggccctcacccgactgccgtgtggcagagggagagagcaagaggggagccaggctgagcaagccataaatgtgcgacgccccaactgtccctcaccgcatttaatgcggtcagggcagatgtgcggcgtgcctagctaacccctgtccatcggatgtgaccggtctgtgaccagcccgtctccgtcacatccgatggataaggcaaacatgtccccacgtcgccctttgtccccggcggagtgggggtgagtatgacccatcacatccgggggccattcgaggaaggactgttgcatgtcaccgttcatttatgagggaatgatagggctgtcccccgtgtcaggcgggggacggcaccgggttccgcgcaagaatcggttattggttagcttccggaagaaggcacagttggaagccaaaaaaggtggagtggggtttttcctccccccccccccccgcgatggaggggaggtagaggcggcatatgtggtatccccttaagctataaaaggaggaccctgcccaccgaaaaaagggggaggcccagaaaagcctgaactccagaagagaggaagcgagcgcgctctctggagtaaagaaacccttgtaaaacttgtccataatcccaaacacaggagtagggtgttacactctatagcggcccgaacctgtataatccgacggtgtgcattcactcctaatagtcatagggacgagcaagcgactaacgagagacgagcctccgcccccggccgaactcatgaaaaggggtctcacgactccctgctattgagggtcttccctcaacacaatcaatgtatgatagtgctgttgcagatatattttgtatatattttttaacatataagttaaaaggcatgaatttgccttaattttccaagagccaaatatattccctttattattcctctaacatattacttgtgtgaatttgacactcaccattcacgatgttgctttaaaacttttgaaaaagatacacaaaacttaattagagtatttattatattcctcataatacattttgttacgataaaaggcttttattttcttaaaacatgtactaaaaaagatatcatgatcaaaatattgaaatgtgaggcgagaaaaacaagaagaaatgtgaggggggaggaaaaaagagagaaaaataggcataattaggaagaataggaaatacatgagaaaatggaaaaaaaagaagaaaataggaaaaaaatatgtgaaattttaaaaaaaatatagggggaaatagggaaacagatgggtcggttgggcaatgctcatgcttgggtcgtaccttgtcggaatatcggcaaccatgccgtggtgtgccaagaatttatataagatactttgtgtatgtgtgaacttttttgcttgtaaatatataagaagaaagtaattagtttttgcaataatttcaaaatctgaatttagtagttacaaagttatatatagaagcaactgcgtattcgtaccgttaccttttatgttattagcttaatagttcttagatttgaaattcataaatacaaagttttactccttttcaaaattaataagttccatccttttcatcaaaactaataatgagtaagtcctatatgggaacaaatttataaatagaatgttgtatttgttgtggagtgataactattttgattttattcttcaaatttcgaaaataatatatacaatcctgtcaaaaaaatgttatatacaacgttgtatttttcttgtagtctaaatatcagttttcgtgataaagaactaaaatttggaattgatatacatatataaatatatatgtaaaattgtagtcagccaaaaaactagtattatctaaatctctaaaaatctagtatttccatccacttattacaattttttttgaatattttctagaaaatttgaaccagctttggtctaaaggaaataatgccttcgaaaaatacatctaaaaatctagtatttccatccacttattacaaatttttttttgaatattttctagaaaatttgaaccaactttggtctaaaggatttttttttgaatattttctagaaaatttgaaccagctttggtctaaaggaaataatgccttcgaaaaatacttcaaaaaa

SEQ ID NO: 2629 - DNA, 5734 bp, Oryza sativa
  unsure (1)..(5734): unsure at all n locations
ctacacgatggcgattctcctataaccccgcgaactagatctcgcttctctctccaaagaagtgctcgctcccaagatttaggatcctaactgtcgtttccaaattagtttacttgagctacctatttcgtcggactttccagacagccatctccaaaaaaaaatcaccacgcagttctttcgattctacttggcgacgacatccatgtgttgaaccatgttcatcttcaacaacggtgattcaagggagagccggtgtcatattgcctgatgcaagcatcttgtagaccacaatcacaggtgcattttcttttgactagaagctgttcgatctatttccccttccgtaacttgagcgtacacgcatctgtgagttggtgtggggaacggggcgggggttgaagagcagtgctgcaatgatgccgccgccggtggtagtgaggtgtggtgaatggaggctgcggtcggctgggcacgtggttgtcgtaggggtgaccggtggccggtagaaaggcgccgggccaaggcgtgattgcacggggtggagatggccagccggctaggaagctggtgcctgcatctagaaagctagagactagagtcctagagctaaggttgtggttagtgtttcttgattactgaaaatggatagatgtaggaggagaaaagcattggagttctacaaccgacaggtgcatgtttctctgtactagttctattctctgcttttgtagtagggaggcactggatagatatctttgtttatctggaatcttgttggatgttgtggcaatgcacctgctatggattgcttcacatggatctgcagctttacattctgtaattggaactcagtagatacattgctcttttacatcagtctagattcaggatcactaaattgtattatcagattatatctaacagctaattgaatttattgtgtcatgatgtttcttggatggtaaaaatattaatattgtttcacagttggaccaaatgttatatgggtaagggcacctttggatgcacaggttatgtacgaatgcactggacgcaaggcacatgggaagtttgcaatggcggatggtgcaattgatagctcagaagtgcaattatccacaaatgctcatccttctcacacttacacagttagacctagccaaatagaggttgaactgcgtcaagagcttgctaatttcaagcatcagcgacaagaggattgccaatcaatacaaaatgctctatctgagttcaataatcagacaaaggaggttattcctcttttcatgatgctatattactgttctttgtttttactgcaatgtgaacgtgtctaactattgcctaatgaattcttattagtatatgattaatggatctgcaagtacacctccacctcagatcaatttggctgcattatttcctagccattcatctccaactactcagcaggtaagaatattctgaaaaaagttttctactacagatctgtactactttggagcattcatccatctttgtttaaaatatatatgtttgactaatggcatcatattttcttttattgtagaatactacaaataatagctccagaaatgtgttcaaccaaatagatggaaataatagtggaaactgcagccaacaagatgctggtttgagcaacaatgaacaggtattaacaaatctactcttttggtagttcctttttcagaatgattgataaagtaaaaaacttgtaatcatttgtcaattaaattgtggaacttagtcaatagcaatttctctgtcttctcaagtgtagatcaatatgaccatggaacattatattagcctagctatttttttgtacccacactataccagattatgcatatatgttacatacataattaaagataatgtgttgattagatatagtatgacatatcattccacatatttaacattattctagctttttcacttggagcttttattgagggccggaattgcttgatgtgatgtatcctaaaaaactgaagtcatcaatctctagcaaaatttacaattttcttactagctagaagtaacttttaccaagcagctttactatgttttgtcaaaaactagtttgatcataatcttgcgtagtcattgatgatcaccacatgagagtataaactagcttgtacaactaaaccattgtttcatatgctgaaccatatagacattaacctatccatagaacactttccaagtagactatatctgtttcaaacatctttagaagatatttttgtactgttagctaaattggagattggagggatacattgtcacctgatcctttttccttttagggtgacatgggaaacaactctgaaaatgtggtgttacaacgcatggatggaagcacatttggttattctagccaacaaactgctcctgctactaatcaaggcaacagtaagcgagggagagatggagactatgttgatagtgaagatgattatgctgatgatggaaactatgatgatgctgatgaaactcctgaaccgttcgttgctgcagttatagttgattatccttgtacaaagtagtgctcactgttttatgttggttaggaacttcaatttacttatccttagtgcaagacaattacttttatttaggaacgatgatttatgtttttattgtgaaacctaatgtcagtacaatttctgattatatgtgatattattaattaagtcatgagatcactggttcaagttacctttgcagtctgtaatagtattgaaaagtgtagtgctatgaaaatggttggaaatggcagtggttcatttataataaacataattctaaagtatatccactgatttgatttttgacagtgctatcgtggaagcatctgtatccatgacatgcctattgtggttactgctataatacccttgttttattttgctacttgtgactgtgttgtcactatgtatgttgaattttctgacattgcagtcatagaagggggctagctggacaccatgttgagatagcttgacaccaagttaccccaacaatgtgggcagtcagtaaacaagaaccacaacatggctgtcaacgatgagaccatatccccgacatagcaaccccaacaggaaatacccaagagctggctgttgacaaatggcatccgcgacagtttcgtacctttcaccaacagttctaggctgttgcggttgctatagtatggtgttcatatcctccacatgaacctataatagtttctacatataaaacaccacatattcaacacgcactgcaacgcaactaagttaggcaaatcacccgtttttacatcacatagttatccaaatgggaatataaatgaggatatttttagcatattaccatttgctatccagggtgagatccaacacggcatattgtacccccaggctccattcgaatgagatgcagatattaaaccttctctttcgcgtaaaacaagacgagtcattagcacataataaattcagtattaactagtacaaacttaaaatggtttaattgatttaaagaaagttaaaccagaccatttaacagtttgggaaatatgctcatgaaaaatgatgaagtagcatatcccaattgagccaaatcaaagatatagtcttagtcggctgtaggtataacagtaaccctgagtatcattagttcattaatcattacaagaatgcattagcatggcagcatgctaccgtaacgtaggttaattatgcggaaatacttaaaagtttgtaagaggatgtgcgtgatagtgatattatccactcatggaatcatctcgcttgtgtacttgaccaaagagggaatatgccacggaaggcagtcgctagtcacaaatgtgttgttcagggctactgatttggaattcctttttttggaaggcagttccgtttaagtttgatggagacgagcatcaagtaaaggtaaattgagaaaaccattagtgtttgattaattgagttttatttatttttaacttgaaaaataaatttatttggtattttatagcaacttatatattgaaagttttcgtacgaaacatatcatttaacattttaaaaaacgtgctaacgataccaaggtctaatatgcatcttaatcataaaacaacgggcagaaaataggatgtgctcgtatcattggagaggatctattgagcacaatccgcagcaacgaaaaagttcggacaatgatatatatattgcagaataaaatagtcaacactagtggccagnaaggcaggaagagcnccatgcaccaaattgtaagtggcagaggataaaaataataataataattgtacgaggcataatcctcggggtggtatacaggcctcagatttagaaaatgtgctcaacttttcatccaagtagaattgaattcagtgaacttttcccctgtcgctgctagaacaggctgtgacaggtacatgctatgttttccctaggatggtgaaatacggttatttgatgtcatggtccttgtaaacctttagtatgagaatgccatttcattgaattcgtgggtggtatatacctccacatcccttaaagaggcaaaaaaaaaaagagaattaattagctaaacggatgaaaaaaagactggacgattggcaaggtacaagatggaatttttgacataacatttgatcattggtcaaattaaaaatacaaatatatattgatcaggtttaaagtacatttggtaaaaaaaaaatcaaagcaataatacatatcacgataaatgaccaaatatcatgtctaaaagttaatgttgccatacattgaaaaaggagatagtatatatatataccttaactcatattgttacacactaagtacatatagaccttgcaactgtttttttctctctctaaaaataagttttgcaaaagaaatcaagtcagcccaactgattcttgatttgttttgtgaaacaacgccacaacaatgattccacgtaagctctatagactcaaaagatgtacagcagaaaaccaaataggtggccgcatgcttaaagctgattgagtactctttagctcgttcgaaaacaccctctgctttcttgtcccgcacttgtatgttcagacacagtgttcgttatgtgcaccgttggtaggcaagtggattttcataattttatggaacatgcttgaaatacagcagctatacacgaagcaagtacactttcagtaaaataaaaaaaatcaactcctgagaataaatgtggataagcattcatccttagaagttgagttttctaaaacagagagtagtattcagcaagcatagtagtgaattacttaaccctagttggaagcccaatttcaagcccaataagatggtaaattgggtacctgaaactttttaaccttgctcatttgccatgagaaagaagtaaaaaattgtaaattttacaaaactatagatattttaacaaaattactgtaaaactacatatttaatatatagtatcgcaaaaatacatattcaaaaatgattttatagtttcttagaaaaagaaggaatggttttatcataaaactacatatataatctatgctatcttcaaagtataatttagtgttgtttttttccacaaaactatagattttagatgctcccttcacctatatcatggtaaatttctaaaatgtgtagttttgcgaggaaatcaatgctct

SEQ ID NO: 2630 - DNA, 7316 bp, Oryza sativa
ttaatagaaatcaaaaaaaattttagttataaacttcgtttcaaagaaagcagtgacatcctgacaaaaaggtggggagcattcgcgcaacgcctgcagggcacccacccaggtagctttgatccctgcatcagaaggggccccctaatgggcgatcgctcgcttggagatgggggcagcgatcaattcgcccccccccctccagcctccctccctccacttggttttcttttttggcaccgcattactttcctattttagtaaatttatgcacctaaagtttatacacctcaagtttacacatctaaagtttagagaccaaaagtttataagtcaaaagtttatatatccgattcaaatttgaatttgaattcaaatatttttttatatatagtatttctatacatctaaagtttatacacgtaaagtttatagacctaaattttatatatccgattcaaatttgaatttgaattatatccgattcaaatttgaatttgaattcaaatatttttcatatatagtaattctatacatctaaagtttacacacctaaagtttatagacctaaagtttatagacccgattcaaatttaaattatatccgattcaaatttgaatttgaattcaaatattttctatatatagtatttctatacatctaaagtttatacacctaaagtttatagacccaaagtttataagtcaaaagtttacatacccgattcaaatttgaatttgaattcaagttttttatacataaatttttttaactttttgtttttttaaaaattttttgtggtgtactgtaataggaagagaagaaggggaggaggaagggggagaagagagagaggagcacagggggaggcgaggggtgatcgccagggcagcgcgggggcgatcacccgcgcgttaggatttccgcatcagaagaccatatcaattccataatgcgagccatgcagccattatatccgaccatacttaacattctctaatccacgtatccacagttcgttaccctaggtgtgaaaacgaagtagatagatcaaaacaaatacggataccatttggagcaaaatcttcaatagtctacaggggcaaagggagctagatagaagagggtgtgcccagaaacccggtcaagcaaatttatagttatagtttatttattttcaccatatgtgctcaatccaaattcaggcgctcaatcaacctaaacttggtctaaagtagactaaggcccctttgaatcacatgaataaaaaaatggaggaataggaaaaacataggattctcacaggaatacaagtgtaaaacagagaattacaaaacacaggaaaaacataggaatgactgtttgattgagccgtaggaaaaacacaggattttgaggagagataaagactcaatggattcttaatatgaggttctacctcatgctaaatttcctccaaaacttacatgggaagaggcattccataggactttcataggatccatatgattcattcttttgattcaaagggctatataggaaaaattcctataggaatgaaatcctttaaaatttctatgaatttcctttgaatcaaagggggcctaagggtgagtttgaggaggaggagattgggaagatacacaaaacgaggtgagccattagcgcatgattaattgaatattaactattttaaattttaaaaatgaattaatatgattttttaaagcaacttttccatagaaattttttgcaaaatacgcaccgtttagtagtttgagaatcgtgcgcgcggaaaacgaggtgtttactcaccctatctcacacgaatgaacgcagcctaaggccctgtttggttggagagatgtcccttaactttggtcccttccgagcataggactaaagtttttagttagggattaattttagtctcgggactaaatgatccaaacagggcctaaacggtgtgtccggcaccctttttctcaactcctctcattcgttttccacgcgcacgcttttcaaactgctaaacggtgtatttttttgcaaaaaatttctatagaaaagttgctttaaaaatcaaattaacccatttttgaaagaaattagctaatacttaattaatcacacgctaatagattgttccgttttccgtgcgggagagattagttcccatcccttcaaactgaacacaccctaaagtaagcgaatgttacccctctctatttcgttccggcttcatccgtgatagtccatatacaaatacaaacacacaacaaatacagatgatttcatgacctttcttccctacagccagccaacccttatccaaccttattgtccggcacggacaagcaaacagtacgaggaacagaagcagcatggcgcaccagcgattctatcgagatatgcacagcggagacatgtaaaaacattaagcactatgtgtagattaatgttagctaacaaactttcagtgtgtactacggttgaaatgtcaaatttatgcatcctaaaaccagaagcatcatcatgtttttaaatagaatgacaagtctgaactctgaactgaatgtctgcataagagtacgtacaaaggcgcatattatacctactcatatttaccagaagacggctgtatggagttccttttttcacaataaggcgatctttaataagcaacaagagaaacaaactgtaaaaggaaacacctttttcagaaaaatcattacattcaattcacaatccgatttcgcaacacagcacaagcaagtacactagaagagtgaaatcttcagtggacaggcaacaagatatggctgtgttcggcattgccggttcccatcctctccctagcttttcacgcgcacgcttttcaaactgctaaacggttgtatttttttgcaaaaagtattttacgaaagttgctgaaaatcatattaatccatttctaaaaaaaattagcaaatacttaattaatcacgtgctaatggaccgctccgttttccgtgtgtacatcctgtgttgggaagactggcttccgaacgcagccttagggcccatattatgtggagggatgaattggggtgctcgatgggaaggcgaggctgttgcagcctcgccgccccggagcctaggtgaggccgaacatagaagaggggagactagagatatgtttaacttcttttttgattgattccaaatgactgcggtgaggtcctctaacaaacatcctaacaaccttatctaataaagcctaacaaatctcctaacaaccttatagggaggctgagttctgcccataacacgtgattaattaagtatttattaagtatttgctatttttttttgctaaaatggatcaatatgattttttaagcaactttcgtatataaacttttgcaaaaaacgcaccgtttagcagtttgaaaagcatgcgcgcagaaaacagagagtagggagttgggactagctcttgcaaacagagcccgagtctttgtgctaccaagatctatataagtgttaacttcatgataaaaaatgaaacatgagattctaatcaggtggtaccgtggtagtaccttccttgaatgtttttttctaagtaagagaagggattcaattgaaatttgcaaccaacataatgaaatcacaagacagagaaacatctaagctatgtgggtggacactaagttagagtacataagcaacttgaagaattcatgtagcccatcacacatcagaaccgttttgataaatcaggtgcattgctgaagtgcagtatcatcttgattaactgctccttttcaaatcatatacatatatagctacaaatttcaagaatcaagttaagaagtgatgcagcatgtcctgccagcataacatgtaatgccaagagtgacgattgccgacctccacaagaatgaacacagaaaatgaggatgaaggggatcccctaataatttacagggttatacagattaaaattgcaatttgccgccacgaggaagttataagcataaggaactataccaaaaggaggaggattgcgatagtggcatagtgccatcaagaacactgtttttttgggacatgagaaccagttgcccaagtcaacaaccatagacaagtagaagagaacgaagttgatgaagtgatatatgcatagcaattaggccatgtacttttgcttgatcaatctgcctaagggattagattatgcaatatctgataatcttgacatcacctaaaaagatcaggaggagagcagagtagaatgtaatccgcaattgacatgccatgtgcattgcagttagttacatatgaaaccaagcaggaaacatatgtagtttgttggttaggcatgtaacaagtgtagcaaagatacctaaatattgctagctgtaagctatcagaaaaacgcaattgaacataacagaatcttattttcctcacaattggaatagcgaaattgcaagagacaacgatattttgcttaacacatttgtattgcctcaaaaacaataatcatgtcttaaaatcaccaagagtacagcaatggagtatcacctagttaaggaagaagctttccagccataaagcaggcaaacttattgctccgggaatactcatacggcacgccggccacggtgagcaaccgctcgaggacctgcttggcctgctcgggctccgccgtttcacactccagctcgtagttcgtaccaaagtcgaagcgcgtctcgtcgagctccacgacgagcccgagggtgtcgccctcctccagctggtacacggcgcgggtgttccggaacccgccgaggcagacgaacggcgcggcgtccccgccgacgccgtactcttcggagacgagccgaatgatcggggactcgaccccgccgaggcttgccgggtcgtcgacgcaggcgagggcgatggcggggtcgagaggctcctcgacctcctcgacgcggctgacgcccgcgtcgatgcgcgggcggcgcttgagcgcgaggacggcgcgggagggggcgcggtcgtcgaggccgtaaaggcggacccggaccgcggcggtggcggcggcgagggggcgcgcggcggcgtcgaagaagaggttgcgctgggcgtcggtgcggcggaggcggggcgcgaggaaggaggagaggcggcggtgcgcgccggcgtcggggaggcggagcttgatctcgacctccatcaaggcgggcgaaggggggagaggagaggctagggtttggggttgggattgggattggtagggaggccgatgcggtgggacttggagggcgcggcgccaggcggcgggtggaggaggtggaggagggggttggagttggagggcggcggggtcgtggtcggagtggatgaggcggtgggggtgctggccgctgcggcggcggcggcgcggaggtggtcttcgagctcgtcgcggtcggaggagcggagctcgatgcgggtgggcttgcggcgcagcatcgatgtgaaaggaatgggttggcccggtgcactgtggtgaccgggtgggctcgggatgagattataatggagctggaaaataaactgcgatgaaaaaaatcttaaaattaaaaatttaaattttagcttgtcggtgacatgggaccgggggtatcttgactagaggtttggggcgccgcggtcacccacgtggcctgaccccctcgggggggtcgggcccgagggtgacgtggccgcccctccctctgtctccccgaggggtcgggccgctcccgtttcggccccgagggttggggcgccccgaccccctgtgcgtttcgcgccaagtgtgtgggtgagcacagcggcgctaacctaaccgcgtttattgcgggttggacgagcgccccacgccgcatttaaaaaagcgtagcacgctcgttcggtctgtgacaggtcacagtgtgtgaccggtcacagaccggtcagatcgcgggttaggtggcaacagacggccttttacacgcctcgccctgtcccgtcggaatgatgagagcctctaggcactcgtccctagccggagccggcgtgctaactcctggagttagcacgtcagtcccggctagattcataccaggcttcatcgcaaccattacaaggaagtcattttatgaagaagggctgacgtgtggcatgctaaactgacgcgtggtagacaagaatgaccggtttgtgactggtctgacgccggtcacgtcatcggcagacagccgtgctcccacgttgcgcctgcttccggcggagtggaggtaggtatggcccatcccatcggagggtcattcgaacagcagccatggcaaatctccgcccattaatgagggagtaacagggagatccccggtgtcaggcgagtgatgacgctgggcctcactcaaagacaagctgtgatttagcttccaggcgaaggcgcaagccagttttttttgggaagatagggtgagtccccacccaaaagaagagtaggtagaagtggtgcgtgtggtatccccttgagatataaaaggaggaccttgcccacttaggagggggacaactcagagaacacctgagctcgtagaggagagaaagaggaagagggtctctagagtttgaactctcttgctctccagctctttgtaactccttcatacacagatccaccagaacacaggagtagggtattacgcttctcagcggcccgaacctgtctacatcgcccgtgtcttgtgcatttgctctctcgcgaaacattccacagatcgagggcttagaacctcacctaacgcccccggccgaaccggcaaagtggggcccgcgcggtctcccgatgaggagccccacgctccgtcatctggcgcgccaggtagggggcgcgtgtgtctttctaagccctcgtcctctttcgtgtgcgccaagctactcccgctcagcccaatggccgaacgggcagtggcgcacaacctctctccgagcgctagcggtgacgatggggagcagaacccgcgctgtcgagctcgtactccaccgtccccctctcgccgaagtcttgggcgggaggaggcgctcgagggggtcgaaaaatccgcgacttcgccgctcgcgggcgatggagaaggacggcgggacggggagcgtcgcctcctcgtctacggcgacggcagcacgccccagggcatgctccaggctgcgggcgcgctcctgcgtcacccgcccgtcgtccccgatccagagactccagcccgacgtcggctggatgacgggccaacttggtcatgacggcgcagcagcacctaggcaccggcag

SEQ ID NO: 2631 - DNA, 9288 bp, Oryza sativa
ggatcccgactcctcctggcgctggaagacccttcaactgagcattctccttcttcaggcgcgcttcctcgtccttcagagcgacgatcctcatgagcttcccatcgttcaaggccttggtcgccttgtgcaggtccgagtgcatcctatccaatcccctcatcacagcacacatgtgaccgaaggtggtgtcgttctcgccagctgtcggacggaaggagctgacgccatcaccatgggctcgacgggggtggtagcggtacgccgtgtcgtggaagatgtagtcgtggcgctcccgtagtctggccatcatcaagtaggctgcctcctgacaggcgtgatctgctgtgcctcctgacgcctccaccgccatgttagcgaggcaagtccccacgtagccatggacctccaagcggacacggtaaggaagctcgccactgagcggtgggatggtcgtgtattccggcgcgtcggggtagcccaccaccagggtcatgcgtgccaactctgccacgaaatcaatcatgccttctccgcggtggttgggtgggtgaccggccatctagagaagacaaaggagtaggatcaatgcatgctcaaatccaaatttaaataaagcaataaagactcaaataaaggaatcaaataagagcaaaattttatgcatagatcattttacatgagcgcgaataaataagacagactcacataacgataaaataatgggaaattagatacataataataataacgaacaaagcataaataccttgcaacccatgataccgagctaggaccgaatgcatttcgcccatcaaaccccaactgactgacgaataaatcccaataattttactaaaaccctaaactgactcgttttgaaaaactcactttaaacgagcgaccaagatttttcccttgaaccacaagaacagatccccattttcccggaacaaaatccaattgcaaagaacatatgcaatgaaaaggattcagagggctcttaggtctttccatttggcttgtcctacggtcaaggtcggctctgataccaacttgtcacgcccagaaatttccgaatagaattccaagcagaatgtgtattaaaacccccgtccaggaccagccggggtacacaaacgacaatgttgacatacagatccacgtcttacaaacatcataaaagtcttacagaaatgcagcggaaaaacaaaagaaactggagctaagccttgacttgaacggcagcgggaacaccactccacaggcatcctcgacggcacggacgaagcctactcctcggagaacccgccatcggacacatactcgagctctgaggttggggggaaaagtagagcaagactgagtactacccactgtactcagcaagtcataccggaatagaggtatgatgcagggatttaacaagggatagctaagcaggttcatttgcataaatgctggcatttataaacaggaatttaatgcgaaaacagttgtaataattaagcagtattaaacatccgctgtccaacgctaacccacgttgcgacaggcccaaccatccacctaaactatccaagttcaacaggttacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcgacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataaattcttccagggcatcccgcgaaccggtccttaactgccatgggtgcgaccagcaaaaccatgcacccacagcccaccatgtggttcattttatttaaccaacaccagagcggtggtattaaaccaacattatcatataaacctatagtctaggttttaaatgagatccccaatgtgtgctagttgaactaagcatggctaagcaattcctagtccaaagtctaatcatgttataacccaagctaacaaaggagcatgatatccaaaagcatggctgtaacaataggtatccatcccatagtgatattataaaacaatgcaatatttgaaagaaaacaatagagcatttgcaaaatgggatcaacatgttcaagtgacaagcatgacttgccttgctctgctgctggaggtacctcggcgactatctcgaagtacaccggagcgtcggagggatcggaatctagcgacatacaaagcaaacattgcaaacaggctataagactactgaaacagagaacaaaaccatttttaatggattctacacatttttcttgatttactgagacttgaatgggattaaacggagctcggatgaattagttatgaattttagaagattcactgtgtttattactataaaagaaatccttaaataatttattgcgcaatattaaccagggctgacgtcagcgaggggcgcggcgccgacaggcgggtcccaccggtcagcgaccgggagagagagaaagggggcggcggctcgcgggcccaccggtcagcgaccgggagagagagaaagggggcggcggctcgcgggcccaccggtcagcgacccggggaaaaggatggggcggcggcgccacgtggcgaccggaccgacggccccgatctacccttgggtagatcggacggcggcgcgggacctcgcggccggggcgcgcgggcgcggcgcgagacggcggcgaccatggcgccggcggcgcggcgctcacacggcggcggcgcacatgcggcagcggcgcaaagcgacgaccggcggcgaccgtccggcggcggagagcggcggctagcggctctagggggagaggaaggggaaaagaagggaggggatgcctcaccgagggtggccggcgcggaggaaggcgatggcggacggcgacggcaagccacgggaggacggcgtcggctagcggacgagcttcggcgtgccctaaggaaggagaagagagggattagagagagagagatggaccatggcgatcgggatccatggccgaaggcggcggtagaggtggcgctcacccgtgcgcgtggagatgagggttccggcgacgaacctcgacggaggaggggtggacgaggtggacctcggccgcgcgaagctaacggcggcgacggcgtgagacggcggcgagcctagcggcggctagcggcggccggagtagcaaaagcggcggcggcgggtggttgcacggcgcggaggcgttggggagctcgggagaggtcggcgcaatggggaaaaagcgagagggggtgccggcgatgcttaaataggggatgggggaaccggacgtggccgggagcggcgggattcgacggccgacgtgggggagtggggaggagagagaggcgggattcggttttcgaatcccggccatctcgggcgcgggcgcgagcgggagagagaggggaacgggcgcggggaatgcggcgcacgcgcgggcgtggtcgacgtggcccggggaaggcggagacgtgggcgcggcgtcggttgcggcggtggcggcgcgagcgggatcggcgggaggagggagacgggtccgacaggtgggccccacctgtcggcgaccccgagaggagggaggcgggcggccggctactgggctgggcctcggcctgcggccggcccagcaaggaggaggggggggaaggaaaagggaaatgggccgacggcccatttcgcaaaaaggaggaaaaagaggggaaaaagaaaaagaaaaagaaaaaggaatttccctggaatttaaaattgcacttgctccattttaattggttaaaattatttctagagctctgaaaattccactaaaaatcctgttagtgaatttcgacatgtagaactcaagaaaaattccacatgtcaaatccgattattatttgcattgttttcttagggttttgtcctgatttcctctgcattttcttagggtcaattataaattacaattttgacttgggaggaaaactccggggtgtgacaaacctaccccccttaaacggaatctcggccccgagattcggaggagctggtgaagaggtgcggatgggcggctttcaactcatcttccctttcccaggttgcttcctcttccgaatgatgactccactgaactcggcaaaacctggtgaccttgtttctggtcctcctttcgctggtatcaagtatgcgaaccggcttctccacataggtcaggtcctcctggatatcgatgtgttccgaatcagcctgttcctcaggtacccttaagcacttctttaattgggatacgtggaacacgtcatggatgccgatcatgttggacggaagttctagctgataggcaacctctccccttcgttccaaaattttgtatggtcccacgaagcgtggtgccaacttgccttttgtctggaaacggtgtactccccggagcggggtgacacgaagatacacgtaatctcctgcctcaaaagtgagctcccttcggcggttatccgcgtagctcttctgtcgagactgagcaatcctcaacctttccctgatgattctgactttctcttctgcttccgctaatacttctgttccgaacagttgacgttcgcctgtctgatcccagaagagaggtgtgcggcacttccggccgtacaaagcttcaaacggtgccatctgtagactggcctggtagctgttgttgtacgagaattccgcatatggtaagcttttgtcccaagctccaccaaaatcaagagcgcaagctatcaacatatcctccaagatttgattgacacgctcggtctgaccatcagtttgcgggtgataggccgtgctgaagtttaaacgggtccccaattcttcctgcagcttctgccagaactttgaggtgaactgactacctcggtcggatactatcttcttgggtaccccatgcaaacacatgatccttgcgaggtacaattctgccaatctctttcccgtataggtggtatgtactggtataaagtgagccaccttggtgagtcggtccacgactacccagattgaatcatgtcccgatgatgtccggggcagtcccgttataaagtccattccaatctcctcccatttccattccgggatttgtagaggttggagtaaacctgcgggtctttggtgctctgctttcactcgctggcaaacatcgcagagtgcgacgaattcagctatttctctcctcatgctgacccaccaaaacttctctttgaggtcttgatacattttagtgctgcctggatgaatggagtactgggtctgatgagcttcggtgagtatcagatccttcaactccttgtcgtcgggtacacacaatctttctcccatccagattgtgccgtgctcatcctcgtggaaatctcgagcttttccaaccctcatgttctttttcagttccgctatttccgggtcatttacttgagctgctctgacttggtccacgagcgtaggccgtgcctccaaagcggctacaaacccgtgttcaacaattcccatgttgagatgttcaaactcatgccgcaattcctcacacatgccctcgatgcatagggcagtgcagtaacttttccggcttaaagcgtctgccaccacattggctttacccgggtggtagtgaatactcatgtcatagtctttgattagctccaaccatcttcgttgtcgaaggtttaggtccggttgggtgaagatgtatttcagacttttatggtccgtatatacttcgcagcggttgccgatcagatagtgcctccagatcttcaaagcatggaccactgctgccaattccaagtcatgagttggataatttccttcgtgtggacgcaactgccgcgaggcatatgcaaccactctgccctcttgcattaggacacatccaagtccgtgacgggatgcatcgcaatagacttggaagtctttcgtctggtcgggcaggatcaaaaccggtgcggatactaatttccttttgagctcctcaaagctcttgtcgcactcagctgtccatttaaacttctcgtctttcttaagcaactgagtcatgggtcgggcgattcttgagaagttttcgatgaaccgacggtaataaccagccagtcctagaaaacttcgaatctgcgacactgtcttcggtggggtccacttggtaactgactccacgttcgatggatcaactgctacaccctgagctgtaatgacatggcccagaaatttgacttccgtcaaccagaagtcacacttgctgaacttggcgtatagctggtgctccttcaacttctcgagtactagacggagatgttgttcatgttcttcctcggactttgaatagataagaatgtcgtcgatgaataccacaacaaacttgtccagaaattccatgaacactttgttcatcagattcatgaagaatgcgggtgcgttagtaagtccgaaggacataaccgtgcactcatatagcccgtaccgagtggtgaaggccgtcttcggaatatcctcttcccggattctcaactggtggtagcctgatcgcaggtctatcttagagaacactttagctcctttcagttgatcaaataaatcgtcgattcgcggcaacggatatttattcttgattgtgacctcgttaagtgcgcgataatcgacgcacatcctctttgtcttatcctttttctccacaaaaatgaccggagcgccccaaggtgaagtgcttggtcgaatgtaccctttctgcagctgctcatcaacttgcttcttgacctctgctaattcgttggccgccattctgtacggtctcttatagattggagcggttcctggtgccaaatcaatccggaattcaatctccctcttgggtggcatggtggtgaggtcttcggggaacacctctggatactcgcagactatgggtatgtcctccaattttctcaagttcttctcttcggcgtccactgggatttccgtctcaatctgattcaacgaggctcctttctttggcgaggctagagatttgtacaccacggtttctcctttctcattggtcagggtgactgtgcgattcgcacaatcgatgactcccttaaacttggtcagccaatccatcccaagaatgacatctaagtctttggattcgagaaggatgaggttggctagaaacggtgacctttgaatttctattgttatagaagggctgaattgaaccgaagtggagctattccctggggtatgaacccgcatcggtgtgctaagttcctctcttactaacccatgcatcccgacaaatttctttgagatgaaagaatgcgttgcaccagaatcaaaaagtactgttgcagggattgagttaacagggaacgtacccagtacgacctctggtgctgcttgtgcctcctccgcagacgcgtggttgacacgagcctggataaaccttggtccggcacgcctgggcttcgggcatttgtcagcgaagtggccaagctcgccacagttgaagcaggaccctggttttgctcccgtctccttcttggcttgcgctggctggcctgactgtgccggtgccattggtgggcgtggagctgcaccgcggttgggctggcctccatggtggttctggctgccactggtgccctgatggaagttgctagggttgaacgggcggtgctggcggacgatcatggtggtaggtccaccctgctgtccgggagtgaagcgcggtcggtgctgactaccttggttggaccggaactgcgccgcctttcttttcctgtccattttgttgcgctgatcctcctgacggattgccttgtcaaccagcctttcaaagtcagcgtagtccccagatatcagttggttggtcagctcgtcatccagacccgccatgaacttctcctgcttctcggcgtcggtgcggacatcctctggtgcatatcgcgcgaggcgattgaactcatgaaggtactctgtcacagtccggttgccctgatggagtgcacgaaattccctcttcttttgtgccacgaccccatctggcacttgtgccttcctgaagctacggcagaactctgcccatgtgacttcagtacccggtgggcgggtggccatgtggttgtcccaccaagctgacgcaggaccctgaagctggtgtgtggcgaaagcaaccttctcctgatcattgcactgcaggagattcagcttcttctctatcgcatggagccagtcatttgcctccatagggttggtggtgctggagaaggtgggtggcctgacacgtagaaactcaggcagcttggactgagggggagggggaccaaactgctcatgctgctgttcggcgtgctgcatcatcctctggtgcatctgctggtgctgctgctgcatctgctgcatcatggcggccatcatctgagtctgatgtgccataacttgggcaagggtcggattctcgggaagtggtggcggaccattgccagaatcaccgttggggtgcacaccatcagcgcgttcttcgccggtgctgccctcgcctgccgtgcggttgccagtcctggtgtagaccatctggagggaagagcggacggggaaaagaagaaaaacagatgctcaagaactaagctttattacaaaggaattaaaactgcaattgttctgatctgaattaaaaacacttaaaagggcaagcaaatatccttattaagacagccatatcataggcacatgacatcgaccgtcgactgaccccaaacaagcaacctaaacacacaaactaacaagcagagactagacaatcgataaactaatgggaaaacgagcctaatgctcggaacggctcctgcggtcggtggagtcgaaagcgtcctcctgctcgtcacctggtccctctgagcgactcctagagtctgacggatcagtctcgccgctgccactgggagtagcagacaaccaacctccggtaccgctggctgaacctctggcggctgatgctggagcgaaggagagagtgaac

SEQ ID NO: 2632 - DNA, 1697 bp, Oryza sativa
tcatatcgacctcccggtcaccttcggtggatccggcaacttccgcacggagcgggtgaacttcgatgtggcgaacctcagtctgccctacaacgcggtcctggggaggcccgcgttggtgaagttcatggcggcggtccactacgcctacctccagatgaagatgccgggccccggtggccccatctctgtccatggcgacctcaaagtcgcgcttgcttgtatggagcagcgcgcggaccacctcgccgcggcgtccaagcccgagggtggcgacgggaggctcagcacctccgtcccggccgccccgaggcagcggatggtcacgtgcgacgaggtcccggtcaaagaggttaccctgggcgacggcccgtccaagaccacacgaatcggtggtcttctggacgacaaataggaagacgcgctcgtctccttcctgcgggcaaacgccgacatcttcgcttggagatcggcggacatgcccggggtccccagggaggtgattgagcaccgtctcgccgtgcggccgggcgcaaggccggtccggcagaaagtgcggcggcaggccccggaacgtcaagccttcatccgcgaggaggtggcgcgacttctggaggtcggattcatccgtgaggtcatccatccggagtggctggcgaacccggtcgtcgttcccaaggcgaacggcaagcttcggatgtgcatcgactacaccgaccttaacaaggcatgtcctaaggacccttaccccctgcctcgcatagatcagattgtcgactccaccgcggggtgcgaccttttgtgttttctagatgcatactctggttatcatcagattcgcatggctagggaggatgaggaaaaaactgcattcataacccccataggaacttattgttatacgacaatgcctttcgggctaaagaatgcaggtcctacttttcaacgtactactcgaatttctttgggtagccaaataggacgtaatgttgaggcctatgttgatgacttggttgtgaagacgcgcaaccaagagaccttactctcggattgtcgcgtcccaaatcgactctaaaatctatcctcaaaattgtgcaaaagaataagtaaaattcaatgtgaaagcctccaacaattaaaatgtgcaaagataaaagtcaaatgaggcttggaggatttttgtatatttcctaaaagcctaaaatacttaaacaaattttagtggaattttcagagcacaaataataatttaaaagaaataaacaaagttaaaaaggttttataaaaagaaaatcctaaaagaagttcttttcctccccccccttccttcttgggccggctcggcccattccctccctctctctctctctttcctcccgcggcccatcggcctccccgcgcgcgcgcgccgctgacaggcgggcccgcccgccactctcgctgacgggtggggcccacctgtcatctccctcctcccgccgcgccgccgcccgcccgtgccctagcgccgccgccgccgcggattccgccgcatcccgtcgtctccgcgcgcattaaagagaggggaatcactccccgcaatcccctctcccgattccccctctttcccctctctccctccctcggattcgctcggaatcaatcccgcaaacctcgccggcgtattcaatggaccccagaactccgcgcccgtttcc

SEQ ID NO: 2633 - DNA, 1480 bp, Oryza sativa
ggaaaaagaaaaagaaaaagaaaaaggaatttccctggaatttaaaattgcacttgctccattttaattggttaaaattatttctagagctctgaaaattccactaaaaatcctgttagtgaatttcgacatgtagaactcaagaaaaattccacatgtcaaatccgattattatttgcattgttttcttagggttttgtcctgatttcctctgcattttcttagggtcaattataaattacaattttgacttgggaggaaaactccggggtgtgacagctgtcgagcctttgtggcgagccttcggaatgtccgttggcccccaaggttccggcccaccatcaccgaaaaatacgacggaagcgtcaaccctgccgagtttctccagatctacacgactgggatcgaggccgccgggggtgacggggttggctaatgaacttgccacctgcgtcggtccactcttgggaggatttgtgccagcagttcactatgaacttccagggcacatatccgcgcccaggtgaagaagcggacttgcatgcggtacagcgaagggacgatgagtctcttcgctcgtacattcagcggttctgtcaagtccgcaacaccataccatgcatccccgcacacgcggtgatctacgcgttcaggggcggcgtgcggcacaaccgcatgctcgagaagatcgcctccaaggagccccagaccaccgcggagctttttcagctcgcggaccgtgtggctcgcaaggaggaggcctggacctggaactcctccggttccggtgtggcagcttcggctgcccccgggtccgccgctcggtcagggcgacgggacaggaggaggaagaagaggtcggcccattctgacgacgagggtcacgtcctcgccgtcgagggtgtttcgcgggccacccgaaaggggaggcctgcgagcgacaaaaagaaggaggccggcgctcccagcagggagcgcccaaccggcaagtggtgttccgtgcacaacacctccctccacgacctcgcggactgccgcgcggttaaaagtttggctgagtggacgaggaagtgggaggaggagaggaggcaggagcgccgtgagggcaaggccccggcggctcccgccggcaaccggcgaagtgaggccaaacagaaggcccccgccgaggacatcgacgatggccacgatggcctgggttccaggagcctgaggtcaccatcgccaccgtcgatgggggagcgtgcgctcacgtttctcgccggagcctcaaggccatgaagcgagagcttttggccgcagcccctacccatgaggcgacgcggcgggcgcggtggtcggaggttgccctcaccttcgaccagaccgatcacccgccgtgcgttgcccagggaggacagatcgcgatggtggtttcccccaccgtttgcaacgtgaagttggggcgtgtcctcatagacgggggtgcagccctcaacat

SEQ ID NO: 2634 - DNA, 9101 bp, Oryza sativa
tctaaaatctatcctcaaaattgtgcaaaagaataagtaaaattcaatgtgaaagccttcaacaattaaaatgtgcaaagataaaagtcaaatgaggcttggaggatttttgtatatttcctaaaagcctaaaatgcttaaataaattttagtggaattttcagagcacaaataataattgaaaagaaataaacaaagttaaaaaggttttataaaaagaaaatcctaaaagaagttctttcccccccccctttttccctcttgggccggctcggcccattccctccctctctctctctctttcctcccgcggcccatcggcctccccgcgcgcgcgcgccgctgacaggcgggtccgcccgccactctcgctgacgggtggggcccacctgtcatctccctcctcccgccgcgccgccgcccgcccgtgccctagcgccgccgccgccgcggattccgccgcatcccgtcgtctccgcgcgcattaaagagaggggaatcactccccgcaatcccctctcccgattccccctctttcccctctctctctccctcggattcgctcggaatcaatcccgcaaacctcgccggcgtattcaatggagccgagatctccgcgcccgtttcctctctctccggccgctctctctccctcccgttgctatataattgctccccgagctccgctcttccgtttccgccgctcgccgctcgctctcgccgtcgaaatcgtgctcgcgccgtgctcctccctctccgccatcgccgccgagctccgttccgccgccgccgccgctccggactttctccttactcggcgacccctccgtccgcttcgccgtgttgccgccgaccccgtccgccgctccgcttcgcccgccgaccgccggagcaccgtcgccctcgtcatcccgagccgcgccgccgtcttcctccgctccgtccgccgtttccgccgccttcgctgtctcggggtgagccgtggaccgtccccttcgtttcccccttccctcctctctctcgggtgccactccgccgcgccgttggtcgccggcggcgaccatcggggcgcgggtgcgcgccgctcccgtcggccgcgccggcgaggccgccctcgggcgcgccctcgcggctgccaagtgggcccggccgtcagccgcccgcgcccgtgggtgcggctgacgcgcgggacccacggcgccgaccgccgccagccgcgtgcgcccggtccaccgtggaccgagcggctgacacgtgggccccacttcccgtggacccggtccgcgcgcccgccccctcggctgacgcaataaataggatttttaattgaaaaataaatgaagaaattcgcaaatatccatttaaagagcataaaaacttcaaatggccatatcttggccatttgaactcggaattggaccgttcaagtctctaatttttccttaagatgtaaagaacccatttttgtgctttgtttctgctgttatgtggagttatttagtgttaaagcctttttcttttccgttggtcgtgtagacgctgcagcttcggaagatccgctcttcgtggaagtcgaagccgtcgattgggaaaacgagcaaggcaagacacatcatcttgatcatattgaatcccattttataaaattatgttgatttaaattattgcattatcgctttatttaaattcccgcgttatcactgttttacttagccatgcctatttacctttgttatgaccatatgattattgtcattgttattattattaccttgttcaccctagatcaaacaaaaccccaactagtggacactctactcatgacaccactagtttaattctaggtagatgcttcgcaatttaattaggtaacattaggaggttttacaactttagactttgggaattctcatatcatttggacactttggaattgttggtttatggtggaattggacacacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctaatgggtaaggcttagtttgtggctcagtctagtcttaaacaaaagtacacggattggagatggatgaagtcgggcgttgatggacattctccagggcaaatgaaggctacacgagctgcggcccggtagtcgagatgtcatacggcggagggttggtgcccaatgctaggggctcagttctgcctgcctgtcccgggtatcccggccgtaggcaggattgggtcggtactcttgtttatggctaggatgggttggaaactatgtcacgtcttccgtctgtataccgtggtggtatgtggcgcgtggtaacacgtgaggaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgattaataatattgtgtagttctaagatcgtgtttacaaaatagccctgagcaactaaatgtcttttaaatgctgtttactgcaaaacttaatccctatattattattcccttgtactcccttgcatttattctgcatttgtgggtgtgtcttgttgagtacggtggttgtactcagtcttgctcaatttttcccaagtccagaagaggagctccttgaagatgaaggctttggtgtctagctcgtgcctgccgtcaagtgcctgtggtcgtcgccctagtcttccgctgtttttcgttgtctttgtgtgctgggccgttgttgcccgtgtaataattatatttacgcttccgcttgttaaactctgaattgtatcaacttttggtgtaccttgcctcctgggacaaggaataatacacgcacgtcaggaacgcctgttgggtgatttccggtcgtgacaagttggtatcagagccacccttgaccctaggacgagccgtagatccccaggccgtagctatattttcaaaaaaataaaaatcctttattatttgtgaaaacccgctattctctcttgtcttgctgcttcatttatcgtcaaaatctggcctttaaaatgttgcttttctttttgtttgtagatggccggcagcgttacccgtcgtggtttgcacatgactggcttcgtcttggagctgcggggcatgtgcgtggtcttggggtatccacatggagtggattaccaggccaggccgctcccggagcaggagggtgaggatgcagagcctcacgctggttgggaggtcactgcagtgattctctccggctctcccgagcggacttcgctggcagtcaccgcgggtggggattccttccccgccgcttgccagaacgccgctctcctcgccatcggcacccttcaccagcgctacccggacgagttgcagcactcgccctaccgctaccaccctcgtcgcggaggagcccgcgactacgccaccttccgagacgccagctcggaggatgacgctaccgtcgtgcatctggcacgcatggtggaggcgtacgacgcggctcgtatcgacttccatcagatggtgcgccgtggcatggtggagaacaacatgaagatcctggagctgcgccaagagaatctgcagctcaagaaggacctcgacgcgttggaggcgcagctgcatcagctcaagatcgcccagggagaggacagccgtcccaagcgtcgccgcgtctgccgcagccagaagatcaccgcccgcaagagcacctccaggcctgagcttgtccgtcagtccctggcgtggacctgcttcgtcgagacccctcgtgccgagcctgcgcccgtggttccccaggagggggaagcctccggcgttggtagctcggagggtgcgctgttgctcaccttccgctctggcccgtcgcagcggtagacgagcagttagtaggcttgcgcgtgtgtttttcctcgtttgtctttttgagttgtgtggggcatggttatgccggtgtgtggcataactatgtcggagcctgtcttattttgtttgcctaagcaacttgaacattaatgaaccaatttaatatcagtaataaatttaagaataatagtagtcgtgggtggttagttttatttgttagctccttctctgtttgctggttctgggtggggttttcagatggtgacgaccaggagaaatgttaacaccggtgaaggcaaccaacccgaaggcagcaaccccaaccaccaaggcaatccacctccgccaccaccaccagacaccaacgccattctcacccaaatcctcgcccagcaagctaacctgatgaatgctttcctccaccaccttcaaaacccgccacaacagaatgctcccccaccacctccccaacactctaaactcgccgagttcctccgcatccgcccacctaccttctctagctccaacaaccccgtggatgctttggattggttgcatgccgtggggaagaagctagacacggtgcagtgcagtgatgaggagaaagtcaccttcgccgcccatcagctgcaggggcccgcatctctatggtgggaccatttccaggccacgcagccagaagggcaacctattacttggactcgcttcaccgccgctttccggagaacccatgtgcccgctggagtcgtggctcttaagaaaagggaatttcgggagttgaagcaaggcaaccgctccgtgatggagtatttgcatgagttcaacaatctagcccgttatgccccggaggatgtgcgggaagatgaggagaagcaagagaagttcttggcaggaatggaccccgagctgtctgttcgtctagtctctggggactatcctgattttcaacgactggtggacaagagcatccgcttggaagccaagcacaaggagctggaatcgcacaagcgccgcttggcgaatttccgcaatcaacagggtgctaaccagagggtccgctacaccaatccctacccagggggatcctcctcgcagcagcagcagcagcagcaacctcgcccagcgccccgacctcaattcgtggtgcgcgtcccacagcagcaacagcagcagaatcagcaggggactcgtgcgccccgtcctcctacgccaactgtgcagcctgttcaaggtcgcagggacgcttcaggtccgcagcgtctgtgcttcaactgcttcgagcccgggcactttgcggataaatgcccagagccaaggcgtcagcaaggccaagcgcctccccgctccaacaacggcgggaaggatgtcattcggggtcgtgtgaatcacgtgacggccgaggacgtgctgacaactccagacgtcatcgttggtacgttcctcgttcattccatccctgctacaattttgttcgactctggagcttcccactcgtttatatctgtgccattcgtggggagaaatcagttgggggtagaaaggcttagaaaccctctgctcatcaccacccctggaggggttatgacagcaaagtactatagccctgccgtccctatagaaattcaggggattccttttccctcggatctgattctgctagacaccaagaatttggatgtgattcttgggatgaattggttggcccaattccaaggggtagtggattgcgcgagacgcactgtcactctgtaccgaggaccagagcaaccggttgttttctttgcacctccaacctctgtcagaagttcagaactgcatcagataggtctgtcagaaatccccatagtcagagagttcggagacgtgtttccggaagaactacctggtatgccgcccaagcgagagattgagttccggatagatcttgctccaggaaccactcctctgcacaagcgaccctaccgtatggcagcaaatgaactagccgaagtaaagacacagttggaagaattgaaagaagaggggtacatacgtccgagtacttccccatggggtgctcctgtgatctttgtagagaagaaagacaagacgaagaggatgtgcgttgactacagagctctcaatgaagtcaccatcaaaaacaagtaccctcttccccggatcgatgatctgttcgaccaactcaaaggtgccactgtattctccaagattgatcttcgttccggatatcaccaattacgtattcgtgaagaagatattccgaagaccgcattcactacgcgatatggactgtatgaattcacggtgatgtcgttcggcttaaccaatgctcctgccttcttcatgaacttgatgaacaaagtgttcatggaatacttggataagttcgttgtggttttcatcgatgacattctgatatactcacaatcagaggaagaccatcagcaccatctccgtctggtattgggaaagctgcgggaacatcaattgtatgccaagctcagcaagtgtgagttctggttgtccgaagtcaaatttttggggcacgtgatatctgctaaaggagttgctgtggatcccgaaacagtgaccgccgtcaccgattggaagcaacccaagacagtcactcagattcgcagtttcttgggtttggcaggatactaccggaggttcatcgagaacttctccaaaatcgctcgacccatgacacagttgttgaagaaagaagagaagtttgtgtggagcccgcaatgcgagaaggcgttccaaactctcaaagaaaagctggtttcctcgccagtgttaatcttgccggatactcgcaaggatttcatggtgtactgtgatgcttcgcgccaaggattggggtgcgtgctcatgcaggacggtcatgtggtagcctatgcctcacgccagctacgacctcatgaaggcaactaccctacacatgacttggagttagcagcggtggttcatgctttaaaaatctggcggcactatctcattgggaaccgatgtgaaatatatactgatcataagagtttgaaatacatcttcacccagtcggatctgaatcttcggcaaaggagatggttagaactcatcaaggattatgatgtgggaattcactatcaccctggtaaggctaacgtggttgccgacgctctaagtcggaagagccattgcaatactctcaacgtccgaggcattccacccgagcttaatcaacagatggaagccctgaacctaaacatagttggtcgtggatttttggccgcgctagaagcccagcccaccttgctcgatcaaatccgcgaggctcagaagaatgatccggacatgcatggactcctcaagaatatgaaacagggtaaagccgctggtttcacagaggatgaacacggaaccttatggaacggaaagcgggtatgcgttccggatagcagagaacttaaacagctgatacttcaggaagctcacgaaagtccttattccattcacccgggcagtaccaagatgtacttagacttgaaggagaaatactggtgggttagcatgaagcgggaaattgcagagtttgtggctctatgtgatgtgtgccagcgtgtcaaggcagaacaccaacgaccggccggacttctccaacctctccaagtgccggaatggaaatgggatgaaattgggatggatttcatcaccggccttccaaaaacccaaggtgggtatgattctatatgggtaatagtggatcgattaaccaaggtagctcgattcattcctgtgaagaccacctatggagggaataaactagcggagctctacttcgctaggatcgtgagtctccatggcgttcccaagaaaatcgtatctgataggggaagccaattcacctctcacttttggaagaagctccaagaagagcttggtacccgactaaatttcagcaccgcatatcacccgcagacagatggacagaccgagcgtctaaatcagatcctagaagatatgctccgcgcatgtgtcctagatttcgggaagacttgggataagagtctcccctatgccgagttctcctacaataacagctaccaagccagcatacaaatggcaccatatgaagcgttgtacgggcgcaaatgccggacaccgctcctgtgggaccaagttggggaaagccaagtgttcgggactgatatcctgagagaagctgaagctaaagtcagaatcattcgggataatctaaaggtggcacagtctcggcagaaaagttatgcagataaccgtcgccgtgatctggaattcgcagtggatgactttgtgtatcttcgggtcacgccattgcgaggtgtgcacaggtttcagacaaaagggaagctcgcacctcggtatgtgggtcccttccgtatcatcgctcgacgcggagaagtcgcttaccagttggagctgcccgcctccttgggcaacgtgcatgatgtgttccatgtgtcgcaactcaagaaatgtcttcgagtgccatccgagcaggccgactcagagcaaattgaagttcgcgaagacttgacttatgtggagaagccagtgaaaatcctggacaccatggagcgcaggaccaggaaccgagtcatccgtttttgcaaggtccagtggagcaaccacgccgaagaagaagctacttgggagcgtgaagacgagctgaaggcagcccatcccgatctcttcgccagttcttccgaatctcggggtcgagattccgtttaaggggggtaggtttgtcgcgtcccaaatcgactctaaaatctatcctcaaaattgtgcaaaagaataagtaaaattcaatgtgaaagccttcaacaattaaaatgtgcaaagataaaagtcaaatgaggcttggaggatttttgtatatttcctaaaagcctaaaatgcttaaataaattttagtggaattttcagagcacaaataataattgaaaagaaataa

SEQ ID NO: 2635 - DNA, 7972 bp, Oryza sativa
gacaatttggaattgttggtttatggtggaattggacacacacttttcttcctctttcaaaacccttaaaacctgttttcggtggggtttgggtgcatgccagttgtggcaagtagcaccccgggcactataaggattaagctcgggcctctgttgcaaagcactacagtacttccacatgtctaatgggtaaggcttagtttgtggctcagtctagtcttaaacaaaagtacacggattggagatggatgaagtcgggcgtcgatggacattctccagggcaaatgaaggctacacgagctgcggcccggtagtcgagatgtcatacggcggagggttggtgcccaatgctaggggctcagttctgcctgcctgtcccgggtatcccggccgtaggcaggattgggtcggtgtcgcgaccgggaaaattgccttttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacctctcctccaaagcttctcttactgaagggggaaaagattgagcaagaatgagtacaaccacagtactcagcaagccacaccggagaatgcatgattaatgcaagggagtacaaggagataataatataggggttcagttttgcagtaaacagcatttaaaagtcacttagttgcccaaagctattttataaagacgatcctagagctacacagtgttattaaacaaggccgtgaaccctcacgaacctgccttaacccaaggcctacgatgaattggaccgaactggcaacccgaccctgggtcccagctcgtcccaagccaacccaggccaaccattccatattttagttgttgagcaaattttaagaattgaaacactgacctgggtacattgctaggcttgcccatatccgagggctcggctattcgaatagatttactctgatcagaggtgtacatctttacccacaagacacctctccctcacgtgttgccacgtgccacataccaccacggtatacggacggaagacgtgacatagtttccaacccatcctagccttagacaagagtaccgacccaatcctacctacggccgggatacccgggacaggcaggtagaactgagcccctagcattgggcaccaaccctccgccgtatgacatctcgactaccgggccgcagctcgtgtagccttcatttgccctggagaatgtccatcgaagcccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccataactggcatgcacccaaaccccaccgaaaacaggttttaggggttttgaaagaggaagagaggtgtatgtccaattccatcataatccaacaattccacagtatccaaatgatatgagaatttcccaagtctaaagttgtaaaaaccacctaatgttgcctaattaaccagcgaagcatctacctaagttcatactagtggaaccatgagtagagtgtccactagttgaggttttgtttaatctagggtgaacaaggtaataacaataacaataacaataataatatggtcgtaacaaagataaataggcatggctaaataaaacagtgacaacgcgggaatttaaataaagcgataatgcaataatttaaatcaacataattttataaaatgggattcaatatgatcaagatgatgtgtcttgccttgctcgctttcccaaacgacggcttcaacttccacgaagagcggatcttccgaagctgcggcgtctacacgaccaacggaaaaagaaaaagacttttactctaataaactccaaacaacaagcaggaacaaagcacaaaaatgggttctttacttcttaaggaaaaattagagacttgaacggtccaattccgagttcaaatggccaagatatggccatttgaagtttatatgctctttaaatggatatttgcgaatttcttcatttaaattttaattaaaaaaaacggattattgcgtcagccgagggaggggacgcgcggaccgggtccacggggagtggggcccacgcgtcagccccacggtccacggtggaccgggcgcacgcggctggcggcggtcggcgccgtgggtcccgcgcgtcagccgcacccgcgggcgcgggcggctgacggccgggcccacttggcagccgcgagggcgcgcccgagggcggcctcgccggcgcggccgacgggagcgacgcgcccgcgccccgatggtcaccgccggcgaccatcggcgcggcggagcggcgcccgagagagaggagggaagggggaaggcgaacggcggtcctcggctcaccccgggacaacgacgacgacgagaacggcggccggagcggagggagacggcggcgcggctcgggatgacgatgacgacggtgctccgacggtcggcgagcgaaacggaggcgcggacgaggtcgacggcgatgcggcgatgccgagggaggtgtcgccgagtcgggaggaggagcggagcggcggcggcggctaaccgaagcacggcggcgacggcggagagaaggtgctacggcgcgagcacgattccgacggcgagagtgagcggcgagcggcggaaacgaaagagcggagctcggggagggtttaaatagcgccgggggaaggaaagagcggccggagagggagcaatcgcgcgcggaagattcggctccattgattgcgccggcgacgattacgggtttgattcgaacgaatccgagggagagagagaggggaaagagggggaaacgggggaggggaacgcggggattaattcccccctcttgattgcacgcggggcggacgggagcggcgggattcgcggcggcggcggcgctagggcacgggcgctggcggcgggcgcggcgagaggagggagatgacaggtgggtcccacctgtcagcgagagtggcgggcgggcccgcctgtcagcggcgcgcgcgcgcgcggggagccgatgggccgcggaggagaggagagagagggagggagagttgggccgagccggcccaagagaggaagggggggaaagaagacttcttttagggtttttctttttataaaccttttcgactttgtttatttcttttcaattattatttgtgctctgaaaattccactaaaatttgagggctccttttagaccaaggagaatttaacaaaaattctccgggtcacatttgaatttttcttgtacgtattttaaggtttgccaatttcttttcgaattttaattaattctattattccttttagaagatgatttttattttgggatgaatttatcaggacgtgacaaatccaccccccttacaagaatctcgtccccgagattcgaggaggctagcaagaagataggttgggcggtcttctcttcttgtctgacttcttccgttgcgtcttgacgaacttccagcaaaactttaccactcggaactgcttggcttgacctcctgttgcggatggaatcttctcttcacctgacttggaccaggatgcaccttttggctgactcagactaggttgcggtagtccagtgatgcttccgttccagaacttctcatgattcatatcttcggagtcaacctcagacaagttaccacttcacgtcatgcgtcaacactagcttgtcattactaggatactatgtttgtcatcataagaatatcatgcttgtcattcacttctaacttgccatcaactgtctcatattagctttcctggtctccggtgctaggtacttctgctatgcgatgcgagggtcaaccactctaactataagttatgcttcccaagagaaccaatttatcccacttgacatactttgacgtctccccaaatagtcttactgctggacttcttattgtctgatcgtgatcctgccagatctgaagcttcgttgttagaggtgatcttaatctgacctctgtagactatcttcgaacatatcacttggttcataactgggaatagctcccacaaacaagcaactcagattcactttctttatgttcagtttactttccgctattctcttcatgttgtcatcagttagcactcaacgtattcctttacacctttaaccttgatgagttctttcccgttggatcatctcccaggacgtggcgttgcctggtaaccggtgcttgcatttttcactccgtgtagcatctgataccgagtggaagatttcactctttgccttcatagaaacacttttacctaggtcatcttgcttacttaatgacaaggtgactgttgcggggcaattacaatcaggggtcttccgtgagcgatgcagagcatgcttctgtttatcaatcacctttcggcctacttctttcatgctagagagcatctttgccaatcccttttatcaatcttctttcggcttatctctaacaggtggtattctttaatgtggattgcggacgcttctggggacgatgaggtcctttggcttgctgcctttcggtgaaaccttgatgtggttcgtcaaaaagctgcactgactaccttcagggaaatacattgcctgctatctgtatctataccactagggtttaattgccgatggtcatctttagtgcttcctcgagatggggagcatccaaattgttcttctgccacatcacctttgaccttgttctgataccaggtaaactaattaccaaccatcgactattatgttctcaaatattgatgtctcctggatctccttatctgttggcaggtatatccgatcttatcaacgtagaggcatgacgagtacccttcggggtttcctccaacaatccttatcttgatctgtaaaaggcgtatccgaactcctatcctcaactactgtctcgttggctttttaacccaacacagtttaattggttttcttttccatcaacaggttggttattaactcgaggttggaacacagttcctctgaaatgagaccctaggtctcctatgtcagtaaacaattatacacatgatcacatatccgcatctttcaaacgaatcctcatggaacttgtctgtattacacatttctccctcattacatgaatacgaggcactgccttaaacgaaaagggacggtgcttaacatcggtacattgtatcctcaacatgaatcatctctaaacatagcaagctcactgtttacagacatgattatatttatgaatttcatgattgctgcaaactttcgattacaccatgataagtagcggactgaaaaccacaaacatggctgctcattttgattctggagagatatagctggcattgttctagtgactgcatccttgattggttctgtgatgatgtgataggactgcataatgctatcattcacaggagaagcttccttctgattgttggttgcagcggatgacggtcttctgcttggtatcgccctccggaggttgattgcccttggctcggcctggagtaggtcggggagagacacaactccttccatctacgacaattctttgctgaggctgtcgttgcagagaatggttgctaagatttattgccgagtcaggtgcagcaggtggagcattggtgcattgtttctgctatgggttctgattaacacgaggccttacgggtacggcgtttgctccagtgaccacaatacgattggaatgtctgcttcgtgtaaattggcgaaaatgtggaggtcggggacagtttttggagtaatgcccttctccactgcagttgtgacaaacaataactttcttacactcgggttcttcatcttgtacttgatttctcagctgctgtattggagcttctaaaggtacaacgcagatactggcatctgtcttgtcagctggtggctggggctgaaattgagcattgacaccttgtggtagtgcactcattggaattggagctgttgcaacgcgggctataggactgcttcgggatgcatggatgaccattcgttgaggagcaagcttctgattgcagggagttgcgtggactgacgtgccggcagctatgtttctcggttttgggcacttgtcggcgaaatgacccattccttgacaattgaagcaacagatatcttcccggactcggcattttcttttctcattttgattcctctgtcctggcactggagttaggctgaaactgtaatcttggcgaggattggtgttgccttgatgcttctctccgttgaaaccggcgggttggttagccatcttcttcgtcagcagaaaactgaattgacaatcttttggtacatgatcagttccttcacaaaagaaacaagtgatcctgctcgttggacacctgtcgggtggatggtcttcctcacaatgaacgcatgtagaggcacacgagctggcaacatgtccgatttctccacaacgagagcatgccttacgttccattttatcctggttgaaaccttggggagatttctcatcttcatcttctgaggagacttgatctgaatcttcactatcagacactctacctccattagctaaaagatgctctgtcaactgtggtgcacctcggaaggtgtttcttctctgacgtcttgtcattcctggtggaggccattctgtgctggtaatgatcatcttacgaacttcaccttcggttcgcattggtgcttttcttttctgctgaggacagttccttgcgtagtgcccttgctcatcacacataaaacagatgatacttgcttcttttgggtcaacatgtggcatggcatgaggggccttctgggatgttggcggtgcgctgacttgtggtgtgagtgcttggactgcctccaactgcacctgaggttgcatctgactcgggttcaaaattggcatccgatgctgctgtagtatctctataagcaatttgttctggttaatcaggtgttggaccactgccgcacaactggtgtcttgtgcttcattcactcgggagcttgaggtaccaatgtcctgactcctgaccttattgcctttctcattgtcagccatctgttgcaaaggtttggagagggagagaaggaaaacgaaggggagagacagattagaaactaaggataggaccttaacagatctaagtctttggctgttatgatgtatgttaggcttattctgcaagttgattaagcaaacaacctagcatggttacatcaccacccaccgatgcaaaccacgcgctacacacacaagcaaggaaacacacgacaaacgaaacactagagggtggcttaggttctgcgacgggttctccaagatcttcactcctgcttcacagccggcttcactgcttcttccacttcactcgcagatcctgcagtcttctggaacttcggcaaacaactgacgatgtcctcttcttcactgacctgaccatctagtactagttgaaaatccgaagaaggaagaacggagtaaaccttttgcaaaaagcattgggggaaggagaaaagaggaactttcgcaaataatttttatttataaaatatgtccttaggttttatccacttggcttttcctacagtcgagaggtctgataccagcttgtcgcgaccgggaaaaattgcctttttcccgaacgctaagtgtattaatccccgtcccaggaaaagccggggtacaccatacaaacatgatataaaagacacatctttattatatcgataatatttacattat

SEQ ID NO: 2636 - DNA, 4421 bp, Oryza sativa
gttagggcacgggcgctgctggcgggctcggcgaaaagaaggaaaataacaggtgggtcccccctgtcagcgagagtggcgggcgggcccgcctgtaaccggcgcgcgcgcgcgcgggaacccgatgggccccggaggagaggagagagagggagggagagttggccgagccggcccaagagaggaagggggggaaagaagacttcttttagggtttttctttttataaaccttttcgactttgtttatttcttttcaattattatttgtgctctgaaaattccactaaaatttgagggctccttttagaccaaggagaatttaacaaaaattctccgggtcacatttgaatttttcttgtacgtattttaaggtttgccaatttcttttcgaattttaattaattctattattccttttaaaagatgatttttattttgggatgaatttatcaggacgtgacagtcggtactcttgtttatggctaggatgggttggaaactatgtcacgtcttccgtctgtataccgtggtggtatgtggcgcgtggtaacacgtgaggaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgattaataatattgtgtagttctaagatcgtgtttacaaaatagccctgagcaactaaatgtcttttaaatgctgtttactgcaaaacttaatccctatattattattcccttgtactcccttgcatttattctgcatttgtgggtgtgtcttgttgagtacggtggttgtactcagtcttgctcaatttttcccaagtccagaagaggagctccttgaagatgaaggctttggtgtctagctcgtgcctgccgtcaagtgcctgtggtcgtcgccctagtattccgctgtttttcgttgtctttgtgtgctgggccgttgttgcccgtgtaataattatatttacgcttccgcttgttaaactctgaattgtatcaacttttggtgtaccttgcctcctgggacaaggaataatacacgcacgtcaggaacgcctgttgggtgatttccggtcgtgacagggctcagttctgcctgcctgtcccgggtatcccggccgtaggcaggagtgggtcggtactcttgtttatggctaggatgggttggaaactatgtcacgtcttccgtctgtataccgtggtggtatgtggcgcgtggtaacacgtgaggaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgattaataatattgtgtagttctaagatcgtgtttacaaaatagccctgagcaactaaatgtcttttaaatgctgtttactgcaaaacttaatccctatattattattcccttgtactcccttgcatttattctgcatttgtgggtgtgtcttgttgagtacggtggttgtactcagtcttgctcaatttttcccaagtcaagaagaggagcttcttgaagatgaaggctttggtgtctagctcgtgcctgccgtcaagtgcctgtggtcgtcgccctagtcttccgctgtttttcgttgtctttgtgtgctgggccgttgttgcccgtgtaataattatatttacgcttccgcttgttaaactctgaattgtatcaacttttggtgtaccttgcctcctgggacaaggaataatacacgcacgtcaggaacgcctgttgggtgatttccggtcgtgacacggatctagcggaaactttcgaaagtctccgctccgcccgcataaaactgaaccccgacaagtgcgtgttcggtgtgcctgcgggaagcttctcgggttcttggtctctgcccgaggcatcgaggccaaccccgagaagatacgagctatagagcggatgcgccccccagcaagcttagagatgtgcaatgcgtcaccggctgcatggccgccctaagccggttcatatcgaggctgtgagagaaggcactacccctatttaagctcctcaaacgctccgggccgtttacctggacggaggaagctgagcgggccctcactcagttgaaggcatacctcagttctcccccagtcatggtcgccccggagccagatgagccgttgctactctacctggcggcaacgccgcaggtggtcagcgcggcgttggtcgtggagcgcgacgaggacaaccctcactccgcgcatccccaccctgtgtcgactcgacccgggagagagcagggaggagaggcccccgagtcgaacggtggcccaaggcccccgacggccggagctggccctctgcccgcttgtccgacggtgccaggcacccccgacccccaggatggccccggggccactgcgggaaggccgcgcctgtcgccctctaaccccgaggtcgtcggcacagaagccgagtgcgccccacgcggcctcttggacgaagagcgccttggagatgcggcccctagcgaagaggatcggccccgccgaaaggtgcagcggcccgtctacttcgttagcgaggccctccgggacgccaagacccgataccctcaggcccagaagatgctttacgccattctgatggcctcgaggaaattgcgccattatttccaggcgcatcgggtcacggtggttacgtcttaccccctcggccaaatcttgcataaccgagagggtactggacgggtggtgaaatgggcaatcgaactctctgaattcgatttgcactttgaaccatgccacgcgatcaagagccaggccctcgccgactttgtggcagaatggacaccagctcctgagcccgtctccgaccccgaggccagttcgggcccctcgcagttgccttacaccgcctactgggtgatgcagttcgacggctccctgtctcttcagggcgccggtgcgggggtcacgttgacctcgccgagcggagacgtcctcagatacctggttcgcctcgactttcgggcgaccaataatatggcggagtacgagggactccttgcgggacttagggtggcagctggactagggatccgccgcctcctggtgttaggcgactcccagctggtcgttaaccaggtctgtaaggagtaccggtgctctgacccgcagatggacgcttacgtgcgccaagtgcggcgtatggagcgccattttgacgggatagagcttcggcacgtgcccagacgggataacgcggtcgccgacgaactctcgaggctcgcttcctcgcgagcccagaccccaccgggcgcctttgaagaaaggcttgcccagccgtcggcgcgccccgaccccctaggggagacggacgcgcctgaacggcccccgaggcccgtcggagtccaggcctcgggacccaaggggagcgctcccagctcccttagattgattgcttggatcgctgagatccaggcatacctcacagataagactctacccgaggaccacgaagggagtgaacgcgtgtcacgcccagaaatttagcccaaatttccagactattttgtgtattaaatccctgtccaggaccagccagggtacacaaaacgacaagtaataaacagttccaaacgtaaataaagcgtaaaaatacttacagaagaggcacttagtcctcacaccgaaacaaaagcagcagcagcggaaaaaaaaaacgatcctagcggggcttcagctccactccacaggcaaaactcaactggggtctgagccttggtcttccaactccatcttcagctcagaagcactacacttctgaaaagggggaataatagcaagactgagtacaaccaccgtactcagcaagccacaccaacgatgcggacgtgcaaaggaacacaaggacggtttgtggctatttgcataaaggcggttgtaaaacattttattgagcaaaacagtaaaacagttgagtaattaaagtaacattaaatctccactgatcaacgctacaccacgttgaacaggcccaaccaacccacctggactacagtgtattgggtc

SEQ ID NO: 2637 - DNA, 5642 bp, Oryza sativa
ggggggaaacggcgcggacgtgggcggcgaggtcccacggacaagcgcgcgcgcgcggggtggaggaggtgggcggaaacggcggcgacgttggacggctcgggcggccatggtggttgctggcccgggctggaggttgggggtgaccccgacaggtggggcccacctgtcggcggctcggggagaggagggaggatgagggaggcgaagcggacttgcgcgaaggagggggcaagccgggccgacggcccaaagagaagggaggaggggaaaaggagggcggccgggcccgagaggatggagagggagaagatcttgggccgaaagcggcccaaagacaaagaggggaaattttattttttttctttttattttaattgatgcaatgatctttgtgctattaaaattatttctcgagctccgaaaattcgcgggaaatttcagagagtattttagggcacaaagaatattacaaaatattctcagccaatgatttttaaaggaaatttttaattccctcaataattcacttgattaagttgatttaacttttatttaatttctagaaaatgcattatttaatgatttttaatcccgaacgaaaatcggggcgttacaaatctaccccccttacaggaatctcgtcccgagattctgggatggctagaaagaaaactggggctggcgggcggtctgactgatttgcacactgcactgttcctttctgattcaactgagcgattcctcaatggtccaaacctgctcgactgaactgaccggcattgaccattctgttctttcgctccaaacaactgaactgactggcctcattggattcgaccttggaggtctggcgccccacaggactgaactctgtacgagtgatctggctggattcgacctttctgttcctttgctttgccaaaactggaccgactggttctgcttgaactgacccagactaggactgcggatgctcctgaaacttacttatcttggactgaactgttgaggttggcaattttggtaacctgagaattcaccacgctggctataagagggtgaaaatggaatctggcatttgtaaatcatttaccctatgtccgcttcgactggtcccaattcaaatgacaagtaattccaggaaaacctgcttgacctgtctttcgtctgtactacaactgtcctcgctgttgcttctctaagctgaactgttgacatgcttcacaggtgtaccttagaattgaacctgtcgacctgagattggggtgactctgctaatggttcgcaactgactcctttaattactaaccaatttgctgcactgggttgaacctacaactgaaacggcaacgaggttagccaaatctcatctctgagacctaccccccttacagtgggtagtcatactttcgcctaactggaaacacttgaactgctatcattgaaaaacaaccattacttctcggatttacaaaagaccctgactttggaaactgacacttcatcgatcaatcaaaatggagcaatgacgatgcactttcatccaggtcaagacttggaacttaacccttagttgttgataggaaactcctcataaagaaattctcatttagctcctgatcttactaactcttgactacttccccatcagttctattgctggcatatctagcatgcttcaggcccgacttcggtgtcgagttgcatagttgattcctcaaaactgaactgaccgactctgctttggaactgacacaacttgaggagttgaggtgtcgctaacaaagctcttgatgtgatgacactgatgccttactgtggaacaaccctctgagaggtgccctgtcgtacatcttccatggatggttggacactttgcaaaaactgctcttgaaaaccataaccactgtaggtagcattgttactcctgggattggtggtgggttagctgtgctgatatgctgaggacttggtggcgtactatctgaggttgcgggtgcttccttctttgaaaacaaactggctttggctctgatcctgattccagcttgcatctaggcttgtacatgttgttggagacactgttgctgcatctgttgcatcggactttgcatctcccgcatcattacatccatcatctaatcttggacaccaaatgttgatcacgagcagggttcttctggcactgggataccttgtagctttcaactgaaccattgattggtgactttaatacaccgtcgttgctcttctctctaacactgactatcttctgccagggcggaagagaggaggaagagaggggttgctaaagataaggtactaagccacttgcctactgatctgttgtgagtagatttttatttttcaagttgtttaagcaagcaacctagtatggtcgcatccccaccagtgatgcaaaccatacccctacacacaagcaaacaacacacgatctagaagctaacgaaactactcttctgggacagattgggtttaggtcatctccgggaaaactccacttgatcttcgcggaacgacgactctgggctgaacttcttgctcctgctgcacgaagcttgaggcttgaattgacttccgaacagacatgaagctgacggctggtcctctaggtatgtcaactaaaagaattggagagactgggaggagaattttgaaaaaccgtttgacaaagaaatgccgaagggcgagaggagacaatttgcaaatagggtttttagaaaacttgtccttagggtttgaccatttggctcaacctacagtcgagttggctctgataccactttgtcacgcccagaaatttagcccaaatttccagactattttgtgtattaaatccctgtccaggaccagccagggtacacaaaacgacaagtaataaacagttccaaacgtaaataaagcgtaaaaatacttacagaagaggcacttagtcctcacaccgaaacaaaagcagcagcagcggaaaaaaaaaacgatcctagcggggcttcagctccactccacaggcaaaactcaactggggtctgagccttggtcttccaactccatcttcagctcagaagcactacacttctgaaaagggggaataatagcaagactgagtacaaccaccgtactcagcaagccacaccaacgatgcggacgtgcaaagggatacaaggacggtttgtggctatttgcataaaggcagttgtaaaacattttatttagcaaacagtaaaactgttgagtaattaaagtaacattaaatctccactgatcaacgctacaccacgttgaacaggcccaaccaacccacctggactacagtgcattgggtcgatttattaggtgtgagactaatcacggtgaatctggtcgatcgcccataaccgcgggcacggctattcgaatagttttactctggccagaggtgcacagctgtacccacaagacacaacccaccgacatgtcaccgcgtcatcatgtgctcatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccctggccgacccaactccatcacgcccaccctcgccaccggtgcctaggaaagggtcgagctatacttcagatcaagcagttacccactcccgcttgtggtaagcactgtaagtcttccagggtttcccgtgaaccggtccttaattgccatgggtgcgactcgcaaaaccatgcacccacagcccaccattcagtcgcattttagttggataattacgaccataaaacatggccagatgtctcgagcacgcggctcaacaagatactagtatgtctaatactgcaattatcccatcgactgagctagtggtaattcagcatggctaagcatatagttctagctaggtcacataagtaacacgagctagtcaatttatcacccaaggttgacaaaggatagatatcaagtaaacatggcacaagcgagcagataggtaaaccctgaccccgtgtaattagcaaaacatgcatatttatttgcaaacagtaaaacatttgtaaattaggatcaacatgctcaaggggaatgtgtgacttgccttgcttcttcactttgatcttccgaactcttttccttgcgaccgcggacttccgaaacgacggattctacacgctggcacgcaaaacgaggaaaaaccctaataaaaaccaagaaaacagtacataaaaactaaacaaacatgtagagctcaattttagatgaattttgcaagttgaacggctcaattcggagttcgaatgaattagatatgaattttagaaggttttgagccattttaatggatttctagaattattaccgatttattgcgcaatttaaatcaattatgacgtcatccgacgggggagaggtagcgccggcaagcgggccccacctgtcggtgactcacgggtggcgggcgcaccgtggaccgagtccacgcacgcgctggtccgcgggcgcaccacgtggcagacacgtggcggccacgacggacggctagcggaggtggcgccgacgtggcgccacagaggcaccgacccgggcggcacgggaaggccacgtggacggcccagatcgccccgaagggggatcgggcggccacgggcgagcgggagccggctcaccggtcggccggccgggagcgacggcgcacggcccgatggtcgccggcgacgaccaccggcgcgacggcacgcgcgggaggcggcgcaaagagggaaaaggagaggagatggagggggtcctcaccgaggggcgccggcgacgggacaaccatggggaggcgaccggcggcggaaaggatggcggcggccggcacgggaggcgacgggaacggcgttccgacgacgcccgaccctggcggagccgcggccgagggccggcaagacctggggaaattattggagcggttagggagggaaataggcgaccggagcggcgagaatacacgccggagaggaatggtggggctcaccggcgaccgagagatacccgtccggtgggtttccggcgatgaacaacggtgaccgaggtgctgcccggcgctgcgaggcgagaggttaagacggagcgacacggcggcggctaaggcgacggtggcccccggctggagccggcgtatggtggaggtggctcgggatgcacggtggaagggtggttgcggtggtggaatggggaaacggagcggaggccggggtagagcttggcacggcgttgccggcggcgcaagcggcgaggtgcggcgacgactagcgcggcggcagcggccggctgaaggcggtgtgtggcggtagtggctcggcctcgcgatgggaaggtggttccggcggtggaggagggagatggagtggatgccggggtgcggtggggtggtgtgatgctataggtggtggcggcgcagcgcggcagcgacgggagcggcggtggcgggcggctggagatcgccggcgagcggcggcgatggggatcggcgtggagagctcggtagagggcgtggga

SEQ ID NO: 2638 - DNA, 1441 bp, Oryza sativa
attcgcgggaaatttcagagagtattttagggcacaaagaatattacaaaatattctcagccaatgatttttaaaggaaatttttaattccctcaataattcacttgattaagttgatttaacttttatttaatttctagaaaatgcattatttaatgatttttaatcccgaacgaaaatcggggcgttacaacgcgtccagcgcatctccaagcgctacgtactggtggaatggaccctctatcggcgcgcggctaacggagtcctcctgaagtgcattcctcgggaacaaggcgtcgagcttcttggcgatatccatgaaggcgagtgcggagcccactccgcctcacgcaccttggttggcaaggcctttcgccagggtttctattggccgacggctctcaacgatgcggttgacctggtccggcggtgcagggcgtgccagttccacgccaagcaaacccatcagccggcccaggccctgcagaccataccactttcatggccgtttgctgtctgggggctcgatatcctgggtccgtttaggcgggccccgggcgggttcgagtatctgtatgtcgctgtcgacaagttcactaagtggcccgaggcttacccggtcatcaagatcgataagcactccgcgcttaaattcatcaggggcatcactgctcagtttggggtgcctaatcgtatcattacggataacggcaccagttcactagtgaactcttcggtgactactgcgaagatatgggcatcaagctctgcttcgcctctcccgcccaccccagaagcaatggccaagtggagcgcgccaacgcagaaatcctcaagggcctcaaaaccaaaaccttcaacatcctcaataagcacggcgactcgtggatcgaggagttgccagcggtgctctgggcgaactgaaccacgccaagtcgagcaaccggggaaacgcctttcttcctcgtctgcggcgcggaggcggttctcccatccgagctcaccctgaggtcccctcgggccgccatgtactgcgaggctgatcaagatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgctgcgtccaaacgcgtgctggactgagcaagctctcaccaatgtgggagggtccgtatcgagtgatcggcgtcccccggccgggctccgttcggctggccatgggcgacggcacagagctgcctaacccgtggaacatcgaacaccttcgtcgcttctacccctagcgggggtcgggtgttaggtctcgggcttgggccaaccccgcacccccccgggcgtgccgggttggccgggggctaccac

SEQ ID NO: 2639 - DNA, 601 bp, Oryza sativa
acggatccagcctcattgtgaaattccatcttattgagccgcaattgaagcaacaaggtgttgcatcacctgtcatggtcctttgggcttgtaacttcgtttgggaccccggcccaagtggggcccatgtggggtgcgccccaatccggtggagcacgaccctaggatcctcatggtcattctcccacccctataagtagctagataccccttcagggttgctggggttttgataaattgtaagtttagccattgctacttcgcttgcagcgcgcgtgtcggctagaccgtccgtctgcttgttcggaaccccactttatcatgtatcaattcatatttgtgcgtcttgtctatctagcaattcagttgctttctatcttgttcttgcttgttctcgattgcgtgcaggaatagggttgatctgcatcgacaagatcaacaacccatggagagctgtattgatcgctaaggcgcaacagaacgtcttgtacggttgtagtcggatcgtcaacgtttctcccaaatcgtagttatcacaactcaccgaaagatcgggccaacaacagccttgagtgtcgagaggaactcagggttcatcacg

SEQ ID NO: 2640 - DNA, 3377 bp, Oryza sativa
  unsure (1)..(3377): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttgctatggctcatggcggggatcaaatccctggtagcggtgaaacgcttgccagtcagcttgctattgttgcatcatagtgttgaagtttgcaacctgtgcatcaacagactgttgccattcccgtgactgtaccacattatcctccaaggtgtgttgttcgttccctgcctacagttcaagtgtatccatcctccgggtgagttctcccagatcccctcgagaggagacagcgacacatccaagaggatgaaggtggaccacttgaattggaggagcgcgagtatccccagtgcagctcctacggctcatgccatcggccgtcgctggcactctgccaggacgaaccaccagcgtcccaatagtccccatacatttacactggtggtgaagaggaagacgcctcctgaggtgcttctctgtacattcgtcatgttaccctgcgtgggacatcacgatgcaactccaattggagtggaatggttagttctcggcaattacacaaatgaaactccgggttaggtaaaggaatcttatttgtatagccgggaaacaaaaatataagataatcatttggaccatgtttgagtatgtggcattgaactaaataggcctcatcaacataagagcgggtgataggaatacttgcttataaagcatagtcccaactcttcatgctgaacgagtcaccaaagaaatacactcaaaaggaccagacaacttcatattttctaaccattgcttgatcatgggttgaacaggtgaaactttgattttttttttaaccatggcatacaagaggactagttcgtcttcacaaactatctggatatcagctctaagaaacaacatgaaaccaagcaacttatgcaacagccccaaggtaggatgatggatgtcactagttctaggctttttagaggatgagaaacctgaaatactttgccaaaacatacgcttgttaaaaaccaagaaatgcgttcctgaaattaactttgcatgttttgtcaaagcctagatgcaagctaaggtctttccgagaaaggtgatattccttgcggaataaccagaaagtacaccatcgcctacctctagcaaggtacatagaaactgcatggtaagcaaacaggaacccagctcatctacacatgcaaatttatcccatccaacagcacgtcaaacagtatgaaactcagcatccatacctatccttttcaaaaggtcgagttgtatgcttaggtctgagcacacgttcggtccttcagcatatgataggcttgcatttcccggtcgcccacgaggtcgagatcggagttgtcgtacagcctcggtggaacgtacgcctcctccatggatgcatccgcagaagaaggtgtactcggcttttcgtgtcggcttgtccgtgagcttgattgtctcttgaatatgcccggaagtcgtttcttcatagctacaacaaagagcaagaatacaagactactcggacgggggttaaacaaatacccaccgattaacattgcaccgaactaaagcaaactcgtatatgtaaagtgtctaaactaaatgcagcaaattgtgtgaatttgaggcaagcttgcaaaactttgaatgaattttgagaggaaggttttgagagggagtgagaatgagttagagtggtgtgacttccctctcccagccgagctgcttatatagtgcatggataatggctagtaatggcatgtgggccccactagccgctaccctaaagaaatttgcagccagccagtgccatgcaggggttcggccgaacccctggtggacccaaccggccccacatttagccattgggttccaacgactagtgtggtggtggccatgcaaaattttgccaaaaattttattttattttgctgcgtttgaaaaattcaaacatgctttgatgcaatggaaaataaatatgaaataactaccaatttacctgttggcaagggcgacatcatttcaagtctgacgagcacgacagtacctccgatgcatttagctcgataaggcacccaattccggaggtaaaggagcaggtgttttttccttaatctgccacaccttctttgccttaggtgcgggcaacggcctcttcataactgggaacgcaggttgaccggcctatattcctggcttcttggatgccggcttaaggtattgacggttcctcgtttcttcccgctacaggaagttcatcatgaaagtgttgagactatccgtccttcggggtttcactctaacctccttgtgggttcggtccgttcttgaactagaccatggagcaatgctccatacttggtctccttgtggacgatatccgttgttgttgttcatgagcatgacgtccttacaggttttcggacgatccgtcccagagtgatcgtcattgccacagacctcacatgccatttgaaaagtcgaaggccttaacggtacccttcttggcgtccttctcattgttgtccattctcttcataaggagatccaattgggcggcgagcatttccgtctcgttgacggtgtgcataccgcgtttgactggtttggagtcgttccttgctccaacctgtatttgtgagcctcttctcaatcagatcgttgacatctctgactgtttttgagaagaattgtcacgtcccaaaacgactctaaaatatatcccttaaatgatgcctagaataattaaaatccatgtgaaagcctccaacaattaaaatgtgcaaagttaaaagtcaaataaggcttggaggatttttgtaaatttcctaaaagcctaaaatgcgtaaataaattttagtggaattttcagagcacaaataataattattaagaaataaacaaagttaaaatgattttataaaaagaaaaaccctaaaagtcccccttccctcccttgggccggcccagcccatctctcctctccccccccctctctctctcctctccccgcggcccactcggcctctcccggcgcgcgcgccgctgatgggcgggcccgcccgccaccctcgctgacgggtggggcccacccgtcatccccttcctcccgccgctaccgacgcctccccc

SEQ ID NO: 2641 - DNA, 3581 bp, Oryza sativa
atttgcccccgcaaatctcgccggcgcattgatgcggccgacctcccgcgcggtttcttcccctcggccgctctttcccccttccaaccctatttaaaccctccccgcgcctccttcgcccgtttccgcccttgccgcaccgtctccccgctggaatcgagctcgcgctgtcgccctctctctcctccgtcgccgacgacctccggccggccttctccgctcgccgggaccgtctcccgccccggcgtcgcctcctccggtttcgccgcaccgccgtcgaccccgtccaccccctcgccgagtccgccgaccgcaggaacgccgtcgaccccgtcgaccagagccgcgccgccgccttcctccgctccggccgcctttttcgtcgtcgccgtcgacctagggtgagccgtggaccgccgcctcttttcccccttccctttccctctctcggccgccgctccgccgtgcctatggccgccgccggcgaccataggggcgcgggcgccgcctcctgccggccgcgccgagtggccgccttcgggcacgccgagtggccgccgcgtggggcccggccgtcagccgcccgcgccctcgggtgcggctgaagcgtggggcccacggcgccggccggtgcgagcccgggtgcgcccggtccaccgtggaccgtgaggctgccgcgtgggccccactcccgtggacccggtccgcgcgccccctcccctcggctgacgcaataaaccctttttaaattaaaatttaaatgaacaaatccgcaaatattcatttaaagagcatataaacttcaaatggccataacttggccatttgaactcggaattggaccgttcaagtctcttttttttccttaagaagtcaagaacccatttttgtgcttcgttcctgcttgttatatggagtttattagagtaaaagcccttttattttccgttggtcgtgtagacgttgcagattcggaagatccactcttcgtggaggttgaagccgacgtttgggaaagtgagcaaggcaagtcacatcatccttgaacatattgaatcccagtttataaaattattttgatttaaattattgcattatcgctttgttatcactgtttattaaattcccgcgttatcactgttttatctagccatgcctatttacctttgttatgaccttattattgttattgttattatttccttgttcaccctagaagaaacaaaaccccaactagtggacactcatggtaccactagtatgattttaggtagatgcttcgctggttaattaggcaacattaggtggttttacaactctagactttgggaatactcttatcacctggacactatggaatggttggattattgtggaattggattcacacctccccctctattcaaaaccctcaaaatggttttaggctgggctcggggtgcatggttttgacagtagcacctcggccatatatggaccggtcttcgggcctctgttgcaaagcactaccgtacttccacatgtctagtaggtaaggcttagtttgtggcttagtctggttataaacaaaagtacacggatggagatggacgaagtcaggggtcgatggacatctctagggcaaatgaaggctacacgagctgcggcccggtagtcgagatgtcatggcacagggccggtgtcctgctgctaggggctcagtcctgcctacctgtcctgggggttccggccgtaggtggggttgggtcggtactcttgtttatggctaggatgggttggaaactatgtcatgtcttccgtccgtataccgtggtggtatgtggcacgtggttacacgtgaggaaaatgtgtcttgtgggtaaagatgtacacctctgatcagagtataatctattcgaatagccgcgccctcggttatgggcaagccgagcaatgtacccaatttagtgttttaattcttaaaacctgcttaacaactaaaatgtggaatggttggcctaggttggcttgggacgagctggcacccagggtcgggttgccagttcggtctgaatcatcgtaggccttgggttaaggcaggttcgtgtgggttcacagccttggttaataatattgtatagctctaggacggtgtttacaaaatagctttgagcaactaagtgtcttttaatgctgtttactgcaaaccctaaccccctatattatggctcccttgtactcccttgtactcccttgcatttattctgcacttgtgggtgtgtcttgttgagtacggtggttgttctcagtcttgctcaatttttcccaaacccagaagaggagcccctggatgatgaaggctttggtgtctagctcgtgcctgccgtcaagcgcctgtggtcatcgccctagtcttccgctatttttcgtttgtcttcttgtgtgctgggtcttcgccgcccatgtaataaattaattaattacgcttccgcttgtctcctgggacaaggaataatgcacgcacgtaaggaacgcccgttgggttatttccggtcgtgacaagttggtatcagagcccccttgaccctaggacgagccttagatcccaagccttagcaatattttcgaaataaaaatcctttcttatttgtgaaaatcctctagtctctctctgtcctgctgcttcatttatcgtcaaaatctgacctttaaaatgttgcttttctcttttgtttttgtttgtagatggcctgcgatgttttctactggaatcaaaaagttcaaaaaacgccaaaacatgatttttggaaatattggagtgtattgggtgcattcatggcaaaaactcacttcgtgattcgcgcggcgaacttttgtcaattaatgccaatattggcatatattggcccacacggttgcgatgtttttgaccggaatgaaaatgttcaaaaagcaccaaagcatgatttttgaacatattgcagtgtattgggtgcgttcgtggcaaaaactcactttgtgattcgcgcggcgaacttttgtcaattaatgccaatattgacacacgagggtgcgatgttttctgctggaatcaaaaagttcagaaagagccaaaacatgacttttggacatattggagtgtatcgggtgtgttcgtggcaaaaacacatttcgtgattcgcgtggctaacttttgtcaaataatgtcaatattggcatatattggctcacacggttgcgatgtttttgaccggaatgaaaatgttcaacaagcaccaaagcatgatttttgaacatattgcagtgtattgggtgcgttcgtggcaaaaactcactttgtgattcgcgcggtgaacttttgtcaattaatgccaatattgacacacgagggtgcgatgttttctactggaatcaaaaagttgaaaaagagccaaaacatgatttttggacatattggagtgtatcgggtgggttcgtggcaaaaacacatttcgtgattcgtgtggcgaacttttatcaaataatgtcaacattggcatatattggcccactcgggtgcgatgtttttaaccagaatgaaaaggtccaaaaagcaccaaagc

SEQ ID NO: 2642 - DNA, 27894 bp, Oryza sativa
gtggctaacttttgtcaaataatgtcaatattggcatatatgggcgcacacggggtcgagtgtttttgacgagaataaaatgttccaaaagcatccaagcatgatttttggacatattgaagtgtatggggtgcgttcgtggcaaaaactcactacgtgattcgcgcggcgaacttttgtcaattaatgccaacattggcacacgagggtgcgatgttttctgctggaatcaaaaagttcaaaaaacgccaaaacatgatttttggacatattggagtgtattgggtgcattcatggcaaaaactcacttcgtgattcacgcggcgaacttttgtcaattaatgccaatattggcacacgagggtgcgatgttttctactggaatcaaaaagttcagaaagagccaaaacatgacttttggacatattggagtgtatcgggtgtgttcgtggcaaaaacacatttcgtgattcgcgtggctaacttttgtcaaataatatcaatattggcatatattggcccacacggttgcgatgtttttgaccggaatgaaaatattcaaaaagatccaaagcatgatttttggacatattggagtgtattgggtgcgtttgtggcaaaaactcacttcgtgattctcgcggcgaacttttgtcaattaatgccaatattggcacacgagggtccgatgttttctgctggaatcaaaaagttcaaaaagagccaaaacatgatttttggacatattggagtgtattgggtgcattcatggcaaaaactcacttcgtgattcacgcggcgaacttttgtcaattaatgccaatattggcacacgagggtgcgatgttttctactggaatcaaaaagttcaaaaagagccaaaacatgacttttggacatattggagtgtatcgggtgtgttcgtggcaaaaacacatttcgtgattcgcgtggctaacttttgtcaaataatgtcaatattggcatatattggcccacacggttgcgatgtttttgaccggaatgaaaatgttcaaaaagctccaaagcatgatttttggacatattggagtgtattgggtgcgtttgtggcaaaaactcacttcgtgattctcgcggcgaacttttgtcaattaatgccaatattggcacacgagggtccgatgttttctgctggaatcaaaaagttcaaaaagagccaaaacatgatttttcgacatattggagtgtattgggtgcgttcgtggcaaaaactcacttcgtgattcgcgcggcgatcttttgtcaataaatgccaatattggcacacgagggtgcgatgttttctactggaatcaaaaagttgaaaaagagccaaaacatgatctttggacatattggagtgtatcgggtgtgttcgtggcaaaaacacatttcgtgattcacgtggcgaacttttatcaaataatgtcaatattggcatatattggcccacacgggtgcgatgtttttgaccggaatgaaaatgttcaaaacgcatcaaagcatgatttttgaacatattgcagtgtattgggtgcgttcgtggcaaaaactcactttgtgattcgcgcggcgaacttttgtcaattaatgccaatattgacacacgagggtgcgatgttttctactggaatcaaaaagttgaaaaagagccaaaacatgatttttggacatattggagtgtatcgggtgggttcgtggcaaaaacacatttcgtgattcgtgtggcgaacttttatcaaataatgtcaacattggcatatattggcccactcgggtgcgatgtttttgaccagaatgaaaatgttcaaaaagcaccaaagcatgatttttggacatattggagtgtattgggtgcgtaaaaactcacttcgtgattcgcgcggcgaactttcgtcaattaatgccaatattggcacacgagggtgcgatgttttctactggaatcaaaaagttcaaaaagagccaaaacatgatttttggacatattggagtgtattgggtgcgttcgtggcaaaaactcacttcgtgattcgcgcggcgaacttttgtcaattaatgccaatattggcacacgagggtacgatgttttctactggaatcaaaaagttcagaaagagccaaaacatgacttttggacataatggagtgtatcgggtgttcgtggcaaaaacacatttcgtgattcgcgtggctaacttttgtcaaataatgtcaatattggcatatattggcccacacgggtgcgatgtttttgaccagaatgaaaatgttcaaaaagcatcaaaacatgatttttggacatattgaagtgtattgggtgcgttcgtggcaaaaactcactacgtgattcgcgcggcgaacttttgtcaattaatgccaacattggcacacgagggtgcgatgttttctgctggaatcaaaaagttcaaaaaacgccaaaacatgatttttggacatattggagtgtattgggtgcattcatggcaaaaactcacttcgtgattcacgcggcgaacttttgtcaattaatgccaatattggcacacgagggtacgatgttttctactggaatcaaaaagttcagaaagagccaaaacatgacttttggacataatggagtgtatcgggtgtcttcgtggcaaaaacacatttcgtgattcgcgtggctaacttttctcaaataatgtcaatattggcatatattagcccacacgggtgcgatgtttttgaccagaatgaaaaagttcaaaaacgccaaaacatgagttttggaaatattggattgtactgggtgcattcatggcaaaaagtcacttcgtgatttgcgcggcgaacttttgttaattaatgccaatattggcacacgagggtgcgatgctttctactggaatcaaaaagttcaaaaagagcccaaacatgatttttggacatattggagtgtatcgggtgggttcgtggcaaaaacacatttcgtgattcgcgtggcgaacttttgtcaaataatgtcaatattggcatatattggcccacacgggtgcgatgtttttgaccggaatgaaaatgttcaaaacgcaccaaagcatgatttttggacatattggagcgtattgggtgcgttcgtggcaaaaactcacttcgtgattcgcgcggcgaacttttgtcaattaatgccaatattggcacacgagggtgcaatgttttgtactggaatcaaaaagttcaaaaagagccaaaacatgatttttggacatattggagtgtattgggtgcgttcgtggcaaaaacacacttcgtgattcgcgcggcgaacttttgtcaattaatgccaatattggcacacgagggtgcgatgttttgtactggaatcaaaaagttcaaaaagagccaaaacatgatttttggacatattggagtgtattgggtgcgttcgtggcaaaaactcactacgtcattcgcgcggcgaacttttgtcaattaatgccaatattggcacacgagggtgcgatgttttgtactgtaatcaaaaagttaaaaaaacgccaaaacatgatttttggacatattggagtgtattgggtggatacaaggaaaaaactcacttcgtgattcgcgcggcgaacttttgtcaattaatgccaatgttggcacacgagggtgcgatgtttttgaccggaatcaaaaagttcaaaaaacgccaaaacatggtttttggacatattggagtgtatcgggattgttcgtggcaaaaacacatttcgtgattcgcgctgatggacccggagttcctctcaacactcaaggcttttgttggcccgatctttcggtgagttgtgataactacaatttgggagaaacgttgacgatccgactacaaccgtacgagacgttgtgttgcgccttagcgatcgatacacctctctgtgggttgttgatcttgccggtgcagatcaaccttattcctgcaagcaaatcgaagaaacaagcaagaacaagataaaaagcaatctgatattgcaaataggaatttaatacaaatgataagttggggttccgaagaacaagcagacggacggtctagccgacacgcgcgctgtaagcaagtagcaatggctaaactttaatctatcaaaaccccgagaaactctaaaggggaacctaactatttaagaaggtgggaggacgacctaagggaaccctagggtcgtgctccacctggttggggcgcaccccacttgggccccacttgggccggggtcccagacgaagttacaagcccattataggtgacgcagcaccttctttttgtgatttcggccgactgggatggaatttggtgatgaagctggatccatttgaaagatgactccgagagctttccatcaagtactcatggacccaaaagggagctcgcatgcatatttggcggccgtctgaagtcgattctgttgcaggtggctgaactggattgcagaacttggacggcctgatcttgatgtgaacgacggttgtatctatagtagtcatggtcacatcacgcgcggcgaacttttgccatataatgtcattattggcatattttggcctacacgggtgcgatgtttttgaccggaatgaaaatgttcaaaaagcaccaagacatgatttttgcacatattggagtgtattgggtgcgttcgtggcaaaaactcacttcgtgattcgcgtggcgaacttttgtcaattaatgccaatattagcatattttggaccacaccggtgcgatgtttttgaccggtatgaaaaagttcaaaaagaaccaaaacatgatttttggacatatttggagtgtattggttgcgttcgtggcaaaaactcacttcgtgattcgcgcggtgaacttttgtcaattaatacaaatattggcacacgagggtgcgatgtttttgaccggaatcaaaaagttcaaaaaacgccaaaacatgatttttggacatattggagtgtattgggtgcatacatggcaaaaactcacttggtgattcgtgcggcgaacttttgtcaattaatgccaatattggcacccgagggagcgatgttttgtactggaatcaaaaagttcaaaaagagccaaaacatgatttttggacatattggtgtgtatcaggtgtgttcgtggcaaaaacacatttcgtgattcgcgtggctaacttttgtcaaataatgtcaatattggcatatattagcccacacgggtgcgatgtttttgaccagaatgaaaatgttcaaaaagcaccaaagcatgatttttggacatattggagtgtattgggtgcgttcgtggcaaatactcacttcgtgattcgcgcggcgatcttttgtcaattaatgccaatattggcacacgagggtgcgatgttttctactggaatcaaaaagttcaaaaagagccaaaacatgatttttggacatattggtgtgtatcgggtgtgttcgtggcaaaaacacatttcgtgattcgcgtggctaacttttgtcaattaatgccaacattagcatattttggaccacacgggtgcgatgtttttgaccagaatgaaaatattcaaaaagcaccaaagcatgatttttggacatattggagtgtattgggtgcgttcgtggcaaatactcacttcgttattcgcgcggcgatcttttgtcaattaatgccaatattggcacacgagggtgcgatgttttctataggcatcaaaaagttcaagaaacaccaaaacatgatttttggacatattggagtgtatcgggtggatacatggcaaaaactcacttcgtgattcgcgcggcgaacttttgtcaattaatgccaatattggcacacgagggtgcgatgtttttgaccggaatcaaaaagttcaaaaaacgccaaaacatgatttttggacatattggagtgtattgggtgcatacatggcaaaaactcacttcgtgattcgcgcggcgaacttttatcaattaatgccaatgttggcacacgagggtgcgatgttttcgaccggaatcaaaaagttcaaaaaacgccaaaacatgatttttggacatattggagtgtatcgggtgtgtttgtggcgaaaacacatttcgtgattcgcgcggcgaacttttgtcatataatgtcaatattggtatattttggcccacacgggtgcgatgtttttgaccggaatgaaaaagttcacaatgcaccaagacatgatttttgcacatattggagtgtcttgggtgcgttcgtggcaaaaactcacttcgtgattcgcgtggcgagcttttgtcaattaatgccaatattggcatattttggaccacacgggtgcgatgtttttgaccggtatgaaaaagttcaaaaagcaccaaaacatgatttttggacatattggagtgtattgggtgcgttcgtggcaaaaactcacttcgtgattcgcgcgacgaacttttgtcaattaatgccaatatttgtatatattggcccatataggtgcgatgtttttgaccggaatgaaaaagttcaaagtcaaacataatagttttttctcttttctttctttcttctttctttcctttccttttcttttcttttttttttgggtgcggcttttcttttcttttttttatgcacctttctgcctttttttttctttcttttttttttattttattttacaaaaacagattcaaggacctcaatgtaaggctatagggactcaaacataaatataaaatttacagtgactcaaatgtaaaagtctaaaaccaaaattaaaattatacaaaaatggaatgctgaatttatactggttccgtttttctgaacggatatcgaaacggacaccaaacaaaaattcaccaaggtgtaaggatggcacggtgtagattgaaccgaaaggagagggagtcggactcaaggggggaatgccgcatggaaggtggttggactcggtgagaatttctgaaggaaggaaaccgattccttttctgcgtggccccaaatagaaacgaaagtaatctaatctagtctaatcttctccttccatcttcctcatgtgcatcttctcccttcttcctcacgcgcacatgcacggcagaaacaaacacacacaaggataggcaaactctagatgcaacacaagaactccaaaactaaccgacagaaacttctgaaaactacaaaaatagaaccgtggcagcgagccgattccgttttcgtaggtcccgacaacaacagagacacggtggcagcgacgactgtggtacaaaacgtgaccagaactcgaaactctaaacgaactagacgctaaagccagcagctcgacgtgacgatgcaacacaaaattcaacaaagcaaaaactgaagagaacaatgcaatggcacaatatggctaggtaaatgatacaaatttttttgtatggctattttctggttatgggtagaaaaaaactcaccgagcaacgaaagtctctgataccacctgctgaaccctgagttcctctcgacactcaaggctgttgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagatcaaccctattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatctaacaaaacccaagaaaccctgaaggggtacctaactatttatagaggtgggaggacgaccaagagggtccaagggtcgtgctccaccagattggggcgcaccccacatgggccccacatgggccagggtcccaaacaaagttacaagcccattggcccaatacaggagacgcagcaccttgcttttgtgattgcggccaaacgagatagatttccgagatgaggctggatccgttggaaggaggacttcgagagctttccatcaagtactcacgggcccaaaacggagcacgtatgtagatttggcggccgtttgaagtcagcaatgtaacacgtggccgaatcagattgcagcacatggaggacttgatcttgatgtcttcttgttgattcatgatgtgagcaatggtcgtatccatagtagccatggtcacatcatcctccccttcttcacagaaaaccgtcctcggtttttccatatggtgctcttcgcgcagtccactgaaaacaacctgtttcttgcaatcaaaacaagacaaactcgagacaatatgattagcagtaacatgtctctctagcttgcatattttatccggaactacaagatgttctaaatctgaacaaatgtaaactctatgcaccaaaaatattcctctatcattatattcgccaaagatatgaaaaatagcattagttggacatggcaaatcagatttagcaaataatttctccttcaaattatcgagctcacaaaaatcatcaaactgaacatagcccaaagtatttaaagaagatagcaatttgcgttcctctacttcattagcaatgtgaacaacatgcttagaatcagcacacaaagaaatagtagaactaacatgttcattcactagttgtggcatggatataagtgaaacattatcacacaactcttctttatcacaaggaacagcaagtaaatcaacttgtgacaaaggcaactcagtaattgattccactaatggttgctctactatagcatgaaaagtggacaagtgtagctcaccttgagaatactcaccttcatttctctcagcaccatttaatttaccttgcgaactttcttcaaataatgtagcttcatcagccttctcctcattcgcgagtgatggaagtgacatctcaaacatatcgttcttctcattttggagacttttctgaacttcctgcaaaacatcagtgataggaggcacaagcatatcttgttgctccattggattctccaaaattttgcgctcaacaatgcaagcaagcatgaacaattggcctatatgattatatgtcacattaacaagcccagcctgaatattgaaattaagccctctgaaaaatctagtcattgtgttctcattagattcttgtaaaccactataagtgatacaaattttaaaatcataaaagtactccctaacagttttgtcaccttgttttagatgttcccatttctcaaggagagcacgtctatagtatgaaaacacaaatctttttctcatcagtattttgcattcatcccaagtttcaagcttattccccacagtatgccaccaaaaagatgcagaaccggtacacttattactagcagccttaatcatttgagcattagaaaaatcatactcatcaaattgtttttctactgctagctcccaattaatgtatgcagcggaatcatactttccatcatagactggtaacttacatgcaacttgtgcaaaattatagtcatgtacctcatatgcatcacgtgaagaagtcgtcatatctcgtcgaaggtgtagatgttgacgttgagcatgaccatcttgtttccccttgcgcaatcctgccatggttagcagcaaacaagaaacatacacaagaatatacacgctcctatcaactactaggtactggcagctcaaatctcacacacactcaagcttttaaccaagctcttacaagatcttaccaatgcaagtggaatggtgatgtacaccgactcaaccaagcaccccaatagaggttggatatatcgatgcctcggcaaacacttgctgtacggctgcaatcaaatctgtggagctctgggtaggcttaaatatgtagcaaaggaatagcaaatgctcaaatcagagaacgcaaagttgaataattgttcaaagtcaagtaccgtgctggtcctaggctagaacgtactagagacgcgagcctagacacaaacggtaccacaaaatagcaccagaaacaactcaagcacactctgatgtatgaagttcagctcaaacaaaacaatattttatcttttctttctttcttctttcttcttttcttttttttccttttcttttctgattttttttggtgcggctttttttttctttttttttgcacctttctgcctttttttctcactttttttttatttttttaacaaaaactgactcaaggaccttaatgtaatattacagggactcaaacataaatataaaatttatagggactcaaatgtaaaagtctaaacccaaaattaaaattatacaaaaaaatggaatgctgaatttatgccggttccgtttttccaaacagatctcgaaaccgacaccaaacaaaaattcgccaaggtgtttgacacaactcagaacggtggaagagagggagggagtcggactcggccaaaggggcgagtgggactcggccaggaggtggagtggatggcagccgaattttgtgtatgggataaaaaggatactgatttttaaccaatccaatctactatatctttccaaaacaaacttgacttcttccaaaatcagatatggtaattcaccttcctcctctcgtgcacgacacaggcacggccaaaacaaacacacacaaggatcggcaaactctagatgcaactcaagaactccaaaactaaccgacagaaacttctgaaaactacaaaaatagaaccgtggcagcgagccgattccgttttcgtaggtcccgacaacaacagagacacggtggcagcgacgactgtggtacaaaacgtgaccagaactcgaaattctaaacgaactagacgctaagaccagcaacacgtcgtgacaatgcaacacaaaattcaacaaagcaaaaactgaaaagaacaatgcaatggcacaatatggctaggtaaatgatacaaattttttttgtatggctattttctggttatgggtagaaaaaaactcaccgagcaacgaaagtctctgataccaccttgcttgaaccttgagttcctctcgacactcaaggctgttgttggcccgatctttcggtgagttgtgataactacgatttgggagaaacgttgacaatccgactacaactgtacgagacgttgtgttgcgccttagcgatcgatacacctctccgtgggttgttgatcttgccggtgcagatcaaccctattcctgcaagcaaatcgaagaaacaagtaataacaagataaaagcaatctgatattgcaaaaaggaatttaatacaaatgataagttggggttccgaatacaagcagacggacggtctagccgacacgcgcgctgcaaggaagtagcaatggctaaactttcatctaaacaaaacctgagaaaccctgaaggggtaactagctatattgacattaattgacaaaagttcgccgcgcgaatcacgaagtgagtttttgctatgaacgcacgcaatacgctccaatatgcccaaaaaacatgttttggcgctttttgagctttttcattccggtcaaaaacatcgcaccctcgtgtgccaatgttgcaattaattgagaaaagttcgccgcgcaaatcacgacgtgagtttttgccacgaacgcacgcaacacactccaatatacccaaaaatcttgttttggcgttttttgaactttttgattccggtcaaaaacatcgcaccctagtgtgccaacattggcattaattgacaaaagttcgccgcgcgaatcacgaagtgagttgttgccacgaacgcacccaatacactccaatatgtccaaaaatcatgttttggcgttttttgaactttttgattccggtcaaaagcaacgctccttcgtgtgccaatattggcattaattgacaaaagttcgccgcgcgaatcacgaagtgagtttttgctatgaacgcacccaatacactccaatatgtccaaaaatcatgttttagcgctttttgaacattttcattccggtcaaaaacatcgcccctatttgggccaaaatatgccaatattggcattaattgataaaagttcgccgtgtaaatcatgaattgagtttttgccattaacgcacccaatacactccaatatgtccaaaaatcatgttttggcgttttttgagcttttttattccggtgaaaaacatcgcacccccgtgtgccaatgttgccattaattgacaaaagttcgccgcgcgaatcacgaagtgagtttttgccacgaacgcacgcaacatactccaatatgtccaaaaatcatgttttggcattttttgaactttttgattccggtcaaaaacatcgcaccctcgtgtgccaatattcgcattaattgagaaaagttcgccgtgcgaatcatgaagtgagtttttgccacgaacgcacgcaatacactccaaaatgtccaaaaatggcgtttttgaactttttgattccggtcaaaaacatcgcaccctcgtgtgccaatgttgccattaattgacaaaagttcgccgcgcaaatcacgaagtgagtttttgccacgaacgcacgcaacacactccaatatatccaaaaatcttgttttgccgtttttttgaacattttgattctggtcaaaaacatcgcacccccgtgtgccaacattggcattaattgacaaatgttcgccacgcgaatcacgaagtgagtttttgccacgaacgcacccagtacactccaatatgtccaaaaatcatgttttggcgttttttgaactttttgattccggtcaaaaacaacgctccttcgtgtgccaatattggcattaattgacaaaagttcgccgcgcgaatcacgaagtgagtttttgctatgaacgcacccgatacactccaatatgtccaaaaattatgttttggcgctttttgaactttttcattccggtcaaaaacatcgcccccgtttgggccaaaatatgccaatattggcattaattgataaaagttcgccgtgtaaatcacgaattgagtttttgccattaacgcacccaatacactccaatatgtccaaaaatcatgttttggcgttttttgagctttttgattccggtcaaaaacatcgcaccctcgtgtgccaatgttggcattaattgacaaaagttcgccgcgcgaatcacgaagtgagtttttgccacgaacgcacgcaatatactccaatatgtccaaaaatcatgttttggcattttttgaactttttgattccggtcaaaaacatcgcaccctcgtgtgccaatattcgcattaattgagaaaagttcaccgtgcgaatcacgaagtgagtttttgccacgaacgcacgcaatacactccaaaatgtccaaaaaacatgttttggcgtttttgaactttttgattccggtcaaaaacatcgcaccctcgtgtgccaatgttgccattaaggacacggatacagatggatgaagtcgttgcgacgatggatatctctgaggcaaatgaaggctaaacgagctgcggctcggtaatcgagatatctaggcaaatgaagactacacgggtcggtgcccgttagtcgagatgccatggcactggactagtacgcgggtggtctcacccctatgcgtgtggcgcacccggtctagatcctgttgctcggggctcaatcctggcctgcctgtcccgagataccggccgtaggcagggttgggtcggtacttttgttcacggctaggatgggtgaagggttatgtcacatgtttacgacgggttccaaggccatggaatgggatgtcaaaagaagcaccatctattgactcggctgacaaggagattcagccggaaaagactgtgccgtaggagtactgcgacacacggttgctgctgtttccccaacgaaaggacgagcagttcgctcgttttgtgatccagaagatccacatcaaagtgccgttgttggatgctatgcaagtgccaacatacgcccgttatctcaaggacatactcaacaacaagagaccgctgccaacaacggaggtggtcaagctgacggaacaatgcagcaacctgatactccacaagctcccggagaagaagaaagatccggggtgtcctatgatcacctgctcgatcggggcacaacaattcgaccagacctggtgcgaccttggagccagcgttagcgtcatgccaaaagacgtcttcgacaagttcaacttcacagtgttggaaccaacaccgatgcgcctccaactggctgactcatcagttcgttacccagcaggaatagcggagaatgtgccagtcaagatacgggatttcttcatcccggttgattttgtggtgctagacatggacatggggaaggagatgccgctcatcctagggcgtccattccttagtaccgcaggagccaacattgacgtgggaacggggagtatccgtttccatatcaacgggaaggaggaaaagtttgagtttcaaccaaggacggaacaatgctccatggtcagaataaagtacgggccgaatccgtagaatattcaagtggtcgaagtggagccacccaaaacggacagcttggtgatatttatgcagaatttcctggagaaggaaacaacgatgcccaggaaccgttattggaaaacgccggtaaaatcacccgtaccggccaagaagtcagatcagccggctcagaagaagccgccgtccgcaccaaaatcaaaaaaggtgtggaaggaaaagctaaagatgcccgctccatcacctccggagacgggtgaaaaatcagtgcactaaaccgaaaggaggtatgtatccgcatatttgctttcaacaatttaaatttttgtatcaccacatatttgaatttcaaaatgcatttaggctttttgaatttttaggaaattcttcaaatgaattttccagagcaaaccaaaataaaattttcaatgaaaatttattgtgccacgaccacactgaccgttggaatccaacggctgaaagtggggccggttgggcccaccaggggtttggccgaacaccctggttcggcctaaccggccaggccaacggtcggctgcctctttctttgaggcaacgtgatgaaccctgagttcctctcgacactcaaggctgttgttggcctgatctttcggtgagttgtgataactacgatttgggagaaacgttgacgatccgactacaaccgtacaagacgttctgttgcgccttagcgatcgatacacctctccgtgggttgttgatcttgtcgatgcatatgaaccctattcctgcaggcaatcgagaacaagcaagaacaagatagaaagcaactgaattgctagatagacaagacgcacaaagatgaattgatacacgataaagtggggttctgaacaagcagatggacggtctagccgacacgcacgctgcaagcgaagtagcaatggctaaacttacaatttatcaaaaccccagcaaccctaaaggggtatctagctacttataggggtgggagaatgaccataaggatcctagggtcgtgctccaccagattggggcgcaccccacatgggccccacttgggccggggtcccaaacgaagttacaagcccaaaggcccatgacaggtgacacaacaccttgttgcttcaattgcggctcaataagatggaatttcgcaatgaggctggatccgttggaaagaggactccgagagctttccatcaagtactcacgggccaaaaacggagctcgtatggagatttggtggccgtttgaaattagcagtgcagcaggtggccgaatcggattccagcatttggaggccttgaccttgatgtcttcttgttcatccatgatatgagcaatgtttgtatccatagtagctatggtcacatcatcctccccttcttcacggaaaatcgtcgtcgttttttccatatggtgctcttcatatagtccattcaaaataacctgtttcatccaatcaaaactagacaaactcgaagtagtgtgattagcaaaaacatgtttctgtaaatgcgaacaaatgaaaatgctatgcaccaaatatattcctctatcattatattcgccaaagatatgaaaaataacattagttggacatggcaaatcaaacttagcaaataaattctcctccaaattattgagctcacaaaaatcatcaaactgaacatagcccaaagtattgaaagaagttatcaatttacgttcctcaatatcattagcaatgtgaacaacatgcttaaaatcagcacacaataaaacactagaaatagcatgttcattcactagttgtggcatggatataagtgaagcattatcacacaactcttctctatcacaaggaacagcaagtaaatcaacttgtgacaaaggcatctcagcaattggttccactaatagttgctcttcactagcatgacaagtggaaaaatgtaattcatcagaagcatactcatcttgagtaatttctgcaccatttaatttaccttttatgccctcttcagataatgtaggtgcatcagccttctcctcattcgcgagtgatggaagtgacatctcaaacatatcgttcttctcattttggggactgttctgaacttcctgcaaaatatcagcgataggaggcacaagcatagcttgttgctccattgggttctccaaaattttgcgctcaatattgcaagcaagcatgaacaattggcctatatgattatatgtcacattaacaagcccaacctgaatattggaattaagccctctgaaaaatctagtcattgtgttctcattagattcttgtaaaccactataagtgatacaaattttaaaatcatgaaagtactccctaacagttttgtcaccttgttttatatgttcaaatttctcaaagagagcacgtctatagtatgaaaacacaaatctttttctcatcagtattttgcattcatcccaagtttcaagcttatttcccacagtatgccaccaaaaagatgcagaaccgatacacttattactaacagccttaatcatttgagcattagaaaaatcatactcatcaaattgtttttctactgctagctcccaattaacataagcggcagaatcatacttaccatcaaaaactggcaatttagattctacccttgcaagatcattatcaggtacctcatatgtgatgcgtgaagaagtcgctatatctcgttgatggtgaagatgttgacgttgagcatgaccatctcatttccccgtgcgcaatcctgccatggttagtagcaaacaagaaacatacacaaaaatatgcgcgttcctattaactagtaggtagtggcagctcaaaaatcacacacactcaagcttttaaccaagctcttacaacatcttaccaatgcaagcggaatggtgacatacaccgactcaaccaagcaccccaatggaggttggatgtatcgatgccttggcaaacacttactgtacggctgcaatcaaatctgtggagctctaggtaggcttaaatatgtagcaaaggaatagcaaatgctcaaatcagataatgcaaagttgaataattgttcaaagtcaagtaccgtgctggtcctaggctagaacgtactagagacgtgagcctacacacaaatgataccacaagatagcactaggagcaactcatgcacaactctgatatatgaagttcagctcaatgataacaaaatgattttctccttttcttctttttttctctctctttttttttgtctttcctgcttttcttttctttttcttttctttttttggtgcggcttttgttttctttctttttagcacctttctgccttttttttcttttttttaaattttttttcagcaaaaaccaactcaaggaccttaatgcaagattacaaggactcaactgtaaatatacaaattacagggattcaaatgcaaaagtgcaaacccaaaaattaaaattatacaaaaatggaatgctgaatttatattggttccgtttttccaaacggatctccaatcggacactctgaaaattttcaccaagctatgcgggaagacacggtatggatctaaatcgatagaagagagggaggagtcggactcggaggaaggaaggcaccacagagaggtggagctgaatattgcggccagcactagtgtttggattcagtgcacaaaataaaaggaaacggatttccacccgatctaatcttctttttctttcctattctgttctttcctttttttttctttccttccacccaaccgaatccaaacagatcttctatattcctttccccttcttcttcctcaagggcaaaacagaaccacagcacaagcactaagcctgggtaaacaacaaacccttgatgcaacaccaaaaccgaccgataaaaacttttgaaaactacaaaaatagaaccatggcagcaagccgattccgttttcgtaggtcccgacgataacagagacacggaggcggcaatgactctggtataaaacgtgaccagaacacgaaacactaaacgaactagacgctaaggcgcaacacaacgtcttgtacggttgtagtcggatcgccaacgtttctcccaaatcgtagttacctacaactcaccgaaagatcgggccaacaatagccttgagtgtcgagaggaactcagggttcagcaaaaactgaatagaacaaagcaatggcacaaagatggctagggacatgatgtaaatttttttgtatggctattttctgcttataggtagaaaaaaactcaccgagcaccgaaagctctgataccacctgatgaaccctgagttcctctcgacactcaaggctgttgttggcccgatctttcggtgagttgtgataactacgatttgggagaaacgttgacgatccgactacaaccgtacaagacgttctgttgcgccttagcgatcaatacagctctccatgggttgttgatcttgtcgatgcagatcaaccctattcctgcacgcaatcgagaacaagcaagaacaagatagaaagcaactgaattgctagatagacaagacgcacaaatatgaattgatacatgataaagtggggttccgaacaagcagacggacggtctagccgacacgcgcgctgcaagcgaagtagcaatggctaaacttacaatttatcaaaaccccagcaaccctgaaggggtatctagctacttataggggtgggagaatgaccatgaggatcctagggtcgtgctccaccggattggggcgcaccccacatgggccccacttgggccggggtcccaaacgaagttacaagcccaaaggaccatgacaggtgatgcaacaccttgttgcttcaattgcggctcaataagatggaatttcacaatgaggctggatccgttggaaagaggattccgagagctttctatcaagtactcacgggccaaaaacagagctcgtatggagatttggtggccgtttgaaattagcagtgcagtaggtggccgaatcggattccagcatttggaggccttgaccttgatgtcttcttgttcatctatgatgtgagcaatggttgtatccatagtagctatggtcacatcacaaaggctagtgggccccacaggttagttttgaccgttgtggatgcactatttaagccaaccggccgggagaggggactccaccccatttcaacacatttccattccctctgcaaagtttgctgtctagttcattcaagctgtgatattttccctcaaatttaaatctttagttgcatatatacaagttgctttggtgaaactaaccggcaggtgaaactcttatcattcctaacccccgccgagttagtccgttcttgcttcattgtgcagaatgaggaggcgattgtctcaactgttcaaagggtccggcccttcatcaagtcatcatgacgggtctagcactcgttcatcagctaatatctcgatggaagacgccgaagctccgcgacatgatacggacatcactacctcggatacacacaacaatcctccaatggtcattcaaggactgatagcaagagctcgtgcgcgacaattaaatttagaggtgagctcgttcctatgttcttctttgtatgaattcgagaaaagattgctacctaatgaatatattgtgattagaaataatagaggggacaaggagacacttggagaaggacttagagccatggaggatcatcgaggacgtccaagtcaaggtggaggcccaaaccaattcgacctcggtgcaattcggagtctaggaccagtctgcactaaaacgggcgcccaggtcgcatacgtgctcggattggggcgttctttatatgaatggaaaactaagaagataacctttccaatggttttggtcccacatccaaatactttccgagtcaatgggtatcgaccgaacaagttgacatccagaatctgtcccggtgctgtgtcaccgtatttgggcctttgggccatgtatcgtgttggaacccattagggttgcgtcgagagggggttgcacgagcctaaactctatatatcagtaccgctaccatctttaggttttagagttttgcttagattattctgtcgagaacagtttcgccgctagatcggtttgtaagaccccaactcgtgagcttatcattcatctgcaattttggttgttttctatctcgtttttgtttgtgttcttcgattggcaaatagggattagccttcttggcgaggtcatccgcgtttcgacacgggtgataaccagaggagacgtggtgttgcgattgcggggctcaagagcgtgcgcgttcaagaagccggatcgatttgtgtcgcgactccgcccaaatcattttttatcagaacctttcggaagatcgggaaccctagtgcacatcaagtggtatcggaggccgttgtaaagtctgtccaagatgccttcactaaaatcggcttcctgaaccacatggagaggttggacaagcagatatccacgctaactgatcgggttgccgcgttggagacaccttccaatgaggaagtggtgagtggtgatgacgatgctcattcggaagacacggtgtatgattccagtggctatattgacacaccagctacaaggcaagcacggctatgacgtcgcctacgcataaaccgcacaggtatgggtggcactcgccaccaacaaggtaataataatcgtgtgccagatgatccttatgctaaggttaagtttaaaataccatctttttcgggatattatgatgctgagaaataccttgattgggagatggcaatagaacaaaagtttaatgcccaccttgtacctgagcaacatagagttaaacaagctagtagtgagttcaaggattttgctatcatgtagtgggctgggttatctgatgagggggtactacctactacttgggaagaacttaaggtagctatgcacgataggtttgttcctccatcttatcatagagatttacgcaagaaattgatgcgtttggaacaaggggataaatccgtacaggattactatggtgagctacaaaagggtgtgagacgctgtggcatagtggagggggtcgaggatgctatttttcgtttttattctggtttgagggaggaaattcaaaacattgttgattataaggaatttaactctatgaaccagttgttttggtttgcaatgcttgaagagaaggaattgcaggggcgtgaccatcagggcaagaacaaggcaagcacatacactccacgcacgatgccatctacgggactacccagggccgtttcttttcgggcgccttcccagccagcgagcaagcgaccagctgcattcggagcttctgcggcaccaaaaccatctccaccacaaccagcagagtcaggtaatggttcttcgcaggtacccgccaagagtgcctcatctgtcgcctcgacgggacgcattcagtgccaccgttgccaagggtttgggcatgtgcagaaagattgccctattcaacgggcctatgttgctacagaagatggctacatcaccacctccgacgtggaagaggaagaggaggaagaagaagttgaggatgaggatggagaagtctttggccgtgatgacacaactgactacaggaccatcgttgtgcagcgggtgctcagcatgcaggtacagcagcctgagaggttgcaacgccataatttgtttcagattttcttcgtcatcaacaaccgtcgtgcacgtgtgatcattgatggaggtagctgcaacaatttggtgagttctgatttggtcaagaagcttggcttgactacacgtacacatccacatccttaccatattcagtggttaaacgattttggaagagcaaaggtaacacaggtttgtagggtttcgttttccattggctcatatgcagattctgttgattgtgatgtggttcctatgcaagcttgttcacttttgcaaggtcatgcttgggaacatgataatgatgctacactttagtgcataatggaaagaaaattactttgctacctttgacccctgctgaaattgtagaagctgataaagagcgagctgctagtttgaaacttgatgaatctgaaaatcagcaagtggctaaatctattttcctacctaaaaaggataagctttcacctagttctaaggttgagggaattaagttgaagggtggtgttatgcttgcaacaaaatgtgacattgctgaaatttcagatgatgatatttgctatttcttgatatgcaaacaagccttagtttctctagatgatattgctagttcgatacctcgtgttgttactaaccttttgcaggagtatgaggatgtctttccagctgagatacccccgggattgccacctatgagagggatatagcatcaaattaatttgattccaggagcatcattgccaaaccgtgctgcttatcgaaccaacccagaggagactaagggaattcagcggcaagttcaagatctcttggaccgcgggtatgtatgttaaagccttagtccttgtgtagttcttgtaattttggttcctaagaaagatagttcttgacgaatgtgtgttgattgtagagccattaataatattactatccgatatcgtcatcctattcctaggttagacgacatgcttgatgaattgtgtggttctataattttcacaaagattgacttgcgtagtggctaccaccaaattagaatgaaacttggagatgaatggaaaacatcttttaaaactaaatttggtttgtatgagtggttagtaatgacttttggtttgactaatgcacctagtactttcatgcgcttaatgaatgaggttttaaggccttttattggacgatttgtggtagtttactttgacgacatattgatttacagcaagtctttggatgaacacatggatcatttacgtgctgtttttaatgctctacgcgatgcacgtttgtttgctaacattgaaaagtgcatcttttgcacagaacgagattcttttcttggatatgttgttactccacagggaattgaggtggatgagtcgaaaattgaagccataaagagttggccggttccctaaaccatcacacaggtgaggagttttcttggtcttgcaggattctatcgccgtttcgtcaaagatttcagtacctttgctgcaccattgaatgagttgatgaagaaaggggtggtcttccattgggaaaagacacaggagaagtcgtttgacactttgaaggacaagcttacacacgcaccattgctacaacttccaaactttggtaagacttttgagttagaatgtgatgagtcacgaccggaaataacccaacgggcgttccttacgtgcgtgtattattccttgtcccaggaggcaaggtacaccaaaagttgatacaatacagagtttaacaagcggaagcgtaaatagttaatttattacatgggcggcgaaggcccagcacacatgaagacgaacgaaaaatggcggaagactagggcgacgaccacaggcgcttgacggcaggcacgagctagacaccaaagccttcatcatccagcaactcctcttctgggtttgggaaaaattgagcaagactaagtacaaccaccgtactcaacaagacacatccacgagtgcagaataaatgcaaaggagtacaagggagttataatatagggggttagggtttgcagtaaacagcattaaatgacagttagttgctcaaagctacttttaaaaacacgctcctagagctatacaatattattaaacaaggccgtgaacccacacgaacctgccttaacccaaggcctacgatgattcagaccgaactggcaacccgaccctgggtcccagctcgtcccaagccaacccaggccaaccattccacattttagttgttgacaggttttaagaatgaaaacactaacttgggtacattgctaggcttgcccataaccgagggcacgactattcgaataggttatactctgatcagaggtgtacatctttacccacaagacacatcttcctcacgtgcaaccacgtgccacataccaccacggtatacggacggaagacgtgacgtagttcccaacccatcctagccatagacaagagtaccgacccaaccccacctacggccggaacctccgggacaggcaggcaggattgagccgctagcagcaggacaccagccctgtgccatgacatctcgactaccgggccgcagctcgtgtagccttcatttgtcctagagatgtccatcgacccccgacttcgtccatctccatacgtgtacttttgtttataaccagactgagccacaaactaagccttacccactagacatgtggaagtacggtagtgctttgcaacagaggcccgagcttaatcctgatagtacccgaggtacgactaacaaaacccaaccacgcaccttgagcccagcctaaaaccgttttggtggttttgaaaagagggggaggtgtgtgtccaattccaacataagccagccattccatactgtccaaatgatatgagaattcccaaagtctaaagttataaaaccacctaatgttgcataattaatcagcgaagcatctacctaaattcatactagtggaaccatgaatagagtacccactagttggggttttgtttatcctagggtgaacaaggtaataataacaatagcaataataataaggtcgtaacaaagataaataggcatggctaaataaaacagtgataacgcgggaatttaaataaagcgataatacaataatttaaatcaaaataattttataaactgggatttaatatgctcaaggatgatgtgacttgccttgctcgctttcccaaacgtcggcttcaacctccacgaagagcggatcttctgaagctgcagcgtctacacgaccaacggaatggaaaaagcaggaacaaaacataaaaatgggttcttgacttcttaaggaaaaattagagacttgaacggttcaattccgagttcaaatggccaagttatggccatttgaagtttatatgctctttaagtgaatatttgcgaatttcttcatttaaattttaatttaagaaggggtttattgcgtcagccgaggggagagggcgcgcggaccgggtccacggggggtggggcccacgcggcatcctcacggtccacggtggaccgggcgcacccggctagcaccggtcggcgccgtgggccccaagcgtcagccgcacctaaggacgtgggcggctgacggccgggccccacgcggcggccactcggtgcgctcgaaggcggccacgccggcacggtcggcgggaggcagcgcccgcgcccctatggtcgctggcggcggccataggcacagcggagcagcggccgagagaggggaagggaagggggaaaagaggcggcggtccacggctcaccctaggtcgacggcgacgacgaaaaaggcggccggagcggaggaaggcggagcgcggctcgggtcgacggggtcgacggcgttccggcggtcggcgggctcggcgacggggtagacggggtcgatggcggtgcggcgaagccggaggaggcgacgccggggctggagacggtcccggcgagcggagaaggccggccggaggtcgtcggcgacggaggagagagagggcgacggcgcgagctcgattccagcgaggagaaggcgcggcaaagggtggaaatgggcgaaggaggtgcgggtagggtttaaatagggttggaagggggagagggtgccgggagaggaaggaaaccggccgggaggtccggccgccatcaatggcgccggcgagatttgcgggggcaaatccgcctgtttgaacgcgagagagagagggaaaaatggggggaaagggagaggggatcatggggaatattttcccccactttattgcacgcggggacggcgggaggcggcgggattcgcggcggcggcggcgatagggcgcgggggaggcggcgggagcggcgggaggaaggggatgacgggtgggccccacccgtcagcgagggtggcgggcgggcccgcctgtcagcgacgcgcgcggggggaggggccgaatgggccgcgggggagaggagagagagggggagggagatgggccgagccggcccattagaggggagaggggtttttagggtttttctttttataaaacctttttaactttgtttatttcttcttaattattatttgtactctgaaaattccactaaaatttatttacacattttaggcttttaggaattatacaaaaatcctccaagccttatttgacttttagtttgcacattttaatttttggaggctttcacaaggattttaattattctaggtataattttaagggatatattttagggtcgttttgggacgtgacatgatgctagtggagttggcattggaggtgtgttgatgcaagatggtaagcctgttgcatactttagcgagaagttgcatggtcctgttttgaattattccacgtatgataaggaattgtatgctcttgtacgttctttagagacgtggcgtcattatttgtggcctaaagaattttgtattcactccgatcacgaatcgcttaaatattttcgctctcaaaataatttgaatcgtagacatgctaaatgggttgaatttattgaatcttttccttatgttatcaaacacaagaaagggaaagataatgtgattgcaaatgctttgtctaggcgctatactttcttgtcccaacttgattgtcggatttttagacttgaatcaattaaagaacaatatgcgcttgatcctgattttaatgaagtgatgttaaattgcaaagagggacgtacttggaacaaatttgttatcaatggtggatttgtttatagagctaaccgtctatgcattccagttggttcccttcgtcttttgttgatacaggaagcgcatggaggagggttgatgggacattttggagctaagaagacggtagatgttttggccatgcatttcttttggccaaggatgagaaaagatgttgagaggttcgtggcacgttgcacctcttgtcagaaagctaagtctcgtttgaatccacatggtttgtatatgcctcttcctgtaccttctattccttggacagatatttctatggactttgttt

SEQ ID NO: 2643 - DNA, 1349 bp, Oryza sativa
gcgcgaatcacgaagtgagtttttgccacgaacgcacccagtaacactccaatatgtccaaaaatcatgttttggcgttttttgaactttttgattccggtcaaaaacaacgctccttcgtgtgccaatattggcattaattgacaaaagttcgccgcgcgaatcacgaagtgagtttttgctatgaacgcacccgatacactccaatatgtccaaaaattatgttttggcgctttttgaactttttcattccggtcaaaaacatcgcccccgtttgggccaaaatatgccaatattggcattaattgataaaagttcgccgtgtaaatcacgaattgagtttttgccattaacgcacccaatacactccaatatgtccaaaaatcatgttttggcgttttttgaactttttgattccggtcaaaaacatcgcacccccgtgtgccaacattggcattaattgacaaatgttcgccacgcgaatcacgaagtgagtttttgccacgaacgcacccagtacactccaatatgtccaaaaatcatgttttggcgttttttgaactttttgattccggtcaaaaacaacgctccttcgtgtgccaatattggcattaattgacaaaagttcgccgcgcgaatcacgaagtgagtttttgctatgaacgcacccgatacactccaatatgtccaaaaattatgttttggcgctttttgaactttttcattccggtcaaaaacatcgcccccgtttgggccaaaatatgccaatattggcattaattgataaaagttcgccgtgtaaatcacgaattgagtttttgccattaacgcacccaatacactccaatatgtccaaaaatcatgttttggcgttttttgaactttttgattccggtcaaaaacatcgcaccctagtgtgccaacattggcattaattgacaaaagttcgccgcgcgaatcacgaagtgagttgttgccacgaacgcacccaatacactccaatatgtccaaaaatcatgttttggcgttttttgaactttttgattccggtcaaaagcaacgctccttcgtgtgccaatattggcattaattgacaaaagttcgccgcgcgaatcacgaagtgagtttttgctatgaacgcacccaatacactccaatatgtccaaaaatcatgttttagcgctttttgaacattttcattccggtcaaaaacatcgcccctatttgggccaaaatgtgccaatattggcattaattgataaaagttcgccgtgtaaatcatgaattcagttattgccattaacgcacccaatacactccaatatgtccaaaaaacatgttttggcgtt

SEQ ID NO: 2644 - DNA, 18892 bp, Oryza sativa
  unsure (1)..(18892): unsure at all n locations
caatgggcttgtaactttgtttgggaccctggcccatgtggggcccatgtggggtgcgccccaatctggtggagcacgacccttggaccctcttggtagtcctcccacctctataaatagttaggtaccccttcagggtttcttgggttttgttagattaaagtttagccattgctacttgcttgcagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaatagggttgatctgcaccggcaagatcagcaacccacggagaggtgtatcgatcgctaaggcgcaacacaacgtctcgtacggttgtagtcggatcgtcaacgtttctcccaaatcgtagttatcacaactcaccgaaagattgggccaacaacagccttgagtgtcgagaggaactcagggtacatcaaagtatgccatgtttaatccctaccgagctccacacataaaccttagagtaggaatcaacaaggcaacatttggtaaggaattcaggttgatacatttagagagactaagtgaatcatttgagaaacttggctttcttttacaaaatcatttgaaaacttccggaataagaagttgaataaagatcgggtgattggtgctctaattgttgttatgtctttcaaccgcccaaggcaaggagaagcagtgtctcgtgggaatcaggggtaagggtaagccaccgtgccaaatattatttaatccgagagagagtacatataccttgcattgccaaatattatttaatccgagagagagtacatataccttgcacctatatctttgagatatgcagcatagtagcaactcctgaacaacaaccaagtctttgtttcctttcatccttcactcgggacgagcaaaagttcaagcttggggggttttgttgaccgtcgttatcgattagttgcgaccgtcaatattacaaaaatagaggagaactagtgatgcttgcaatacatatatctgttagaataataatattccactagtattaggtatactaaccttttgcagagaatgacaataaagtggaggagaatcaacatcaactcagacgataaatcaatcggacggtgttgagaaccagacttatgtatgaatgggccaagaactcagaaataacatgacacattaggccaaaattcacaagtctacaatggaggacaacaaaggaggccgccagctgaagatgggatgggttgggccagcccatggttcggccgaaccatagggctcggccgaacctcccgtggcgccgatggatgcagggtttggatggatggctgggattgatccccaatggcagttggaggatattaccgaccattccaaccgtcacaaccgtcattacctgcctataaaaggagctcctcttctcacttcactcacacacttcaagcaatagctctctcatttctttcaagtttagtttagtagtatctagctggtggaatagaaatagggtaggaatcaggagtccggaagccttcggaagagttcgggtatggctctaacagctttccttttctcttttgtaagctttgtacttttattagaatagtcttctaaatacatttatggtattgaaatattttccgagtatgtgagtacctattttacattatgttcatgttatactgtggggatacccgtgaccgtccaggatttcgatcgtgcacagattgatatacagaacagctttcgatacatatacccaagttttacataaattattacataaaagataactaagacaggttttaggggccgacaggccaaacacactccctacaaacaaaagacccaaacacaaaataggataaaaacaccacaggcaacgcccgagagcagatcgacctagaacaagaactcgtcagcaccataaaattcttcccgttcctacgcctcctcagggaaaaactgatcgtctgaaccacattttatgcaagaggtgagtaccgaggtacccagcaagccacatccataataatacaaatagaatatatgcaaggcgtaccaagaagaatatagttcatcaaggaggtttcattacaagcctattataaatagtttttccctactttgtaaaacattttatttgcaaacagttgtaaattatcattttaaaatagtagcaatattaatcaccattcaacctcatcttcatcatattccatattttaatttaaaatctactcataccatgataaataggaatcacctaatgacatagcttctcaaccggaagcatggcacattcgaatgatttaagactcatctctgcagagactgcccagctttacccacctgatgtcaatagctagctaagctgaggacaacatagccgttcgagagtcccacttactactagttactgcctagtgggatattgatccatcctagcagtcgggcacttgttgggcctaagcaaggctagacggtcgttgctttcacgggttccaccattgcggatcatgtcaacctggccgaagccccttccacatgtccaccccaaacctgctcatagagccaccctacagtctttcatatagtgggacaatgtactaggctaagtctgattactcagtcctgtggatgggcgcaaattacatcattttccatggcataagggggtagtccttatatccggggaaagccaccaaaactagcacaggcccgtgcatactttaagtgtaaatatacactttccacaaaataattataacaatatgcacggcctcacacaccacaacatccatcttcacccggaattaatcttccatatcactccaggtgagtgactcatatcaaataacatattttatatcacctgacacgccaccacatgacgacgggtaaaccatgtatatgagtatatatatttggtggtcttatccactagaatattatcgtgaagtatataaatctacacctaggttatcaaaggacgtgatataacaatccatggatttggctaataataacaatgtaataatgggtaataactaaactaacaagtttattaaaaaataattcatatgcaaaataattttataaatactcaatgcataaaataactaagtggttctctactaggtttcaatatgatcaaagattggaactgtggcttgccttgtggaacgtgtccttcggaagcttcaacgtagccttcttggtccacttcagttcctgcgagtccagtgggatcttcaacgcgatctaacgtacgcacaagaagaaacgaccaaataagcctataagaaaaatactataaataagaattaaaataaatggtgaaggttggagccagaactgtggaaagatgcactagaagttctatggtttcaaataacaaaatatcactgtaaagcaggggtttatggtgtatacaagaatggacatgatgcagaggtttgggtactggaaaccggaagaaattgtgtctagaggtggccgaaccaaaggtgaaccgaacgaaaaattattgaaccattaaacagagccttagccagatttgtttagctctgtttcctgtcttatggttggattcaaccatgatggcacagtaccacgtactactgttcatcttcttcagtgagacgaacctaggggcaagggaatagagaacagggaaaaagtaggaaggtggatgctaggctgtgatgggtgataggtaaggacatcatgagcaaaacacgttctcaagggtcgcgaactcgatgctgttgttagttttcagagacgacacccacaccgccggaacaggagttccagatctggagctatggtgacaccgggcatggaagtggcagctctggtggtgaacgcgggcgggtgagcgcgtcaaaaggcgttcccggatgagaaggttccatttttgtagttagttgataaagaggacattctggacgtgttggccacggtaatggccatgacagcccatgggagcttcggaaaagctcgatacaaaagcggaaaaagagggaaaataaagaaagaagcctcaccgatgagtggcaaagttgatggcgtgctgttgtggcagaaaaagggccagcgacggtggatttggccagtgaccttggcggcagtttggagtggtttgagggcagggatgagcttgagtgctcggtgtttccagagaaagaagaagaaggggaaaaaggaagggagaaaagcctctcgctaagattcgcgcgacggctatcggagatcggcgcgtggctcgtatgaggcggcacgggcgagcgtgtgcgagcacgggaaaggcacgaggcggcacgcgtgtagcgcgagcggccctgagcggcgtcggcctgcagcggctcggctggagccggcctacctaggctgggccaggacatgggctagaacagcccaacacagagagtgaccaaggaaaaggaaatccggaatatggcctggattgcaaggaacatggcccgagcagaaacacagtgttctatttgaatttttggagagatttttgtatggaattttggtaggatattttttaataggaattgataggatttgggatcttagaacaattgcatgatgactccggtttaacttaaaataaacatcagctcttctaatgattttgggaattttctctaggatatctcggattttgtttggtgagggaaactaaacaaggttatgtgggagtcgtaaacttagagggaacaaaagaaatataaggattgggaggctccaattcgaaagaacgaagaacatcgactttaaatattttcgcaaaaaaattatcttgaaaaatctagtatgttacatatactgaatatacggctagcttatctaggagatgctttggtgcgggtataatgtttgcttatgcaattactctatgtcatgacgatgatattatagtagtatctggtagtttagacgtggtgtctagattacgggatatcattatttggggttatatattgcggatgggaggtgggccgctgatggtgacagctcagtacgggtattcctccgcgccggtatatagtcgtaagttaatttcctggggagggtattcctccgtatttagctccggctgtatggtcatgacggactgtcgtaaggaactcgatagtcaggggtggcttctcgatgtaccaggagggcattggatagagggtattagctagtatatcagttaactagaatgtatgtatactatgtatattagaactataggaatagattttctttctcttttctttccacttagctcagataatatattatgagaatgagtagtaatgcttgtgtgtcactctacccttggattatcttaacccctgcttagaatatgattatcacaagtaatatataaatttttagaatatgattatctctctctactctcggttgaaatgctacaatggtatatccgtgcgcttgcggatgaactctgtaaccataatataccagaagtatttctgcgccattgctggaaattatatttctagtaatgtcgttaaaaaataccaacactcgggttgccgagtttcttacgacaacctgtcataaccctccaaccgaagtaggatacgaggtgtatccaaccccaagaaattgtatataaactgtagggaagacgcccgtactaagctgtcactatcagcggcctgcaaatcacctagagaatatacccccaaataatgataagtgataacctaaaccacatgcttatgttactacttattactctacagccttgcaatcagtgccgagcatctgagtccccgagacataactctcggcctagccagagcagacttatgacccggtaatcagacattataccagcatcaatgcaaatcccagaaggtttaaccacacagattatactacttacaaataaactaagaatggtactcatactctatgatcgtaataaagtaccgaacttgtatattatattgataaatggaagtcttacaaagaagaaaggaaaagctatagaacctttaccgaactccccgaagcctccgtggacttggaactactctaactctactctactaacactaatactaactttgtagagagctttgatccttccttgagtgtgtgttgaaagtgaaggaggtgaggtccttttataggtaggtatgatggatgtagagtatgggaattgtcggaaatgctccgcaaccgccatcaggagttcatccggagcgtccacgccaaaccccaacctcaatggctgtgatgggggttcggccgaacaatgatctggcccaaacggcctaatttttggcaggctgactcctcatttgctcctcaatccaaaacatggaattttgggcttaattgatgatgtcttttgtgagttctcagcccatctatccataagtctggatctcgaaagcctctgattgattgatcgtctattttgttgtcgattctcctccatttatatgtgcttctccaacatagatgttagcagcatagtatatagtggaagtagatattttatttggaatttatgcattgcaagcatagctagtcttcatacattgggtaatattgacggtcgaaattggtcgataacgaccgtcaacaaaaccccccaagcttgaaccgttgctcgtcccgagtaaagaatgaaaggaacaaagacttggttgtttattaggagttgctgcaatgttgtatatatcaaagaaacagatgcaaggtatgggtactctctctcaaaacaaataagtttggcacggtggcttacccttacccccgattcccacgagacactgcctttccttgtcttgagcggttgagagacagaacaacaattagagcgctagttacccattctttattcaacttttattacgggagttttcaaatgatttttgcaaaagaaagcaaagttcctcaaatgattctctagatcactcaaagtgtatgaatatggattcctcaccagatttgccttttttattcctactctaaggttgatatgtggagcttggtagggatcaaacatggcatacttgcattcacatttattactaggtcaaaaacttagactaaaatagatgactaatactcaagatcaagatcgtgcaaagtgtgaatatggtggaaaaatatgatggaaaataaaatatggataaagaaaatgcttctcccttgtgcttatgcttttcctccaaaatatcctttaattttcatagagagggtatggctactttttctcctttttttccttttttttttcatgctccaattttgggagagcaagaatatattatttttctcatagccatacctttccctcttttttttttttgcaaaggatttttctttggaaaggaagcatggatgtagaacttatttgtggataatgatgacatggatatggtagatgatatggatgctatcttccattgtagaagcttagcatatgtgtgcatatgtgggtgtatgatcttgatcatagagcatgaaaagtatctacacaagtcacaaggatttgacaaaatttaatggaattacaagtaaccaaaatgtatatggcttaatcaatatgaatattttggctctggtaggaattcatatcaaatgaggaactttcaaaattatcattttgaaaaataaaacatccggaattcaagtcaaacttagaacatgattatttatagcaactcttatttactatctcatatctcgcaacaacctagactcagatcagcaaagtgcagctcacttacctcaggttcctggataattgtaggctacccttattcaaattttgagagagtacttaaccatgaacccatatatgagagatataaaacagagcaactattcatcatttcaacatgaagaactaagcatgtcttacctagcatattaaatctaacctatctttttggtatttttagttttgcaaatttttatgttgttttcaggtttataaatgcaatgcaaaaatttaaacatgtaatttgaaagggaaatatgcaatatgatacaagttaccttagtggggggagagacatctctcccccaagcttgcttcttgctatggctcatggcggggatcaaatccctggtagcggtgaaacgcttgccagtcagcttgctattgttgcatcatagtgttgaagtttgcaacctgtgcatcaacagactgttgccattcccgtgactgtaccacattatcctccaaggtgtgttgttcgttccctgcctacagttcaagtgtatccatcctccgggtgagttctcccagatcccctcgagaggagacagcgacacatccaagaggatgaaggtggaccacttgaattggaggagcgcgagtatccccagtgcagctcctacggctcatgccatcggccgtcgctggcactctgccaggacgaaccaccagcgtcatgttgcgggatttgggttcaaccggggacatccgcggtcgggtcccaatagtccccatacatttacactggtggtgaagaggaagacgcctcctgaggtgcttctctcgccattcgtcatgttaccctgcgtgggacatcacgatgcaactccaattggagtggaatggttagttctcggcaattatacaaatgaaactccgggttaggtaaaggaatctcatttgtatagccgggaaacaaaaatataagataatcatttggaccatgtttgagtatgtggcattgaactaaataggcctcatcaacataagagcgggtgataggaatacttgcttataaagcatagtcccaactcttcatgctgaacgagtcaccaaagaaatacactcaaaaggaccagacaacttcatattttctaaccattgcttgatcatgggttgaacaggtgaaactttgattttttttattaaccatggcatacaagaggactagttcgtcttcacaaactatctggatatcagctctaagaaacaacatgaaaccaagcaacttatgcaacagccccaaggtaggatgatggatgtcactagttctaggctttttagaggatgagaaacctgaaatactttgccaaaacatacgcttgttaaaaaccaagaaatgcgttcctgaaattaactttgcatgttttgtcaaagcctagatgcaagataaggtctttccgagaaaggtgatattccttgcggaataaccagaaagtacaccatcgcctacctctagcaaggtacatagaaactgcatggtaagcaaacaggaacccagctcatctacacatgcaaatttatcccatccaacagcacgtcaaacagtatgaaactcagcatccatacctatccttttcaaaaggtcgagttgtatgcttaggtctgagcacacgttcggtccttcagcatatgataggcttgcatttcctggtcgcccacgaggtcgagatcggagttgtcgtacagcctcggtggaacgtacgcctcctccatggatgcatccgcagaagaaggtgtactcggcttttcgtgtcggcttgtccgtgagcttgattgtctcttgaatatgcccggaagtcgtttcttcattacagataccaagccagcatacagatggcaccgtacgaagcgttgtatggccacaaatgccgaacaccactattgtgggaccaagttggggaaagccaagtgttcgggaccgatatcttgagagaagctgaagcgaaggtcaggaccattcgggagaatctaaaggtggcccagtctcggcagaagagttatgcagacaaccgacgccgtgacctggaattcgtagtggatgactttgtgtatctccgggtcacgccgttgcgaggcgtacaccggtttcagacgaaagggaagctcgcacctcggtttgtgggtcctttccggatcattgctcgacgcggagaagtcgcttaccagttggagctgcccgcctccttgggcaacgtgcatgatgtgttccatgtgtcgcaactcaagaaatgccttcgagtgtcgtccgagcaggccgactcagagcagattgaagttcgcaaagacttgacccacgtggagagaccggtgaaaatcctgggcgccatggagcgcaggaccaggaaccgggtaatccgtttttgcaaggtccaatggagcaaccacgccgaggaagaagctacttgggagcgtgaagacgagctgaagacagcccatcccgttctcttcgccagttcttccgaatctcggggtcgagattccgtttaaggggggtaggtttgtcacgtcccaaaacgactctaaaatatatcccttaaatgatgcctagaataattaaaatccgtgtgaaagcctccaacaattaaaatgtgcaaagttaaaagtcaaataaggcttggaggatttttgtaaatttcctaaaagcctaaaatgcgtaaataaattttagtggaattttcagagcacaaataataattattaagaaataaacaaagttaaaatgattttataaaaagaaaaaccctaaaagtcccccttcatgaatttgatctttcatgatttgttaggtattatcctagagatctatattgatgatattgttctcaaatcggatggtatggaaggacacatagcagatttgaggttagcttttgagaggatgcgccgaaatggtttgaagatgaacccacttaaatgtgcttttagtgtgtcggcggggaagatcttaggattcatggtgcaagagagaggagttgagattgatcctaaaaagatagagaagtttcgtgatttcaaagagccgacatgcaagaaggaggtccaaaagttgctaggtaaattgaattatttgagaaggtttatttctaacctagtgggtagaatcgatgcttttgttcctatacttcgcttgaaaaaagaagccgattttacttggggggcaaaacaacaagaggcgtttgaatagttgaagagatatttgtctactccacccgttgtgcgagcgcctaaagccggaaagccttttcggttatatattgcttccgaagacaaagttattggtgccgttttgatgcaagaggaagatggcaaggaatatatcattacatatttgagccgccgtcttttagatgccgaaacgaggtatgtttttatagagagactttgtctatgcttatactatgcttgtaccaaattgaggcattatttgttatctagtacatgcattgttacttgtcaagccgatgttattaaacacatgttgagaaggccaattctaagtgggagaattggcaagtgggcatatgctttaatagaatatgatttggcttatgaaccattgaaatctatgaaaggccaaattgtatgtgattttatagtagaccatcatatagatattgcttatgagggagaggtttgcttagttgaagttataccttggaagatttattttgatggtttttcttgcaaagaaggtcaaggcataggggtagttttgttttcacctaatggcatgtgttatgaagcatcggttcgtttggagtattattgtacaaatactcaagccgaatacaatgctttattattcggcttacaagttatggagatggttggagctaagtacgtggaagcttttggtgattcggaattggtggttcaacaattcgccggagtttacaaatgcttggacggatcactaaataggtatctcgattcatgtttggatattattgccaattttgatagttttgttattagacatattgctacgcgtgataattctagagcaaatgatttagcgcaacaagcatctggctataatgtgaagaagggattatttctgatattagaagagccggtgcttgattttaaatctttgtgcgaaattggcaaaactggagaccaggggcggtctgaccggcattgcacggccggtctgaccggtgaccaggggcggtctgaccggccgcatgccgccggtctgaccggcgaccctgagcggtctgaccggccctgcgtggccggtctgaccggttctgggcagaacgctggggggcacatttcaatcaatttagaggccgaattaagtgtgaattcggacatttgtgcccagggaacagaagaagattggagaattcctttgattcgatatttgaaagatcctacacttaaggttgatcggaaaattcggtggcaagcattcaaatatacattgtttgatggagattgtatcgccgaaatatagatggtgtcttgttgaagtgcttagatgaagatcaatctaaagtggctatgggagaggtacatgaaggaatatgtggaactcatcaatcggcccacaagatgaattggttgcttaggagagtgggattctattggccgaagatgattgatgattgcttcaaatattatagaggatgcaaggcttgtcaacggttcggcaatgttcaattggcgcccgccgtcatgttgaatcccataatcaaaccatggccgttccgaggatgggctttggattttattggtcaaatttatccttcgtcatcaaaggggcataggttcatgctagttgctacggattacttcaccaagtgggccgaagccgtttctttgaagaatatgactcatatggaggtaattgaatttattttgaagcatattatccatagattcgatattccacaaacattaactacggaccaaggtgcttcttttatgtctaaggaagtgaagagttttaccgaatcttatggtattaaattgttgagttcttctccttactacgctcaggctaatggacaagccgagtcgagtaataagacattgttgaagttagtgaagaagaagattgaggaacacccaaagaggtggcatgaggtgctttccgaagcattgtgggcgcataggatttctaaacatggtgccactaaagtcactccttttgagttggtttatggtcaagaagccattttaccggtggagataaatcttggttctcttagttatatcaagcaagatgatttgtcaagtgaagattgcaagacattgatgggagacaatcttgatgaagtcatcgacaagcgcttgaaagcattggaagaaatagagaaagagaagaagagggtggccaaggcgtacaacaaaagggtgaaagcaaagttgtttcaagttggagacttggtttggaagataattatgcctttgggtactcgatccaaggagttcggtaagtggtctactagttgggatggtccttatcaagtatgcggcattgtttgagggaacgcatattttttggagacacttcaaggggagcattttcagcgagcaatcaacgggaaatacttgaagaaatacttcccgagcgtttggcaagacacttaggaggtactatggccggtaattggattatcgtcctaagaccaaaacatgttctatgtttttagattcacgttgttcatcagacaggcaggggggcatatgtttacacccaaatttggcacctaggattaaaatagaaaagattgccaaaattgggaagtctaccggttttctccgagtggaccggtctgactgccgtgtgttggccggtcagaccaccggttgaaggccggtcagaccggcggtgtgtggccggtctgaccggcaggtccgagtctgactgtgtttcgtcgggtctcgaggtttccttgctcgggaaggcatgtttcgggtttcctttggtttctaccccgagttggacgtggaggagggcctgtagagggcaagactaacccctatataagggacatggacggttcattgtaaaaaatcaatctacaatcaatcaatcgaatcgtttttcatattgcttttagttttctcttagtttgtccatctttgtcggtttgcgccgtaaaccgtccgccgccgctgcgagagtgcgacacctctttgtaggtttgtcctgaaaaccttccattttgcccacgagacgggtagttatctagaaatcggctctgctagccggtttagttatcaaaacccatctaggtttagctctttgctagatcgaggtggttggcgactctaggatcaccgcaaggctttaggtgctgcgatcgtgcttgtcaacttgtcacaaaacgttgccaacagtaacaaatatatttagcatgtgagacattaacccatatatcctccacatgcagtaacactatagcatcattgtgaaaacggttttaaaaataatacatatcttgtgagatattgcttttcaaatattggtatttttgaactttagcactccttatgaagtaacagaatatgtaatttgcagtaacatgggtatatacatgcagtaacatggttttaccaaatgtataaaattgttcaaaacactcgtacatcaatcagacctcactcaaagccacctacagactttacctatagcccacctattcgatcttcatctcgtaaaactgacatagtaaaattacgattatcgtgcagtaacataactacttggaagtggtaacatgcacccattatgcagtaacacttctacttttgtgcagtaacaagtatatacttttgtgcagtaacaagtatatggttagcatgtgaggctttaacccatatatttttgtttcgattcctggtctactacaattttactacgatgttactgccaaaagtgcagtaacgtcctatgtgttctacagtaacgtcatgtgttactgtacttttacaacaatgttactactagagcatagtaacatgttatgagtttcggtagtgaaagatattagaattgataatcatattactttctcacaaaattcttgaaacaaatagcatcattagataaattggttagaagaatgttctttgaactatgaggtcatgggttcaagtcttaaatttggcaatttattttttatttttctagaaaagagaaaaaaatgtttcagggagaaaaaaaaacagaaaaaagaaagagagaaagatcaggaggagggagggggagcgagagagatcgggaggagggaggggaatcagcagagagaggggggaacaggagggagagaggggaggagggaggggaagcaggagagagaggggggaacaggagggagagagagaaaaaaaaacagaaaaaagaaagagagagagatcaggaggagggagggggagcgagagagatcgggaggagggaggggaagcaggagagagagtggggaagaggagggagagagaggggaggagggaggggaagcaggagagagaggggggaacaggagggagggagggatacggatgagaaagggagggggtatagaatagtcttaccatatatatatatatataaaactaataaaaatatttggatttttccggtcgtcacctcgagtccttacggtgatttttcatcccaccctcgaatcccaatcgcaagccaaaaaaaagaaagtccgaatcccaatcgctagccagaaaaaagaaagtccgattcaatcaaaagggcgataaaaaaatctattggtctgcttcgtccgtcgcccacatcacgcgtgccccctctccaaatcggaatcatcacaaaatcatcccctctccaagtcccaatccaaatcggaatcatcacaaaatcatctaaaatctaaaatagttcataggaaatcaacaaattatagtgtaaaacaaatcacacaggagggaggggcgagcgctactccttgccagacctccacgccgcctcgctgccgggagctgtcgaccggctgctgctccagggatccgccgaccagccgttgcaccgagagggatccatcgctgcgccggggatccgccgacccgccgctgggccgccgccgccgcctcccctccttctagatgcggcggaggggagggngccaccgcctcccctcccctcccgccagatccgggacaccggatctggcacacagggccgcctccacctcctctcccgctggatccagcggatgggagggcaccggcggcgccgccgccgagacactgggccgccgcccctgcccgccgcctcccctcccgccggaaggaagggtctgcaattcctatttctatcatctcatgcaaaacgaggagaatgcaaggcaagggcgagaacaataaaaggaacaaatccttttaggagggattgctggtcttcttaatcctctattgggcacaagaaaaaggcttttttgcctttttcttgtgtcgattcttcttgtattgtatcgaaatatgaatcttttttcttcctattcggcaaagattactatttcttctttatttgggtctgtctcttgaacctcttttgcttaggttcaggcgatgtagtggacaaaaagagggaaagaaaatatggcgggggacaaattttttgtgaccaaatagaattgcttgacttgttcaattaagttcaatttagaacttacagaaattttgcaaaaaaaacggataccacctgcaattttctcgtcgctggtagagggagggagagcggaggaggagagaatgagagaaggcgcgcgggcgaaagagagaggattagtgcgagagaaagaaacgaggcgcggtgggcggaagaaacgaggcgcgcggctcccaccgctttctcgacgtatgcggatgcaaaagtcacggactgtgacttttagtcactcacggtgtgactttcaggtcatatccatccgtccgttcctttttttttgactaaaaaaattaaggttgcaatttgttattatgtgaaataacgatatctatatctatctactctatacctaattacaaaataagtaaggattccgtaaatttgttttgtctgtcgttatattattttttttcttccacaacgcggtttttttatctggtttattttccgtctgattggttttctctcaggttttttccgttcagctttttttttggcgcgtgggtttttatggtttgtttttttcccgtccgattggttttctctcagtttagggtttagggtttagggttttttccgtccgattgttttggatcgaaaaaaataactaactggcaacacaacaaaaaaacatgtatattattaaaaaaacagatcaaccaaatcaaacgaaaaaaatgagcgacccagaatagacctgaaaaaaccatgtttattattaaaaaaccagatcgggcaaaaaatactcggaaaaaaccatgtgtattcttagtgggtcacgatttttttgttgtgtttttttggtgggccctgttttttccaacggctgttttcgatcagttttttcttgtgcacacggaaggattgaatcccaaatagagttacctaatctctatctttacctattataaaaattgaagatgatttcatactcaccttaattttcatccgtcatctgtgttagacacgtataaaaccaaattggaccggaaaaaacaaccaactggaaacacaaccaaaaaaccagatcgaacaaaaaaaaccattgtattattaaaaaaaatcaaccatgtctattattagaagaaaaaccaaatcaaatggaaaaaatgagcgacccggaatagacatgaaaaaaccatgtttattattaaaaaactagatcgggcaaaaaaaactcggcaaaaaccatgtgtattgttataagaaaaaccggatcggaccggaaaaaatgagcgacccagaggtcaccgttgtcgtttctgtctctatcaataaaaacaattttgttagtcgcgttctgctgttcaggtgttcttcgttgccaatgtccaccatcaatagatgactccaattgttggacacatcctaccacagtccgcaccaccgtttgatcgtcagactattcacgctcatcttgagtactatgagaatatgagtatatcaatgtgcaatggtggtttttatccatcctaattatcattaaaatttataatcaatacctagcctaagaaacaattaatccgtagcgaagcactggcattttgctagtgtgtgtgtgtgtatatatatatatatatatatatatatatatatatatatatagagtatgtgttccaatagtatctactactagataaacgcttttctctcccggttcgcaaccccttttactctcaggtagcgaactgggagaaagaaactgggacaaaagatgacaatctttagtcccggttcaaatacccgggagtaaatattcatctttagtggctgagccatgtcccagttggtccccttttctttttttttcattgtttctttcctacttacaaggttaatccctgtatttcttcccaaatcgagtaggattcatatcccaaatcaaaccccaaatccccaaatcaaagtaacatcccaaatcattcacatcacaaatcgtaagttacttatacaaacaaatcaagtacatcacaaatccttaaaaaaaattacacacaaatcaaatacatcacagattatacatctcagatccatgtaatgaatcacaaattctaaaaagagaaattatacatctcagtgaatcacatattatcaaaaaaaaagaaaaaaaaagaaaaaaggggacatcgacaaaggagagggcgaccggccgcctccatgcatgcgcgccggccaccgcttgccacggccggccccgccggccgctgccgggctctggccggcctgccccccgccgccgaccgctggatgggataggacaggggagaggaggaggaggaggaaggggagggtggacgaggagaggggagttgaggaggaaggggatctaaggggtagaaggagaagggatgatccaatcttatctaaatatcttggtgaggaatttctcgtgtgg

SEQ ID NO: 2645 - DNA, 17648 bp, Oryza sativa
acttagctcctttcctccctcaaatccgtgcgattaaatcatgggattccaaaattgattatagcgaattaatcccctttccctcctctctctttcccccacaattcccccttgattcatgcttttaatcacccggaacgcccgcgccaatcccggccgctttccatggccaccggccgacttttctgccgccgttctcacctctcccgtgcccggctccctccctcggcgtcgcagcagccgcccctaccgcctcgcccgcgcgccggtcggccgcgccgtctcctccctcggcgtcgcagcagcctcccctccaccggcgtcgccttcgtttcgcgcggaaacccccggaggtgcgtccctgccggcaacagtggtgttgccgccactgctccgcctccagccgcctttgccgcctcgcctttgcaccggccgacgtcgccaccacctccctcggctccgcttcgccgtcctcatctccggcatcacctcctcctcgcctgaagctcgccggagtggcctcctcgtcggtgtccagtacctccccgtctccggccggctcctgttcgtcgccagtacgccgatcgacgtcgctgtctcctctatcgacgtcgcaacgtcgtcctctcctccggctgctcctctgtttcgccggaacgccgtcgcccgtgccggcctctccatcctcctcgtcgccgacgtcccttcggtcggccgctcctcctcgccggctcatcaccccgctgcaccaccatcgtcggcatcgcagcggcgtgttccacgccgtcctcgtctccgtgcagctactgtcggctgccctcgtcgcctcatcgccggtcccggtcgtcgtcctcatcgtcgtggcattcgtccctccgtcaagccgatcgcgttcgtcgcccgcgtttcgtctagtgtgctgctgcagccccgtcatcgtcttcgtccttggctccgcgtcgtcaagccttgtgtcggccgtgtctcgccttcgtccaaggatcgccgccgaagtcgttccctcgccgttcgcctccgtcgtccctgagtcgtctccgccgcgcccgttcttcgtcgtcgtacccacgcctcgtcgtgtggtggtaaggatctctccttcactgcttccgtcctcgtcctttcggtgtcgccccgtgcccgttgtgcggctgtctaccccggtacccgtgtaccggtgtcggtagtcgttcgtgtgtgcgtgtggtgaccgtgtttgtgtgcccgctcggtagccgcgtggtttccacgtgtgcagcccgcatggtgtctagtggagtccgtttgtcggccacccgtctcggttgacacacggggtccgcttccgtcgacccgtggaccgtctctgtgtacccggtctgccgtggtcccttaggttgacatgtgcggtccgcatgtcaacagcgcagccttcctgtcttttccaggctagcgcttacacatgttttatagttgcaaagcctaattacaataatccgtaaatctccatataacaacattaaacttcggatgaccatgtcttggtcatacgagctccgaatcgacctgttcaagtctcctaatgtttgttataacctaaagaaccctatgctttctttttatgtattgttattgtttctttataggcttgtagctttgcttgtgtgcttcgcatagcttctgtcgttccggaggttcccgaagcgtggttcgtggtcgtcgccaaaggttcggaaggctgttctctctgagcaaggcaagtcacatcatccttgagcatattgaatcccagtttataaaattattttgttttaaattaatgcattaccgttttatttaaattcccgcgttatcactgttttatttagccatgcctatttaccttggttatgattttattattattgctattgttattattaccttgttcaccctaggataaacaaaaccccaactagtgtgtactctattcatggttccactagtatgaatttaggtagatgcttcgctgattaattaggcaacattaggtggttttataactttagactttgggaattctcatatcatttggacagtatggaatggttggcttatgttggaattggacacacctccccctcttttcaaaacccccaaaacggttttaggctgggctcgaggtgcgtggttgggttttgttagtcgtacctcgggtactataaggattaagctcaggcctctgttgcaaagcactaccgtacttccacatgtctagttggtaaggcatagtttgtggctcagtctggtcataaacaaaagtacacggatggagatggacgaagtcggggctcgatggacatctctaggacaaatgaaggctacacgagctgcggctcggtagtcgagacgtcatggcacagggccggtgttctgctgctaggggctcaatcctgcctacctgtctcgggggttccggccgtaggcggggttgggtcggtactcttgtttatggctaggatgggttgggaactatgtcacgtctttcgtccgtatgccgtggtggtatgtggcacgtggttacgcgtgaggaagatgtgtcttgtgggtaaagatgtacacctataatcagagtataatctattcgaatagccacgccctcggttatgggcaagcctagcaatgtacccaagttagtgttttaattcttaaaacctgcttaacaactaaaatatggaatggttggcctgggttggcttgggatgagctgggacctgggtctggttgccagttcggtctgaatcatcgtaggccttgggttaaggcaggttcgtatgggttcacggccttgaataataacattgtgtagctctagaatcgtatttataaaatagctttgggcaactaagtgacttttaaatgctgtttactgtaaaacttaacccctattattatccccttgtacccccttgcattaatcatgcatctgccggtgtggcttgctgagtactgtggttgtactcattcttgctctatcttccccccctttagtaagagaagctttggagaagaagtcttaggtgaagtcctggcttataccccagttgagcacctgtgaagatggagacgtaggcccgctagtccgctgctgtttatttttgtttgtcaggcctgaagtgcctttttaataatgtaaatattatcgatataataaagatgtgtcttttatatcatgtttgtgtggtgtaccccggcttttcctgggacggggattaatacactagcgttctggaaaaggtatttttccgggcgcgacaatatgattgtgattgcatgaatgtaatttatttccaaattatatgtacataatcaaacccactaatttcgatgtaattgctttatttccgtccatactaattaatactttctatgtcttgtgtgtatatatatacgtgcagcgatggcattctattttttacacactccagtttcatatctctatgccgttacaccgctggacgtcgaccgtatactcgagtcgctaccggcctatcgtataccgagccgttaccgcaaactgagttaagtctactggtcgtgccacagctgtacactagccataaatcgttcgttcgcacgaagtatagtccaaagcctagttcgttcggtcgtcccgagttgctcattattaatagagtcattttaagccaccgattttgttcgccggttcggttgaccgtttgagtggtctcgtatcacggtgggttgactcgttgagttgatatcccgcgaggcttgcttaccaaagttatatttccattgatctattttgtttaatatgtaataattgactatggttttccggttaatagtaattacacatctcatattctaaaatctatatccaaacaatctgagctccgttttaacccattcaagtttgtagtgaatttgttgaaatgtctagaatccattaaaattggtttcttttgctgtttcaatagccttattgcttgtatttcttgtgtgctttgtttgtcgtttagattccggcagttccgacgctccagtttattttgaagtggttgtcgaggttccgtcagctcaagagcaaggcaagtcatacatacagcactgatcatgttgaacctattttataaaatcccctgctttctattaaatagcagtatttttgaacgtcatgtgggatggatgtctatcgtactcagcctgttgatatctcatgccattgataacttgggatataattgattagatgattggtttaggaatgcttaaccatgcttagatcaattagttcacaatgggattcataataatttagtccttaattatatgatgatgtaccaccatggttattgtttaattaaactaaatatgcttagaaggtgggttgtgggtgcatggttttgctagtcttgcccatgacaattaaggaccggttctcgagaatccctgaaagatataatcatacttaccacaggctagcatgggctccaggctaaatctagagtataacttaacttagctaacatactacggcagtgatagatgcgatggtgccgttcggacctggctttggtctctgttgtttccggatttacctaggcacgagaggggactgcccgacttggctaaaaaggagtagggctggacgaaaagctcgtggctcttgtctggcttggctcggctcggctcgtttgaatttgctaccgagccaacctaaggttttagctcgttagctataatgagccagctcgagctagctcgcgagctgctcacaagctaaacaagtctagcccaagtagccatctatgactcatttagtgaaggagcctgttgacggccgttatcgaccagtttcgaccatcaatattacccaatgtgtgaagactagctattcttgcaatgcataaattccaaataaaatatctacttccactatatactatgctactaacatgtatgcaggagaagcacatataaatggaggagaatcgacagaaaatagaagaatgatcaatcagacgctgtcgagaagtagccttgtggatagatgggctgataatacagaattaacatgagtaaacaagcccataattcacatcactaggctgaggaataaacgaggagtacacttgccaagttctgggccagatggaccagactagggttcggccgaacccctaggttctgccgaaccatggcccagaaattccacaggccgatagttatcgacatccaatggcggttatgaccgtttctacctgaagcaaccgccgtggacacttttcacaaggagggagaaagatgctctttggatgcttcaccatgccacatgtcaagaggagagcaaaaatgctcctaggatgcttggagcatctccacactcccaaggcacctctccacctataaatacccctcctctcattcattccctcacacacctcaagaagaagatcaagagctctctcaagtattgtttagtagttctacagatagtggagtaggaaatagaattgtcttcatagtcctcgagttttcaggagatttcgggtatggctttaatagctttcctctcttcttttgtgagacttattaaattaatagaatattcttctttatacaagttcggtattttattccattcatattacttgagtgctgactttactttatactcgtgtaacaagctttccagataggtgtattgatgtgggtttagtgtccgattattcggttgctctatgtcggttgcaaggatgtagagtagtattttactaatgtaagcgcggtgcttagattattaggtaccactaattggggttatatactgcggatgagaggtgggccgctgatggttacagctaagtacgggtattcctccgcgccagtatataatcctaagttaattacttggggagggtactcctccgtatttagccctggttgtatggtcatgacgggctagggtggcttctcgaaacaccaagaggacactgggtacggggtattggttgcatgactgtataatagcaagtatagactaaagatgtatgtatactagaagtacaggaatgatacttttcttattctttcaccacttagcttagactatattttagagtgagtatttcttagttctttcttctgtgtgtcaccctaccctttgaactgagttaacccctgcatagactttgatgtatataagtaacatataaactattaccatagtactctcttatcatatcttcccttgggataaaataaatacgataccttggaatactcccgggtgaaatgctacaatggtatatccgtgcgcttgcggatcacatctgtaaccataatataccatgagtatttctagtgctattgctggaaattatatttccagtagtgccactaagaaataccaaacaagcatttctggcgccgttgccggggaagataaatgattaagagttcactacttgctaataattttatatttacctctatataagtcactgtcctttgtaggcaaaccttgtttgttttctcttttatgtgaaaacagggtagtacaggactggttatgatctgccaaccaaattcatatctagagtcactggtgaagtgaagccgacctcgtgtcgttcatcctcaaggttactctatcggcaaccagaccagtcaatttcgcgccacaagaattgcatgatacggctgagaagaccctttgcaagtttgctgctccctctgttgggtaacatgctagatggaacccacgtcagtatgggagatggtgctttgatctgaaaatctgcttagtcaagatggcgcaggcttgcacattctgtggcaagcctaaggaggatgcaagtgcttatttacagcaattcctggaaagctgtagcacgtataccgtcaaaggaatcagactccaactgttgccgctctccctcctcgagagagcagaacagtggttctacatcaaccgtgtaacagtgaatacccggaataagcgctcaacggcattcctctcaaaaattttcccgatgggcaagaccaacactcctcgtggaagaatatctagctttcagcagatgagggatgaaaccattcttgaagctggggaaatgctgcaggagtacgtcaccacccgtcctcatcatgggcgtccatcctgcagaatttcttcaacggattaaccctctcgtcctgggatcacctggacgctgctgctgaaggagcacccttctcaaagacggtcagtgatgccaaccaacctgattgagaagatggtctcaaatattggttggagcaaggaacgactccaaacccgtcaacgcggcatgtacaccgtcgaagggatggaaatgctcgccgcccagttggatctccttatgaagagactggacaacaatgagaaggacgccaagcagagtgccgttaaggctttgggctctcacataacatgtgaggtctatggcaaaaccggtcactctgggacggatcgtccggaaacccgtaagaacgtcatgctcatgaacaacaacaatgggtatcgtccacaaggagccaaggatggagcattgctccatagggtagatcaagaacggaccgaacccacaaggaggtcaaagtaaaaccccgaaggacgaaaagcctcaacactttcatgatgaacttcctggagcgggaagaaacgaggaaccatcagtaccttaagctggcttccaagaagccgggaatacaggtcaggtcaacctgcgctcccagtttcaaagatgccgctgcctgcacctaagaccaagaaggtatggcggattaaggagaagacacccgttcctataccttctgaactaggtgcctcatcgagcaaaatgcgttggaggtacggtcgtgctcgtcggacctgaaacgacgtcgctcttgccaacagataaattggtagttatctcatatttatttccattgcatcaaagcatgtttgaattttcaaacgcacattgagatttgaatttgaggcgatttcttcaaatgaatttttgtgagaaaaataaaatgcaatttttggcaaaatttagcacagccaccttcacactagtcgttggaccccaatggctgctgatttttgcagggtagcggctagcggggcccacatgccattactagccgttatccatgcactatatatgcagctcggctgggagagggaagtcacaccactttaactcattttcactccctctcaaaaccttgcaagcttgcctcaaattcacacaatttgctgtacttagtttaaacactttgcatatacaagtttgctttagttcgatgcaaggttaatcggcgggtatttgcctaacccccgtccgagtagtcttgtattcttgctctttgttgtagctatgaagaaacgacttttgggcatattcaagagacaatcaagctcacggacaagaagacatgataagccgagtacaccttcttccgcggatgcatccatcgaggaggcgtacgttccaccaaggctgtacgacaactccgatctcgacctcgtgggcgaccgggaaatgcaagcctatcatatgctgaaagaccgaacgtgtgctcagacctgagcatacgactcgaccttctgaaaaggataggtgtggatgctgagtttcatattgttcagcgtgctataggttgggataaatttgcatgtgtagatgtgccgggttcccgtttgcttaacatgcagtttttatgtaccttgctagaggtaggtgatgggttaccttccggctattctgcaaggaatatcaactttcttggaagaccttagcttgcatctaggctttgacaaaacatgcaaggttaatttcaggaacacatttcctgattttaacaagcgtatgttttagcaaagtatttcgggtctcatcctgtaaaaagcctagaactagtgacatccataatcctaccctggggctattgcataggttgcttggttttgtgttgtttcctagagctgatatccggataggacgaacttatcctcttgtatgccatggttagaaaaaaaatcagagtttcacctgttcaacccatgatcaagcaatggttagaaaatgtgaagttgtctagtcctgttgagtgtatttatttggtgactcatttagcatgaggagttgggactatgctttatatgcaagtatcttgtatccctgctacccgctcttatgttggtgaggcctacttggttcaatgccacatactcaaacatggtccaaatgattctcttatatttttgtttcctggctatacaaatgagattccgtaacctatacgggagtttcatttgtataactaccaagaactaaccatttctctccaagcggagttgccttgtgatgtcctatgcaggtaacatgacggatggcgagagaagcacctcaggaggcgtcttcctcttcaccaccagagcagatgtatttagacagttgggacccgaccgtgcatgcccttgattggacccaattcatgcaacatgacaccggaggttcgtcctggcagagtgccagcgacagccggtggcatgagccataggagttgcactggggatactcacgctccttcagtccaagtggtcaacttccatcttcttggatgcattgctcagtctcctctcgaggggggtctaggagaactcatccgggggacggatacacttgaactgcaggcagtgaacgagcaacacaccttggaggatcatgtggtacagtcacgtgaatggtagcactctgttggtgcacagctcgcaaacttcaacactatgatgcaacaacaacaagttggcaaaattttgcacggccaccaccacactagtcgttggaacccaatggctaaatgtggggccggttgggtccaccaggggttcggccgaacccctgcatggcactggctagctgcaaatatctgtagggtagcggctagtggggcccatatgccattactagccgttatccatgcactatatatgaagctcggatgggagagggaagtcacaccactcattctcactccctctcaaaaccttcctctcaaaattcattcaaagttttgcaagcttgcctcaaattcacacaatttgctgcatttagtttagacactttgcatatacaagtttgctttagttcagtgcaaggttaatcggcgggtatttgcttaacccctgtccgagcagtcttgtattcttgctctttgctgtagctatgaagaaagacttccgggcatattcaagagacaatcaagctcacggacaagccaacacgataagccgagtacaccttcttcagcggatgcatccatggaggaggcgtacgttccaccgaggctgtacaacaactccgatctcgacctcgtgggtgaccgggaaatgcaagcctatcatatgctgaaagaccgaacgtgtgctcagacctaagcatacaactcgaccttctgaaaaggataggtatggatgctgagtttcatactgtttggcgtgctgtaggatgggataaatttgcatggtagatgagctgggttcctgtttgcttaccatgcagtttttatgtaccttgctagaggtaggcgatggtgtacttcccggttattccgcaaggaatatcacctttctcgaaaagaccttagcttgcatctaggctttgacaaaacatgcaaagttaattccgcaggccggtagttatcgacatccaatggaggttatgaccgtttctacctgaagcaaccaccgtggacacttgtcacaaggagggagaaagatgctctttggatgcttcatcatgccacatgtcaagaggagagcaaatatgctccttggatgcttggagcatctccacactcccaaggcacctctccacctataaatacccctcctctcattcattccctcacacacctcaagaagaagatcaagagctctctcaagtattgtttagtagttctagtgctagtggagtaggaaatagaataatcttcatagtcctcgagtctttaggagatttcgggtatggctttaatagctttcctctcttcttttgtaagacttattgaattaatagcatattcttctttatacaagttcagtattttattccattcatattacttgagtgccgactttactttatacttgaatcaatatagtcgtgtaactagctttccaaataggtgtattggtgtgggtttagtgtccgattattcggttgctctgtgtcggttgcaaggatgtagagtagtatttagtaatgtaagcgcagtgcttagattattagataccattaattggggttatatactgcggatgagaggtgggccgctgatggtgacagctcagtacgggtattcctccgcgccggtatataatcctaagttaattccctagggagggtactcctccgtatttagccccagttgtatggtcatgacggctgtcgtaatgaactcggcagtaaggggtggcttctcgaaacaccaagagaacactgggtacggggtattggttgcatgactgtataatagcaagtatagactaaaaatgtatgtatactagaagtacatgaatgatacttttcttattctttcaccacttagcttagactatattttagagagagtagttgttagttctttcttctgtgtgtcaccctaccctttgaactgactttgatgtatataagtaacgtataaactattagcatagtactctcttatcatatcttcccttgggataaaataaatacgataccttggaatactctcaggtgaaatgctacaatggtatatccgtgcgcttgcggatcacatctgtaaccataatataccatgagtatttctagtgctattgctgggaattatatttccagtagtgtcgctaagaaataccaacagagcccacgtatgtagccaacgagcccaagtgaagtggctaagcccatgaaggaaaaatgcaaatagccctgtagcatctagtcctttactcatttacttgtctgatgtctccaactctggatcgaatcaattgattccttctcttctcgttcacctagtgacgctgcttccttgttctcgttcccctcttgccgattctctcatctcgcgttgccattgattatcatatcttctcgtagtgccgttctaggcccccaaccatcgacgcctaccctattcagattctcctcgccgtctccttcaccggctttgcctcgcggcactcgacctctgccactcaacctctgcttcgccggttgaagcactgccacaccacgccatcatatcccctctgtcggatattcctcgtgtgctttttcctcgttgacctagctagcctgttgccagtagccttcactgggcaacaaagtcgtggaggtcgcggtaccccacctcgtcgccccacgcagcagtcatggctccacctcgtcacctcactagcttggctcacgagccaaacgtgctagctcgagcttgcaggcaagccgagccgagatggggttctagctcgttaggataacgagccaagctagctcgttatagctcgttatcctaacgagctagactgagccgagctgagccgagccagctcgatgtccatccctaaaaaggagggggtgaaacctgaggtgggtatgtttggttagggagggttatataaagggttttttcatgatttccccctttgcagtatcgcggtggtactttggggcatggtaacatatgtagaatcgtgtcttgtgagtaaagttgtactcctctgatcagagttaaaactattcgaatagccgagcctgcggttattgggcggtcaaccagctcaccgtgattagtctcattctagttaatatgacataattaactggtgtagttaaggtggtttggttgggactattgcaacgtggtttagcgttgagcagtgatttttaatattgcttaattataattattgttttattgtattcactttatgatttataaatgctgcttttgttgcaaatatcctatagcctatcctttgtgaatatcttgcatcataccttgttccggacattgaggatccctgtgggttatgaaggaagcaacgtgttttggtcgtgaagattaagtttagattatttgtttatttctatagcatttgtaaaaattatttattatttttgtaagacgtggatttgtttatcaaattatcgtttgtgtactctagctggtcctggacagagattttattacacattctacttggagttcaggtagggaatttctgggcatgacattagctgagaaggaattactggcggctagcttgccatcggctgtgtggccgatggctgtgaacttttggaaattttcattgtcttgaacaattgagccagccgtggcgactgttatccctaattttgcggacttgctctgattttgggaaatggaaagaggagatcaagtggataaataactctcaaccaattttaggagataaaaaaaggctcaactggattttgatataagggcacacaagaattgtcatacaaggattgtctttcaaaggttctagacgctgagtgaggcagccggccgtgctagcttggtctacgactctatttgtggacgggatagaagagcggcaggccgagcgaaaaaaggtaggaatagactgtgctaggactgaaaaggaaaaacttaatgggcttttggctcaaaaccaagaaaaaattttgattaactttttcattatagtgtatagcaatcataatatttcaagttattgctcagtttataataggtgttgtttcactatgaaaaatacatttacccgttgcaatttttttcagagcgtgtacattcccgtgtttgtctgctccggctccacccgaactccggcgcccaatccgccggcctcgacgccggttcgatacccccgatgttatcctgtgggcggaggacctaatcctatctatcctgttccccaacacccatggcaactagccacctcacctctcgctccctcctcgtccaagcccagtaccccatctcacggctcccatccaacctccgcctctccctctcccaccacaagcaaccagccgccgtcgccaagcgccgccgagcccccgccccctcccacccggccttctcttcggtcatccgcggccgtcccaagaaagtccccatcccggaaaacggcgagccagccgccggtgtccgcgtcactgaacgtggcctggcctatcatcttgacggcgcgcccttcgagttccagtacagttacacagagacgccgcgcgcgcgccccgtcgcgctccgcgaggccccgttcctgccgttcgggcctgaggtaacgccgcgcccatggaccgggaggaagccgctccccaagagccgcaaggaactgcctgagttcgactccttcatgctcccgccgccgggcaagaagggggtgaagcccgtgcagtcgccggggccattccttgccggcacggagccgaggtaccaagcggcgtccagggaggaggtcctcggggagcctctcacaaaggaggaggtcgacgagctcgtcaaggcgaccctcaagaccaagcggcagcttaatatcggtgagttgcatctgatgcagcatcactcaattgtacacatggaacatcaactaattcgacagataaatgtctgcaagatttgtttcccccttgggctctggtaccctgttatgtctgtctgtgttcttttgttttctttcctataaaagactcgtgctctatgtgttttggctttctttacaaagccagatcaataataaatattgagtaaatttcacaaaactacaggtatttttgcacaatttatcagaaaactacagatttaagagctttcgcaaaactacagatttagtatgtccgtttattgtacaatctatcacaaaactacagatttaagaacttgtttcacaaaactatagatttagtgtattcgtttatcacaaaactacatatttagtgtcttcatttatcacaaaacgataaatctagtgtctccattatcacaaaactacaggttttaacaaggaaggggatggagaaagaaaaataagtatattttgttattatactcaccgatcaccgtgacatttatctcttgagtttagttcttatcatgtagccgctttgtcagccctttcttgtattcctagtcagtctctcattgccaacttttgcaggtagagatggtctaacacacaatatgttggagaacattcattcgcattggaagaggaagagagtgtgcaagataaaatgcaaaggtgtatgcacggttgatatggataatgtctgccagcagctagaggtcaaattttgctacttacctcagaattcttaaaatgcatacggtgtactactcagttaaattggtgactgttttattttttttttctttatggaccaatgttctagtaactcatctgaaactaatagaatttagaagttgtcttagctctggttattcattagtgaactcctttctgcttgaacttctgttttccatttccatatctgggagcaccttatctgtgactcttccctgattacttcatatcatacatgagcaggagaaagttggaggaaaagtaattcatcatcagggtggtgtgatatttctctttcgtggtagaaactacaattacagaactcgcccaatctatccacttatgctttggaaacctgctgcaccagtgtacccccgcttggttaaaaagatcccagacggcttaactccagatgaggcagaagatatgcgcaagagaggacgtcagttaccaccaatttgcaaactcggtaagtctctttgtttccatgtagttgactcctttaactgcctttcaaattgtggaatctgcaaatttcatagttaaaagaatgaaaaatatatgcgctagttgccaaagtttatttttgaaaatattagtgcctttgcagccaagagtaatgtccaaaataggaagtacctgagggaggttgatgtcgaacatgaaactactacttttatttgtcagaaacacttgaaatgtggaattacagttgaaccaatgctgcttcttttgctgagtgtggtacatattgtctatccacattagcccatcttcttgcatagcactgttccatgtttgtgcagtttgttgtcattgtttacattccattttttttaaaaatttttaaaggaaaaaatggtgtttatcttaacctcgtgaagcaagttcgagaagcatttgaagcatgtgatcttgtccgggttgattgctcaggtcttaataaaagtgattgcagaaagataggagctaaacttaaggtttggtaaatgctcagaatattatatcgttatgttattttgttcaaaacatgattaattctacctttgcaggatctagttccctgtaccttactgtcttttgagtttgaacatatactgatgtggagaggaaatgattggaaatcatcccttcctccattagaagaaaatgattttaaagtggcgagcgaccaaattttgaatagcaaagaagcaggttctggaagtgctctgaccccaattgagctggtcaacaatgccacgtctctcaagaaatgcaacttgattgaaggtgcagaaaaattggaagattccatgaagtctagttttgaaaatggtatgattttgggttctgcatgtggaaaccctggagtatgcaactctgaaggtatagatggaactgagtcctcagctgatgctccaattgaattttctccttcaaattcagcaagggatttagatccatctcaaacatcaacattgtattgccaaagctccctattggacaagagtgaaaatggagagctcattgagatgtaccctgacagatgtggaaactcggaacaatctccagatgtaccagaagctttaacttgtctaatgggcagcagtgatgagattcatgaattggaaactatgaggagaaactgcaaacatttaaacggcagcgatggtgttaacagtgattccatagtcccttcctacatggaaggaattttactccttttcaaacaagccattgacagtggcatggcactcgtgctgaatgaaaatgagtttgctgatgccaattatgtgtatcaaaagtctgttgcttttacaaagacggctccacgatacctggtactccggcatacaccaaggaagtcccatggtacccagaagactgagccagccaagaatgtaaggataaataagcatcttgaagaacataaagtatctgatcatgtcaaaaagaaagaaattgtcatgggaggatcaagaatgcagagaaatgatcacgcacgagaatttctatcagatgttgttccacagggtaccttaagagtagatgaacttgctaaattactggcttaaaggtgatcggtcctttattaaccgaaggtgtgttgcgttatcaaccttgaattaacgtgcaaagtatatacatgtacattgatatgggacgtataaaacttttcgtcaatttggtcatgctgtgtaactgatcacgctttctgcattgaaatgttggaatgtaataatatggaacggcgaagcattttcagacaatgagctctacctat

SEQ ID NO: 2646 - DNA, 5581 bp, Oryza sativa
ggtaaagtgttcgaaataacccttttcaaaccattgatcctaagcatatgcctggaagttgaagtaagattttatagatgtagcttactgtaaaatcaagaagttgatttagattttgtgatgaaaatattggttgtttgctgatgaaattttggagatttatagacgattgattttgtgaagtgagagtgttcggttgaccctggcgatcagaccagccaaaccaatggtctgaccggtgggatcttgaccgttgtcggtttcaggttgtcttattggatatggatgtttcctttagggatttgactttaagatgatttctatgcatatggatattgttgttatactaatatgagtcaagttgggacgaacttgtgctcggaatatggtttcttggttgttttacatgtgcaggtgttgcttgaggcctcgggagagtattgctggtgatagattggagttaacttgggagaagttgatgtctaggtatcaacagattataggatcaagatgtcgattagagggggggtggtgaatagacgatttaaaaatgaatggcacctaatcaaaactaacctaagttgctaggcttagtgagggttaagtctaattaagcaactaagttatattttacaaacctagggtgatagtggcttaagtatatctctaagaaagtaaatcacactcctaagttaagtttagcaatcctagagtgatatgatctcaagtatgtctctaggaatgtaaattgcacaactgtaaatgcgacaaataaatgagacaaggagacaaaagattttttaccgaggttcggaaattcgccgatttcctactccctgttgaggcgagcccaactccaccgctcaactagtattaggtttactaactttttgcagagaatgattatgaagtagaggagaatcgacatcaactcggacgataaatcaatcggacgatgtcgagaaccagacttgtgtgtgaataggccaagaactcagaattgacacgatgaattaggccaaaattcacaagtctgcggagtggagcaatagaggaggccaccagccgaaactgggctggattggctagccccaggttcggccgaaccaatcctggcaccgttggatccaggttttggcatggacgtccaggattgcatcccaatgacggttggagggcacttcggacaattccccttccacaaccgtcataaccacctctgtataaggagctcactctcttcacttcaacacacacctcaagcaatagctctctcattcctcccaagtttagtttagtagtatctagctggtgtaatagaaatagaatatgagtcaggagtccggaagccttcagaagagttcgggtatggctctagcagctttcctttcctcttttgtaagatttgtacttttattagaatactcttctatatatatttatggtattgaaatactttccgagtatatgagtaactattatacattatgttcttgttatactgaatataaggctaacttatctgggagatgctttggtgcgggtatagtgtttgcttatgcaattactctatgtcatgatgatgatattatagtagtatctagtagtttagacgtggtgtctagattacgagatatcattatttggggttatatattgcggatgagaggtgggccactgatggtgacagctcagtacgggtattcctctgcgcctatatataatcctaagttaatttcctggggagggtattcctccgtatttaaccctggttggatggtcatgacaggctgccgtaaggaactcggcagtcaagcgtggcttctcgaagtaccaggagggtatcggatagagggtattagctagtatatcagttaactagaatgtatgtatactatgtatattagaagtataggaatagatttcttttctctttttttttccacctagcttagataaattattaccgaggatgagtagaaatgcttgtgtgtcactctacccttggattatcttaacccctgcttagaatatgattatcacaagtaatatataaattattagttgagttctctctacatgatcttccacgggataaaataaatacgatacccttgaaatactctcgggtaaaatgctacaatggtatatccgtgcgcttgcggatgaactctgtaaccataatataccaggagtgtttcggcgccattgctgggaattatatttctagtaatgtcgttaagaaataccaacaccggcccacggagaggattacccaagcctcgatcactaggggtagttcttccttcactccgaaggtggtgaactccaaaccactcacaaccagcgtcggccttcctccgcaatcttctcggagaggtcaccgggcaactactccacaagccgtctaagaggcggcaacctccatgagtaacaagcaatgacgcggctcggagatagctctacaatggaagcaatgcacttgactcttggctagaacaaccttcaaccactacaacggatgaacacaagctcaaatgagtgtgggagaggtgcaaggggtgtatacaattgaagtggatgccaagagagtctccttgctgctggtgggggagtatttatactcccacccaccaaaactagccgttggggggtgaaatcccccaactctgtgtactgccagtctgaccggagttgtgtggccggtcagaccgtgctactctgcaacggctagttttctagttgttgtagggctgtcattgggccccatcggcctggccggtcagaccgcagttgggtggtagaccggcctcggctcggtcagaccgcccctagctcggtctgaccgaatgcggctctggcggctctggatcgccaccccgagagccacagggagaggttccctaggccggtcagaccggggttcacccgccggtcagaccggctgacctacgccggtcagaccgccactaggtggtcggtctgaccggccctggtcacacagcaggcacaacaggataatgagagcaagccaaatctaaatgcataatgacctaatgtggaaatttaaatcatctctttgctaggtcattacccctcttaatagtacggcaaagctataaataaactagcacagtttgattgcccaatacctcgatcaatttagaattcaactactagtttaccgtcatctatactttgctttgcgccatcaatttttagtccatcgataatcaaccatgcgcacacatgatgtgtacctaactcaaaacacataactcgatagaacggttagtccacaattagcgcttgtcattaattaccaaaactaacaacgggggcctagatgcttcaatctccccttatttggtaattgatgacaaacacttcaaacatatataatcaaatataaagcacatggatatatttttcaatgtatagaaaatactccccctaaacatgtgcatatcaatctcaaagaacaaatttggaacaaatgcacatttcaacatagttcaacacaaatacaacatatgatgtgaacttcacatatagatcaatcaattgcataggatggtcacaaatatatcaaaatcacatccaccatccatcattgcacaagttcacatcaataaaccatccaaatcataaaagttcatccatagatcatccaagtcacaaattatccaaagagggctcacaaataataacctaggctattacatgaccacggagggcccaaatctcacaagagagttcaacaaacgataaaaacacacaagatagataatatagcccattacatatagatatagccctcccaacttagcctaatagatatgaggactaacctcactacttctagtcccaacccacctaagatagatgaatttcttctccccctttggcatcaaggaccaaaaagcttcattcttgaggaatagagggaggatggggtataggatagtgagacgaagaggaagaagggtcacggcaacgagaatacacataggcatgtgtgttttccatggtagtcatacgccggtccaaagaagtgacttgagaggatatcctggcaacctcagaacgaatgcccctcgcatcctcatgcattgcctcagccctcatgctcggtagttagcctttgaatgctttcacttaagctatttatagccccaagcaccgagttgaaatagtcctgaggaggcatgccaaagtatgcataaggaggagtgaagtactcattgataccttgaggaggaggaggtgctgagcttgagattgccccagggtggaaagaaggttgcctcatcctaggagtatggggagtgccaagctgaagacgaggcttatattgcttatgcttctttagattgtttccaacactcccaagctgagcttgaatctacctcataatgtagggcgcatggtaaattcattgactaaacgtgcccttggatattgcaatctcttgcattatgaggttcaccacatcaaactgacgaccctgcatgatggcatctatcacatgccaagccacccccttaatatcatcattattcccacatcgagggagaatggtggctctcacaatcctgttcaccacactacgaatagtcatcaaccctgcaactttcccatgggtgtgtcgccttccatcttcatagaactgtgaaagataatcaatggagagcgggttgtgagtatgctcctcatgcagatcatcaccaaagtcaaagcggatgttgagtaacctccggaactgcctcctagagatagagtactggagggtgtgtgacatccacttcatctcactacaatcaccggcaacccacgttgtggcataaaattggcggatgagctcctcatcatagtcttgtgccataatgactatgcaatctatccccacagccctgaaaagggcttgcaagcttgtaaactctagagtctcatttatgttccgccatgaaatccacttgtgctttgcaaaagccctgctcctgtagagctgctcataaatagtcttctggaaggccgtgtgaaaacggggatcagtggtgtctctaggcctcttgaactgatcatgatgccttaggatggtgtactgagcggagttcctgatgttaaccacaaactgaacagaaggatcaatttccatctcatttccttcttcctcatcctccccactgccactgtcatcaccatctccactttcctcttcaccctcttcccgtccctcattcacatcttgctcttcttcctcacttgctcatattcctctccgctcgactcctcatgctcgcactcgggctcttgcacggccgcttgatgaccatggcgagtgcggggaggcattgctgaatccaaagagcaataaaggaatatgagcaacaaatttagaaaacactcggttaggcggaaagaaattttgcactgccggtcaggggcggtcagaccggtggccaatggccggtcagaccgcccgtagggctgaccagaccgccactaaccagtcccagcaaaaattctttcaccccaacacaaatgattctaaataggctaggataattttgcacagggt

SEQ ID NO: 2647 - DNA, 2889 bp, Oryza sativa
gagtgaaatccacggtcaaaccgaggggatttggtggaggagagtggctagggtttgagagaggagagagagatgagtttttcgagttggggatgagtggggaagagaagagaaggggtaggtgcaggatggagaagaagaaaaagggcaaaactacttgggcccacctcagccggtcagaccggccctatgtggtcggtcagaccgcctcacctggtgtcacgtctagaaatttagcccatatttccagactattttgtgtattaaatccctgtccaggaccaggaccagctagggtacacaaaacaataaattaatatacagacccaaatgtaaataaagcgtaaaatacttacagaagaggcacttagtcctcacaccgaaagagaacgacagcagcagaaaaggcgatcctagcggggcttcagctccactccacaggcaaaactgaactagggtttgagccttggtcctctaacttcatcttcaactcagaagcactacacttctgaaaagggggaacaacagcaagactgagtacaaccaccgtactcagcaagccacaccattgatgcagacgtgcaaggggattcaaaaatggcttgtggctatttgcataaaggcagttgtaaaacattttgttgagcaaaacagtaaaactgctgattaattaaggtaacattaaatctctattgatcaacactacaccacgttgaacaggcccaaccaacccatctgaactacagtgcattgggtcgatttattaagtgtgagactaatcacggtgaatctggtcgaccgcccataaccgtgggcacagctattcaaatagttttactctgatcagaggtgtacaactttacccacaagacacagccccacaacacgttcccgtgcgccgacatgccaccatgacatactggaaagaggccgtgataggacccttcgcataaccccctctaaccaatcgcaccacacctcaggtttcacctccactcctcgcaaggcatcgggcagtcccctctcgtgcctaggtgaatccggaagcgacaaaggccgttgcagggcccatcccgctccatcatgcccacccttgcctggatacgtcggctagaggaaagctacactacaaacccagccgttgcccacgctggcttgtggtaagtacgataagttcttccagggcatcccgcgaaccagtccttaattgccatgggtgtgactagcaaaaccatgcacccacagcccaccattcagtcgcattttagttggataattacgaccaatgaaacatggccaggtgtctcgagcacgcagctcgttctgatgctaaaaaggtctaatacttcaattatcccatcaactgagctagtggtaattaagcatggctaagcatatagttctagctgggtcacataagtaacaagagctagtcgatttatcacccaaggttgacaaaggacaaatatcaagtaaacatggcacaagtgagcagataggtaaacccgattcccatgtaattggcaaaacatgcatatttatttgcaaacagtaaaacatttgtaaagtaggctcaacatgctcaaggggaatgtgtgactggtttgcttcttcacttggatcttccgaactcttatccttgcgatcgcgatcttccgaaacggcataatctacgtgctggcatgcaaaatgaggaaaaactttaataaaaaccaaggaaacggtacataaagagtaaacaaacatgtggatctcagttttagatgaattttgcaagttgaatggcccaatttggagttcgaatgaattatatatgaattttagaagttttgagccatttaaatggatttctataattattattgatttattacgcaattaatgattatttttcacaaggaaaagggggttgctgacgtcagcaaggggtgaggcgtggaccgcgtccacaaaggggtggacccacacgtcagcggcacaagggcgccggtccaccgtggaccgggaccaccgaggcggtccaccaccggtccacgggaatcgacggcccggatcggcccaagccgatcgggcggccacgggcggcgcaacaaggacacaggcacggcatgaagctggcccgggcgagccatggcacggcagcggcacggccaccggcggcaacagccgacgacgccgaacagtggcgagcggccggaagacggcggcgttcacgggcagcggcaatgcaaacggaagggaaggggagcgggaggaggggctcaccgagcgtgtgggccgacgaggcggagccggaggtggccagcgatgggaagaggcgacggtgctcctcaaggaggcgaagcggacggtgctccggcggccttccgcgagcgggaactggcggacagtggccggaagaacctggagaagaagacaggggatttagggagcgaggaggaggcacgacgccgagggaaatggcggccgaaagcggcaaggatcagcgaagctcaccttggacggaggaaagcggtctcccgtgatgattcgtgaggagggaggggtggacgggcagtgcatggtgactgcggtgccggggaaggcaacgacgcagcgcgaggtggtcgggaacggcgtcgagaggcggccggaggcggctgctatggtggcggtttgggtggtgtggtagagtgacggttctagcggcggaatggaggagcggaggggatgccggggtacgagacgacgcagtgaagccgtcggtggcggttgcacggagcggtgtcggcctgctggagggcgtcgacgggcggcggagctcgggcccgcgctgcggcggtgtttcggaggcggagagggtaaaaggagtaggggccggggtgcggcacggcacggcgatgccaatgg

SEQ ID NO: 2648 - DNA, 1198 bp, Oryza sativa
gggcacgtggcggggcaaaccagcgcagttttcttgggggaaaattggggaaatggtggaggaggtgggggggtgcagttccaccacttgggcttgagcaggaagggctgggtggtgcggattttgcgacggagtaggcagcaatggcggccacgggcggttactggcgaggtggctggaggaacggggaggagctgacaggtggggcctcgggtccacctgtcggcgagggaaggagagaggaggccggggggcttatgtggacttagggagagatggggagcaagcgggccgagcggcccaaagaggagaggggagggaggctgccgggctggagggcaaagaaggagggagagggattgggccgagggcggcccaaaaggaaggagagggaattttcttttttttctttttatttaattgtttaaatgaactttgtgactttaaaattatttcttgagctccgaaaattcgtggaaaaatccggagagtactttagggcacagagaatattgcaaaatatttctggccaatgatttttatgggaaaattttaagtctaccattatttcacttgattaaattgctttaacttttatttaatttatagaaaatgatttattaattgatttttaatcccgaacgaaatcgaggtgttacaaatctaccccccttacaggaatcaagtcctaagattcgggtatggttagaaagaaagctgggtgtaggcggtctgatcgatctggccgatctgcacactgcattgatcccttttgttttaaactgactgatggactgaccaaccagcataacttaactgaactgactggcatcgaccattctattcttttgctcaaaacaaccgaactgactgggattcgaccctggagttctattgcttcgcaaaacttaattgattagctctactcgatctgaccctgacctgaatcacgagggctcatggaacttcctgtccctgtactgaactgctagcattatcaccttttggtaacctgagagctcaccaagcagactagaaattggcagatctttcatgaaatcttgtatgtgagcctgcatgaatgacagattctaactttactttgacctgctcctgactaccagaactattctaagaggctgcttgaccggtctttcgtctgaactgcaactgtacctgatgttacttctctgatgtg

SEQ ID NO: 2649 - DNA, 4819 bp, Oryza sativa
  unsure (1)..(4819): unsure at all n locations
tgctgactacacatttctgaccctgattcttggatatttcttgcccatgtatggaacaatttctgccaacttccgagaaacatcatgaggatttctagaattcgtagtggttccttcgaacatatggagaaccatccatgattcataatcgtaccactagggtgtaattgttgcttaccattctctaacagtttccaagggtagagagttcccaagattccttgtatgatgttacttctgaatttttttttcattactccctacacttgaatacccttgatactacctttagagagatttcatagtgtcgagcgctatggatccaaccattgtcacttccttggttaatcctttctttactcgctcgcaaacaggttttggagcacaacaaaagtgcgatgagttagaagggaaactcttggtttcttgtaacttgcagatacacatgttaacttgcttttgcatactcaaaggtgaaaagaagagaaacgcttgactcctactctattcaatattcccttttcaactatatcactggattggaacttctatgcacaaggaaggtatttgaacaccaaaggcctgtgcacaattgttgactcttgctgacagaactgctgatcagtagcacatttacccattgtgattctgacatggttgacttgtccttttgttggttactagctgaagctcccacaagaacaaaactttgactgatgacgttcctaagacaaacatcaatcctcttggtagctaaaaggaacgagaccttctcactatcggtgcaactcttctgttaatttcttgcgagacctctgaattggagcagtatgagatgcatggctgatgttgacaaccacattgaagtctgatgcttgagacattgattgcagtcgctgctgaagaattgagccgtctctccgtagctaaagtagatcactgatttcctggcttcgtctgctctgctggtgctgattctgtaatcttgaagtgattgctagagaaacaatagagaccttgtcagtgcacttaatgacaattcatcatgatggaaactttacacccaagtgacggttggtagtacttctctttctagggtctttggactggatctgaccacttcatacaggaactgatgtaacttgaggagacaaaggagttttaaccatgttgctgacttgatgagactgacgctttggcgctgaacaaccttttgagagatgataggtcttccaacaattggaaacaatggtggactatctttcttggtctcgagagtagaccattactgaggtggtgtcccggctcaaaacgattgagacacttctcacttgatggatctttgatgtgcactcttcccgctgtgcatgctcccaactgaaaccagagtagagaactcataaccttggtgacaatgttattactatcactgtgggttgccactgcagatggagctaggggaagaacggaactattgctactgctgttactgagtgccataagttgacgaacaggttgcaaagttgtcttttggtctctcattgccttagctagtaccaaactcaattgattatccttgagcacatggtgcattccctcacacaagaatcgtgcatcctttctctgccaaagactggactgcagtgtaccatagtttttgtaagcaagctaacctggacatttcttctctcctgggcacagtgccctattgtcggtcgttttgacaaataagtccaatgggtgattgaacactttgtaagaaactgcccttgtacaccataaccaccgtgggtagcacttgctgcttcagggatcgatggtggcttagctgtgctggtttcctcaggacacgactgtacaccggcaggggttgtaggtgcttccattggacaacaatggcgttgactctgactccgactccgggcttgcacctgagcttgtatctattgttggggacactgtcgttgcatctactgcattggactctgcggtggctgcatcaatctatgacacattgttggtaattcttacggtcacagataaaatccgcaagcgcacggatataccgatgtagcacttcgcctacggagtattccaatggtatcgaatccaaggaaacgtgtgtgatcagatcttcctccggttaatccaaggacaccaagcaaatgataggccaggatatacaggattttctagtgagaaacagtgtctagggaaagcttaactttaatcctaatgcaatacttcaggcactggcaatccgctgttcccagatgtcgctctactatgcacccggacaggaaggacttaagtgatcttgagggttgtcaccacctctacacctacctcaaacagagtgtgggatacgcagccattactatattgaatattatattgaattcagagtaataaacagaggagaagattaccgacaactccggaattcttccgacttcttctactctactctcttcctattctagtatacaatatagtacaatagagcctcttataattcagctcaagcttggaagtgtgtgtgtgtgaagtgagggagtgatgtccttttatagggcagttatgacggttgtgagaaggggaaatgtccgaattgtcccgcaaccattattgggagagcatctggagcgtccacgccaaaccctaggatcaacggtgatcggggcggtttggccgaacctgggctgggccctcctagcctagccttcggtcggtggactccctagactctcctctgtctatttctcggagttttgggttgatttactgatgttttgatgaagttcacaacccttccttgtatggatacataattctcactttagtctagatttcctcccaacatcagggtttatcatctgcatacaaatatacaccaacacttgtggaatatgtgagattaagcacctatcactatgttggatgttttattatctaaactttatgcagatgggatttttataaattttcgcaaacaagctcttttcctcatgttgacttcctctcttgtctctcaaggatgtatattttctttttggatcctcaatcaaggcaaagtgtgccaaaatctaccctattctaaggctgatatgtggagcttggtagggataaattgtgacatacttgcatcatatatatattgtaaagctaaaaatacggactcaagaagatcatcaatcatacttctagatcaagagtctttatttgtggtgaaaaaaaaatggaaaagtaaaatcttttgtggaataatggaaatgattctcccctttttcctatacttcctcctcccttttgttttcttggcatgaatatggaaggggcatggctatattttctttccaactttgctcaatgatttgggagcaagcatttattttcttcttcttttttttatttttttttcatagtcatgcctttcctccccttttttttcatttttctttttgccgagaacttttttaggagaagaaagcatagtctaatgtagaagtttattcgaatggaatttttgtggaaaaccaacttccagtttagaagcttagcttaattatatatgtggagaaatggaaatggaaatgaccccttgatcatgggagtacgaaagatatctcacacgagtcacctaaatttaacaaagctcaatataatgtcaagcagtcatatgcatgataaggttcatcaaagatatacttgcatatggccttggtaggtataaaatgaagtcaattaggaggattgtgctttttaaaatgattttattttgtgaaaaataatttcccaagagtcataacaagagttacaagagttcccttcatcttgaatcatctcgcataaagcaattacttagatgcataaggttccctaaacatggatggttgttcataagcacaagttcggctgagaataatgaatatacaagatcaatcacatgaagaatttcattagttggaaattttatctttcgcttatgcttgaaccaattgttttctgaattttcagctcaaatactataccatggtggagatatacagataaaagacgtgctctcctgcttacctgtgaaaactgggaggtattggggccaacactggttcggccgaactactctggtgcccaatacctctgcaattttttgcagagttcagtgccttccaggtgtttagacattcagtaattttcagattatgtgcacgtcagaagctgtgatatctcccccatacttattaaacatgaaacaaaacaaattttgacaaacattggggttaacaccaatgagctacattattcatagcaagtgcttatatgattggaaaaacaaaaaccaagcacctactactattttactcatgggaaaggaagcatctagttagcataatacttattttcctttcccatttctacgattgcgcgcttgattttagcgcacaaaccgtgactaagggtgtcgaaattatttctaatttcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2650 - DNA, 1052 bp, Oryza sativa
tggtttaattaaaagagaaggggaggagaacagttctactttttccaatatttttaaagggcttttatgggtaaccatttggcataacctagggtcaaggaggctttgataccaacttgtcacgcccggaatttctatccaaaattccaaacgcttacatgtgtgtgaaccctctccagaaatcagccgaggcacacaataacaaattgataatagagtacaattattactctaataataagcgaataaaatgtcattacagaggtagatagttcctctcaatcaataaagatctaagcagcggaaaataaaataaacggcgcaaacggttccactccacaggcagtttgacaagggctacacctaatcctccacaccataagcatcattgtaaaacttttcctttgatgaatgatggcaaggtgagtttatgacatactcagcaagtcacgcagcaaatatgcaagtgcacaggataccaaaggatggcatagtagggttcaatttgcataaacagcatttaataaacatttcaaaatttaataaaacagttaagtaatattaatcaatattaaaccaacgctatacaacataccctgttgcataggcccaaccattctgaacaaccatcccggctgcacagttctatctccaaaccaggaatataccattccaaaccaggagctaaccaaattattaccagttatagcatcttttattatgatgagaggtgtgagactaatcacgaaagacattgttagacccgcccataaccgcgggcacggctattcgaatagttttactctgatcagaggtgtaccactgtacccacaagacacagccccacatcatgtcaccatgtgcctcaataccaccacggtacctcggaaaggagctgtgacaataccctttgcacaacacaatccactacagcgcacctttcctggatcataatcacccccttataaacaaggcatggactcccagcgacccccgtgggcttatctccgccacttctcagtctggtgctccgcaatgaaccatgctataca

SEQ ID NO: 2651 - DNA, 525 bp, Oryza sativa
taaacacttttccaattgcgacacatggaacacattatggactcctgccaaagattgaggtaactctaactgataagcaacctctcctcttctactgacaatcttataaggtcccacaaaacgcggtgccaattttcctttggtgtgaacacgatgaactcctcgaagaggcgtgacacgaaggtacacataatctccttcttcaaaactcaaatctctgcggcgattgtcggcatactcttatgacgagactgggccacacgcaatctttcttgaatgatctttaccttctcttctgcttcccttaggatatcagtcccgaaaacctgacgttctcccttttgatcccacaaaagcggagtgcggcacttccgaccatacagtgcttcgtaaggagccatctgaagactagcttgataactgttgttatacgaaagttctgcataaggtagattcttatcccaacttccaccaagtctaaagcacaagctctcaacatatcttccaaaatctgattcacccttt

SEQ ID NO: 2652 - DNA, 458 bp, Oryza sativa
attttaccttctgcatcactcgacatccatacacgtgaaggctcaaggctaccacatgaccagttagtttaccgatgagttcccttctgtagaaggtaggtccatacccaagaagctgaaagggtaaaaaaaaaaagctcagataagttccacattttcattattttttgtaaaaagtttaaaatgtatattcatgatgtaataatcaataacaaatatttttgtttgaaaataaagtcaatttccatttgggaaaatcttctggaccgcgtagttggcaaaaacatcaatagccaacatgtgggcatgaggaacaatttcttcatacaccatagctaactctgccggtgttgctctctcaagcttatgttgtatgaaacggcttccaaacggatcaatgctgcatataccaaatacaaaaagtgaaattaggaaatgctgctaccaaataaaccaac

SEQ ID NO: 2653 - DNA, 367 bp, Oryza sativa
tcaaaagttgttagattttgatgggtgttttttttcatcaaatgtataatagacagactcataaaaaaggaattgattacctgtattcgatggaaaattaaaccccaaatcttgcatattggactaaaaatcaaactccaaggacccgttcgttagtcatgcaaatgaggatgtagacgtaggattcatgaaattcggatgagacttcctctggttcgggaacataacagtatcctctcgcgtcgtcctccctaggggcggcacgggaggtgacgacccggctgccccttctccctcacctccctcctccgcctcgctgccgcccgagtggctactggcgcacggccacaaggacagtggcggcggg

SEQ ID NO: 2654 - DNA, 1364 bp, Oryza sativa
aagggcgcatccttggctagcaaattagtcagcggcctggctattgtagaaaagtccttgatgaaccttctataaaagccggcatgtcctaagaaactgcagattcctttgatgttcacaggaggaggaagctgatctataacatcgattttagtacgatcaacttcgattcctcgttcggacactcgatgcccaagaactatccctttacagaccatgaagtgtcacttttcccaattaagcaccaggtacttttcttggcatcgttgtaagaatttgtctaaattctgcagacaatgaccgaaagtctttccatagaccgagaagtcatccatgaagacttccatgatgtcttcgatcatgtctgagaaaatagacatcatacatctttggaaagatgtaggagcattacacagtccgaaggacatcctacggtatgcataggtgccatacggacatgtgaacgtagtcttactctggtcctccagatggataggaatttaatgatacccgtaatacccatcaaggaaacagaaaaacgaatgatttgccagctgttccaacatttcatcaatgaagggtagcgggaaatgatccttttttgtagccttgttaagttttctgtaatcgatgcacatcctccatccggttacggttcgttgcggaataagttcgttttgagcatttgcaacgactgtcattcctcccttcttcggcacaactggactaggctaacccactcactatatggtacgggtaaattgatcccggcatgcaggagtttcaagacctctttctttacaacctcttgcatttcattattgagccgtcgttgaggttccctggagggagtactcttggggtcaataggaatacgatgggtgcaaagcgcgagattaatccccctaagatcttgaagtgagtagccaagtacagaacgatgcttttccaatacggtaggaagacgttgacgctcgtctttagagagcttgtcacttattataacaggggcctctctgtcattgtgtaggaaagcatatcgtaggcctagaggtagaggtttaagctcaagcggaggttgaggtggcggttccatgattggcaggtcgagagtctcaccgggatctgcttcttccttgatgaaatcggggacctcatcttccagaagggcctcgggagactcatgaggaggaactgcggtaacctcttccactaactcaatttctgggagaaggtcggtcaaggtgatccttgcccgtgaaaatggaattgagaattcattctctcccagtgttattttgaggctacctaaatgaagtgtgttgataagaagttgctcaatgggtagcctgattaggatgtca

SEQ ID NO: 2655 - DNA, 1392 bp, Oryza sativa
tgaaactaagaatttctactcgaaaggcagtaatacgagtaactggaaagaaggcaagacagaatctgtctcacaacttttcctagctaccgtttacacatccaacggtagaggtgtaccattgctttgctctctcttgaagagagaacgggaacaatttccaccgcacagtttcttgtctcatgccacgaatcttaaggcatgatcaaacttgttcaaagtctcgcagatgatggtagggattttctagatcaaagccagaaaaaggattttccctaaccgtactaattagttcaggacgaatttcatagccagttgtataaatgggcttcgatgaaggaggtggctcatagaattcgccccgaggagcagacatctcaaaacgaggttgctccatggtcgagaagagtttgacaggaatacttctctaggatagcaggggtgaaggtagactaaaaaagtaaaaaggatacaaggatgaactgggttcggaaatgatcagcaaccgttccccggcaacggcactaggaatgcttgttggtatttaatacggttacagataaaatctgcaaccgcacggatataccgaggtagcacttcccctacggagtattccaagggtatcgaatccaaatgaacgtgtatggtcagatcttcctccggttcatccaaggacacaaagtaaatgataggccaggataagaggatttactagtgagagacagtatctagggaaagcttaactttaatcctaatgcaatacttcagcactggcaacccgctgttcccagatgtcgctctagtacgtacccggaaagggaggacttaagtgatctcaagggctgtcaccacctctacacctacctcaaacgtaccgtgggatacgcagcaattaccggataacaattacttaaataccacgtctaagcaattaatatctactttagtgtttataactcatcaaagcaatcactatattttagttgattatagtgaacaataatcccgtatgctatttaggaactaaccaagagataattctcacaagataaatctaaattattcaagaagaatattatattgaattcagagtaataaatagaataaaagaaataggagaagattaccgacaactccggaattcttccgacttcttctactctactctcttcctattctagtgtacaatatagtacaatagagcctcttataattcagctcaagcttggaagtgtgtgtgagagtgaatgaagtgaggtccttttatagggcagttatgacggttgtgagaaggggaaatgtccgaactgcaccgcaaccgtcattgggagaacttctggagcatccacgccaaacccaggatgaacggtgatcagggggttcggccgaacc

SEQ ID NO: 2656 - DNA, 657 bp, Oryza sativa
tgagaatcaaacatgcatgtcttaggaggcttacccaccgggccattctttcaccaaatgcccaacctcacgacacttggagcaatacttaccattactcttgacaaaacgagtggcacggtgagaaggtttcttacccttctttggaatgaatccaagtccctccttgttaagatgcaccgttgctcactcaaaatcttgtcaagagtgttcttacccttgaagcacctctccaagctttattgagcttagccacttgctccttaagctcattgtttttaacaacaagtgaggcatcacaaatagaaacacaagagttagagctagagctagacatatccacaagatcatcacaagaggtagaaatgctagatgatgcaacatgagcaatatggcaagtagcactatcatcaagcaaatcacaagatatgccaacatcaatgagagcttcatgttgagtagtggaaaggaggttgtcatgagcttccttaagcttctcatgagaaatggtgagtctctcatgagaagtctttagctcctcatacaagacctccaaagaagcatgatccttctttagggccttgaacttgacaatctccttctcattataagcatggagctcctcaaacatactcacaagctcatcataggaaacat

SEQ ID NO: 2657 - DNA, 227 bp, Oryza sativa
aagccaccgcacgcccccttcgtcaaggggtgggtaaggcgggagccggcccacggagaggactacccaagcctcaatcactagggtagttcttccttcactccgaaggtggtgaactccaaaccactcacaaaccggcgccgggcctcctccacaatcttctcggagaggtcaccgggcaacacctccacaagccgtctaggaggcggcaacctccaagagtaaca

SEQ ID NO: 2658 - DNA, 649 bp, Oryza sativa
atcagatacgcgaggctgctagtcgactaacgaacgcaggggtagcctcttctcagggcacattccgacccgacagagagaaggatgagctgtcactcgccctacagactcccgagcatccaggacgaacacgagggaaaggcgtgattccctagaatattggatttaaggaggacatccacacgtacaggagtcggatgaggagcaagagagataccgaggcgaagattgcagatcttgagtacaggatatcgagctacgagttcagcatgcaagaggaggtggcaaggaaggtggatgaacgtatggccgcacatcggtcccaagatccccagccgtacattcatcctgcaatggtcagcccatcaggcaatcgtagcagctgcgcctcaacggggcaggtcggatcacagagcatggacgccatgcaaacccaggacgaaaccacctgccccattgatgagatcacgcagcggacaccatgtgagctgcatattcccttcaagaacttatcaatcaaggtatgctcgtagtttgatgatttttgactagtacatcccgcaagttgctccttaggttgattaccaatagataacctctcatcacttgaaggtggcgttgggaatggccatctcaacggaccctttcg

SEQ ID NO: 2659 - DNA, 947 bp, Oryza sativa
attccatgaacggtacatggaaatgagcgccaagggtagagagatgttcggagcgaggatcagaaactccaacttcttgcaaggagaagatgttctctggatccatttcaaggatctcttcgatctgtaccagttggacgccatcgacgtctctcttctgagcgcatggattttgtgagtatctttgagtcgatttgtttcgttcaataattagctcctggcatatatgtaagcaataatactttcttttcattgttgtagaatggagatcaaagggcccgatggcggagggtctgcgatactgggttcatcgaccctcggaaaatcaacaccgaaatgatcgacaagtacgagaaagacacagaggacaatctcgtccatctcctaacgcagcagcatttcaagacgtacatactactgccgtacaacacagagtgagtttttattgtcgctcgaacaaatttcgttcccatacatatagcatgtacattttcaatcatatatatctcatctcacgcatattccagattccactgggtcctgttattcttcgacctggacgcatgcagagtcactgtgtacgactcaatgaataaagagaagaagatttttgccaaggtcttcaaactgatagacaggtaatataatgccatctattccaaagtggcggggaatctatggctattatgttgatctcaggtaataattaattataatagcttgcaattacatattaagggtttgggatgggtccgttcaattggtcgcgggacttgaaaaaaaattggcggaggtttcattttccaggaagtactggaataatccaaaataaaattgaattgattttttaataccggttaaaataaatagaaacctaatcttttcttggtttttcaatgaagtgtgcaaagcaggaccaggaaactaacttatgcggctactacgta

SEQ ID NO: 2660 - DNA, 213 bp, Oryza sativa
gcccgtcagaccgtgctactctgcaacggctagaaaactagccattgaagagctgtcagagggccccatcggcctggccggtcagaccggcattgagtgggcggtcagaccggccacggctcggtcagaccgccatcggctcggtctcactgactacggctccatcggctctgtatcgccaccccaagcagcaccatcccggcctccaagggg

SEQ ID NO: 2661 - DNA, 1541 bp, Oryza sativa
tctttataaagtaaagttggttgcaacatttttccatctgtaatactaaaaaatctttaaagttgaactttacctgttcccctcttgagttcatcggtacatttgtggtttgttgatttatactagagttgtactaaaatgtactaaccaattgttttcgtgcttttgctgtactactatatgttactctaaatataagtcatcttagtcttgtgcgtgaatttaggaagtgacttatatggccttgttaccgttcagttattacttattacactttggagaggatacctcatttattcgtaacagtgataacattcagtcattcaaaacataagagaaaaaaaaaaggttggacgattatacatgtgcctagatgttgctttaagggatgtataaagttgaagttaatagtttcgatttaatacatcatcaggccctcttttacatcccccagtacaagataactgattggttttaactagtaaactaatatgttttattttgcatggctctgtaatctttcttttgaaccttgaattttctttattcagttagccatataagatggctggtttcactctttctacacacacgatgccatcttatgtgtcaaccaaccttaccctttatttgtactcgatatcatttgtaatatggggtatcatttatatcaagatttgtttgcattaaacaggttgctcttgcatctgggaataaaaagaacattgaaaaagtgaggaaagctcagcttggtatcacctgcccaatgttgtaactgtggacgcatttggactgtcattaaatgaagatcatctgcatcttaccactgaatcacaagtaaagcttggtgaaatgctcgcacaagtctacatgagcaatttttgccagcaacatgctaggaggagtcctgtcaggtgaaataatctgtttaactctggaagtttggcacctaaatatctttctctttaaactgttattataattcttcattttctcgttggttgaaactatctagaggtgaaccaaccaattcatcttgcatttcttgcacagtagcattgatcctttcatttaacaagacatcaacttactggtcaattatgggttggatctaaatttaacaattcgagaaccaaacattacccaaaagaaataattttcttcttttcaacattagttggccatgtaaaaaaaaattcaacttcaatgccttttggggtccttcaatatataaatttcttctttattttgaacaaaccaatttgatgggaaataaaaacttctggttgggttcatggcaattatactattgggggcatgtttccttcacatatatttgctaggcctggtagattttaagctcaagcacttcaaaagaaaagttataaaacttacaccaaccctattcattaaataaatagaaaaaatatattagtatttttctttattgcattcccatgttttcagggtcttctcatctgccgtccacattattgcaagactgtcaagtattggtttttaatcattaaaaaaccgtactt

SEQ ID NO: 2662 - DNA, 771 bp, Oryza sativa
atggtaaggagtggccacgttgtgtttggcttccatttctcgtaggaggtctctgaaggttttgtcaatgaagtgaaaacctcggtcgcttatgaccattctgcgggtaccaaatcttgggaagatggtttctgtgaacatcttcttggcgtgcctcgcatccgcggcgctgcacggcatagcctcaacccacttggagacatagtcgactgccaccagaatgtactcgcagttacgagacttagggaaaggtcccatgaagtctataccccaaacatcgaatatctcaacttgcaaattgtatgtaaggggcattgcatcgcgagcagtgattcctccttgcctctggcagcttgtgcatcttctgatgaattcttttgagtcttcgtacattgtcggccagaagaaaccactttgccagattttggcctgggtgcggaatgcacgtaatggcctccatagggtgaggcgtggcatcgttctataatcttaagtccttcatcagttggcacacatcttcgtagtaagccatcggagcatacccgatataggtagggctcatcccatatatgacggtgactttcatacttcagttttcgttgattttcccctggtggtatgcacttggataccatgtagtttactatgttagcatatcacgtgttggagtcgcgaaccgtcatcagcatgtcatctctcaagagatcatttatcggttgttcctgcatgttagtgatgtgcaatctggacaaatgatctgctacataattt

SEQ ID NO: 2663 - DNA, 686 bp, Oryza sativa
atgtttttgaccggaatcaaaaagttcaaaagcgccaaaacatgttttttggacattttggagtgtattgcgtgcgttcgtggcaaaaactcacttcgtgattcgcacggtgaacttttctcaattaatgcgaatattggcacacgagggtgcgatgtttttgaccggaatcaaaaagttcaaaaaatgccaaaacatgatttttggacatattggagtatgttgcgtgcgttcgtggcaaaaactcacttcgtgattcgcgcggcgaacttttatcaattaatggcaacattggacacgagggtgcgatgtttttgaccggaataaaaaagctcaaaaaacgccaaaacatgatttttggacatattggagtgtattgggtgcgttaatggcaaaaactcaattcgtgatttacacggcgaacttttatcaattaatgccaatattggcatattttggcccaaacgggggcgatgtttttgaccggaatgaaaaagttcaaaaagcgccaaaacataatttttggacatattggagtgtatagggtgcgttcatagcaaaaactcacttcgtgattcgcgcggcgaactattgtcaattaatgccaatattggcacacgaaggagcgttgtttttgaccggaatcacaaaggtcaaaatacgccatagcatgatttttggacata

SEQ ID NO: 2664 - DNA, 728 bp, Oryza sativa
ttcgtggcacgttgcacctcttgtcagaaagctaagtctcgtttgaatccacatggtttgtatatgcctcttcctgtaccttctattccttggacagatatttctatggactttgttttgggattgcctagaactaagagggggagggatagcatttttgttgtggtggatcgtttttctaagatggcacatttcataccatgtcataaaagtgatgatgctgttcatattgctgatctgtttttccatgagattgttcgcttgcatggtattgtgacatcccggcctagggcttaataggattaatagaatactcatatcaacaagttgcaacttcttttccggaagccaatctccaatgaactccagggtggcctggagcaatttgggatgggtgaccgaccgggaaattcttcccgggtgcacacgagtgaggacaaagtgtgcagaaaatatatgtattggtctgtgaggacagtctattacctatgaaagctatcagatgtaagcgggcccggcctaggggaaggcgggacgttacaaaatggtatcagagccgactctcgcggtttcacgggcgcgtgtgtcgcagttgcgcaggcatggtgcgcatggctggtgtaggccgggaatggttacacagcatggcacatgcgctggcactggacacatggacgtggccaagagaggacgttcctagcctagggttgatcgacgggggcgtcgat

SEQ ID NO: 2665 - DNA, 6164 bp, Oryza sativa
ggccggacgacgatgatggttgaagcggcggcgctccggtgcgtgctccagggcgttgtcgacgtggcttgcgttcccggcgatgcactgcacgagaggggtttaggtcaaaagaggaaatgctcggcattgtgtggagagatgggaacgcgaaagagatggaggtgaccttgactcaaacggagatggcgaaggtcgtcgtcactacgaccggcggcgaggttgaggatgacggagagccagagaacctctccctcggcttcttcagctccaaagtgatgtgtggagaatggcgacgcgtctgggaggagtagagagcgagaaaagggaaaccgagatcgacgacacgttgcggccacgcgtcggctcgctcaatctctccctctctcggctggaacagtggaggaagtgatggacagagtcaaggcaagcttaagaggctgtcaagtgggtccaggtcgtggcaaactaggctagggtgagagggttgggtaagattctgggtaaacttgatttttagattaatttcggaattattttctcctctaactttgaaactacataattcaatgtgtggaccaaattaattagtgttgattttactggaggtaaatgattacacctagattccattttctttggttgcactcaaaaataatgggtggactgctcacagaaattaaacaaagatgggctattagaaagctagattgaatttttaggaggcttaaacagagaaggaaaattctagaaaaattacatttattcatgataactaatctagtatttgaataaattattttccatgttcacttatgtgcagttaaatgtacttttggatgaaatatggttttagccgattaaaatttaatttgatttcttttagttgtctgtttcgaccgattaatttgagatatcaacttgagtgttaacacgttaccaaattacggaggataagtttgtgctaatcattgtccacataaatttttccatgattttatcttgcacaaaatattttagagaattaagatgacctttgtttgtatatgtgttcccacttcataattgcatctaatattattatagggattacattaaacttcttttagactgagaagatgatatttgagtttaatattaagtccacatgttatcactcaagattactataggtttgtttagtgaaataattcttttagattatgctcatgggagctattatggaatacaagtccaaaactccaaatgcacaaagaactcgagggttaagtttgcttggcctggagcaatttgggatgggtgaccgaccgggaagaatttcccgggtgcacacgagtgaggacaaaatgtgcagaaaagacatgtgttggtctgtgagggcagtcatgacctatgaaagctatcagatgtaagtgggcccggcttgggggaaggcgggacgtgacaaaatggtatcagagccgactctcgcggtttcacgggcgcgtgtgtcgcagttgcgcaggcatggtgcgcatggctggtgtaggccgggaatggttacacagcatggcacatgcgctggcactggacacatggacgtggccaagagaggacgttcctagcctagggttgatcgacgggggcgtcgatctatcttaagggggtgagggtgtaacatcccgacatagggcttaataggattaatagaatactcatatcaacaagttgcaacttctttttcggaagccaatctccaaagaactccagggttaagcgtgcttggcctgtagcaatttgggatgggtgaccgacctagaaattcttcccgggtgcacacgagtgaggacaaagtgtgcagaaaagatatgtgtgtgcttggcctggagcaatttgggatgggtgaccgactgggaaattcttcccgggtgcacacgagtgaggacaaagtgtgcagaaaagatatgtgttggtctgtgatggcagtctatgacctatgaaagctatcagatgtaagcgggcccggcctgggggaaggcgggacgttacaggtatgccttctactattgtttcagatcgtgatgcaaaattcttaagttattttgggcgcacgctatggaacaagttgggtacaatgctattgttttttacaacatgtcacccacaaacagatggacaaacggaagtagtcaaccgcactttgggtaccatgttgagggctattttgaagaaaaatttgaagatgtgggaagaatgtttgcctcatgtggagtttgcatacaatcgggcaacacattctactaccaaggtaagtccttttcaggtagtgtatggtttcaacactcgtgctccaattgatattttgcctttacctactagtgagagggttcataatgatgctaaggcatgcgctgaatttattctgaaaatgcatgagtcaaccaagctcaacattgaaaagatgactgaaaagtatagaattgttggtagtaaaggtaggcaagaggttaagcttgaaccgggtgatttagtttggttgcacttgagaaaggatagatttccagaattgagaaagtctaagttgatgcctcgtgctgatggtccttttaaaattgttgagaagattaatgataatgcatataaacttgagttgactcccgagtttggggttagtcccacgtttaacatatcagatttgaagccatacttgggagaagaggatgagcttgagtcgaggacgacttcaattcaagagggggaggatgatgcggacatcactaactcgcatacatacaacaatcctccaacggtcatttaaggaccgataacaagagctcgtgcgcgacaattaaatttagaggtgagctcgttcctatgttcttctttgtatgaattcgagaatatattgctacctaatgattatattgtgattaggaacaatggaggggacaaggagacacttggagaaggacttagagccatggaggatcattgaggacgtccaagtcaaggtggaggcccaaaccaattcgacctcgggtgcaattcggtgtgcaggaccagtttgcactaaaacgggcgcccaggtcgcatacgtgctcagattgggacgttctttataacatttccaatggttttgctcccacgtccaaattctttccgagtcaatgggaatcgaccgaacaatttgacgcccagaatctgtcccggtgctgcatcaccgtattttggcctttgggccgtgtatcgtgttggaacccattagggttgcgttgagagggggttgcacgaccctaaactctatatatcagtactgtcaccatctttaggtttttgggttttgtttagattattctgtcgagaacagtttcgctgctagatcggtttgtaagaccccaactcgtgagcttaatcattcatctgcaattttggttgttttctatctcgttcttgtttgggttcttcgattggcaaacagggattagccttctcagtgaggtcatccgcgtttcgacacgggtgataaccagaggagacgtggtgctgcgattgcggggctcaagagagtgcgcgttcaagaagccgggtcgatttgtgtcgcgactccgccaaaatcgttttttatcaaaaacctttcagaagatcgggaaacctagtgcacatcatgacgactcctgaacgacaccaacctcgaccttgccagtgatcgggagagacaagcctactacatgctgagcgaccgggagtatgctcacacgcaagaatactcaccggagttgctgaaaaagataggtatggatgttgaattttgttctatttggaaagctattggttggcagagatttactgtggtagatgagcctggttctcgtttgcttactttgtaatttctgtgcacttcgaaagaaatagaagatggtatttctttttgctttttacgtaaggagttcatgctcacatggaaaggcttgagtacacttcttggttttcacgattcctgtaagatcgatctcgagaaaggaatttctgggttcgagaaaaattggttttgggaagatatttttggtgctccaatttgcaagaaacctagaacgaatgatatccataatcctacacttaggctcatgcacaaatggattgctatgactttgtttcctagaggtgatataagaccctttaggggggatgaattaattatcatgtttgccatggttagaaaaatcaaaattgatcctgtaaaatgtatgataaggcaatggtcagaaagtataaagttctctgctcctgttgagtgcacttctctgattactcggatagcaaaagggctaggggtcgttagcgaccaaattgcttttatctcagccgctcgtccgtgtattgatgaggcttatctagtgtaagggcatattctgaaacatggagcagatggatctttgatatactttttccatggttgcacaaatgaaatcccattgcgaaatgcgggatatcatttgtacaactaccatgaactaaccattcccctgcagaccatagaagaatctcgtgcaggtggaacatacagggagacgcgcaacatgacaaggaacgaacgagaaagttcatcatactcgacacccgtgaagatgtatgaggcaggttgggcaccaactggggatgcacccgggtggacccaagctccacgccatagcatcggagtctcaacctggcaagcgccagttaggaccggtggcatgcgcctcatgacatccaatggggggacaatcaacctcccagatcaagtggtgtgcctccatctccaagtgaatggggctcgagttcctctcgttgggacttgggtgaaatcactaggagaatggacacccttgatatgcagacgggggagatccagtacaacctcacggaacacatagctcagacgcaagaatggcaacaatctgctgatgctcagttcgccaacatcaacaacatgatgcagcaacagcacgatgaccttcaagcatacttccgttttcagggattcaatccttatcaaggaccctgagcgaaagccaaacttggggggagacatcgctccccctactaaggtaacttgtatcacattgcatatttctctttctaattgcatatttgctttctaattgcatcttataaaacttgaaaacaacataaaaatttgaaaaatagaaaataccaaaaagataggataggtttgagtcatgctaggtaagacaagctagttctctttattgaaatgatgaatagttgctctgttttatatctctgctatatgggttcttggtaaatactctctcaaaggttaaatataagtagccaacaattatccgggaacctgaggtaaatgggctgcacttgctgatctaagtttaggttgttgcgagatatgagatagtaaataagagttacgatgatcttgatactagtttgacttgaattccggatgttttgtaaaattgaaagttcctcatttgatataaattcctaccaaagccaaaaatgtgctaccttgattaaaccatatacattttggttatttgccattccattgaactttgtcaaactcttgtgacttgtgtagatacttctcatgctcactgatcaagatcatacacccacatatatgcacatgctaaactcctacattgggagctaagcaatattccattccatttccatattaccaccaaaataaattctccatgctttcatgtgctttcttctcctaaaaaaaagaagaaggagggaaagacatggttatgaaaagaaataataaaatataataaagttatgctccatcaagcatgagcatgattgaaaatatatatatatatatagccatgccctctcctaatcaataaaagaaggatttttgggagaagaaagtaagcacaaaggagaagcattttccttttatttttcgtcatataccatttccaccatataccacacacacattatgcacgatcttgatcttgagtatgtttagttatctgctctagtctaagtttttgacttagtaataaatgtgaatacaagtatgatgtgaccatggctactatggatacgaccattgctcacatcatgaatcaacaagaagacatcaagatcaagtcctccatgtgctgcaatctgattcggccacgtgttacattggtgacttcaaa

SEQ ID NO: 2666 - DNA, 585 bp, Oryza sativa
ggccgacactgagtatcgctaccatccccgtcaaccacagggaagtgaccgtggcagctaccttaagactgaaggaattgagaatgatgctaccacaaggcatttggttgagatgctgtgggctatggatgaaagccgtgtggagactgtgttagcagctcaagatcgtgaagatcggaatcgtggtaagatttgcacgctagaagacaaagtggatcgtttggagaaggaactagccgcgttgaagggagaagcaccaccgcagaaggccagggttcgtcttaccgcaaggaagagagctctatttgtccatcgctaccaattggcgccaaaggtccgtgtggtggaaaaaaaagttaccccagccctagcggattctccggtcgtcaacataagtgatgatgaagtagaagaatccaagcgcacccattccaagatcgagtggggagcaattcaagatgatgaagacgagccgaacgagccttcaatcaactccgatgcccggaagaattagaaagccttgtcaaaccgttgtcttagatcgttgtgttagtttgcttgttttaagtttggttgtgtgtgcct

SEQ ID NO: 2667 - DNA, 815 bp, Oryza sativa
aatagaatttcaaggagtaccatttctggccaatcttatcttgttagaatccaaagacttgaatgtcatcttaggaatggactgtttagccagatataaaggtgtgatagcctgtgttaacaaaaaagtatttctccccagtgatgatggtcgagttgtaactgttcatgcattgtcttctgagtctttagggtcaagactgaaccaaataactttggaagagattcctatagtccaggagtaacctaatgtgttcccagacgatttacctggtatgccgcccaaaagggatatagagttcagaatagatttggtaccaggaacaactccgatccataagagaccttatagaatggcagccaatgagttggcagaagtcaaaaggcaagtagacaatttgcttcagaaaggatacatcagaccgagttcatctccatggggagctccggttatttttgtggaaaagaaagatcatacccagaggatgtgtgtggactatcgtgcactaaatgatgtgactatcaagaataagtatccgctgccccgaattgatgatttgtttgatcagcttaaaggtgccaccgttttctccaagatagatcttcgatcagggtatcaccagttgagaattaaagaggaagatatacctaagacggcttttaccactaggtatggattgttcgaatgtactgttatgtcttttggacttaccaatgcccccgctttcttcatgaacttgatgaataaggtgtttatggaatacctagacaagttcgtggtggtctttattgatgacattcttatctactcccgaa

SEQ ID NO: 2668 - DNA, 1103 bp, Oryza sativa
ggaaagagcaaaatcaccaaaacagcacataaacaagcatgaacagtacatgtggatatttttaacatgtagatctcaattttagaaaaatttagagacttgaaccaactaaatccgagctaagatgaattagttatgaatttttgaagattaaatcggattaaaacacttatatggattttaattgaattatgacgcaataatgaattatttttgaaaaggaaaaggggtttattgcgtcagcggctagggtttgcggtggaccgggcgcacggcagcggttcacgggaacgaacggccgagatcgatccatccaaaacggacggccgagatcgatcgggtctacggcggctcacggcagacggccacgatgacgtcagcggcgacgtcactccggcggcggctcggcggctcagcggctcgggcgcgcttgctcgccggcgaacgacggcgcgacgacgcggacggagggcaccaggacgtagagcgcggggcggcgaactcaccgatgaccaaaacgtcggcggaagatgaacggacggcggcggcgacgagaaagaagcggcggagaccttcggcttgacgacgacggcggtgctccggcggtctacagcgacggcgaaggggcggacgaggacggcggcgacttggcgaccacgatggcgacctccccgagcgatgacgacgaccggaacgacggcgaagcacggctggagcgacggcgacgactgcggctcgaggttacacggcgctagggcgcttccgacggcgagagacgaagacaatggtggtggcgggtagcggcgacaccggggatccttttataggggcaaggaggcagcggcgaaggcccacggcgaccggcgacgcgaaagaaacattggggttcggaggaaagagatcgatccgattcgacctcgaatccacgaacttccaaagcgatttagacgatgattccaaaagagaaaaggtagaggagatcccgaagattgtttcccctctattgatttcaccggatcgggaaagacgcggccgaatttggaaagcggcggcggcgacttggcgctagggtttcgggcggcggcggccggaggtagacgaag

SEQ ID NO: 2669 - DNA, 498 bp, Oryza sativa
agttaccgatcatacatcaacgctacaaaatcactgttcactaaaccttaagtgagttgccatgtctcgtagatggcaccctccatctctaaatcttggcttcgccactgcaaagagaagccgtcatggcggtgatggcggcaaggggagctggcggcgatgaagtgtacgcggccagtggcggtttcagtggtggtgaagcatgggacgcggcggcggctcgaggaggggcagcacgcggtgaagcatctaggcccccggtgttaattttagtaattaatgacaagcgctaattgggactaaccgttgtctttgagctatatattttaagttaggtcgacgtcatgtgtgcgcatggatgactatcgatggattaaaatttgatggcgcgaagcgaagaaaagaagacggtaaaactagtgctttaatttagaattgatcgaggtgtagggcgatcaaatttgctagtttattttttagtttcgccctactattaag

SEQ ID NO: 2670 - DNA, 1423 bp, Oryza sativa
tgtactgactcttgctattgaattaatcttttgtttgcaggttttagtcttagtctttgagtgatgcgggtaatcgactgcttcttctaggacttgaacttaatggggtaaacccctagtcggtgtgcttgtggattgggtagacaagcttccgttgttctatatatttatttggccggttggccaatgtaactaaagtcgatgtagtttataatcgctttcatcttagttgtgtttgctatgtataatcatgctcgagatgaaagtgtgaatctagtgcacatcctgggaactagattcacatgagtatgagttaggaatatttgggatgttgcagatctttagccatttttgtcaagtctcctgaatgtgtaacacatctggccgccgccttcgagtggtttgacgggcacatctcaggctgaagttgactggcaggctaagggcccagcaatgtctccaatattcctctctcgaggcgtcggatgtttcattatgcttgtttgatgacttgaattattcacttcatctctcaaatataatggaaggtctggagagcctatgacagcatggtatcagagcaaataccgactacaggagccccttaagttgtcacttagaattgcttcttaaaaattattttgagtgctatgctctcagttacaaattatttgcaaaaatcatgttcaatcttatatctcatccttctttagagattattttactttatgtctcatgttttgattttaaaactcttatcttgctctataggaccgaaacattttggaaatactatttttgttgaattttatttgaaatcacttaataatcacagcaaaacagtaacatagtgttttgaaaagttttgaaatccatttgcaaactactcctatgtattagcacggatttctaaaatatcgggttaaacatagcccctagtaaatgggttttgaaaatgagtcgataaaacttaaaacttgctagacaatattggaattccatctccctatgttatctctgaaccaaaaatgaatttggtgggattttgtactttcctctcccgatatttcaaaatttcaccggtatggcctaaaatgtgtagttgggtatagaatagaatttgctgtgcttaaccctctagattgtttgcttagatggaccacccaaaattcatctagcctctggaccaccctaacataatacgactaaaaggtgataaaatttatacaacctaaaacttgattaaagtttcattttgtgccggttgttcttttttttttctggaatcttgagtcagtctgcttgttatttttgtctagactaaaccgtaggtgataaacctgagaattttttacatgcatcatgtagactaacccagtaagcatcatgaattttggcataatttttagacccgtgcatcata

SEQ ID NO: 2671 - DNA, 118 bp, Oryza sativa
tgtttcttggatggatttttcatgggttggatggccctttgaataagctttccatagagtccaagaacgccaaattccgagacccgagtcaagagatatcgtcgttttactaacggtc

SEQ ID NO: 2672 - DNA, 2103 bp, Oryza sativa
gtatttacctaaaaaaaaattactgtcagtacataagaattacgttaatatcataaaataataatgtaccataaataattacctggtggcagcctagggaactgatcaggatacttccttattggacttagcagaacccggtggtcgtgcactgaccccgaccatccagttacatcaaaaattacacggtcgctccagtctgacatgaccaacacaatttgggtagtttcacctacccggttatggtactaatttgctaggtgtgcagggacgacaacttgcacttttgttcatctatggctccaatagagttttcaatttttttttacctatcattatagcggacacatggatgggtagtactggaagttgggtccaccggccgaactatatcacctgccatacgggctatcgctcgaagcaatggtaaaaatatttggaaatagttgacccgatctttcgaacctattgtttgctctcctattagcttcaccccctgacatagttcacaggaaaatgctaccgcttccgcttccagtgcgctaacctcataagacactaagttgtacttgaactgaaggatgtcactagcctaggtaaaatcacctaatcaggtcacatacagaacatgctcctgcaccgagcaatattttgtaatgtatgcatcacccactgttggccagtcagtaggggcacgcgacgtggtgcccttttgcggtcgtacaagtccagatgtaatgaatccttcgatgaaatcctcaatgtattcttcgatatcatcgtcggatatctcccccatcgaacatttagaatcatcgctgctcctagtgctcattgcttcagaactgcacagatatgattcatacagacacataagtaatccaaaatcaattgttgagctaacacatataacattgtgaactggacgtttcaataaatctaaaatgcaaatgtgaactagactcatgacataaaattgttacaacatgacaatcgcagcacaacgtttgggaataaacgaactacacaaatccaaatttaactagacgaaatacacatctctgcggcaatactcgcacgtgatcagaaggtagtagtgccgcgagaaactactggcagatattggtgaggtaaacctattggagctccactgcagagaagcaaggaatgggaagctagcagaagattagcgatagcgcggttcctcatctacgacgcttctcattgcacgcatgtcctctgcctatcgcttcctcatcatggaaaaggcgatcctttctcattgggtgtaccgcctcccatagatagaggatacaatctaaaatagttgaatctttagttgttttatatttggattcttacattgtaatatacaacttgaattatatctggattcttacattgtaatatacaacttgaattttatgggattttgatcgtagagtttaatttttttcattcaaataagctggatacgttgttgaatataaaaacacctttttttcatgtgttgtaatccaaataagtaaataagaccaatcaaaaaaatttcattaatgctttctttgtatgaagtaatcttggggcaattgtttatttgatcctattttaaagtctaacttccaatttaaccctacttttttagtttgcttatatgacctcgttttttccaatcaaaaataaaaggttgacgaccctatttcgtgaagacatgataacggtgttaactaaggggcgaattgtcctggttgcccttgctcatatgacccaaatgtatcaaagttttttttgtttgttttgactttttaacataatttaacgagcataactttgatatattagagataactttgataaatttggattcaatttgacagatttggctcaatttgataaatttgactttaatttaaaaaaatgacataattatggcagatatacaaaatttggacaacttttctcctatttgtccatcccaaatccaagtgatattcatatccaacataaaatttctgtccaaaagcatgtccatcactatgtgacaacacatacaagtcccaacatcacaccaacgaccaccacagccatgctgggcttgggatg

SEQ ID NO: 2673 - DNA, 49425 bp, Oryza sativa
tatatgtagcacacgagcttaattatactcctccatgccctattcacgagaaaaaatatctaataattttaacatacatctaaacaaaattagaggtttggccttacgtggtacagatatacaaccatcgaccgtatactcacgtgcgcatgtacttctactctggatcgatatcggtcctgaggaaaatgcgagcctaacaatatattagtttctaatatgctttcgcaacattcttcccattcaaaactatataaatatatatttatatctcattatgtgtttgtccaaaggtgaaaagagaatgacaggatgcaattaataacttggggatggggaagacacgggaccggctgagtatatatagaacgatggcggatggatctcctctctatctcctgcctacgagctgctttgtttgcttgcaggatttttagctgtactttgctaggggatgccacaggcttctaaaaagtatgcccattttgttcccatgcgtttgttgcattccttggctgcattttttttttgtatggtttcaggcttgtccgcgagtgatttcagctactatgctgagtttgctgccttgctatacgtgggctttgtccgtttgctccaggtcttaaaaacagtgaaaaatccacggctctgttggttattacctctgcttctgtggcgtattaatcctctagctagctacctcaagctttgaccattcttaccctcgagtgtgcatggcctggcctggctggcaggccagtcatccttgaaagttgaaagttcttctcttttttttttcagaaacttaatttgaaagttgaaagttgaaacttgcccctctgatcacaatacaaaccttcgttttaacggtattcatgcactgatgcgatttctatgtttcaatgcatgtaaatttaatcagatgcttggaaagaaaatctaattaattcaaaattaaaaaattgacaattaaagtaagaattttttgacctaatattattgtttgctaaataacccaaaaatccttatatttcagaacgaagtgggtatattttaggacttttgatgtagtcttcgatattgtaggagtgatgttaagaatttatttttaaatacaaatctacgatacattctttcacagcgtgcttttataaagacttcctcgatcagaccttaacctctacgattttaacaaatccaatactagaactagcattaatgaagatatttatatttaaaatcaggccttaacctctgcgattttaataaatctattactagctagcattaaaaaatatttgtatttgaagtttttcgaattttacatgaaccatacatgttcaaaatggcatgtttttgttactgaaggagtatgtttttagccaatgtcctatgtgaaaagaatttggctatattggtttttgaattggctttccccttcagaaaacttccgaggaagcaaactaattaaacatcttctgaaaattgcgaaatgatgtccaatcgactgtttttaagaaatcatggtataattctggcctataacaccaactatgatgtacaattacatcggcatttgctaaatgtaaattaagacaaggagcaaaagaccaaagtaacaatttggagcaacattgtttggactcgatgatgatgataaaagttgtttatacttctttcgttaacgagggcacggctaagatatttcaccatcgcagatcaaaagtttctccaaagcaaattcttcaaacagaaaaaggccgcttaatacggtgcggtggaggcctcgtgctgccagtgtggtggtttttgagtggatgggcgacgaacttcaagaaaggttgcaggggttccaggcgaaagccatgtctagtagttcaccgggccggcaatggctacgccttcgggtgttgtaaccccctctagggcactgtcgaggattcatctcttccttggcgagtttctcgaggtgatggcggcgtctttgatgtcgtgatctctgtgggggcatcgttttagagtctcgtctttgttgttttgtcgtaggcctagtggcgatcggccacgtatagcggaggtcttttggtgctaggttcctctctcggtgggttgtgtttgtgtggttagcacgtggttcttagtcatgcactttggtgcacttctgacttcgatagtgtctgtcgattgttgtaatttttttcctttttaatatattcggatggtctccttcggtctttcccggtgaaaaaaagccgcttaagtcgatgccgtcgatggatctaattaactggtgtaggtcattgagagttttcacctaagttgcttgttctccaaaatgaccaaaaccatgccacaaattctgttggattgaactagaaaaggctagattttctaaagtctatagctcagtacacatattcgactattaaaattaagattattgtaggttataccgatcaaacagagacgtcagttgcggagacagggacggctagtagcatggcctcctcgaacaatacttctatatctatatttatattacctaattaaaaaatacgtaaggtttcgtaaaaaaaattccgtccgtcttttttttctttttcgtccttttttgcaaatttttttcgtccgttttcctttatccggcggaaaaaaaaagcgtgcaaaataaccacatgcaaaaaaaaactggggaagaaaaccgcgtgcgaataaaccaatcggataaaaaaaccgatcggacggaaaaaaaccagcaagaaaacagcctattggacttttttttctcagtcctttttcaccctttttcttttttcttttttctgttttttagtcttttttttgtccgtctttttttctgctctttttccatgtgctttttaattttttttctgggccttttttccggttattttcatatgtttttcttcgttgctgttttttagttgtatttttccgcacgcggtaaggatttgtgccatgtttttttcatcacggggcgaacactaacgtcgccgccatgttgatctatcttcccatgcgttccctcctccaattgattgccaaacatcaatcccccctactccctcaccattttcctcatgattttcccttttaactccgctgtaattcactgaatttaatctctatttaaaaatcaccggcttttttttctttccgtcctttttcaccctttttcttttttctttttttttctgtttttttcgtctttttttgtccgtcttttttctgctctttttccatcggctttttactttttttctaggccttttttccgggttttttcatatgtttttcttcattgctgtttttttagttgtatttttccacacgcgataaggatttgtgccatgtttttttcgtcgcggggccgaacactaacgtcgccgccatgtcaatctacctccccatgcgttctctcctccaattgattgccaaacatcaatccccctactccttcaccattttcctcatgatttttccttttaactccgctttaatttactgaatttaatctctatttaaaaatcacctttttatctcgagttttgtcgcttcgatttcaataaaaatggaaagaggagaactagtgtatcaaaaactctctaccaatttggaagatcgagaaagattcgactggatttgatgtgggggatttgaccagatttgatggggagaatcggggacctacagctccacttgacaaggaaggaaagaaatgagtttttgtccaaaaccaaataggaaaatatatagcaatctaaaaatgtttttacccgttgcaacgcacgggcattttttctagtatattgttaaaatacgtaaggtttctgtttttttgtccgtcactttttttttattttcatcttttttttcctttttaccgttcctccattttttttcttcgcttcttttttccttttttttcacccgttgtttttttctcttttaacgttctgtttttttttctttttcgccgtttgttctcgtcatctccaccgccatgtcgatcggtctccgcattctctccttcaattgatagtaaaaatcgattcctcactactctcttattattttctccataatttttcctttcaatgccgctttaatttaccggactccctcattatttttcccataatttttcctttcaattccgctttaatttaccagatctaatctctatttaagagttttatggattcgctcagattttgataaaaacagaagagtagaataagtgcatcacaaacccttaaccaattttagaagatcaataaagattcgatgcgatttgataggagatcagttctagcatcacactcttccgggctttgatggggaggatcagttctagcatcacactctttcgagctttgacgacagcagtcggctatatgagttgctataatgtatagtgatcgaaaatgtttttatctattgttaaagacgacagtcggctatgcgagccgggcctacagctttactcgtgggctaggtcaaagagacgcacgccaagctgagagaggtagcgggctaggctgggataaaaatagaacgaagaaataatcttttggcccaaaaagagtataatgtatacgattcaaaaatgtttttatccgttgcaacacacagatattttttctagtttacatatatataatcatgtaactaattaggtaattaaccaaagtaatagcgtattaggttatctccaagactcttgggtggtctctcttatgttagaaaaccttactcggcagcagagaaacatgcttaattaaatgatcaacttttaaggtatagccaacttgaaaatacatgaagcggccgacacgtacggatctaaggacgagacttcatcagaccatgaccaccatacgcagaacccctatcgcacttgccaaaccgtcgcgatctccacaaatcgagccaaaaacattctgcactgtacacgaccaatttgtatctgcctagctagccaccctggcacgctgcagatacaactagcttttgctcgctcacttagtttcaactagagcttttgctcgctcgctcactactatcttcaatttatttatagctaaactaatagccaattcatacaatagttgcttactatactattaatatatagtcccacctgtcatatacacattgcgtcttggagtccgtgttgcagctggctacgaatctgtagcccgctgctcttctctctcatcgtttatctcattaaaatatgtttatagctggttaatagcttgctattgtatctgctctaagtccattgtaatctatcttccactgccattgacaacaagggatcctaggtaaacgaagattcctagtttgtaaacttaaaaagaagaatggacaactacatagcatcctggtctaattagaatttagcatgtgtgacttatgataactatgtgcgtatgtttactatcaccttgctagtttagtaagagtggaaccgacatattagaattcatcccttcaaccatatgactcccgggttgatccttttatacgaagcgatgatggaagtataagtgaggtggtatgtgtaagtgggtccacctgtcaaatagactggttacgcagttctgaagggaaggctattacaatctattcagcataattgtactaatataggccaaagagaaaaatggtcatagacctaaaggacccagagcaggggaaagggaatttaaaccagtgtggtagcttcttctagaatcggctgtctcattaaaatgcaatgtccaatttgcagtatccaatttgcaagtggtccttgttgttttagcaactaaactgaagcacatgctgcctccaaccccagagcaatgcatggggtggcaactggcaactatctctaccaagagacaaaaaagaagtatgattaagtgtgggtaactagagacataaaccacaggaataggataaacaacaccaagacaaacattccagtcccagtagtgcttatagctaggctagaatggtgctaagcacaaactgcatcacgtgaacctaactaggaaaatactatatgctcatactatcatagtagtaagaaagcaagaggaatttaattctctcttggaagaacaagaatccaactaccaaatctctctctcccttatcccctttaacctcttcacaaggatttcttctttctttcttttctttttctcttttgttcttgtgggaacatgcatgacaggtgcaggcgtcagaatacggatgggcacaatggggaaggaggatgctaaacaacaaaaccagcgtcaggccagccagcatagaccacggtttgtgtacacacacacacacacacacacacacacacacacacacacacatatatatatatatatatatatatatatatatatatatatatatatatatatatatatatatatatatatatatatatataattcatatatacacacacacatgcacttgcttccaaggcacacaccagaagaatatcacacaagcagaagcaaacagggcagcagcacatcacatagaagtagtagtagatcacacaccatgatgcatcatcaatatatgctctctaccaaaatcaaagccacgagccacagctccagccagccagcagtatgcagttggcactttacttggcacccacatcacaccctgccaacttccaaagcaagctctatactcaacagctgctaatccagacaagaacctgcagatggttttaatgcactaattagtaactagttgttgcatgaccccagctccagctagctcaagaatggaaatcagggttacaaatgttcatccttgaaaaggtaaagggaaatgtgaagggggaaaaagggggttagtctcacaaactggaacagaaaaagaaaaaagaaaaagaaaaaaaaaagagaggagacaaccaagaaacaatggaaggaaaacaagaattctagagatgggtctcctcccatacattggagtgcaatgtaggtaataatggcgaaacttggggaccttctcgccaaaaactcttctctctctctctctcaatattttttttccctttggaagttctctctaacagagcatgcacaattgcgagaaggcccccctacaattagtgaattgcggaactcggcggcggcgagcggcggcgcggggacggcggcggcggcggaggctcagacgtagccgttgcggctgaggtggaggaggccggagctgccgcacttggggcacacgtcggcggtcttcggcaccatgaagtacatgaagcaagcccggcagccggcggcgacgaggacgtgggcgccgttgtcgccgacggcgtagccgctgccggcgccggaggccgactcgtcggtgggggagaacgacgagagcgtggacgacacggcggagccccggctgctgctggcgctgctgctgctgctgctgctgctgctactgctgctgctgctctcctcgtcgtcgccgtcgcggccgtcgtagccgtagccgtagccatagctgccgtagccgtagccgtagccgtagccgtgcccgctgctgtcgtgcgagcgccacgccgccgccgccgcggtgaccgcgcccacggacgacacggaggtgtaccccgacgacgtggtggtcgacgccgcggcggcggcgccgcctccgccgccgcggccccgcgcgcgcgagcagcggcgggaggaggacgacgcggaccgcgacgccggcgacggcgagtacgccgacgacgagcgcggatcgatggtcgtccgggtgccgtcctcccagttgatgtagtaaacttgccccgtctgcatcagcaaagccaatcacaaagcacatttcacacaaattcacatgaagtcatgaactacacatcaaaattcatctaaaaataataacaataaaggaaatgcgcttgaactagacagctagtggtacagattaagttaatcttgcaaatggcgaaatgctgtttcaagaatgtggtgagtaaatgtgcatgatgcatggagaagtttgggtggggaaaatctacaagtacattttggtgacagtctgcaagaacaattaatgcggtggcattcagttgcttccgtgaaacaaggttgagaacctattaataactgatgcccataacaaagtacagcagaacaggggaaagaaaaaaaatctggatcaaatggtgtaatgaatgctgctctctttgtcctcttgtttgtttgcaaatcacagggcaaggttggcaatgaagaacaccaccaccaaattctcatttcatcctttgtaaaaaaaaaaaaactctaatctgcaggaaagctgttctacttaaaaagcacataaatgtattgcagtagtatcttcagaaaaggctactgaaataaccataagaagagcatttttgtctactctgttgctggagacaaggtggagatgaacactccattttggtgattaatacgcatgaatcttcattggggtaggcattcattcgtctgttcaaagtactagcagggatgaaaaagaaagggagacactttgtcacaatggaactgaagatttcccagaggtgagaatcatctggtgtttaacaaagctctgcgattagattagaacccaggaccaaaaaaacagagcattgtggtccagaagaaatctatagcgaaatctagagtttcagatagagacagagcaaaaaggaatggatctacagggatgtgtcagaaatttagaatgcaacacagatctgaatgcgcgcttagatcagagaccagagaaggtgtggagatttgaagagccttgatatcatcaacaaaaaaaaagaaaaaaatagtaccatcttttccgaggtttcttttctgaacttttgtcatccctgtgttaaaaagaacggcctgaatctctctgaagatgatcgaatccccaaccaaacgaagataagaaccgaagaaaaaaaacagagataaataaaaaaaatatttgcatagacgaagagaggaatcgcagatgaagcaaggatccaagaacaagaacaagaagagagaagggagacgaggagcagaaagagaagaggaggaagaagaaaaaaaaaatcagcgcggacgggtcgtctcgtctcgtctctctctccagttcgagcgcccgctttcgccattaatgatcaaatgattgatcccaatcgagcccaaaccaaaccacacccacctacctcggaaactgctatccatttatgtctccaaatgattggacaaagggcggcgcgccgccgcccaccgccgccgccgccgcaagaatcgatcggggaagaaaaggaaacgcggcgtatgcatgtatggatgcatgtgtggaagaagagatgggcgagtagtagtagacgtacccggatgtcgaggcactgctcccagtggtagggcagggcgacctcggagttgagctcgacggtgaccccctcgctgtcgtcgctcccctccgccgccgccgcgcgcctccccctgcgccgccctcctcctcctcctcccccgccgttgagggagcagttgcgcagcgacgaggcgatcatctcgatgttcggggcagtcatcaagtccaccaccaccaccaccaccccacccccccacccctccccctctccaacaagaaccaaacggacggcgaggaagaagaagaagaagaagaagaaggaggaggaggaggaggaggaggagaaggaggaggagaaaggaatttgcttttgctgttgctgccgcagcggctgccgatgccgcggtggtggtggtggtgcgcgtggccccccgggggtagcgtaggcagcgtatgacgcgtgaggctacagtggtggaggtggaggtggtggtggtgcctggttggagccactgttatatatactgccattgttgctcctgctgctgccaatcttgggtgtttttggggtggttttttggttttggttttggtttatagggttctttggtttggtttaggagggggtggagggaattggaggaacagtctgtctggacgagtgccaactgtgtgccaacatagtatgcgctgggattaacggacggacgccgatgcctgcccagggtatcgggcggtttctggttcacttcctacgtcttgtatgcttgcccaaggtatcgggtggtttctggtgcacttcctacggctgatatggtgctggcgggtgggggtgggagcgtcgtgatatgcgccgatggtttttccggcgcctatgtaaatctgggggccgtgagagaggttttgttttcgtgcgctggattcactggcgtgtaagtatgcgtattaggctatgagtaattgacggcttgtccgcttcctttttagtgaagtaatgatactgtaataatgagatatgcttccaaaacaacgagaggtcgagagcgatcaaggtgaaagttttaattaaccatgcctagcttcctggtattcatgaatggtattctatgctacgatagtccgaaggcctatggaacctgtttcacatgtgtataccgagtctatataagtaattgtgtgttccttatcaatgttgcattgaggatgctatagaagacaataatatttttttaatgaatgaaccagccttgatcttctttttgtttaagataaaagaagaaggaaaactgtgataatgtggtgtacgaccaaaggaagaaaagtataagcatgaaggggttgaaaggtgcaaatgatgaaagctttctgctgcagccaagggggagagagagggggggatcgatgaatgatgctagggggaaaggtaacatcaacctactaccatggccactctctctctctctctctctacatatcgctctctctcgtatggtgtgttttggtgttgcatgttgtccctgctggctgatgcagctagcggagctcaaaccaaaccactggcccggcccggctcttgggccaccatctcctgcgcagattcctcttctgccaaaccgaggaaaggttccccccttgtccctccctcctcctctctctttctctctctccttccttgaatcaacctgaccatttcaaaaactccatcacaactagctgaatttgtctcttggaaaatggcattagcttagcagcaaaatgtggcaataaaattatagaaaacatgcagtgttatgtacagtgtaactgtgtagagagagagagagagagtgtgtgtgtgtgtgtgtgtggaggaagaagaagctgagagcctgagagcaagcacggtcagtggcctctgatgtctttgacctactagcatgcatgcatgtacaccactgttgcaacatcagacgagatggatggatcgagctgggacgcatgcgagttaatacttttttttattctatattgatcatcatatatataagttttttcatgaaaaccaatgtgagttgagaacatttgaaacgttgtagagagttttagcaaaatttgttaagtcttctgaatgtgtaacacatctggtcgtcgccttcatataatttgacaggcacatatcaggctgaagttgactagatatgtgagattgtctcacatgttcactactcgatatcacatattttatttaatgtaattaagttgtgatggaaaaaatgaaagcttaacaacctctaaatgcgtgcatgcatacatgcatgcttaatttgcatgcatgcataaatcgcatcacttaacattgggtgagtatgaattatcccaagatctgaaatcagacatctttcatgctcaattattaatatcggatgaagaacctctaacttaatccggagtggttatgatcttagttggtagtcaagtcagcattttatttaaaaacaatatgcggaatccacctatcagattctctccgtttcacccctctctaacagatggatcccaccgatttcttaaaaaatgctacctagactgtcatgtaggaccaaaaccactctagattaagttaggagagttcttcacttgatattaatagttgagggtaaaaaatgtctggttttcggatctaggtgtaattcgtactcacctaatagtttagaggtgtaatttagactttctcctaaatacaatactgttgcacgtcaaaccaaagggcactggttatataatgatcaatttaaattttttagtattatatgatgatcaatatgtgaagggatcgatgatgtcacactacgtattatgttcgtttattttagaaagaaaggagcatggagaatctcttattaccatgtagcttgtctctgtcctctcctctccggcatgcatgcacgcgcttgcgttgcttcgtttcgcttggttgcttgcacgcttgtccatgcatgcacgcacgcgtggtgtaccgcgaaaatcttttggatggctgcgcctagctcgtgttcgtgcatctatctatctatctatctatctgtctatcttgcatcatcatcacgtactggatcgatgtatgtatctctttcctcctcctcctttttttgatctagcatatagcttaatttgttctcgttctcgttgttgcggtgtacgctctgctagattccaatgcagatgcgtggtagtactcctacgtgggtaacatgggacatggccgttgttgcttgctcgctttgctgatctctggtggtttctctcacgcccaatgacgacgacgaccatgatgatgattgatggaactccggaaagggggagattgttttgtagggccgtagctgtctctggaacagatatgctgcatcgatctcggaccaaccctgctactagtagtggtagtggtggtagcggagatcggtcgatttttttgggccctgttgattcaagtggacgggcaaatgcgaccctccccacacggttgtgcatgggatcgacgttttcctcctcccacgtactacctccttccctaaatgtttgacgtcattgatttttttaaatatgtttgaccattcgtcttattcaaaaacttttgtgaaatatgtaaaactatatgtatacataaaagtatatttaacaataaatcaaatgataggaaaagaattaataattacttgatttttttaaataaaataaacggtcaaacatatttaaaaaagtcaacggtgtcaaatattttgggatggagggagtacgtacgtactacctccgtatatttcgatagaatcgactaaggcagtgtttgtttctatggaaggaagataaagttagtgcacagaaaacacgaaaaggaccccgtaaaaaaacacgaaaagtcattattaactcataatttattaataagttttcattattacaaaaaaattgtgcaacaactttcatttatcaccgctacataacaggtttttccatacggtccaatcccaattttcacggatggcagggcgatccacatgcaccaaatggtctgtgaaaatcgttcacgcgaaaatccgactttttacgtgcgggtgcttatgtcgcccgctcgcaaaaataaaaatccaaaaaaattaaaacccaaaaatggcgaaacctaacctgccctcctcgtcgtcgttgtgggggcataggggcctagcggcggctgggtccgcccgctcccgtcgccggagccagagccagatccaccgccactgtgcctccccactgccgccgcgcggggtagggcagccgctgcccctccccaccgttgtatccgccgccgccgcgcctcactgttggtatttattatgaccacggaataatctataagcgcacaaataccgttgtagccttcacccaagagtatttcagtgtatcatatccacagtaaacgtgtgtgtataatctaagaacgaaattcttcgaaggacaacaactaaatggtaggcttgggatagagtggactcctgtgggttagttatcttaattaagttaacgtaaaactctatcacatgggcaagataacttgtcaaaaaaccaaatcagtgccaggtccattggtgaaagactatcttagcacaattttccatttgaaaaaataatagtaaaaggacctcgacaatcctttgctagccaataattcacatacctattcatgtaaacaaatcacaactacgaaaaggattttttcgtgcggtggaaaagggttttcacgtgcgagtgggcgaaccgcacgcacccagttgtctgcgaaaatcgctattttttgcgtgcgggtggcgcaccctcatgcgaaaatctgattttcgcgtgcgggtgcttatatcgcccgcacgcaaaaataaaaaaccaaaaaaaaataaaaaaaaaccgaaccctaaccttgtcgccatcaccatcgtcctcgtcagatccgccatcgccacgcctcctccctaacctcaaagccgccgcagccgtcgtcctcgtcgtcgccgttgtcctcgtcagatcagccaccgtcacgcctcctccccaccgcccgccggccgccgccaccaccaaataagtggcttccaggcaagcatgctctgctgttcctcagaagtctcaaccaccgtattaatcagaagagtgcccaaaataccacgaacttccaagcgaactctatatggcaactctccattgaggggctcaataactgtgtactatggagcttcaatgtaaccggcaacaaatgtcatatttgcaagctccgcaacaaatccttccatgccttcaccatggtgagtacagggagaatcggccatctaaagaaaagatagaaggaacaaaactgactccgatcagaaacgagatgctggcattaaaactggaaacaaaaagaaagaaaaggcactaaactgaaatcaaaaatactgaagcaatataaatatttttttaaaaaatactatttttggcccaattttttttttaaaaacgaaactctccctttctttttaaaccgaaacccttccctttttttctgccaaaaccttttccttttttttgccaagaatttttttccgaaaatattatttttctttttgaaatgccgaaaacattttttttaaaaaaaatcaaaaggcacaaagaaaaatatttttttgatgaaattcagaaacttgaaaacaaactcatttatttggactcactggaccacttgaaaaggagggaagaagagatttccaggggaataagagaatttcatagggctctatgggctttccgtttggtttgtcctacggtcaagatcggctctgataccaacttgtcacgcccagagattcgacaacccgaatcccggctatctgtgcatagtccaggcatcaactagagtacacgaatctgaagaagttaaaaaagactcacactattgtatttttcaagttaaaagaagacattagatggagcggctgccactagttgtgtagtcacgtcctatgaaaaaaaaagcatatattaaagttactttctttttattataagttacttctataatatatataaattacttttaggctttattaaatttacttttatatgtctatgtaataattggctgtagctcttttgagtaaaggccgggatatttattccattatctaaaaaaatatatctaagaagtgatttagtgaaatctaaaagtaattttgatatattataaatgtaatttacaatttttcatcagaatataatcatgtgagatctttctacaaagatttaattacgaacacgacggtgtaatcggatcgtagatcggatgagtagtttaagagaaatttttatttgaagtataggtggataggatttctcatagatgaagtagtagcgctgtgtagtcatgtccaatattggatgctgcctttcaaaaaataaaagagcaattacaaatttacaaccattttaatttgttattacagaaaaaaagagaaaacgatacttctaaaaacaagcatatccatatcagatatcgtatcaaacacaaatgcgtatcgggatactctcgaatgcatatcgaacatggaaaagctaatgggcgattgatcgctaagggcgatcagggcgacaccccctcctcctcaacgtggttttcttttttggtaccgtattactttgctatttttagtaaatttatacatctaaaatttatacacctcaagtttacacatctaaagtttatacacctaaagtttagagacccaaagtttataagtcaaaagtttatttatccgattcaaatttgaatttcaattcaaattttttttatatatagtattttctatatatctaaagtttataagtcaaaaatttatatacccgattcaaatttgaatttgaattcaaattttttatatatatagtatttctatacacctaaagtttagagacccaaagtttataagtcaaaagtttatacatccgattcaaatttgatttgaattcaaatattttttatatatagtattttctatacatctaaagtttagagagccaaagtttataagtcaaaagtttatatatcctattcaaatttgaatttgaattcaaataatttttatatatattattttctatacatctaaagtttattaacccaaagtttataagtcaaaatacccgattcaaatttaaatttgaattcaaatattttttatatatatagtatttctatacataaatttttctaactgtttttttatttttaaaaagatttatggtgtagtacgaagagaagaaggggagaggagccatataggggggatggggtcgatcacctggagcgatcgatcgcccattagctttaccctatcgaacacatatttccgttgctttttaaacaaagaaattaatttctgctactttttcaatatttagtccatacattgccaatactcctagtataaatatcatcataagttacttaaagtttgacattccatcccatttgaaacttattgcattaaaccatgcatttctgcttttccttccttctatattgtgtattttataatttatatatatgccccgtaaccgtgattttgaaaatatgactcagagcatctcacgatttaaacagcaggctgtatcagcctatgacggatcaactcgtcgacgtacattgagcaaagtattgcgcatgatccttagcatcattatttatcaaattttacatagctcttctcattttgcgacagggcagtcacccttactcccttagcatgggtcaggatgtagatacacagtaaaaaccttctaaaacagtcaggcgatttagatcaaaccacatgggagaaaaagctgctacttgggacttgggagtgttacagatgtgaagtccaggttatgcactatacacactgcttataggaaacagccaactggcaactgcttccattccagtgtcactcttccttcagtatcggcggccaccgccagtggacaagagcactttggtgggtttcttgcctttcttcccgactacatttggtttgtgcgtgtccaggctattgtctgacgctctagtggaggaaatgatgctggcaaaggataatgcgggtgttgcggctggccctgcatagaaaacagtttagttatgccaggatttcactagaagaaaaatgggcactgccgcacactggtaagtgccagcgtccaaaggtgcatcgtgtgtcaccataccttgttcccccgtgctttcacttttgccagtcaaatccccagattcaactcttagaggaggcgagtcttgggcagacgcaaagccaagccgtgcaacatcggagaaaagctttctttcgctggctggtggactcgtggagggtccagcattgtttccaagagcttaaatggaaaatatatacacacatatgaagtgaggcagggcaaccaaccatacaggatgaaacatgcagagaactaaaagcacaattgcaaacatgtgaatgcttcagaatgtggattaggagcactaacaagtatgtgttttgccccaatagaaagtctgaatatgcaaaatcaggtctgttcataaatgagtttatttaccttcaaagtcatccagagagaacataaaatcgccatgtggcccactactgggagagaagcttgtatgttcaaacagcattgcagatgcctgtgcagcagcagcaacttcggctttcactctatcgctttcttcctaaaggaaagcaccaaggagaaaaagtaaatgaccaaaataaaccttacaactataagagtcagtttgaactggtatgcaaacagagctgaacacaaaaaacatctcactcaggtatattcttgaatatattttggcagccaaaacacccaattttaaagaaattgaccagcaactcaaaatattcagttttttttccaaaaggcaaagtctgctcttagcaacctagttataagttatgtctgcttgagaaaatccattctatgtatctgacctcctgtcacagtttaatttccatcctaattcatactccctccgtcccaaaatataacaacttttagccctcaacatttgtcccaaaatataacaacttcttcaccaacattctttttccaaccaatcacaaccctccaccattcacttttcccacctacctccactactcaaccaatcacagccctccatcattcacttttacctacttccttaataaccgtgtccaactctaaaaatgcttatattctgggatggaggtagtactttttaaaacataccccttaacttgcaaaaccattcaaaggaatctctcaggccaaaacaacagagttttcaattgcaaacagtggtttcaataaaatttactttcatggaatttggctcaactccatatactgttaagccacccatcactctccatcccacagtcagtgtccacattgaccaactttaataataattagaaaaacagtctgctcatgaaaaatcgggttgtttcggccagggatgtcttttgaacagtaatgaaactttgtggacatcttttaaatggtacaagagtccaaaatgaaaattgaaccaaggtatcagatatgttatagtacaatgtcctattttctccatgtttccatattgtgtggtacactggtagacatatacatgtataatatgtcttgaaagaaatgcttttaaaccatgtgagatagacaatgattactgtaactggcaagattgcacttcccagttctatcaaagttaataatatgtttcatagcatctccagtcatgtacttggtgtgtcatttctggtaaacaaacacaccctgttctacataacccaagagtaactacacgtctacaccacacttgaaggcactgcgtatatcataagaaacgatggacccatacaacaaattaagaacatctaatgttactaggtgactccttgaaaagcgcctctataaaaaactatttgacagcattattaaatccacagggattaactgctggcaaatctgagaatagtgtccacttgcaaaatacaaactaaagaaattttgaacaaacaacacacaacagttctgactaacaaattttcaaaagtcgactagtcatgatatgactactgatggcgaaatgctgaataaacaatacaaagcagttctaaccttcttggcagttcgtttcctctgtttctctcgcttcttgatttcatccatgaatggagctaatgagctaggaggcagcatatcacccaggtcaatttcacagaactgcgtagttcatagatgacagagcgtaagaacaagcttgtaagtaaaagttagttatccacaactggtttacctggaacgttgttgtcaatgagaagtgacttagataacgatagcgctttcttgtagcttcggattgtgttacagtttctagctccaagatttttccatgtattctgcgtgcaagtaagctggataagtatcaagcaaacaccacgagcaacaaccagatacaaaaaaaaaggagaagagataagcactccaaccagaatgtagtatctcatgcacacaagaaatacattgctcgagcaaattgagtaaaattggttatcagatcaaactaaacaaattatctctgcttacatagtgaaaaatccaattttccataatcataatcaggatgcaatctacccaatactaatacaatacacaaaataatgtgtcaatatgagagcgatgacttttaaggtgtaaacaaacactataccttggtgggagcatatcagaacttccataatggtttataaggcatttcatgtttagcggatgaagaattaggtgttggccatcagatacctgcaacaagatttgacatatcaaaactctgagaatgaaaaaccatgtgcacaaggtaaacaatcacagccagacatacttcagacctggtaaaaattataagtatcattctcatttgaatctatgggagccatacatctctcttctgttttcgatggcattcctttattaaagattttatttgattcaggtgaaatacagagctccgaaacaccagcaatcatatcttcatctgatagaggagatagcttgtgttcactgttctggcgtgaagattgtgcattattagggttccttgatttggaactagttacaggtgagaagctgtcttttaggggagggctgacactaaaatttctgtactcactccaatatttcatccgttcttctagctgctccaaagcggtagaaacgtatggaagtttctccaagtcatccacaaggcctaaatctgccatatgcaaccaattaacaagatctgtttttgcctctctaacagaaagttccacatcagacgtcaaaatgaacttggagaatgcactgcaaggatcttcgtctatagtagattcatcagtgaggttcttaatagaaggagtgagtgaattttttgagcggctcaaaagtgtaaatgtcacattgtcaccaacatgaaaatgctggacttgagtaatatagattgtatacaactcctttgttgagatcatcatgaaacacagtgggcacttcttccagctttcacctttgtaatcttcttttcccataagtaaataacgtaaaatgcatggaaagcaatatatatgaccacatgatgtaatctgtgggcacaatgggctctccaagcaaatagggcattgcacctcacaagggctataatatcttacacatacaatatcttcccactggagcatcttatctggatccattaattctatttcatagcttccagtatccaacacaacaaacttaaaatttgcttgtaggaacaaatctttgttgtatggtctgatcttcctctgtcttcttgtaggatatgttctggggcctctaggctgtggccgagaaattggatcatagtggaaattcagcagataattggcatttacagactgattctttctagcagtcacctgagtaccattcccactagaatttgtagtggatagatcaatcttcagggattccatcaattcaggtctctgaggagttgcctggcctgaggtgccattattggctgaaaaacctgaattcccatgttcagaagagtggcattcagaaaaattgccaacttcttgggtatatgaatcatcattctcttctctagagattctgaatccaactacctggacatattccagattcataagaaaattgaatgtaagtttcataaaaaatcaagagcaacatacacaaatgtttatcgaaaaactgaaatctgatttgaattacgttatgtaaacattttaccttttgggaagtatcaacatattctctgatagctggaaccaccgagactgcaaagtatgagttgcgttgtaaaaattactttccaaatgggtatattggaaactagtaaggcaacacttcaataatatttatgaaaaaaaaataccaatcaatggatatttttattagcaaaatgatgtaatcaatgagcatgctcatagcagacattgtcaacactcaacagtgaatttgagaatcaattgaactaatgaagaacacaaaatggcttctaagggaacagaacttggttgagactgcaacatgctatgtcaaatggggtcactatcttcatgaccccattgttatttccactatttatactagatagcataacgttcatatggaatcactaactcctgaaaaaacataatcccccgctcgctttaattgagccttccccacttttgaaggatagctaagtaagttgtaaggcatcaattgtccaatatggtagtgcctacctgagaccaaaatgtctttacaaagaaatgcatgctctacagcaaagtaatgaatctaaattccatgagacgtaaccattaatccgcatcggcagcactcgatagtaactgaccaattataagcttaaaaacattgatccacatgaatccacacgagaattggtccaattggattacaattaaccaagccaaagctcacctaagcacggatacagaaatctgtaacccacgaaacacgaattaacctagaaatcacagaccaacactcaatttaccaaaaaggtattagagtttctacacaaagcttgggctcaactctacaacctgcaaaattaacaggtaaaaagcttcccacaatcctcgtccccccaaccaacccagtccagctatctagatcagtagatctgcaagccccgccgataatcccctatcgtttcaatcgacgtttagccgtggaagggggaagagggagggagctcgcgggaagcgagaactcaccggagctcgggccgccgctcccgccggcggctgagggcggtgagacgggagccgtaggggagcgtcggccgcggcggcgcggtggggcggagctgttgccatggcggggtccggggctagggttggaagggcgcggcgcgagcggctgggatcctctggtggattcggaaggggagatggacatcaactccgcgcgggagctcggtgttgggtcaaacggcggctcgtctggtcggcggcgaggtggcgggcggcggtggcggcggcgacgccgacgcggtcacggtggcgcggcctttatacggtggtggttggggaagcagacacgacgaggacgcgcatggcttggctggaccaagtccacgtgagccgcaaacgtggaggattatagtattatactggtcggaaaagcaggtgggtcccacatgtaagtgtgacggaatctgtgagccgagtccatggaagctgtgggagggcttatggaggaggcgaatatgcggttgagttcgctggcgttgccgaaccgatgcgacggagctctccacgtgaggatgacgtgtgggcccagtgacccacgcatatggacccagcttatggaatggatgggctggacctttgcttgaagaaattagtatattttgcttctcctaactactgccctttgtccaataacacccctcaacaataaaatcggtacattacatcctccaactttaacaaccggtgcaaatcaatatttttagtagtttgcaaagtggtttttactgacatgataggttgatcgtgcttagactcactaagtcagcatgggctactgtaggacccatgtgtcaacgcccactcttcttgtcctctctctttctttctccaaaccaagccaacaagcccctccgagcacgtccacttgtgagtccgtccaacatctagctccgagaggctatgatgcaacaggaggttgatgatcgaggacggagatcacaacggcatgggagctcaacaacgcgctcattgcaccatccccaagtcggtgctctctccctcatctcctgcgctacgcacacaaggagctcgaagctcctagcgaccacctcccaacggtcggacaaggggctttgggaggaggtcaacagaccgaggacgaaggtcatagcggcacgggaactcgaggagacgctcgccgcaccatccccaagccgatgctctctcccctatctcctccgccatgtgcgtgaggagcttaaagcttccagcaaccacctcctagcagctagacgaggggctttgggaggttggtagactggggatagaggttgtggtggcacgagagctcaaggaggcgctcacctcactatctctctttcatcacttccctctttccacttgggacctagggagggaggcggtggcgaggtggagctgaggaaggcagtcctcccgaagtagtcaaggaagcccaacgagaggagacgactggtggaaaagagtcctatctctccaaggatagtggagacatagaagtctgggcggagcaggcaaaggccttaggcggcaacaggagctcggcgaggcatctcgccaaggaatgttgtgcatgtgcggcgccaatgcatcttggtgcatccatggtgccgcgggcgctagttgatgctaccgagaagaccacctcactcgcctcgccgccacccgagaaggtcgcgatgctctactacagcgacgaggccaccctctactccgctagcgacagtcgcgtccacctcgccaataggctcgcaagcaagcaccaccactcccttttctctccacctccctcgattccgcgaaccagaggaattcctcgatggcggcgaggagggcgagggtggcgacctcggcggcaacggcaaggggcgtggcgagggtggcccgtgccacaacacgttgggcggaggtaagtgccaccgctgcgtcgtccgcggagagctcatcgaggtggcactagggttgaaagcagacgattgaggaaagagacgacgaagaggcgttgtggtcaaaagtagccacggctacagtgccaaaggaattgggtggcagcaagggtgatgcctggtggcggctgtggcatgaccatggtggtgcaagctcgccggagtcgttggctaaggagtgtagaagaagaggaggaaggaggatgatccgacatgtgggacccactgtcattttttttttctgtttaaaatgccacctaagcaccatgtaggataaaaccatctacaaaaacatccagggagtcgatttgtaatagttttcgaagatggggaaggcgctatatccggttttggggaaagaccaagagatgagggagtcagaacagacttcttccttgctagaatagatcccggtggagagtggaggacgtgttaagctaggcctttgctaggacatttggcccattttcataaattcaagtaaaaacgaatgaaccaattccatttcttacatcaaacaggaaaaaagactcatacaagatgagaaaaatatcccaaagttaaacggcgattcttatttagcacatttgcgttcgcagtgcacattttcttttcctaaaaaacattcatctgaaaacattcgtccgaaaaactttcatctggaaacgtttgcctgaaatacttttataaaataacttttgcgttggtaatgcaacttcactaaagcagataaacattgctacgattcagatcgtcaagatgccagtaacaaccttacctttcctccctataaattacagtacaaaacaaaggcaacatctcaaatcaataacggtttctgaccgaacttcagaaccgggggtttacaaaagaatcgaattgccaattaatgatccctaagccaatctgtacaatatccccataaaaatgtcaccttctcctctctctcccctgctgtaaattatttcacactctacgtgactccgaacaacctgaattcctacgcttaattagcgttacatataggagtactagtatcttattcatatactgtatatgcctggctatagcttgtcggcgatccggccgagcgcgtcggcgagccggccgagcacgacggcgaggctggccgcctggtctcgccgctgctcccggtcgagccggctgttggcgttctgcgcctccagctgcgccgccaccatccggctgctccgatccaggatctccaccagcttgctctgcagctcgccgccgcggcggccgtcgtcctcctcctcctcgtcgtcgtcggctcgccgccgcttctgcccaccctgctgctgctgcgtcgtcggcggcggcggcggtggcgtgcctctcgatgcggcctgctgctccggctgcttgtctttcgacgtgcctgtgaaaaaagaagaatagtcgctgattggttagtagtgttacgatacttccagctcagatcagctgttcgtcacgttactttcggagaagattgtgtcgtctgatcatgcaactactaattaccaagtcttttcaactcttcgccggcaaaaaaaaaaaatggaagcttttttttttcaactgtactacacatcgagatgctaatgaaaactgcagatttgctcgtggaaataaaccaaaaaaaaaaagcaaacggattcgtttgctgctactacgattgatgacatattgacatgacactgaggaagtaccacgacgcgtatgatgaaacgataattaattaaatctgcaggcatcatcatctgcacagtacaatgcacatgaatatttcgtatctgcaaagaaataggttaccgatctaaaccatctcctttcatttgtcaaaacaaggcaaaggacacaggaattcacgcctcttcccagctctaaagattggccgggaaaacgtatttatctctcatctctctcattttatgtgtgtcatctaaatagtcattaaaaaaattaaaataaattgacaagattaatatgaaatatatcactccacatacatgtaagttaaaatttaatttttagtagacgtgcattgcaacgggtaaatactattttaattttattattgttatatcttttagttaaggtgaaatatactgtaagaacccgtttggatatatatattattttagaaaatcatgagctgcaattaggagtctgatcgtctcaagttagcatgcgagtttttaaagaaatctcttatacaattccttctgtatttacaaaaacaaacgaacttaaaaaccgacttaaatacggctttgtatttccaaaaagaacaaacttaaaaaccgactcacactcggataacgtaccaaagtaccgacaaaaacatcttcaatttgtataatagtataggcaagttataacaaaaaaagctgcgaatatacgataactattttcagtttaattcattttttttgcaacttatagaagttgaatttggcttttgcatgcttatgaagtgatgtatttcatagcaatctatgttgaggtgacatgcaagtaagtagaggatatccccttaagagatgaaaattcatatctagaggcaatgctgctactactacgtacaaccgtttggcaatgctactaatcttcaggtgtactcgatttgaagcactaaactaaggtattagttttgaatcagaatcatatcaaactgacccattttattcgaacattgcaaatttgaaatcctaaatgccgtgcgctaggaaggaaccgaaagccgtgttcgatatcaaggactgccaatacagagaaagcttcgagggacatggtaaccaccgaatcaattcagtttttggtgggttgccacttccatcacaccacaggggtgagtaaactctagttttggtttcaatggcccccacacggccatatatagctcaatcagttcatcatgcgaaagcagagtttgcattgcgttgcaacaattggttggacagagatgtagtttttgccccgaggagcccactgtttagcactagttgggctagtggctaacatgatggacaatctaggaaggtgaacagtgcaagtacaattgacaatttggatttcctttttcttttggtcttactgtgtgggttgaatttggatttaaattttaggataatacatatatattgtgcaaatgccattaaacattttcaaatttttccgtaacaaattacatgtgatttgaaagaatgacggggcaaacctctcttacgggataaaaaaggtttcccattctaggaagcatctgacagtttactagtaaaaccatttgctgataatcctgaaatttcattgctaagtgacatggtgaaagagatgcatcaagtgcatttgcaggctgcagctacctcctgccacccaaactgataatcataacatgcatcactaatctaaatcgcaattttttcgcctttttgtctacggactatgctgatcaagtcaatggaacagtaacttatttctttttcccttgtgcaacactagcaacaaatctggaaacaaggcagcaaaaggagagagctcgatcgagaaaagatgatgtaaaatgaagtgaaatccgattacctcctttctctgttcttctctggaaaaagaaatcacgaggaaaaaaaaagcaacatgaatcgatgaacctaccaaacgaaccatctctaccagaacgaacacgaaccagaaacaagaaagacaccaggcaaatcattcaaaccctcaccccaaaatttcaatatgaggacgcacagactaaatttgagcactggaagctcaaaattttgcggcaattcaagtcgtcaacgcaaagaggacacgctgaacaatctgtgcgatgggaaccggaaagattcccacctttttcgcgtcctatgaacagcgtaaacacagattcgtcgctcaaaagctaggttttgtagcaaattatttcccgagtttaccgccgaaaagtgctaagagttcgaattcatcgaggaggaggaggaggaagaggggcgagaactctgcttttatcgccaaaagatattgcaattttagcagcaaaaaaaggaaagaaagtcaaagggcagctcaccggatatcggcaaggcgatcaccgctcgaggcggcgcctgtgccgtcgcagcgacggcggcggcggtcgccggcggcgcctcgtcgtcgtcctcctcctcctcgtcgtcggagaacagcgactcttccgcggcggggcggccactgtcgaacaccgtctcctcggctcgggctcgcgtcttccccgtctcctcctcctcctccacctccacctccacctccgccgccgcgcgcgcgggctcctcttcccccgccgcggcattacctcctccggagggggagacgagggtgccgcgcccccggccgtcgagtatgtcgtacacctcccggtcgaagaaccccgggagccggcgctcccgccgcgcgtcgttccgcatggcccagaacgacggctcccgcggcggcgccgccgccgccgccgcgcgctcccactccttgatcttcttgtagtccccggcgaggttgctccaccgcttcctgcactgcacggcgcccctctccacgccgtgccgccggcagtactccgccaccgccgcccacttgggctccagcgccgccaccgccgcctcccccccagagccccccgccgccgccgccgcagcagcagcagccgccgccgcggcgcggcccctcccgccgcgcccgccccctcggccctccaccatgcgcttcccctcgatcagcaccagtatctcctgccgcgtccaccgcggcagcctcggcgcgcggccggacggcgtggcggctgccgcggccgcggccgccgcggcggggtcgccggcggtggacatgcgcggcgcgtgtgcctttctttttttttttttgtggcggaagttgacgtgacggcgtgaggcgggtggtgtaacggagagataacggcgaggaggggaggggacgcgtggggaagaagggaagggggagagagagagagagagagagagagagagcaaagagggcatgaaggaaggagggaagaggggttgtgtcttaagagaagggattaggaggattttggaggggttgttttagttattagacactcatcatgtggaggagatgagacatttatgtagtacactagtactaaattgtaatcaagcatccaagcccaaatgcccaaacttggttttattagggatatattttaaaatgaccatccataatttttttatacaaaaaaggtattgttcttctcatggcattttcattctcctaaacttggtattattagggacactttttaaaatggagagatggtaattttgattgtattctaaatttatgtgatggatttattctttattctcaacatgtgagttgtttacaaaagtagaattccttttgaacatcgacatgaacgaatcaggagactacaatagcttacatggaaaataaaatcatttatgaatgtccttatctttatgtctaaatgtttgatgacaatattgcttaggtgggaagccaataaggagcttttcaattaaaaggattagtaagggaggagggtcatgtgtattgttcaacagccatgggcttagaacaatgttggtatatccgtgtaggaatggatggcttaattaagtgatcaacttaggatattaattgccatagttgcagtcttagccacttccataagctagcttaaagaaaaaaaatgtcctggagggagagagttagttggggcttaaccagaggaatcggtgctaaataccaaatgcccatgatgcctcatatctccatgatgtaacaagcaaaaggtgttttggggttttggaattggagaaacctttggataacaatggtggacattgcaaggagtggtgctgccttaaggaggtggattaatttattgtgtgattaggacttgtgattagagcacaacaataccctgccaggctcctaccgtctctgtcaatctttgtgatgggataaaaatttcttttcttatctttattccacaccaaggggtttaatttggcccattttatttttttagtcaaaaaaaatgtacaggagtatttgatttgtctgtgtgctagacacgtgtctaccggaggtggaattatatgggaggccaattgctaaaccacatcaactagtggttagcactaaccctcttgaattagtgcttaaccttgcccctaatggctaaagttcacaaaaaaggatgaccacgttaggatgctgctactaagagaataagatgccagacttaattattcttaattaattgttcttttgtgaaaattgaaaaaaaaaataaagatgtaaggaaccagtgtatagaacatgtactatctgcataaatgccatgatgatgatatggttttgctcaaaattgtgtataggtgtgcatcatatatatatggtgctataagcaggttggacctcacctaatagagttgtataattagggctccagtattggtttagctgtccctgacctggccctttaaatttgaggaggtccatttccatgccatatggcatttgaattgacctcacctactgccaagttcctgtcaacatggttgtaaacaactacactgcttgtattttggtacatgtatgatgtatcctctagctttcccctatattattattgcagcttgtagaacacatcttaattagcactgcgatgagaatatggagagaagccccatgattgaatttcccttttcgatgcatgtcatgcaatagttagccgtttcagagagttagcttcgcactgataattagagagatcaattaattagtggaccaaatctagctaattcttgcactaagagccaaaaagaacatcattagggggccctttcgaacgcgaaaatttttcatgcttttgtactaataatgaaaattacacataattctgtgagagagttcttagaaaagagaaacttagaaaaaaaaatcctaaatagtaacagagttcttgatctcggaaaaaaaaagatatcttttctcctgtcactgtggagacactgtttgactttgattggggagattttataataattcccagtacggcaacaaaatcctgagaaaaaaaaggagagaagtaaataaaacggcggcaaatcaaaaggttgtgggagatttgggcatgatcctaagaggatatcgcccatagagagagagagagagagaggtcccaaaacgagaggcgtggctcttccattgttccatgcacctcgcttgcttgcttgctcgctcgctcgctcgagcctcctgtaactttcagtgtcaacttccccttttctgtgtgaccaaatgggcctctcccatccatctctcctgccctttcagccactacaagaggctacgcatcctgcaacccatttacacatatacatatatactccatccgtcccataaaaaaccagcctagtaccgaatgtgacgtatcctaatactacgaatctagatatacatatgtttagattcatcgtactataatatatgcaaatatatatatgttacctctggtttcgaatgtatgtaactgttggccagtacaacaaaaattttaactgtgaacatcaataaacattaaatggttatacgtcatgacacatggaagttttatggctattttgtttattttttttaaacaaaccaacgttatataaaaagaaaaaaggtatattttttctttaattatatgtgtccatgagatgagacgatgacctcttcttcctctagctggatgctgatgtttccattgcgatgtgccctagctatgtgtgggggagggaagggagggcagttagtagctttgcaagctagctgatgggtggataggtcatggtgatggcaactgctttcattagaaatgaaatgaaagaaagaaatcaagaaagaaagaaatcgaggatgaaagatattgagatagggcaagatgaggtgtgacaggtgcctctcttgttggtgccttgccatcctatcccatgttgacgactcatcatcgatctcgatcttgtgtccgttttgactttgttttcctcctttttctcctccttttgcatatgtataatccactgcaaaattaaaatatagctgtgtgtatatattagcatatgcgcacgtgacgtgacgacgtctggtttttctctattccttccttgatgttgttgtcacgttaattttaataatttaatggttcttggtgtacttcctgatacctctaaattcttttgttggtttttattatatctgcgtttgtgcggtaacttcttgaccgcaaaacaaaattgaagttatccaaaatctcgaaaatttttaaaacacaaccatacggatgaaaacatactgatactgattggaattgaacccgacagtaattctgaaaacattaaactatatataaaaaaagcacgtatctaactgtcgaaactagatttcggcaataataaaagggggtggctatcaagctggaaaagtgtatgggtttggagacaaaagatttatacaggttcaggccttcttataaaagaagtaataccctactcctgtccggggatgaatccgccgagtgtattattgattgtatgatttagagaaaatcaacatctgcccctagaggcgcccggaccccccttatatatgggaaggagtccgggttacaaaagataatcaatatccctaacggaatacacagatatagattaaatacagccgtgaccgactaagtctcaaggtgtttccttgttgtacaagtcaagaaacaaacccgagatacaaataagatattctatacatattcggtatcctatatccagcccaaatagtatcgccgtgtagatatgggatatccataatctccacagtagcccccgagacctttgcagtcaaccatcgtagccttctcaaagatagcaatccgagtgcttcagattattcatgccaaggcccaccgagtagcgaagacgaagactgtaaagggcgaaaagataaagaatatggtgcatcgaatagatgcacctaattaggtgtagcccccaactatgtgattagttaacaaactaaacatatagttgagaacaatataataacacaatcatgcattagatggcaaaagcatacgcgtcgcctaaagaggcattctagccgactgctttttagccataataaaaagaatccgagtggtttacactcgaaaaggttcacgaatgaacacactggacaggcatccgaatataaaactataaagattacccaccaaatattataaaaattatggtaacaaaaagactaatagcctaggctatgtcaagttaccacaataaaaataggtatataacataccaaggaaatgactatgataaaaacaagtcattccaagttaacccaaacagcttttgtagcctaaaaaagcttacaaaaacagcataacgcttttctgcagggcaccttttaatttgcattgcaataactccaaagaattatatgaccgcataaaaaggattttgtcagcattgggcaacactattgtgtgcataaatattgccaaagcaaaatatgcctaagtccctaaggaacacaatgggccacgctgttaaaagtattgggctgaggtactgttcaggcctaggcccatttgcacctccgatacccttaacaaaaaatccgagatccaagcgacgcttcgtcttccccgccggaacgctcgccattttccccactccttgctacagtaaagagctgcgccggcgaactagggttcatcaatccgtccaaatccaccttcgaaaagtgattaaaaatccttcccgtgatccaccgcctcaattcctcacctctcccaagccatccatcaaatcaaatcagcgcattcgggtaaaatcgatggcggaggagaaagaaagctttgaaggccaatgggcgccatccgacgtaacggaagagaacttgaaggagatggtggcgcacggcgttctcccagccaaggagatcatcgggtggcggccagcgtgcggtgaggcttttccgacccctgatacacatgagatcgtagtcttctcgcatttcttctatggcggcttcgctcttccgacctcgaaatttttccgcgggatcttgaacttttatggaatcagcttgcatcacctaaacccaaattccatagtgcatatcgccaatttcgtccatgtttgtgaagcctttttgggaatcaagcctcactttgccctgtttcgccggatcttcttcctcaaaccccaaccgaacaagagcaaaccgtgcgtagtcgggggggggcaggattccagctaaggggaactctgagccaaaaatacttctctatgcccttcaagacttcaaacaaagggtggcatgcaaactggttctacgttcagaatcctgagcctgctcttcccgggtactcttgtcttcctccggtgtaccaagatacctggaactcccttccaatcggagatgaagcagtccaagccttggagttgatggaccgcatgttaaaactcaaagaacaaggtttgcaaggagagcagattactcggcatttcatcaaatgccgactggcgccaattaaagaaagatcccgtacagcttttgagttcgacggcaagcatgatcctaaccgtgaagaacctgactctctggatttcaaaatcatgaaggagagaatgtataaaatcttctcaaatgccattgtcgttagctactcacaccagctgccagttgtgccatataatgcattcaatccgcctccgcaggtatgtatctgaaatcttcaacttatgaccaaaatagtatcttgtcttcatgttgaattaactaaccatggaggcatcttattcaggaatatgtattgatgaaatccgatcccccaattgctcagcgacgatctcctcgccagcacaccattcagggaagtggagggccgacaatcatgtcagacccacaacctcaaacctccaaaccggctgggcagacaggtcctcgcaagagaaagctggtgcttgatgacgacgagggcgatgacagcaacaaatctggggacaagggcacgcccaacaaactcccgaagcataccatgcccaggaaaaaactggctggccgtcaaatgccaaagattagaacatcttccaggtataaacctctcgataccattttgtttcggcatgcttcccttatagaaattatgctaaatatcgaaagggcactttgcaggaaaccgtccgatatagatccaaccggaaaagatcctgatccggctgtgacagaacaaaatatatccaaggacgctgagccgactgctgaaagccagccgactgccgaaagccggccgactggcgcccatgcttcggatgacaaggccaatccgagtgaccagccgccgactggaaaccagtcggcaacaactgaaactgcaacaacccgagagcccccaactggaaaccagtcggatgtaggtcctgatcaagaaatccctgaagttgaagcgcaagcgacatcttctcaaggaccagaggctggaaatgactcggtggttggctctccagataaagaacaaggatcatctcgcgctcagccaggcacatcctcaggtaactcatcttctcaagtgatatcgttctgaataactccagcttgctcgtctaatgtcttggaaatacatcaggaacactaggcgatgacgaagaaacaattcctcgcataaaggcggctgatgactcccgtccccctatcttactcaaatggtgggacgagaactctcaagtttccggcattgttataaatcgccaaaaagaagatgaggaagtgtgccagctgaagaaagcacttggagaagccactcgcattgtgaatgtaaatcttccgggtgactgcctttaataactttgttttcttgttagcaaaactaatccatgaaccaccgtgcagagaatccatcttcgtaatgaggccaagactgcaaccttagaaaagctggttccacatttgggaactcttgaagccgttagggaacagctacacgaggccaaggagtatgccaagaaaacggagaaggaattaagggaacgaattgcacagctccaggactccaacttcgagctgagtggttcatcaaaaggtaatctctagatctgtcccatttatactgtcatagctggatcctcaaacatttggatttcaaacagcgcaagccaccagaatggcccagatggagaaacagattgaagccttgaaaagagacaaggtagaactggctgcgaaaagggactcagccttgaaggaggttgaaggtactgccaactgacaatttgaactgtcctctctttaatgcagcagattcttattataaatgtattttgtagaccgtaaaatcaaatcgcaagctcagtttgatgtcctggttggtaagatcaagaagcttgaaggagcaagagacgaagtcgccaatgtcgctacaccactcgtccaagctatgttccttaataacagtggtccgagtgcacttgacgcaaccgaaatctttgacaagttaagagttgcaccggatgtatacttcaagaacatcaagaaagctggaagcatgggagctagcatggcattagcgatgaccaaatccttgtacccaagaattgaaatcgacaccattgatggatttgcagatgggacaagcgaagaagctgctcttgatcttatcaacaatgctcaaaatgcggctgacaagattgcaagcgatgtggtagatcaattccgcaacaacaaccttcagccgagcaacgataactctgatgatgaaaggactgattctgactgagtatgattgtaacaaatggaggcataatttgtactatactggtgtatttatgctgtgcttgatagttctagccaagtctttgatttcttaaaagtttttatcaagctttgttgagcctaaaacccaaataagctattaaaaactttcagtcctcgcaaactaagtagaaaaaaccaaacaaggcaatgatagaccaagtaagcaaattaaattgataaaaaatcacactccattattataatgatagcccccgactgacaacttcaagaagaaaacttgatgttgacagtcaagatagggaagtacaatgataaacttaagcgtagaaacgacgaagatgctcaatgttccaagagttgtcgacaagagtaccgtcttcgcgcttgagtcgataagaccctggccgggtgacttcagagataataaatggcccttcccatagaggagataacttgtgccgatctcgtgtagtttgaattttcctcaaaaccaggtcaccgactaaaaaggcacgagatcgaacattgcgattatgatagcgccgcaacccttgtaaatatcgagccgaccgaatcaaagctgcttcgcgggcttcttccaatcggtgcaagtcatccactcggtcctcttcgtagcgttcttcacggaaatttcgaaagcgcaaagactcgaattcaacttcactcggcaacattgcttctgccccatagacaaggaaaaaaggtgactggcctgtggcccgactgggtgtagttcgcaaagaccaaagtactgatggcagctgttgcacccatttgccggcatagggttttagccggtcaaaaacacgcgctttaatcccttgaagtatcatgccattggctcgctccacctgtccattgctcatggggtgtgccactgaagcgtagcaaatcttaattacaaagtcttcacaaaagtctttaaaaactccgccagtgaattgtgtgccattatcggtgatgatccgattgggcactccaaatctatgcacaatgctgatgaagaagtctcgagcattgtccgctgtgattgtgacaaccggtttagcttcgatccacttggagaatttatcaatggccacaaagagatgcgtgtaaccgccgactgcctttttaaacgggccaaccatgtcgagcccccaaaccgcaaacggccaagacagcgggattgtttgcaactcttgagctggtagatgaatttgtctggcgaaaaattggcaaccttcgcacgtgcgcacaattttgtcggcgtcggacactgcagtaggccagaaaaaaccctgccggtaagctttgccgacaatggtgcgtgcagcagcatggtttccgcatatcccagaatgtatgtcttttagcaattgtctcccttcctctaaagatacgcagcgttgcagaattcctgaagggcttttcttgtataactcggcttcatgcaaaacataaagtttgctccgccttgaaatccgctcggcttcatctttgtcttgggggagttcttgagaagtcaaaaatcgtatgaggggctctcgccagtcggcttcaaccatagctacgtcatgagtgtccgcatcttgagtagtatctttatgaggtacggtcggtgtataaaggtgttcgacgaaaacatctgagggcgccgcctcacgcttggatccaaaattggcaagtctgtcggcggcttcattgttgtgtcgaagaacgtgactgagctcgagtccatcaaatttgtcttccaatttgcgtacctcttgtcgatatgccatcatgttgtcgtcaaggcaggaccactctttcataacttggttaacaaccagctgtgaatcgcctcgaactattaaacgctttatccctagggaaattgcaatccgtagcccatgaaggagggcttcatactcggcgacgttgtgggacgccgaaaaatgtatccagagcacatagctcaatctttctccagttggggaaatcaaaaccactcctgctccagtgcccgaaagtcgtttggatccgtcaaaatgcatggtccagtgctccatgttctccgcgggggtatcctcctggcactcggtccattcggcgacaaaatcagctaacgcttgggacttgattgaaattcggggcttgaatgatatgtccaaagacatcaactccaaagcccacttagcaatacgtccgtttgcttcgcggttgtgcagtatatcaccgagtggaaatgatgtaaccaccgttaccgagtgaccttgaaagtagtgagatagcttcctggtagtaattagaataccatataacagcttctgaacctgagggtacctcgttttggagtcggctaggacctcgctgacaaaataaatcggtcgctggactttttggacatggccttcttcctcgcgctcaacgaccaaaactgtgctcacaacctgggaggtggctgatacatacagcaacaacggctcctgcgggtgtggtgaggctaagactggtggctcggtgaggagtttcttgaaatcttcgaaggccttctgtgcttcgggtccccactggaagttatctgttttcttcagtagcttgaagaagggcatcccccgctcgccaagtcttgaaacaaatcggctgagcgccgccatgcatccagtcagcttctgaacatctttctgggtacttggcggtttcatgttgaggatagcagtaactttctccgggttggcttggatgcccctatgagacaccataaagccaagcagcttccctgacggtactccgaaggtgcacttttcagggttcaatttcatcctgaaagcacggatgctcgcaaaggtttcttctagatccgagatcaaatcatccttttgcttggtcttgacgactacatcatccacataggcttcaacgttgcgaccgatctgcgttgagaagcatctctggatcatgcgttgataagttgctcctgcgttttttaatccgaacggcatggtgacgtagcagtatgccccaaagggcgtgatgaatgaagtcttcaagcagtcggattccttcagtcggatctgatgataccccgagtagcaatccaaaaaactgagaagctcacagccggcggtcgagtcgactacctggtcaatgcgaggcaacccaaagggatctttgggacaagacttgttgaggtcggtataatcgacacacatgcgccattgccctgttttcttccgaactagaaccgggtttgccagccagtcgggatgaaggacttctttgatgaagcctgctgctaacagcttggttaattcctccttgatcgcgtccttcctgtcttgtgcgaatcggcggagtcgttgtttgataggcttggcatcttctttgacatgtaaggagtgctcaatcacctctctaggaataccgggcatatccgaaggtttccacgcgaagatatctttattattctgaagaaaggtgatgagcgcgctttcctatttacaatctaactcggcgcctattacagcggttttagtaggatcagagggatctaggggaatctttttagtcttggcttcgctttctccactttttgaagtcttggtggcaggtatttctccttcgctcgccgtggctgcagccagtcggatatcctctcgggcagacgccatctcgcgagtttgggccatgtcgcaactctccttgtcgcatgtgacggcttgcttgatgtcgctccgtagggataggactccacggggaccaggcatcttcatcatcatgtaagtgtagtgcgggacggccatgaacttggctaacgccgggcgtccgagtatggcatggtatgctgtctcgaaatcggcgacttcaaagctgatattctctgtgcggaaattttcccgagtgccaaaagtgactgggagggtgatctggccgagtggagttgcggataatcctggaattactccgtgaaaaggcgcattgcttggttttagctcggagcgaggaatctgcatatcatccaaggtcttggcgaagaggatattgagtgcactgccaccatcaatgagggttctgtgaagcttgacattacggaccactgggtctagtaccagggggtaccgccccgggtggaccactcggtcaggatgatccgagcggtcaaacttgattgcaatctctgaccatcgaagatactggggcgtgtcgggctgaacagcattgatctcccgttcagtcaacttctgcttccgtttagactcataagccagggggccgccaaagatatggttgagctccttgcggtgatcttgaaaacctgccggggtgtcaccgtcgtccttcttccttgacgtgctttgttcttcgtcagaattcttccgtgcagtcttggtgtattgatccgcgaattgcttgtagatgaaacaatctttggccacgtggttggagttaggatggtgcgggcattgggagttcatgatcttgtcgaacgtgttgacgcgcgaacgctgtcgagaagagtgactggcggttgcaacaagttccgcaggcttacgcttgcggtccttatgattgttacatccacctcctcccgtagccggcgtacccttgttttgcttccaactcggacccgactgctttgatgcggtgacagcgtcttcagctttggcgtactcgttggctttttcaaacatgagcttgactgtcctgggaggcttgcgcccgaacttgccgaccaattcttcgtggcgaatccctttggtgaatgcggcgatgatgacgtcgtcggtgatgtcggagatcttgttacgttgttcagaaaatcgccggatgtaatctcgaagggattctccggacttctgaatgacgttgtaaagatcatattgtgtgccgggacgctcgaaggtgccttggaagttggcgatgaagtggtcgcgtagttcggcccaagatccaattgtaccacggggcaatccatggagccaagatcgggcggaatccgctaaagccactggtaaatagttcgccatggccttgttgtctcctcctgctgcgcggattgcgagaccgtagacggtaagccacgattcggggttagtggtgccgtcatacttctctattccagtcggtttgaagccggctggccaatccactcgacgcaggtcgtcggtgaaggcatcttgttggccgatgagatcacgcgctcggcgccctgcttccaaagctcgctgacgtcgatcctcagcctccttcgcggtccgctcacggtcctgctgctcacgccgtagccgttcttgttcttgtgcctgatgctcctcctccagtcggcgacgttcttcggtctcccgggcttggcgttgctcctccgtctcattattggccatgaaaacgccaaagtagagaggggtatagttgtcatctaggcttccgtcgaagtcgtcgaagtcgttgaagtcgttgtagcgagaactaaattcgtcgtactccacgatgtcagtaggacgtgagtcgacggtgggagagctgttgtagtcatctagctgatccgtcgaaaccgtgccgagtggttggaggatgacgccgacttccctgaagctaggcgaaatcggtgttaaggccgacttccgcctaggcctacgggatgaagacgctgtcgtggtagagacggccgctaaatcgtcggggagcttcatcaggactggtgggtaagccccatcatcttgatctggtgtcgttggagaagatgcgatctcggtcgagtggtttgaagccgactcggttgagatggtcttgaagtagctttcagccgcgttcgggaatccgaacgggaccgaaatccggttctctcccgactggtttgactccgagtctaggagagagatcttgccgaagttgttggtgatgaagtcgaggctgccgaaccgaaacgtctgcccgggtgggaagacgaggtcgtcgatgccggagacggaacccattgcactgatcggcgaaaagcttgacgctacccctacctggcgcgccaactgtcgaaactagatttcggcaataataaaagggggtggctatcaagctggaaaagtgtatgggtttggagacaaaagatttatacaggttcaggccttcttataaaagaagtaataccctactcctgtccggggatgaatccgccgagtgtattattgattgtatgatttagagaaaatcaacatctgcccctagaggcgcccggaccccccttatatatgggaaggagtccgggttacaaaagataatcaatatccctaacggaatacacagatatagattaaatacagccgtgaccgactaagtctcaaggtgtttccttgttgtacaagtcaagaaacaaacccgagatacaaataagatattctatacatattcggtatcctatatccagcccaaatagtatcgccgtgtagatatgggatatccataatctccacactaacttaatatgactatattatataatgatataaatttaaagttacactatgtaaattacaaaatattacccctttagccatatactcaaattagggatttggttgagtagttgatggaccactaaagtatgggccaaatagtaacatgaaccacagatactgggtatttagaaatacagtaactattgtattgtagaaatagtaatatccataaaaaagtaaagacaatgaaatggttggtacaacagttccgtttctatatttctttaccatttatattttcattctgtttggttaatattttcatataattcttttggcaagagttaattgaaatccaccacaattttgatagggtagctagggacggaaaatatatatgttgctcgatttgataggaaaatttgtgttatgagcatatgaacattgattgatgttctttttttgttcagagaattaaactaaccctacatctgcatgcttcactagagaatattcttcgactctaaacttgaattttctcatttttcgttagtatatggttttttgcaaaagttttttttctaaatagaagttgtttaaaaaacttaaataatttttttaagtttataattattaatacttgattaatgtgctaatgagttttctcgttttgcgtgcgctaaaattctatccccaaatgaggtgatcgaatagagctttcaaataaaatctctcatggtccctcaataaaaaaaagggtgaaacttgccggtaaaacgaatttgaaaatctccagtaaaccactcacctcatcacctacctctgttaatttctgttttgtttggcttgtctttccaatggagaaaaaaaactaaacgaaagacaaaattgtaggatcgaaagacaagaactaagccaaccagagggggggtgaatggttggtatacccaaaaaccgaaaacttttagcgaaaataaaagttaccctcgaaatcgacggaagtcggtctgaccgagatttatctgccggtctgaccgaagcgtagccgccggtctgaccggtgttgatcttccggttggaccgccctggaatccctgtcgcgcctgttgtcaccgccggtctgaccgcaggtcacccgccggtctgaccgccgcgatgccgccggtctgaccgtcggtgtgtcgccggttagaccgccgaaacccggcgaaacacaaatcgaagaactctaaaagtggatgacgactttatcaagtcatgtgttgcaataaaaagaagataaacccatctataatataacaagcatgcattaaagtataaccatgaaccaaagattttacaattaagcttgaatcaacaatcaaaattcatgatttcatatgatttataatgcaacatcttaacaagcacataggttgaagaataaacactaaacacatatacctattgcatttatcactctttctcaaataacctttagcacaaaataaccaagagaatttttttaaccttttcttttcttgagcctttttgctcatatttttctcttttattacgggtacgtccctatcgtcaagactgtttccagggattcggctccaattattttgctcacatcgaatacgtcctcgtcgtcaagaccgtttccaaggattcggtattcatttttttcatattttttattctctttttcacaatgagcaattaaagctatttgaggaataacaattcaataaagcatatatatagagcatttataaatcaaaccatatgctagcatcaacattgcatattttcttaattcaagtagaatttaaatgtcatgcatcatctcccttaaaagcaaaatctaaatctcatgaaaagactagaatacatacaagctatgctagagacaaataaaccttcaaagtattgctagcatgcacaagaaaataccatatgcataaacaaagctctcttttctcaatttttctcattgtcatattattgcttgataaaaccatgaggtacaaactccccctcaaaccatgccaaaaggatgaattatgcccaattcaccatgaagaaaagcaaagcgattagaatccaaaggtttagtgaaaatattagcaatttgcaactttgtgtccaaaaactgcaattcaacatctctcttcttaacatgatccctcaaaaagtgaaaacgaatatcaatgtgctttgtgcgtgagtgttgaacaagattcttagcaatgttaatagcactagtattatcacaaaagagaggtactttctcaaaagtaagaccataatctttcaaagtggataaaagccaaagaatctgtgaacaacaactagcagcagcaacatattcagattcagcagttgattgagcaacactagattgtttcctagaagaccatgcaatcaatgatgtaccaagaaaatgacatgttccactagtacttttcctatcaattctacaaccaccaaaatcagcatcgaaatatccacttaagtatatagaagatgaagtagaataccaaattccaaactcaagtgtatgattcaaatacctcattattcgcttgaccgcttgacgatgtgaagcacgaggagaagcttgaaagcgtgcacacaaacacacaacaaattgtatatctggcctagaagcagttagatacaacaaagatccaatcatacttctatattccttttgatcaacagcttcaccatcttcatcaggatccaacatagctgtataaccaattggtgttgaaattggcttgcaattctccatcttgaaccgtctcaaaagatcctttgtatacttcatttgatgcacaaaagtaccttgaggtgtttgcttaatttgcaatcccaaaaaagtacgataactcacacatcatgctcatctcaaattccttgcgcatagtctcagcaaaatctacaaccaaagcgtgagtcgaaaaaccaaaaatgatatcatccacataaatctgaacaaaaagttgattatcaccatgcttaaaaacaaaaagtgttttgtcaacctttcccattataaaacctttcgcaagcaaaaagttcttaagactatcataccatgctctaggagcttgtttcaaaccatacaaagctttagacaatttaaaaatatggttggaaaaatcaggattttcaaaacctggcgattgtttgacataaacttcctcctgtataaaaccatttagaaaagcacttttcacatccatttgatacaatttaaaaccttttgaagcagcaaaagccaacaaaagtctaattgcctcaattctagcaacaggagcaaaagtttcatcaaaatccaaaccctcaacttgagtaaaaccttgagcaacaagtctagctttatttctcacaatcaaaccatcctcattttgtttatttctgaaaacacacttggttccaataatattatgtccagaaggtggttcaactaaagtccaaactttgtttctctcaaaattttcaagttcttcatgaatggcgttaatccacgattcatcggttaatgcatgtgacacatctttgggttcaaaagaagcaacaaatgcagaatttgcacaaacatcatgagtcgttaccttagaccttgtagtccgctcacctatattaccaatgatttgttccggcggatgtcgtcgttgaatgtgcaaaggagcatctcgaacaacatcaacagaaccctcagccgacgaccctggccggtctgcccgcacctcctgtgccggtctgaccggaggtgtgacggtggtctgaccggcctggcgcccggtctgaccagccgagccgacctcctcgtcgtcgttgtcgtcgctctcgtcttaaaaaatatgaccatcctcctcctgaacctgtgacagtgtacctgcaatatcgggtctagtacctggactagcctcatcaaaagaaacttcgcaagtctcaacaattttgtttgtctccaaaataagtacacgatagccacgagtgtgtgcggggtaaccaagaaataattcatcggtagaacgtgcctcaaacttatccaaatttccagatttcaagacaaagcatttgcaaccaaaaacacgcacatgtgaaactttgggttaatgtccaaatcgaagttcataagaagtttttccaagttttgatttcaagaaaacccgatttgaaatataacaagcagtgttaatcgcctcagcccaaaattttctaggagttttatactcatccaacatcgttctagccatctcaaccaaaacacgatttttcctttcaacaacatcgttttgttgaggaacacgaggagaagaaaattcatgttcaagacctctttcattgcaaaattattcaaaagaagcatttttaaactcaccaccattatcacttcgaattcttttcaaagaaccaagaaattcaagatccaatcgaagaaacaaaccacgaaagtgttgaaaagcttcgtccttagttgccataaggaaaacccaagaatatcgagaaaaatcgtcaacaataaccaacacataccactttcctccaactgattgcactctagctggaccaacagtgtccatgtgtaatagctgtcccggtgcatccgtcatcacagaaacaataggagcatgtgaagaagcaaccatcttagcatgacgacacggtgtacaaaccaaatgaagatctttcttaagtttaggcaaaccacgaacaagatccaaaccacttaacctagtgagatgatcaaaaccaacatgtccaagtctacgatgccaaaacatcacatctttatcaaacttagcaaccaaacatgttatcacaggtgaaccaggattttcaaaatcagctttaaacactcttccatagcgagaaatattcaacacagaatcaccacaagaatcaaaaactttacttccagttttcttaaagtgaacctcaaaattttcatcaacaatttgtgaaaccgaaagcaaattgtactttaagtcctcaaccaaagctacattctttaattcaaatttttcatttaccttaaccaaacctatagcgagaacgacacttgtagaagcatcaccaaagataatcgattcagtcttggatgccttcttgagtaaggagaaccaatttttatcaccggtcatgtgccgcgaacaaccggaatccacgatccacacgttctccttccttgccaccaaagcctacacacaagcagaagtcgaagcctcagtactggggttagatgataataaaaatttaggaatccagtactgaaacacacgaccagaagatccaataagcatatatccacgtgcaaaatcaattttagaattttcagaaaaattcctccgaggccggtctgaccgaagtacagtggccggtctgaccacttctgtaccaccggtctgaccggtgcccgggatgaatgaccctaatttt

SEQ ID NO: 2674 - DNA, 6090 bp, Oryza sativa
  unsure (1)..(6090): unsure at all n locations
tgccactttgattttacaaaagcaatttctctctcctttttctgtttatgggctgatctgaaaccaaaaccaacaatatgtccaccttttccacaaaaagaacaagtatatttttcacgatgattagaccattggtagcattagaagatttagcaacactagcaacaacatgaggttttgcatgcacaacattggattttgaagaagatgcactcatagtagacatgataccagcagatttaaacacagttttgttagcattaggtttaaccaaaatctcaccacttctagcaccaacacctaacacaacaggaggatgtctagaattataagcataaggattaaaacctaaaccacggttatgtgtgctaacctttgattgatccaaaatcatgttgaggttctttttaccatcagaaaatcttagtaaggaatttttcaaataagaaacctctttatccaaattagcacaattttcacaatctaccatgacacatttgcttttacgacatttagggcaagaaagcacttcattgtttttcacaacatcttccatgaactcaacatgacctaaagcatctttcaatttcaacttattcaaattacatgttgagcaatccaaaatatcatgaggttgttttaactttttaacagaaatcatgttaaacatcaaactagcatgaaaagcaatttgatatttttgcaacaactttttagttaaaaataactcatccaaagtgcgtgtgtgcaaagcaaaactacaagcaagagaagatctatttttcaaatcatgtgcagcattaacatctctaatttttgaaatctcattcattaaaacctcacaattttcgtaatcatcatcattaggaataagagattttaatctagcaatttcagatttaagagattcaatgataaatttctgttttctagacatcttctcacacttcttattcttttcactcaaaatattaatagcttcctcaaaagcacttacctcattatcttcatactctgtgtcagattcaccacgcgccatgaagcaaacatcggagatgctctttcccttatcatcatctccactttcaccatctacatcacttagcgactcgaaggcggcgcaaacttgttgaaaagccttcctgagattctctagcttcctcccttgggatgaacccttcggcttgttgttgttgttgttggtattctcaccatctttgtcttctcttttgcctctcccaagcttaggacaatgcgaacgaagatgatcaattgaaccacactcaaagcaatgatttggaccacctcttttcttgttcctggcattatttatagctcaagcaattctattagcaaccaaagccaaattctcctcctcgatttgttcgagttgatcattgtatgtggcattaaaaacagcaagaaaagaaggcttagatgaagaagcatcaacatccaaagaagaagaagaagaaaccaaagcactcgacttagaatcaacttcccgagaaagaacattcatctcatgtgttttcaattttgtgtaaagtgaatccaaagtcaaagtagacatattaacagactcctgaatagatgtaactttcatctcccaaatagacatgtcaagaccattcaaaaagtgacgagaaatatcagattgtggataattagtatcataagaagaatcaacagatttaagatcactcaaaattttattaaacctagaaagatagtaatccaaagcttctccaggtttcatctcaaatttaatatactcctttttgaaaatatcacgacgaagttctttaatgttatctgttccttgatgaaagttactcaaagctttccaaatttcatgagcagttcgaaagtgcgcaacacgatcataatcagaaagagaaataccactcaaaagaatgttgcgagctttgcaattttgttcaaactcagtttttaaagcagcagtattaatctcttcaggaatcacataaggatgagaaacttttctctaaatatcataatcttcagccataatgtaagattgcatcctactacaccaatgagaaaaatccgttccatcgaaaacatgaggcttagttgaaaacctagcaggagtagccatggcaaaaactctagatcgataaaaattcaaagaagaaaacaaggctctgataccacttgtaggattgaaacacaagaactaagacaaccagaggaaggggtgaatggttggtatacccaaaaaccgaaaacttttagcggtgtcggagatatgggcccgggggtatgcgaagtgaggggaatctaccttcccatcctgccacgcgtccctacagcctagtcctgtccccgcattccgcgaaccgcaggagcggccggggggtcggggcctcggggtgccacgtcatgcccctcgggcccttgcactgctttgccccgaggctctcgcccagctgccatttggcagggggagcaagcgaggagggggcccaggctgaacttcctttaatgcgcacagcgccccaactgccccctgtcacatttaatgcagtggagcagatgtgcggcgtgctaaactgacgcgcgatggtcaagaatgaccggtctgtgaccggcctgacgccggtcacgtctgactggacggacaaccgtgctcccacgtcgcatctgctttcggcggagtggaggtaggtatgacccgtcccatcggagggtcattcgggcggcggccaccacaagtcttcacctattaatgagggaatgacagggctgtcccccatgtcaggcgagggacggcgctgggccccgctcaaggacaaactgtggtttagctttcaggcgaaggcacgggtcgagttccagtcaagttagggtgggtccccacccgaaagaagagtaggtagaggcggtgcatgtggtatccccttgaggtataaaaggaggactttgcccaccgagagagaggacgactctcagaaaacctgagcttgtggaggagggaagtaagagtgttctgccgattttaggaacccttgtaactcttagtctaaatcccatacacaggagtagggtattacgcttgatagcggcccgatcctgtataatttgattgtgtgcgagctagctaggagccttggggacggatacgcaatttctagaggcgagcttcttccctcggccgaactcatgaaagggggggtctcacgatctcccgctagagaggatcacccctcaacaagcggaaataaaagttacccggttagaccgccgaaacccggtgaaacacaaatcgaagaactctaaaagtggatgacgactttattgattctctctgtgtttacaaagtgcaccaacagcactccttacataaatttcgactaaactcgaaaccctaactcaaaactcaactcaattgctctccaaagcgataccgggaagcctcacgctccccctctatttatacatgaggcgggcagcctaaagccacgaaccaaactcatactaggagtcctaaacaccttaggaaaccctctagtacaagaaagaaactttacataaccaatcgtaccaaatttggactccttccaaattcaactccgcatcccatacgcacacaatacctccatcgtatgccatatggaatctccatcaaccacgtgcatcaactctagcctaagtattccgcatgatctctgaccaccacggacgtcgtcttatccccaagccgattcccgatccatcaccgcaaatactctcccgaggcattgagtcacctacacatgaaataaacaaagaaaccatattccgagaccaagctatctccaacttgactcattagtagcaaacagtagtattacatacgtatagtatccatctagaagtcataatcatgaaataatcacggatatccaaacaaacaacccgaaaccgaaactgacacagcgtcggccggtcagaccgcgggctgcgccggtctgaccgcgcattacacgccggtctgaccggttaccagagcccggtctgaccggtcacataaaatgacgaatcctgcgatcacctgtgaaatccaatcatctctaaaaccacttcatgaataaataccaaataacaaaaccaataatctctaatgccaattgttcatcacagaataataaccaaaaacacctgtacacatggcgagtggcgctgtgtgaccattgtacgtatacgtaaggatgacgctcttgttgatgcaacgaccgcacgtatacgtaacgctaatgcatgaagcatgtcatcagagtagctaattaaaaaattgccacgtatcctcttaattaatcgcacctcttgaccactatacaattaattaactcagctaaatatactgcttaatgtcatccactactgttgctgctggaggcatatatatccatatgcatctatacttgtatgttactgtatcaattgctaaattaatgacacatcatgattaatattgtaacatagtgattaaccaccacgtgttagtccattcacaattagatcttgtttggaagattgccggagattcttaaaaacatctagaagagatgtgtttttcagcttttacttatctattggttaaataaatttggaccatttagagaacctcgggagattttggaaaaagctattaaaggcctagaactgtgttatatttttttcagatatataggggcttagaataaaaaaattgtccctcattatcgtgtggggacacaacgcgcgagagagagaatggcgcaatttataagctagtgtgcagtgttgtattcacatccatatgggagtggagatcggaggaggagatgatcgatggattgacatattccaaagctgagcacaattaggacacgagcaagtgctctaggggatcttgtgtactcgatttgggaatgattaattcgtgggtggattagtgccacccacagctaagatagggtactctatcggtgcgtggctgcatatatggtggagggattagctatccagccatcaatcggacactgcttttttttttctattaacacataaatactcccatatttcatattataaatcattttactttttttcttaatcaaatacctttaaatttgatcaagactgtggaaaaatatactaacatttttaatacaaagcaaacatatattatcagaatatattcaatgttagattaataaaactaatttgatattgtagatgttgctaatttttatataaacttaatcaaacctaaagaacttggactaaaaaaaattaaacgacttataattatatataatatgaaacggaggaagaagtatatatacaccaccccacgagcacacgctatatatacacacacactagtatgtgcacgattaatacatgttcaagacattgagaactaacgtgatcattttacttaaattcctataaccgaagtgcacacgcgtgtataggggccctttgaaatggattggcaaacaactttagagaattcaatttcttctaaggatcttttttttcctatggaacctttgattcataggaagaagatagaaaattttctacataattgcatttctatgatctataggaatacgagtaagagattagagattagacctcttgtaaaacttacttttggcttaatttctttttgtgcaatcaaacggattctcttcttatttcatgcattttcaagtcatgcaggattggaaaaactgaaactttaatttctgtgttttttctgtggtgtttttcctatcctgctggcctaggatttaaacctagcttgtttcatgtatacactcacaacatgtaatgattgaaacaatattcacgctaaatcatttggatgataatttccagccgcccctatcctaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2675 - DNA, 14615 bp, Oryza sativa
  unsure (1)..(14615): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgaccaccaatgaccatcagaaaataattaaaaacgaaaattgatggatcaatttctatttaaacagttcgagctctgttcctccagccgcattgaataaccaaaatactactagtagtaaaatcattttgagcatccacacctaatcaataaacgagtgcaccaaccaaagaacagcgcactccacctggaaaacaacgcggggggtggctaaaaatcgcaatttcgcatagggctcctcccaagatccgattttgacgccgatttgatcacagaaatcccaaaaaaaaaaaaaaaacaggagatagatgggaggaggagaggaagaaatcaataaatcaatcaattaatcaataagtcgatggactcgcgcacctgggcggcgtcggcgagctcgtcgagcttggccggcgtcggctgcggctgcggctgccgcgacttcctctccctgtgctgctggtggtggccgaagcccttcagcctcagcaacggcgacttcatcgatcgatctctcttccctctcccctctctgatcgattactcctcctgtctaacaatccttataattttgtggggattaagcttatctaatcttttgctttgggcggcgatggtggaaatcgcaagaaaagaaaagggccttgatttcgcctctctctctctctcttgatctttcgttgttcctctatgaaaggtagactaaaaatggagggagattttatagttatagctgctgctgcttcttttataactttagcctaatggaaagatatagtggggcccccatgcccttggttgaccaaagaaaaagaagattagacaaaaagcagtcttggatttgatatagtagtataataataattgtagactgactgagagaaagcttagcttagaccggcaaatagtagtagtggtagcatcaaggagattttgctacgaatttttcttgatttgggttggtttttcgtcggagaaaagattaattttctactgtatttgttgttcccctttgcttttgaatttgatgatgacatctcgtcagatactaacagcggctgatgatacagtgatacttacctaaattaacactgaaacctgtggattattattttggtttagtaactatactactcctactttttgtttcagtcataccatatgaactaaataatgtctcacgctttgctgcgagatatatattgtataatggagaaatgatgaaatcatttagattgaaatattataaaaatgatttgagaatggttatttagcatgtgtatgtttaattttagaataaaataaattataaatataattactatatacttacatgttgagctttacgtgtttactggattgacgtggcatgcttgcgtgtaggttttagaagtactaataaatacaatgattgcatgttgagatttaggtatttagtgggtattagctttatagaaagaagatattaacattgaaacctgtggattattattttggtttagttaattacttctactagtttttatttcaagaaaattgcatgtgtaccctgaaagtttacctaatcttttctattcttctgagatttgctcgttcccttccatacttctaaatttcagttttgaccccttctatacccttttcgttagttgaccgttaaattcctacaataatatccatttttccatttggtatcaagaaaatataattttataaagtatattgattgagtgtataaatttattgtatgcgactattttatttatgagtttattttgtgggatattatttaacaaaaataatattttagtttcgcctccgtgaaggaaaaacaaaaaaaaatatctatgacaaagtttatttttagaaataacaaatataatatattttttaccattaaaaactgtatatatagcatattttgttacagtagtacaatatttttataagataaatctatttatgttcgaaataaataataaaaaattatttttatgtcatatataaaaataaattatcataaatattatttatgactttgttatgcaagatattatttatgataatttatttttttcatacaagataaaaattatttttgtaaataatatctcacaaaataaactcataatagttgtatataataaatttttatactccatcaatataaatcataaatttatattttctcaataccaaagggcaaaatggaatttatggtaggaatttaacggtcaactaacggaagaggtatagaatggatccaaactgaaatttaggggtatgaaaaagaatgagcaaatctcatgggtatagaagagattggatgaacttttaaggtaaacaaggaattttctcttctatttcagtcataccatctactgttcattagttaataggtactcccttcatgctaaagtctaagttatactatttcttttatcttacctcatccctcatataacaaagactaataaattataggcatacatacaaaccaataaatatattaagagcaagtacaatagcatactataagctagctataagcatatgcagaaaaaaaaagagatgagagagaaaaaaagtgtgttgcaaatttacactcagctgcagtacggattttaagatgttgtgtttgtatgagagatggaaccaattatataatggcgtagtatatatttgtagtaacttttgtatgaatagtctattagattaactatagatgatttggagtagttagatatactatcaaacttgctctaagatgattacttgggcggtaaaatgaaaagacgatccattcatttaagtattagatgtataatgactaaaaaatatgtccctctcattaaataaaaacaatgcaacaaataaaataggataagacttttggatggagaaagtaacaacatattatctctaatacacgaacctaagtgattttatcttttgttaattcactctcgtactatctcgctctctctttgaacttaccttagaatttatatagaggttgttatctatacgaagggtggctcgtcatttctcttcttcagctaattatctaatgttctgtgagtgtgatatttttacaggcaacctatttgctatagggaatatatactatgcacacaagcttcctatgaatactccgtgcacatcaactaataaatatcacaaaaaattttaaaaaaaattgtacacatacttcaaatagtattaaacctacatgtgaaattttatcttcaaattcattatattttagccataataaaaaagacaagattctgacatatttttacccttaagactgtcagattttcacctttttttaggctaaagtataataaatttaaatatgagactttgtagatatgtgtaatactaatatgagtaaatgttcaacttctgctaaaatttttcgtggtattttttagttggtgtgcacaggaaggttatgtgtatttctggtagaatttttcgtagcatttgttagttggtgtgcacgaagtgtgcacggaaagtttgtgtgcataggatatgttccctctgttctatgcctctgtaactcacccttttttttttctttccagaaagtgtttaactttttttaattatggctgcgaatgttaggttgatggggtgtgatgccctggttgctcggatagatacgcgtgggtgcgtgcaagcgcaaccgatgaatcaatgaagtggcctcaccgtcaggtcgatcaggaagcacttgcaaaatggcaagggcaccgtgacatgattcatgaccacccaagttgagcgagacatgaccaccaagcaccaacccaaaccgaggccacctgtccactttttaatggtgttcttttttccccccgaaccttttcaaaatttgtttatttttttctgaaaaagagaactcagcatacttatttattaaaaaaatattgtaatgccactatttattgcgtgacaatgataaataaattttaggagattcttttttatgttgtatatactaaatagaagtagtttttttgcgggatatatactaaatagtttaaaacacataaaaataatcattgttttttttttattttggggatttcctattgtttgcagtttacataagggcatacgggtcttcttcttaaaagaatataacgtcaaactgggtaatttttttttttaaaaaaaagggtcaggaatactagcagaacagtagggaaaaagagaagcgcaagaattcgatggcaattaggacataatatattttgagtaaattatacctctatttagacataatgtttgactaataaggagaatatttcaattgttcatccaactcagcaagattactcatactgtgccgctttggccttaagttaatttgcatgtaccatacaactttgtataaattaatgaaatgaacgttttacaactttatgtattaaaataattatattcatcttacaaattcatttactatcagtgtaatttattcatatatttttaaggagtgacaaaaataaaggaaaatatattaacatatgcccatgtgtacatttgtaggcataagtttggttcgtcatgcatggtttcacgagattggtccattattaaatttactattattctagcccaagattatagtgaaaatgatgaattacacattgaattgtgttcttgttagaaagacaaacataaaataattggagaagcaacattagtgttgtggggattcactgtttgcttccatctatttgagagtgggcacatttggggaagtatgagagtgttgtggtgcgtgcatacgtcttatgcataataaaaaataaataaaataatgcggtgaatttatacgtttgttgataaagatggataaactagtactatatgctgcaacactttgtttggtacgtacgaatataaaagcactcatttcatttgacaaaaaaatacctagaatattgcaaaattaagctaggctatctaatagtttcgagattcgtactgctacagtgattctacattatcatctatcccccaacccccttggttctttcctaacgctctttggatgtcatctgataatgcctagcgcaccgctgacgcctccccacccaacacgtcatcgctcggtcgaaagacgtcaacagcgtcggcgaggcctcctgaccagcctcctcctcaatctagtagcagcgaaggcctatcaagtgattccttgctaccggatccgccatctaggccaccgcttcctaccacttctttgctttgcctccgccgccaacgtcgactcgaccaccgccttcttccatcctcatggctttgacaccgacgcctctcatagccatcgctttaaatccgacaatctccctctacataccttcctaccatcatgtcaatccggggtcatggtcaaaccctaactctgggtcgtcgtcggttgccaaactagagaaaaagtatctagggttaccggatcacgaattgcaaaacacacaaatcatgagtttagaaatttacagatattttagccccaataatcgcaaagagttgcgaagaacaatctgagatgatctcgctcgccatacagcactttgtttggaaggcacgaaacatgcacgctagtcatgcatgcctgggaagaaaggaccatatgctgatctgcttcgttggaccgtgttaattccaaacgaccagcggttgctcagccacgaagaaattaaaccatcatacgtaagctatgatatattggtactaattaaacgacctaattagtatatatacttcttctttcatatcatgtcaaatccttagttttttaaccagtcttccgagtaataagactttctagcaattctatatgaatgcgaccaatgctagaaagttttataatatgaaacgaccaatcctagaaagtttataatataaaacggaggaagcaattactcgatcccttgatctcctcgatccctcgttgtaagcgaataagcgattagcgatcaaggtcagacgtgcggggttttgaccgtggaccgaagaacggcccaacaggtttaatttcgccggtcaaacggtggttagctagcgtatacattactagtatgtacgtgcatacatgtctcggcgtacatacgtacgtcgtcgtcgcaagtgcagcgccgccacacacagtgtgaactaacctacgtaagagctgacctggatgcatgggtttctgtgacgcaacacgtgtcttgtctgtgtgccagttgtcaaaatcaaccttaagggtgtgtcctgtcgtatcggaagagaaagtatatactacggccctgtttagttcacactaaacttccctcaaactcctaacttttcatcacatcacatcacatccaaaactttcctacttacataaacttcccacttttttttccaatctaccaactttctccaaacttctcccaatttcagaaactaaaacacaacctacgtatcatattggaggttttagatatatagtctatagttcaaggtggcccttcatcatatatctggtgacggagaggcacaaagttcaaggttaattaagctaataagagcttaaatattttcacaaattacaaagtatttttcaagattataatggggattatgaagctaggtgtggggcccaagctatagctgccccatgcatgtttctgcccctgattatattgttaaatgtgccacttaggttaaagctactgtacatggcattccttctcaatgcacagtggtttgaaggggaaaaaaaccaccatgatgatttatggaagagaactactggcataaccactactacacaaactagataggtattggttgggaacctagcatagatgtcaaattttccaaccggcacaaaggtgctggctccaaaaccggcacctttgaggtccaaaaatacaaacaaagaaaaaagctcgtagctgccgtcttcaccccaaaaaaagcggctcaatgcatcggctcaaagcatcgagcagctccccttcacccgatatcacccaacatttaattcatagaattaatcggcatcaagaactacccaaagaacatcaactcaaacacaaaacacaaagaacatggagaggatggatgacggcctccatggagaggatggagcagcagacgagcagcacatcgggtcccatcttgcatagctcgtcggcggtggcgaagaagcagatcccacagcacgtccgaaggcgccacccgccaccgccgcctcccctcccgccgtcgcccacaatcgcacgtcgctattgtcgcctcccctcccaacggatctggcagaggggaggggcgccgcctgcctcccaccgtcacctcccctcccgacagatctggcggaggggagggcttcacccgccaccacacgccactgcgcctgagagagagagagagagagagaaagagagagagagagagatgggagaggatgcggtggagaggataaggacatacaagagataaggaggagaggatatggatgacaaggtgcggtgtggtgcggttcgactccgctcaatataggggtgtcggttcttctttataacaggcacctatagttacttaaaggtgtcagttttttgtgtttttagtctacggagatggaaaaaggtctacatatgtcggttttcgcacttcaggcacctatagcgccgatctctatgtgccttttttagtagtgaacacaactccctccacaatagcttacgcatcaagtagtcttttcaagttgcttaaaaaaccgtatgtgtttttcatgagacatgtgcgcctctagaggccactctttaggctaaggtggcgacttggcttcaacataaaggtgcggggtgacttaccatgtcaccacacaatgtaattgtgcttatgttatagggacgccctctttgtttaggctaaacttattagcttaggcttttaagttagcttatcggcttatgatttataccaatggatttaatatcctaagtttagtggtggagtcgtacatctaccttatataagccaaaaaagcttctccaacttaggttttggcttaatagtgttagagtggcttaatagtgttagagtggcttatggcttaaaaaaagccaaacgaaaaagctgcttatttgtttagtattagactttttagcttataagttaagccttaaaaaaagagagaatatttcaagagagtagaagagctaatttttctcacctttgaatgcgtggacccttttgggattttggcagcttctagtatctaatcatgcggtcacgaaaaacctttttatgaataccaaggtgtgcctcgagagttgagaggatgtgctaaggtgagcatccgttttaaggctttttcggtttctcggatgttcggtttctgtatagtagaaaatcacaatatatagttgtgagaaaaaatgttgctttggtggtttattgtcaaagaggagcatgtctacagctaagccgagccactcccaagtcccaacaataatcaagtgcacgaccaaggttggatacttggtgttatgccactcacaagacaaaaccgcgaaagctatgtgtgccctgtctacatcaagcaggtgaaagacatctactctaaagatttaatcttgcatggtgtcggtttcttcagtaagtttgattcacactagaaaaaaggacatacgactacaaactaaatactgagttacatgaaaatagaaactgaggaaccaatcgaaaaaccaaaactttggttcggcattccgttcgtggtttgtttttgcccacatctactgctaccaatatgcgtaagagatactttggtcgtttgacactctagcttgatgaagagttggatgaattgtttttgaattcgattcaaaattataaatataaaatttatatatgtataaaaatttatatgtgcaaactttatatacacataggtacaaaacatatatgtataaattgtataaacttttttatgtgtaaagttttatatatagtctctctattccaaaaagaatcaaatcctagaggaaaaagtataccgaaggtccctcaacttgtcatcgagttacaaaatccattcgctttaggtccttcggtggttttgaacccggttttatccgacgtgatggctgagtcagcgtggaactcacgagggccccacatgtcagtgtggccacatcatctctcttttcccctcttctctcccttcctcatctctctctctctcccccttctctgctctgcaaggcaggcaatgcctcggcggcgggcgtcggcagtgatggcggctatgggcaacgtggcggcggtggggggaggagctgttggcgggcggcgggtggccgagctagagcaggaggctgacgcggaggaagacgagtgtgcagcggccggtgacgcgaacgacggcggcggtgtggagcggctgaggcggcggctcgcggccgaggggaggtggagaaaggccacgctggaggagctggagaaggataggtgcgcggcggccgacgaggccgagctggagcaggaggctgacgcagaggaagacgaatgcgcggcagccggtgacacgaacagtggcggcgcagaggagggcgacaacgtggagcgactgaggcggcggctcacggccgaggggagatggagggaggtcgcactggaggagctagagaaggagaggcgcgcggcggcgtcagcggccgccgagctggagcaggaggccgacgcggaggaagatgagtgcgcgacggccagtgatgcgaatggcggtgacatggaggagggcggcagcgtggagcggctgaggcggcggtttgtgacagaggagagacggagggaggtcgcgttggagcctggaggagctagagaaggagaggcgcgcggtggcgtccgcggccgacgaggctgagctggagtaggaggtcgacacggacgaagacgagtgtacgacggccagtgacgtgaatggcggcgatgcggaggagggccgcagtgtggagcagttgaggcggtggctcgcggccgaggggaggcggagggaggtcgcgctggaggagctggagaaggagaggtgcacggcggcgacgcgcggccgacgagaccatggccaagatagcatgcctccgccgtccgcgcgccgcctgccgacatctccttcccccactgccgccgcgtcccccgtcatcgccatcaccgccgacgcacgccaccgaggctgccgatcttgcagagtagagaaggggggagagagacaaggaagagagaggctgatgaaccctgagctccactcgagacactcaaggctgttgttggcccgatctttcagtgagttgagataactacgatttgagagaaatattgacgacccgattacaaccgtactagacattgttgtcttgcgccttagcgatcgatacacctctccgtgggttgttgatcttgccggtgcagatcaacgttattcctgcaagcaaatcgaagaaacaagcaagaataagataaaaacaatctgaattgcagatatgaattgaatacaaatgataggttggggttctgtaacgagtaaatcggcgatataactgatcacgggattacacggcaaagtaacaaagctaaactttaatctaaataaaacccaagcaaccctgaaggggtatctagctacttataggggtgggagaacaaccaagaggatcctagggtcgtgctccaccagattggggcgcaccccacataggccccacttgggccggggtcccaaacgaaattacaaacccaaaggcccatgacaggtgatgcagcacattgtttcttcatctgcggatgacttggatggaatttggtgatgaggccggatccgttggaaagaggactccgagagctttccatcaagtattcatgggccgaaaacggaggtcgtatgtagattcggcggccatttgaagttagcagggtagcaggtggccgaatctgattccagcacttggaagacttgatcttaatatcatcttgttcttccatgatgtgagcaatggttatatctgtagtgaccatagtcacatcaaggggaaaatagagatgatgtggccacgctgacatgtgcgttccacgctgacttagccaccacgtcggataaaactgggttcaaaaccaccgaaggacctaaagcgaacggttttgtaagttgagggatgccatatatgttttataagttgagggatgtcatatattatctggttttacggttgggggatgatttcgtaactcgatggcaagttgagggaccttcggtgtaccttttccaatcctagctaccaatgtggatgaatgtatatattttgactgggccaacatgcatgttactagtgggctcaaggcccaggaaagaaagaagacacacctaggctgtgtgggcgcacgttgactcgctcttatcgcgtttagcaactcgcgcgttagacctccccccaaagaacttgactcttttccttcggaagtacaaactgataataaggaatgacaattgatttacttataattaaatgatgccaacccatagctaggattggatatgtatataattggtgcaaccgcgaataaatatgcaaatgtctaaattgaaccccgtcagatgatcgagtgacaaacatgaataaacagttcattactttagcgaaaatacagcggtttagatacatatatatggtatacaacaaggtagttgccttctctatgtacagagcagatcactcaagaacaatgcatagttctcatccatggaaacggtttggatatcaagagggtatgttcttacgcaggcacagcgaagctcggttcagaccagcgagttggatccacaacgaggcacggatccgacttcttgaactcagccacctgcagatcgagtgcattcaaaagaaagttgaaaaaaaaaactgaaagaaaaagctcaatgggagaacagcgtttggacaagacgatggcgaaccttttccccacagctggggcagtagtggtatttgtgccagaggcagtccatggaaggacaaaggaagcagacgcccatcatgaagggcatcatgcaagccacaactgatgctagacttggcttcgacctgttcaaagcaacaacagccatgagtgtgtttttttaagtaatgaagcttcacctaatgatatgtttggtatggtattggtgctactggtcttgaggtgtggagtaggaaatcataacacacaaatcgacagctacttacaactaaaataatgcactaagacccaaatttatagtatcaatatggggctcaggcttaactatggtgtgccagttcatttccctatcaggaaaataaatacaagaaatgtgttattcgtgcccattcttgcatcgccaactttagcatataaaaccattactcactactcagcagtcagcagtcaaatcttgcatcaccaagctgacacatgattttcggttcacaaaaaaatctgacaaattgtctcaatccatagctcatgcaaccattcagagttaactagaacagataatgcaggcaaatatttagatggtctttggttcttttcaaagcccaattcaaaactagtaacaaaactcatatagtgccacttcatcatatttagtggcaccatctgatttgcgcctcataaatgcaaatgcaattacgaacataataataataataaagggcagaccccactagaaaggtatactgcgcctctcttgtatatatggttgaaacaagtagactgtttttgatacagtttgtcttctaatacttgtttctatataatcccaaaaataacacctttcaaacataaagactaatatcgttcaccaaaagttgtttcagatgtaaggacttaatgcaacagacacttagcaatgtgggcagcaatattgccaggaaacatacgaaagacggtcatttaaaaacagagtaacactcaattcagatataaagctgattgcaaacaattccaagaatcatgcaagctcagatgagcttcagtaagccttagcacagccaattagatggtctcggcagcagttcaaaaacagaaaatgagcttagctcaagatgtaatttggttcctttttttcgcaatgctataaaaatatgctataatttggttcctacagtggcaggagatatatacctgtcaatagaggtacaataccttccaattaacataaaaaaaatacctctgccacacaatacctcccatggactgggaaaaaaattgtatcttcggacctgttcattgagtacagaggctactaaataacacaagtgacaagttagtggaagtagatggctaccatgttacaattcacaaacatccatatatatagatctaatctaaagtagtgaaagaattattctttctcgagtggaggatttgccacatcatcaaaagactaatggccgtcagatacagctttgaaacaaaatttaccgttggatatagagaccaacaaagaatcaaaaggtcaaaataaagaaggggttgtctggaggcttcaagaggcttccaggagaaaaggagagggaagagttccaccagcgatggaaacaaagcaatttgttggtggctctgagtaatcgatggcccaaacagaataatgggcttaattgaaccattataaattccttcctaatagcagccggaaagcagaaattccatcctcttttcttcatgtgactggagcttaaacagactgatgattatccattataccatgaaacccaactttaaaagaaaaatcaaaataaacttttctactaataaaatatgaattctattaaaatgaatcttcttctttcaaactgaaagacatttatacacttgataagttaaacatttattcaatttaagatgaaaaaataaaatgaaataaaatccatagtagttctttatcaagttcttcatataaaaattgaaattccgcacatatatccaatagacattactcatagaacttttacatacttgtcaatgtgggcatcaaagtcacgcaacgtgcgacaaagtggctagtatatatgactgccaatttctgttattgtgttttattacgatggtcatgttatatattagctaaactaggtgttacatgtcctaagtgcatgattaactctagcgctcgagactcttcattagaagaagaaagctaaatatgttcgtgtaacttttagcttccagtacaagctctgacatgttatttcaactgacctagaagggttcagaacacagggaactcttcaaagtgttttctaccagatggaagaatgcctttcttctactctctccgtccctaaatat

SEQ ID NO: 2676 - DNA, 35989 bp, Oryza sativa
tgtaagttcatgttttcagataatggaatcttttattgaactcatccaattacatcaagatgatacaaaagcactggtaaggattatgttgtccaagcagacttaggcccttgatttgcatctgttgtaaaccttaaaatgggagagtaattacaagtttgtaactgatatactatgaacctattatattctcttcctcatatcatcagattcataatttaacaataactcaaattctcacctcccctatagaaactcaacttaacagaaagccaatcgtgaatgcgacttggataagagcaaacgaataacaagaaacagatgacatgaaaaacatggggaactccaccagggcttgagcttctctggtttcgacaacctagaaagtatcgatttcttcttctcccttttcacggtgcagattagactaccgaacaatctagtactcgttgcagatcaatacaccgaatgctggcaatctcgacctatcaaccgctcgaattccacatctatcccttcgaatcgcaggtaaaggccacaataaaaagactgcaggggggcgagtacggcgggttctcaccggagggaggagacggccgcggcgccgcaggcctggcagtggaatggcgcgggggtgtcgcggaacatggtctgctgcaggggcacccccttgggcgcgccggcgtagatcgcgttcggcgggggcatccccgccgcgtaggggtccggcgcgtagtagtaaccgccctgggcccccgccgccgccggatggtacgggatgccgatcgccggctcgtcgccggccggcgcggggaacgccgccttggccgccatggtggtggtggtcgtcgtcggtgacggcggttgggttgggttgggttggtttgaatcttgacttgtctcgccgcggctgtcaggttgtgggctggaagcctggaaacggagaagatatttatatgtgtatgcgtttgtacaaggtctgaaaaaaaaatattttcgttggaaaattttataggattttatgtgtaatcgttcgtaatactccataaaactcttctagaaaatgtagttagtcaaaaacgtaacaaagcaaatgttgaagataggagaaattacgagaccttgtttattaccggcgcattccacacaatcgggctttttttttctaaaaatgctcgaaattactttaatccgggcgactggcgcaggggagcccgatctggcgctcccccgcgtgcccctcccccctccacatgcgtgaatgcaggccctaggtcccaccgcatcctctactttcacctgccattgaaaaaaatcctttggatacctcctattaagggaatttgttttattttttccaccaaaaatatttcatctagtgtattcacaatatttcactatgtatagttctaatgttacaaactgaaatactccattgcaaccaaaaaaacccacatattttggaaaccccctattaagggatttcattttattttttattccaccgaaaaatatttcacctagtgtacttataatatttcactatgtatggatcaaatattatagtgaactgaaatattctttcgctatttgctgaaacattgtttttatataaggtgaaacaacaccagatttaaacgggtgaaacattttcgatctacttagtgaaacaattccgatatacctggtgaaacatcgtgcaacatttaaaaaaaatcaataataagctattttttttcatcggaatatatccatatgtggccttgttttgaagatttaattgcaacgaatttaatggtgcaatcggatcatgatttagataaataatttaagagaaaaatcagtttaaaatagttttgcacgtaaaacaggtgctaacgtcagcgtccgatttttcgaagatttggatcgggcgaccaatccctagtcacctccagaaatgctacacatcacacgtataattttagaagagaaatcatatgaatttctagccttcaattcgcttaagccatgtcgagacggccaccttggcatggccaagagtcgaccggcctggcctatttcacgacagtcattctaatcgactttagatgaaattcaatgtttgtaatgttcatcaaagatgatataaggccatttccaacccaataactaggatagtgtccataacattaaataaactgctacctaaaatgaaaaatgatgtggcaaataaataaatgagaaaagataatgaaaccatgtctcgcatgagatatggtttctacacaacatttaagacattatgtgagataagtaacattaaatttaagtatggaatagtggtgtttgcattaaaagagtaatgtcagtttatgaaaactatgttagtgtcttgtgttggaaatagcctaagacatcaaatgagtccgctcactaaaggagtgctggtcgttgggaccacgtgtccaggcttggcccggcccatcctatttgcctggccgacctgcgcgccctttttccacaattatattatctagatacgacgatacagatacggatacgccatcttcctaataataaagatacggggatacgcgtatatatatataaataaaaataaaaaaaataaatcgtaaactaggcaattagcaatttagcatagcagagcatgccaacaccaagtcaccaaccattagattcatctcaccaaaatacaaataatataaggctaaaccagtgcatatgtaagtgcaagatttcaaatagtacgcaaatcacaaattaatagttcatcaacatgcatagtttcacacatcacaaccagttcacagagacggtagataacatcaacatcatcatagagctaattcaaatagaattgtttaggacttcaaatacaactcaataaatcaattgctgctttcatccattgtaactgaagtggctgaagcgccattatcatcttgtatatccaatgcaccaagatcttctagcactctctcaagatttggctcatcaagtgacagtgttgggccctctctaggcagcacccgacagtgctgcgccctctggaggcggtggcgctgtgcccagcggatggcgccgctgctaggcgatggcaaacagcggaggcacggcggtggacggaggaggtgcgacgcggcggcggcggggaatggcagtggcggaggatggtggcggtgctgtgctacgacgcaaggaagagagcgagctgagttggggttggggaagcagcgccgttgatgttctttggcttgctcagtgttcgatggttttgatcgatgattttagggttagaacgtatcgcgaccgtatcgggaattttttttattatctgaaaatcgtgaaaacaaccgatacgtacgagatacgtatcggggcatatccgatacttatccatatccgatatgaatacgtggcctgggaggcgtatccaggtaacatagccccacgacacccctctcgtgttagaagctccactttgtttatttttatttgctagaatgtcaggaatagtatactctagtttgtagaggagttcggttgggaatcggcaagattttgaaggaatgtctttgggacttcagtagtgattcttgtatcttacaagttatacatttaggctaacatatatttgctttatattttttagtatttattttccgcaattacattcactctttatttatgttacagagtatttctctaatcaacggattggtcactcatcatgtggaataaactagaagtctgtggtgtagagtttgcaggtttcttggttggatttagttcacctagctggatttgagagtgctctcttctaaccagcgggagtattttacgagtatacgacctagtccgctagatgtggtgccttggatgtatagttcaaggaaagggtagttagaaaaattgatggatgtaatcgtacaggtggtgatagcccaaggcgtccttaatagtcgtccacgttagttctagtgtgttggtgttagacatcaagaagggaaattccttgatagtgagaacatgcgccctgtgccttattagtacaagccatgctgagattttctcatgctgaaatacatctactccttagtctcctttgaaactcctaaattggataggttgggtccctaagtgtcatctgtagtttaacttcagtcatatcttttattagatcttacccccatctctaattagtgtagatttccttacacaagcaacatagaatgaagaaaacattttgtgccagcagtgtgtcctttggaaaatataaatacaataccctagaatactccgagataaagtactatattgataattccatgcacgtgcggaactattttgtgagagcataagaaattcaacaagcactttttcgcgtcgttgctaagaacgcaattggataaaactttcattctttgtacattgtcttgatgagtggaagtttattacttttctaagcgggtttgcatttcctcatgttttttgttgatctgaagacatgacatgtttatggtcaattttgatctcccaaaaaattgtcaaagttatcatgagttgttcatgaataagtgaaaaatatcattatcataaacacatctcatcatcataggccaaatcataggagaatatcctgttagttcttccttcaccgcctctaactcagcctccacggatcattatggccgagaggaaaattcaggactattccgatcctgttagcaaagtcccgcaaaggccgaccatcaatgtcaaggcagagaattttaagccaaagctgatgtttattgatatagggcatatttggcagggctccaactcctaaatttaactccaagagctaggtctagagtggagttgtggaacagccaaaatccagctcctccttcaagtttattttctgaaagcactccagctagctccactcccattttggatggagctgaaactgttttggctagctctatcaaacatgcccatagttgctcatagttcatgatgtgaccatgcctactgtgcatatatataaccattattcacattatgggttaactgaaggcattgagatcaactcgcccaaattctggaatccaaattgaccgcctctaacagcgttgatttcaaacagccactaaatgtgcatacgagctccattttgagtccatgagtacttggtgaaaagctcttgaagtactctttccaacgtatctagccccatctccaaattccaaatgaatcatccgcaattgaataaacaaggtgtggcaccacctgtcatgggcctttgggtttgtagcttcgtttggggccccagctcaagtcctcccacctctgtaaatagctatgtacccctttagtgtttctcaggttttgtttagattaaagtttagccattggtactttttcgggtaaagtcatgatcggttagatcgttgttttctcattacggaaccccaacttatcgtgtgtgtattcaattcatatttgtaatgtcagattgcatttatattgttcttgtttgtttcttcgatttgcttgtaggaatagggtcaatctgcagcagcaaaatcaacaatccacggatagatgtatcaatcgctaaggcacagcacaacaacgtctcgtacggttgtagtcggatcatcagcgtttctcccaaatcgaagtattatcatcaactcaccaaaagtcgggcctatcagagtcgtgagcatatcaagtgaagctcagggttttatcaatccattatgtagcaaaccattagtaatatggttgctcataatccattctatagcaaacctttgaagatgcaacggacacctccaacagttcttaaaggtttgcaacaccttcgcctattccccattctctggttgagaaggcaaagtggtgttctatccatttgatcaagaggctatctttatatggatgagatgctccaatatatttctttctatatacttgtccaccaaaaagccaaccgcactgtggaacaaaagattgggatttcaacagttgtatgatgagtcaattcccgatgcatgggagaatttccaatagtgcatccaagcctgcccgcatcacgacatggaacaccggcttctcatccagagtttctacaatgtggtagtgcatccacaacgtgggaactgttgtatttcttaatgtcacagataaattccgcaagtgcacggagaataccgatgtagcacttcaccgggagtattccaaggtattgaattcatagggaacgtgtgtgttcagctcctcgtcaggttcatccaaggacacgaagcagttgtaggcaaaggatagagaggatttttctagtgagaagcagtgtctacggaaagcttagtttaattctaacgtggtactttaggcactagctagttcgctgctaccagatgtcgctctactccgtacccggacagggaggacttaaagtgattctgagggctgttaccacctctacatccacctctaatgtactgtggggtacgtagcaaccactgaaaattaactacctaaacaccacgtttaagcaattaataactactctagtgtttataacttactaaagcaataactatattttaatggactatagtgaacaatgatcccatatgctgttaggaactaaccaagaataattctcacaaagtaaattgtaattaatcggaaagatatttctattgaactagagtaattaacaaggtacaaaaataaggataggattaccgacaactcctgaattcctctggcttcttctaccttactctctccccattctagtatacaataaagtacaatagagtctcttataattctgctcaagcttggagtgtgtgtgtgtaaagtgaaggagttaggtccttaaataggttggtatgatggttatagatatgcgaaatgtccaaaattccccgcaaccgccatcaagagagcatctggagcgtccatgccaaaccccagaaccaatggtggagatcagggttcggggcttggcccaactagcccaggatttggcctgggcctcctcctcagcttcctttatacatttctctggtagttgggctcaatttctggtgtttcgatggagtttaggagcccaactcttatgtggatataattccccttaattttagtctagatttcctcctaactttggcggtttattacctgcatctaaatatacaccaacactcgtggaatatgttagaattaagccctaccactatgttggatgttttattatctaagttttatgcaagtattggcggcataaaatcggcattcaacaggcgccaacaggaacctcgacatagatgcgggaggcaccatcttctcactttatatcaatgttgcccaagcgttgatcgagaagatggctgcccaccaaggttgaggcaaggagcataatagtactagccctaggccaccaccgctgccatcttggtcgccatggtggtcgtcggtgggcgatggtaggttagttggttggtatggtttgaatcttgactcatttcgcaatggctgtcaggtgggctagaagcctagaattgagtgacaagatatttatgtatatgttgtcaatgttagaaagtatgacgctcatctagaaaacattttttaaagtaccattacctccatcataaaataaaaaaagaacttctaggattggacacgggtactgaggaagtaaggatattaattgagtgaatgttgaggttagatgagaaaagaaagtaggtgaagaatttgaatgtcagaactttgaatctgtatgttaaattgcaacttattttcattcatttgtatccatttttactgttaacatgtcacgaactccctatgttaacaaatataaacactctaaggatttaaaattaatttgtttcaaaatattaggattcttatagtactggtattttttttacttaaagtattgccagggctttgcctcgcagtgtaattttcatttaaaacaaaaatatttacaaattacaaggaagaaagaatagaaaaacattaggaattacaaaagttataaccgataaaaaaactatatgttttaaagggtccattctgcacatatgcagaagaacttctttcttgaacaggattctccatgatccaaaggaaggttgctcatttcgaaaatttttcccattcctttgcttccagatatgctaggcagcaacaaagaaaaatttcatgaaacctttttgcctaaactgcaggcgtgccgatacaatcatttgaaaaaaagttgagattggatcccacagaatgcccaaatactgctaacttctctgactgaatggacaaaagaggaaaacatgctctcttgtttccctaagattattaacacgaagttcacaagtgaagtcatcgttctcctttgtatagtgatgacgatcaagcatatctctggtgttcaatctatcattgaaaagaagccagacaaagactttttatcttcaaaacacatcgtattttccatatccaaacaaaaggtctaggtgtttgcacagtcatgaaagtgagcttgtaaaacttattagcagtgtatctatcagaattccatagaaaactccagtcatctcccttgctatcttgtaaattaagaaaggaaatctcttcctccaaattgagaaattcttcataagattgacttcttaaagccaaagggaaacaatcttccaaaggatgagaggacagctgctgcacggactactttttatccaaggccacactaaacagatttgagaaagtcaaacacctaacctcttcattccaaggatcatcccagaaaagagctgaagaacctgttctgacagtacatcttgaaattcctctgaaaatgtctgacaaagcaataatatctcgccaccagaaagagcctttattccaaatcatatgaggcaccttaatgccatagtaagaattccagattaattgaacccaaggcagatcttctcctttgtaaaacttcacaagatgcttcagtaaaagagctgtgttctgaactctcaaattaataattcccaaacctcctttcacctttggtctacacaccatttcccatgaagcaagggattttctagatgagcttgggttgtttcccctccatagacaatttttccttgcagtatcaatagctttggctacagaaacagacaactgtagggaacacatgtaataagttgggattgaagataagacatagataattaaagtgagcattccaccctgtggcaaaaaaaagagaactagctatcaatcttctctcaactctgtcgaccaaaggagcaaagtccacaactcttggcctagttgttcccatgggcaaacccaagtgggtgaaaggcattgtaccaatagagcacccaagtaagccaacaaagagcttagcattctcttgggggagattgattggatataagctcgaattatgataatgatagttcaccttgagtccaattgactgagcaaaagagttaagcaaagctttgaaacaaaatacttccctctaagatgctttaagaagaaccaaagtatcatcagcatactgaatcacaggaaaacccttgccatcttgttcattaattggtttggacagcagacgcagagaaaaggctctgttgataactctttgcaacagcttagcaccaagaacaaaaagcaagggggaaagggggtccccctgtctaactcctctcctacatttgaaagaatttccaggaacaccattgagcagaacagaagtatgagatggagaaaacaccatctgaacccattgcaaccacttgttattgaaacccatgctttgcatgatagaaaggagcacagagtgctcaatagaatcaaaggccttttcaaaatcaagcttcagcaggattatctccctcttggattgatgacactgatgaatatattcaaaagaccatgctaagcaatcttgtattgttttgcctctaataaaaccatattggttttcatgaacaagcttgagcataataccctggagacgatttgccatcaatttaattaaaattttcaaactgacccccaccagagagataggcctaaagtcattcacagtttctggaaggattttcttaggcactaaagtaatgtaagagctgttaagaggctgcaaatcagtagaaaaaagcatggaaatgggctgccagcctgtagaaatcttgagaaatgataggctaatatttctttagaaagaacccattaaacccatctgaaccaggggccttctctaggggaattatcttaattaagttgtcaacctcttgggtagagaactgatctaccagacaatccaaattaattggataagggattaaaggccattgagggagaagaagagatccccattctgttcttaaagctttggaagaaaagacttgccttttggtcatgcaaagaaaccacttgaccagattgatcataaatctgagagatggaattcaatctaaatctttttgtggcaatagactggaagaatttagtgttctcctctcctaacaacatccatctgtttgtacatctttttttttccagtatagcttcttgaattctagaagctttatcgtctgcaacttgataatctctttgaaattccattaatatatacccaagggcctttgttcctctatcaagtccaaaaagttcaacacattattacagttaactagaagagtagttaactttgacaaatttttactccacttcaacagacttttccttaaaaattttagcttaaaactgatgcacttagctggattatcaaaaccaggatccacagacaaaaccctgctgacaagatcagaaaatccctccatttcaaccccaatgttttcaaatctaaagattgggtactttggaattcttgtatcaattttaacagcatagggaacatggtcagaaatatttcaagcaagaggaagcacagtatttgtctcaccaatcactctcccatcaccaaccgtataaccctcatttaatgtggagcatcaacattttttttttcattttccttagtctctccgaaaagtatctagaaatactttttatatttgtggatgaaggaactattgtattatattgttttattcaacatggacagatttcccattttctccccagacaagctataagtaaagaaaagattgttggcttcggttgacaaaaaaaataaacaatgcaacggaaaatgattttagggtaggattttgtatattcattttcttagtggtaaaaaaaccaaggctgaagaaaagagaaaatgatgaaaaatagtctagaatcatttaaaattaagtttggatttaaattttaattagttacggcaacaagctccaagcgatgagagcacatcttttttcttcctcatgtgctcttaggatagatcttttgattgcttgaacgacaagatttcccagcgcagttagttaaaattggatttgttataaaactcttagatcctatttacatttatggaattatattttgtaacaataaatattaaaaataggattggatttcatatacaaaccattttcttctgtttctataggtagtattaaaactacaactattgcaattaagctacaccattataatttgatatcaccacgatctaagtgttttttctaattaatatgttcatttctaggccttcatatatagtacgtgaatatgatggcttttcgagctcttgcagatagattatatgggcagccagagagatccataggtgtagactcacttttaagttgtacacgggccaaaatagtctaggttggcctaggccttataggactggatccaacaccgtacgcactctccctttttgcaagaactgacatgatacatgggctgtaaaccaaacttttttaaaaaaactaaaaacaacggcggaacctaacggcgaacatcaatgtcgagatgctgaaaaggcagcacaaagctttgactttgacttcacgaggcacgtgtcatcgttgcggagcttgccgcccagcgacccagcagcttcgactccaaggcgatcccgccattggtgtcaaaggcacgtggagtcgttttgccgtgaaccatggttcacggcgatcccgccatcgttttgtctgcccatgtacgccgtcctcctcgcacgtcgccacatccgccgcctcttccgcgctcctcgttgggcgctgcgcctccttcccgtcaccaccgggtgaggcgcctgatccagccatgcggggaccggatccagtcctaccgctcgagcagcagcaaggtggagggaaggagaggaagagtttggcagcggcgtgcttgcttgatcgccgcccgtgccgccctggggctgagcggaacgagggccctctgttcggagacctcagagctgaagctagcaaactataacaatactttgagatgggtatcgttagaagttctcaaattctattagtctttgatatcagcctcaaggcatcaaggatttgcaggggtatctcaggagcagcgaggcatgctgccaaggctcctggctggcctatggcgagagccgagagggggccttttcttcaggtgttgtgggttcacacgagagagatatatatagaaacatgccgtcatgttttttttttaacgactcgcactagacggtgtgaaattctattgatagagcagaaaaaaattacaagattacaaccttgcaaggtcgtaaccagaaaaaaagaaaattataccaccacccacacaccgacagcgccaacacacagatccaggagaaggctaacaccggatcggccgccgctaagcgtgaccgaccgccgctaggccaacaacagaacactgccgagatcacccaaaatccgacccatacaatcaacacaaagccaactctatccaagacttcaggattcagggagagagggtgagagagaagatggaacttgtagaaactaggacgccgccacaagaggatgagaatctagagtgtgcttgcaccaattgctcggggggtttcggcaaggggatgcctagacgacgtctccaacgagagaagcgacggaacaccaccaccgccatccgtcaaggtctcaaagagaaccaagactaagctttcactcggcagccatccttgaggggcgagacggcacgacaacgccctcaggaggggaatgacactcgaacgtcatcgttgcctgtccggccaaggccgggctgggttttcacccgccgtccaccacctgtcgatctaccacacatgtaccattgctccaccgccatccaaaacctccgccggagcgtgggcaccactgcaccggcgccccccaccggccagtctccgcgcgctgccaccggtcgtgcctcaccgggccactggcctctcctcccgccgcatcggccactgcctccacgccgggcagcctcgtcgcgtcgcaccggcacctcgaccgcacctccacgcaccagggccgcctccgccgccacctgccgagcctcactggcctctgctctcgccagtcgcacctcgtgcacgtgctgccagccagccgacgctcctcctcccgccagcgccgcaccagccatgtggatgtcatctatttgaacattatattacgggtctagattaaggcgtagcctcattattctccttaatggtgatggtgattgataaatctatcgtcacccatatcacgagaacgtgggttactagacagtgagatactccctacgtaataattataagtaagtcgtttgggataatatttaagtcaaatattagaaatataaatcatgaatatttctcaagttgttgagtttgaaaatataaaagttatatgaatagatttgttttgaaaaatactttcataaaagtatacatatatccatttttaataaatatttttatataaacaagaagttaaaattgtattttagagaccatgtcgctatacaaaacaacttcctttacgagtatagagtgagtacgtggacttttgactgttccctgatcctaagttataaaacaagaaaattttattttaacgtgggtataaaatgatgacagctatgacataaagatatttttatggcgattattttattttatttttttgagactttaaagtgtacaattggattctatttttggaattgctcgacaattgtgacaattttttcgcaaaaaaaaactttcacatttctagccattggatctcctcgagattcatgcaaactttctcatttctaataaccattggatctcctcaagattcgtgcagagctgcaaaaaattcagtcgcgcgcatgagtcagagtggagtcgaacccacatcctgttgaacacatgcttgcttgatttgttaaccatctcacctcacacatttttcatctagttacattaagtaagctatagtgtagtcataatataattgcacttaattatactaaagttatttttcaaagttttcatcaaaataccgtcgaatgttctatatagctgctcccttctaattgtttttttttcgaaaattctcattgcaaagtaggggtattgagctagtttaccaaaggtataaaatgatcgtagtagatggccacccaggggcatgcaaggagtactcctttcatcctataaaatgacaagctattatctctattcagatttatagtattaacatatgttatatttagtattaggttggttttttaataaaatgtggaattaggatacttcttaaactactgctacgtggcaattgggaggaaacctttttttgggggcatggtgagtccaaggctaaacacctccggtcaaagcagagagcacacacacatgcattataggccagaacctagctagatagagtacgtagagagagaaagtatggctgtgtgtttagttaagcgcaaagtttgaattttgattgaaattggagatgatgtggctaaaaagttatgtatatgacagattgatgtgataaaaaatgactgaagtttggatcttaaacactaaacacagcctatgtgtcgtctcacatagagagagctggcatggcaatggcacaagtgccaggccagctgcgtggtggggcccgtggtccatgcagggagggagctaggtaggtagccagcgtgattcgattcctacaactatacagggctcgcgagagacagccgggacgacagtgaaagaagcttaataagctggacatgcaaacagtgcaggccgggccttagttcagctcatcaaggccctgaatcataaggccatgatgccatattgcccccccccccacccccccaccactttccatgtttagctggatgcttgcgtaccatatgccatgccatgccatttcacaagcacaagcaactgcatgctaactgctgtaaaattgagatcaatataattaagcttattcctgtaaaattgagttcgtgccaaattcatatggttgacttagcgctgcactactgaccattcagcccgggtcctacttggggagctttcggtagtagttcctcacagaataaaaactcctccaacaattcggtttttcttttagattctgagaagctgtagttgtagaaataaaaaaaaactactacttccgttttaggttataagactttctactattgctcatattcgtatagatgttaatgaatttagacacatatttttttttatatctagattcattaacatttatatgaatatgggtaatgctagaaagtcatataacctgaaacggaggtagtagaagtcaggaactggttgttccagtttcttcagattcttgctaaccggatatattactaccagctgcttatcagaaactaaagctcagatccccaaatagaccatatgcgttgcatgcgcacatgtatactctgataaaagcatgtacatacatttgatggcagatgaagcggcagcccaatgtgcatgcacagtatatatgcatcaggctgttcaatctttcactgtaggtaacgtacgtacgtgatctatatatcgtgtccggccggctcagcatgcatgcagggctgggccggacggcaaccaaacacaagaccaacctagctagctagctgctagtctatcatctactccctccatcccacaaaaaaaagacaaacctgagtttttgtgtttaattctgactgtccgtcttatatgaaattttttcataattcgtattttcattgttgttagatgataaaacatgattaatattttatgcgtgacttgtctttttaatttttttcataatttttttaaataagatgaacggtcaaatgttgagcacggaaacaaggtttttttttttttgacagatggagtacttcacattcgtggttaatttgctgcaatatataatgtgtgggccttaatttgcttgaaatctcgatcgattgatagatcatagatctgcaaacattaattgtttgttagggcctagctagcgaccgactttcccatgcagagcttgcaacaactcatcacacatctcatgcacaaacaaaatgtacgtacgtccatgcaagctattctctctccatcttaaaatataagcatttttagaatagtatcaagttaaacatttttaattttgatattaatagtaaaaaaataaaaaagatcaatcatttaaaattaatgttactaaatttatcattaaacaaactatcataatatgtaattctttttatttaaaatgtcttattttttatagatattgttagtcaaagtagcatatcaaaaactatgtcaaaatttaaaaatacttatattttgatacggagggagtagctagctgtccaaggtgtgttgttggctggacacctctctaattaacatgctaacatgtacacttgtagggcacagtttgagtcaatgatcaagagggaaaaagtgtgtgtggcactgtatttgcataggaggatctataaaataaatatatataattgggatcactgatgaaatttggaggtgataatcgatttgggacaattcgggtgaaagtgcattaatcctcctagtgggttttggtgattaatgacaaatgtggttaagtgactaatgagttcattaagtaactttcaggtgcattagtccaatgtgtgaaagatggatgcttggagaccccccccccccaaaaaagtacaaaatcaaagcggaccggaacttgagaagtgcataggatagtttatctattgaaatcaagtttttaggaaaaaccatactattaagaggggttctaggtgatgctctgatatatgtcaagtgctcttagtataaaccaagtgtcaagtttccctaagagtaatttttgcaaatactccatatgtccaaaagtgcaagtccggaacttcctgtcttccaggtccgaaagttccggtcttgtgaaaaatattttcctaagtgtagtccggaagttcctgtcttccagatccggaacttcctgtctagtttccagtttaaaattgtgagtaacggctagatgacgtcacctagccgttatacatatacagctcgtttccagcttgttctttggccattccactttcacttttcgaacctagagctgttgctagcctctcccaagtgtttattgccttctccgctcaatctagagcctaattcttgtgagaaagagagattgagagggagagaagaagatttggagaggtgtgaagactaggatcttgggtgagcacttggagtatctcgtgggctgtcatctcggtgcttattactcttggagatgatctcctagacggttagtgtcgcccgcgagaatccgttgcatattgtggatgtcccgggtaagtttgtgaaggatctcctctcctccgaaagggaacaaggtaagttaatgaagttcttatgctgagattctagaggttttccaagtagagcaacctacacttgtgacgaatttctagaagtaggttgagttggatcttggtggtcactcaattctagaaatttgcctaggggtgtttgtggttgaaggctgtggatttcctctagggtttttgcacaagtaaggcaaggggttaattgagacctagctctttggagctcctcaacagagagtaggatcgcaagatccaaacttcaggaaaaaaaccgctcttgtctctttctgtgatgtttctatggatgattctgtgatatatctcctgcttagaatacctgtgcatcatcttgagacgattggcttagtctcctgtttcgaaatttgaatttcatctttcatctgtaacccggaagttcctgtcctaagaacaccagaagttccgggcctggcaggccggaagtttcggagttccttaccaggaagttccgggtctgtttgaattttaccgctgtgatttgtttataagtttttagggacagcctattcacccccccccctctaggcttcatcagtgcgttcatcggggatgattgatttgagatctgtggacgggaatggagtgaaatcaatatattacaaacaatgaagaaaagaaaaaaaaataaaggagcaaccggatctagcccggctccatctttagtcctaaaaagggcttcatctttagtcccggttggtaacgtcaaccgggactaaagatagatttttactcctgattatttcacccgggactaaagatagcgatttttagtctcggattcgtagtcagggtgttactaaccgagagtaaaaaaccacttctccaccggtgaaatatatgatggtgtcaatgcctgatcacaagagaaatttcttcattctgtaccgtacttttagggtgattggtagagagtcagtcattagttcgttcatctgactccgaatgcatacatgcatgcaggatccactatgtatatatatttgtttcaattaacgaataacaactagtaatttattactccctcccgtcactattatttatcatttccaacaatgaaatgatgccaagtgtaagttcgttttgctgtctgaaacgtcatttatttccgtccgaagggagtagtacatgcatgtttgatataaatgccacgtgctaaactgctaaggcctttcacagtgccacgatgtggtgagttacctcgttgctgaacaccgaccgacgtggaggagaaaggaggtgggtcccgtgccttgcaaggttttgcccctcatatagctagggtctgggtttctcacgcccgaaaaagaaagtgcgatgcggtcccctctctgctgctcctccgaaatcctccccattcttccccccaacccgcgcttccaggccaagatccgagtgggcttggagctcgccggtgacactgccgagtgccgacgagaaatgggacattacaaaaaaaatcaaatagatgtcgtcactataggtgccggtagtgctaaaaccggcatctataggctttttcccacctttgtaggttgaaatcgcaaaaaaaaaggcacctttaagtaattataggtgtcggttctaaaataaaaatcagcatctattatactttgtgtcggttttctaaaaaacagcacatttaatatattataggtgtcgattaattaaaaactgacacctataatatattataggtgctgttttttttaaaaaaaaccaacacctatgtaaatcgagccgagctggccggcatcggatgagccgaccggtgcgccccaccacgacgagacgagcattggataaggttcgatcgtctcgctctctcccttctctctcgtcacgctctcttcttctcgtctcgctctcttctctctcccccgcactgctagcgactagctggcggaggcggtagcggcgaccgcgccctcccctccgccagatccggcgggaggggaggcggcggcggcggcggtagaaggggaggtggctgcggcggcaagtggcatggctcatgggcggcagcagcagcgacctcccctccgccagatccggcgggagaggaggcagcggcggcggtggagccctcccctccgccagatacggcggggggtaggcagcggcaacgacggcggcgggcccctcacaggcgacggtgagcacccccaaccgtctccttcgcttgcggctgcctgattcaaatgtttgattcagtgattcaatgatgtttgatgtgagatgaatattgccagatttgtttatgagatgaatgttgcatgattcaaatgtttgattcactgattcaaatgtgattcagtgatttattttgtgagatgaatgttgccaaaaaatttttgttgcggatgtgggaggggggactgctcggctcgatgcgtcggctcgatcgatggagccgatgcatcgagccggcttttttttattctacgaacctaaaagatgccggttctacacctttttgatttccaatcagtgccgcctcccttgtgccggttgggaaaaccggcacagaatacctattctgtagtagtgggagaagccgaaagatcagaaaaagcggagggaaaaagagatagataaccagcatactccatgcggcggcggccggagagctcgccggctacaactcggggggagcgccgcctctcgatctgcgctacccaaagctcgccgaccacgccgcccccgatctggcctaccggagctcaccggccacgccgccagattgatgaagagtgagctgataatggaatttttcttcgataaataggaaacttaagattaagatgctccggaatggaaatgaggtgcttcgacctctctttctacggttggtttctgacatcaatcttgatctatttcacaacaagtgaagtgggagattgacggttggtttacagactgcaatcagctcgggagaaaaagaaagaagtatctagctaaacttctatctgagcctttacgagcaggatccggagtgggttgcgttcattcagcaggagctgaatcacaacacccctctggagccatctgtcaatcaggcccctgctacttcggagccgtctgtcaatcaggcccttccttctgtcaaacaggcctttgtcttgctaaacacaaatccttcttttcttgtatagacgaaatacaaataagaactaagtagagtcccagagctttttctggtccatatgcagcctgaactgtgctgctctagctaattgcccaccccttccacgtgtgatttctatgttatgtatggccgtgcctaagggcatatcggttgaagtagattcttcttttctctcaaaaaaacccccctatccggacgccattgatataccaattccattgtataccatcaaaattgttagggactggcgccatttgttagacacggtaaaatgacaaatgctcccctagttaccataaaactaatgctacctatagctccatggcacaataaaaggtttcccttttgttttaattacacaaatgattgtgcaattgaaaaattcctcagtttcatgtgcacaatttaaaatccttccttgcatattggcatcgaggaaaaactcacttccatggtcatttatgggaagaaaaatagttacactcaatgctataaaattacatttgccgttgtcattgttgaatttagcatataatgatttaacttattccataaataaattatgacactgcatatgtaaactagcataatcgcataataagatctacacatgtaaactagacagtaaagcatgaacatatcaaatatgcgcaacatgtcgaacacgtaccgagggttttagaaaactggttgctcgtggtactgtgcattgacgatggcgtgcagcacgtgagcgaagaggaagacgagccgttgtggacgaacagggagcagtcgcataaagcgtttcccaaaaaccttattgccaccttctcccggtgtaagacgtcgaagacgaaggtttcggagacctgctcccccgatcaccggtgtatgccaacgagcgggatagagtaggactacgagcggtgggcatctgtgcaaggatcaccggtgtatgctgacgagcgggatagagttggactacgagcaacggatcaccggtgtatgccgacgagcgggatagagttggactacgagcgacgggcatctgtgcaagggtgaggaaccaatttcggggaccattcgacgtcgtcgtgcacacgcgccgccatgccatgccatgtgaggcgagcgagcgcgcgtgtattcccccctaatctctccacctcacatgtctcgagcggctatgagagtatcctcccttataaggaggtctccctctcatagaatacgcaaagtggtactaagctcttcatccatattatcccatgaggtgagcttttatgattttttaaagaattaattttcgaatgggctaaggcccatctattaatttcaacaatccctcaccaaatttcaaaatttcactgaaatttgcctttttttttcaatgtattgtttatataccagtggtttgatggagaacaattagggttgaacatctacctagaactcaaaactaaacttactcacaacttgaacaattaatggactacgctttgaattgcaagtcttgtacaagccagtttcactcagagtgttatctggtaatagaccgtcagtagactactcttcgggtgaaacatataagtcgtactccttgatctcttaataagcttcctagaagattcacccaaaatgaatctcttatatttatatcaactttttcctgggaaatctaaaatgaatcatgttttggttcgtctgctaggtggatccatgaggcatatatatatagcttcgattgtgaatatctatcatttgatggcccagctatatgccagcttaattggcaaacattttgtttctagctttacacatggactgcatgccaactatgcatgccaagtggctcagtcgtcgttgttcagtataattagtcaggattattcctttggtccatccatgcataatataaggtatttgttctatttaagctgtttgttctacgatgttaattgaatgaaaggatttaagattagtaaaattataatatgggtccttgatttttctgtactagatcttaggtatttgcatacatagataatgaaaacgagaatccttcgcctcaggcgaccggcggctccccccccccaaccgcgcacgtgaccccctgggccccaccatgtgtcctgccctcacctaccacgtgtctcaaaaaaatgtttcacctagtgtacttataatatttcactatgtatagatctaatgttgcagtgaattgaaacattcttttgtaacaaatcacccacatattttggaaaccctctattaaggaatttcgtttcattttttgtttcacaaaaaaaatgtttcacctagtgtactcataatgtttcactatgtatagatctaatgttacagtaaattgaaatattcttttgcaacaaatcacccacattttggaaaccccctattaagggaattcgttttattttttgttccaccaaaaatgtttcacctagtgtaattataatgtttcactatgtatggatcaaatgttacagtgaactgaagcattctttcgctatttgctgaaacattatttttatataaggtaaaacaacgcccgatttaaacgattgaaacattttcaatctacttggtgaaacaattctgatatacttggtggaacatcgtgcaacattttaaaaaaattcaataataagctaaaaaaatttcatcggaatatatccatgtgtgatcttgttttaaagatttaattgcaacgaatttaatggtgcaatcgaatcatgatttggataaataatttaaaagaaaaaatagtttaaagtggttttgcacgcatacatcatgctgacattagcgcctgattttccctctccccgtcgagcgtcccatcctgagttgtgtcctaattaaaactctctagttctttaaaatattatactctgcatgtgaatatatatggcaatatgttttgggtatattaatagagtttctgaacatttatttcaaacatactgctcaatttgtaccatacttagctatgggtccacaaaacccaacccaaggactactatacactcacccaacccaaggagcaagtagccgatcctcacaatttggagtctcggaacgaaacaaaaataaagacctttagttaaatgtatgagaattttttaaaatttacagcatatgaaatattaaacaatatagtttacaagaattagctagacttttatgtacaattagccacattatttatttttgaagtacttgttaacacccaacagacaccaagaacgaaaatagaaaaatatagccaaatttggaaatgtcacggtttccttcacggggccggtctaaccgccggcatagtgttggtcataccggcagcatatggtcggttagaccggctgagtccgactccgagttcaattttatcgggtcttaggtttccttacttggtaaggtattattcgagttctaattagtctatcccccgagtaagacatggagaggatcatgtagaaggcaagaccgatctctttataagggctatggccaattcaattcaaacctaccctatcgaatcattcttttacattacttactttcagtcatgtcttttactttatcctagtttcatctatttttctcgattttcatcataaatcgcctgccttcgctacgagagtacgataacctttgtaggtttgtctcgtaaaccttccgattcacccatgagatgggtgattaactccatattgacctaaatcaacctagagaccggtttacatctctaaatcggctccggtagcaggtttaatcttcaaaacccatcttgctttagagttttctatcaagatggttggcgactccattaatgcctcaaatatttagatgagtccgtgttgatcagaaaaagcacctgcagtactatcgtataattatttctagagtgaattgtacattggaccacctattttgacctaagttgcatatctttctgttcaagcaagtacacatacattatctttatctttgattaatctacaatatacatataaattatcattttcaatgaaattcgatgcatataggaaatacatgataaaaacagtatgataacatgacatcatacttcatccacacaccacactgcagattaatttactgaaaaaagtggataaacttttggataaaagtggcacgcttttcaaactgctaaacggtgcatttcgtgcgaaaactttctatatgaaagttgttctaaaatatcatattaatccatttttcaagtttgtaataattaaaactcaattaatcacacgttattacctccttattttgcgtgaaatatttaatctttatattcatctttatgttaaggagatttaaacaccacctaaatgtaccatggtccctctaattttaatgctctgaaaagtataactcaaatttgtgcattcctatgtgatatacattccctaggtccatactccatccacgccacactgctgtgtgtactgtccactgcctacctaccctgtaccagtacatggaccatagctaggacagtatcacagacggtacaactgttttttcatggtgtccgtatgcccttgtccgtttacatacatgcttgtattcatcagggagaaaaaaaagatagaaatacggctaaaagaattgaaacaagaaatccatagacgagaggaatttgaaagagagaatctctgccagggcccacacatggacaaccctccaaagcccctggtctgacatgtacaaatccctggacggccttggggggccacagagagagagagagagagagtgcatatgactgatctgttgagctggagttgcttccaactttgagaattgagattgaaccagtgtgtgtgagagagaggaagaactagtaagtacagattttaatgcggactcttgaaaatatactggctttaactttatctcactggtaaataaaaggatccacacactaacactaactatctataaggtggagttttcacacttggttaattatgtaaaaaaaagctaatattatgatagcaacaaccagtagtccaccaccgtaataataaaaatgctatccattaagcggagtcgtcctccttccctccccttctctcacacacgtggcacgtcatacgctccgtgcacgtgagtaactaccgtatccaatattatattcttaatcatctttctagtctatctctaattatataaacttgacctattaaaaagtacagatatattattagttttaaaatagcaccgtcactactaagaattcaccaataatttacggtttcatccaagagaatgatcctatttttataatgtactatttctagaatgaatagtcaattagatagttgacagtgtaatgtagcacactaggttataagtcatacggtttattagtgattaaaaatattataaaagtaaaacttttatatctatgttgttattgatttaaaaaccaatgctataaaataaatttacatgaaaaaaaacatgaaaatcaagttatagaatttatatttcggcagctgcttgtaagttgtagagcaaaaaaaaattccctcgtatgatttcaatcctttatattttcttcatttttcctttgctacaaagaagctataattaccattacaaggtactaagagcataatgagatagatatcttcagtgcatgtagggatgtaagtgggccgatccgcaaatctacgtatatagaggtcaaataaatgggtaatccacgggtttctgcgtcatggttcaactttaccgtacataaggatgcaagtgggtcgatctgtgaactcacttatagatcaaattattaaaagaacgcgaatattagagaatagcctaacatcaaataattagaaggggtgaggctttgaactcagatcggctagcccaccaccttatgaaactagccgaaagacccctagacgtttctcgtagatcaaattattagataaccagatgacaaatgacaaatccattagttaccccctacttttatctatatataagttcgcggatcgacctaactgcatccctaactgcgcgcatgcatatccctcgatctcagctcgatcgatcgatcaaactggctcttagacagcatccaatgtacgcgtagtttcgccgtaccgcaggtagataggtactgtagtaggtacgacgcgcggggctcgcgcgatcgaacaccacgtcgtcgccatcgatcgctgtccacccagctagctagctcagctcgaccgctgcccacggaggaagaatcgaacgcggccggggggcgccttggctggatcacgcgagaacaagagagcgagcgtcgtcgcagcacgtacgtcgcgtgtcgcgtccgcgtgcatgcaactgcgcgacgtacgtaccgcgggggccggggaaacgatggacggagttagttagttgaaattcccctgatggtcatcaatcacatcgatcgacatcgtccaggttgggatcatggcgttgcctgcgtatacgtacttgcctccccagaccacgcaattccttaactgcaaagtactgatcacaccctcctgctgccaacctgcatgccattgctagctagtagcagatgcaaggttggaattaattgaccttacacacgttagagcatctgcgagatggcctctcaaatgacccttgctaagccaaattttggtaattttagaaaattaaaaaattcgtactccaacaacctctctaattggattggatagctaaaccatccgactgcccaaatctctcacctcattggccaaacttgtctatccaaaatcacttacggatagtgagccccacgtactattccttctccccatatggccactccactccactccactcttaattctctctcgtgctgcagcgtctgctataccattaaaaatcgttggagtgaatgttaaatttggctcttgtaaattttttttgacaagctaataaccaaataaacattcgaagtagagccgataatagcaaactctgttggagatgctcctagcaaataatcattgtcaacccggctggtcgtcggtgaaatatttaaccgatccatctaacttggccagccggcagtccggcacatgcaagcattatgcatatacgtacgatatgtgtacgtggtgcttaagtgcttaactaattccagatagatcatcgatatatacatatattctgatgatgaagaagaagaaagaaactactttttgcccggccggcccctcctcgcaccctgattcaaacagtgtataccaattatattggcgcgcgtgatatcgagatcgatcgatatgatatacatgtagggctaagctagtactccctccgtttcatatcacaatattttctagcattgcccatattcatatagatgttaatatatttctagatttatatatatatatatatttggacaatgctagaaaatcttataatataaaacggatgaagtagcatatgcatatattccctccgtcgcaaaatataacaacttttagcttaaaatttgtcccaaaatataataacttcttcgcccacattttttttctcaaccaattacaagcctccaccattcaattttcccacctaccttcacttctactccaatcacaacactctcccatttaatcatacctactttcttaataaccgtgttcaactctaaaaatacttatattctagaatagagggagtatatgcggccccagataaatgggagatggatcgatcggtgttggtgtacatgcatgttactattgctagccactgtgtgtccggtctgcgtgatgcatggatggatgcaaagcgcagaagagaggcagagagagagagggggggtcatggatgcatggaaaatggatgggggatatatatgctatgccccatccccatcatgctgccctcccctgtgagacacagtgccctcttgtctccccgtgacacatatattcgtcgccgctaaagcatgaactgctgaagctaagctatagcccctcatgcatctgagcgaccttcaccaacctcatacccatccatccatgcattgtacgtaatgtccggccatggcgagagatcagtgtagtcagtcatgagtcagtcgtagctgatcactagctcgagtgagtcgcgtcttcgcacgccaagctgccaacccatgatgcacccctagctacaatcgccctggcccctgtccatgcatgcatgtactctcctatagtatattggaggtacatggaaactgctgttagatggacaaaattttagggcatttttgaataacatgagtggaaaaatgaggaatagaaaaaagaaacatatgattctgacaggaatgcaagtgtaaaacagatgattagaaaatacagggaaaacaaatgaatgaccgtttgatttgatagcaggaaaaacgtagaaatcagagatagactcaaaggaattttttaagaggttgaacctcttgctaactttcctccaaaatctctataggatttaggatttctcattcctactaattttaaaagataagatatgattcaatcctatcatcctatgtaaatccttcaaatttcctacacttttcctacaaattcaaaggggctgctaatagacatgcaaattaaggagatttaggttcaattaattgtttgttttctgccatccagcaaatattttatctctagagttgaataatatacaaatggttttggtcaactgtagcttaggggccgggggtgcaagcccacattgtcgcccgttgggatcgtcactctgcgccacgcctaaccgtacagaaaccttatagctaagataataatttctattctggataagataataatttctattctggatatagacctactctaaaattaagtgatttttaaattagcagttatgtttatgcatgtgtcacgctttgaggatggtctatgtcactaccgaattatagacctacctataattcggtagttcaatcatcaccgttggctcattatcactgtcaaatcgtgataagaactgtcagtgatactcaacataccagacaatatatatacctccaaatcctatatcatgtacagtaaaacaatttaatcgaattcacactaagtcattccaaaaaaaaaatacaaataagtgactatatattaaatttgttgctggaaggcatgctgactatatatagatcgcgattaaggaggagtatatggaagacgctgtagagagggaggagaagcaaggagagggttttgtgggggtatgggaattggcggcaaagatgtgtcaaagatagggatggcaaaggcgtggggcatgggcgggttggacaaggatgtccccgcccccgctccccgcgttctcccccccccctcccaactaccaaagaacatgtgaaaagtgtgggtttttccaaccggcactatgaaggcggcaccgatgagtgctccggcaccaatcccattttaaaaaccagcacctttgagaccactcgcgagccaaaaaaagctcgacatcgagctcatccaccccacatcatagaactccaaatcaatcacaatccccaatccccaatcaaccaacatcacagaacaagaaacactgaagaacatcacagaaatcattcactaatagggagggctccaccactgcctctcgtcccgccgccgggctgccaccacctccccacccgccgcctgccctccttccagatctgatggaggtagggcgccaccgcctctcgtcccgccgccgcgtcgcccctcccttccgctgccgcatgccgccgctaggccgcccctccacggccgccgctgggccgcccctccctagatttggcggagaggagggcgcggccgccaccgcagcctccgccggccacgggcaacgagagagagtcaagaggggagggtgctgccgccaggccgccagcgcctctcgtcccgccgccgcatcccccctcccttccactgccgcatgccgcctcccgccgatgacgccgctgggccacccctccccagatctggcggatgggatggcgggggctgccccgccgcctttgccggccgcgagcagtgagagagagtcgagagacgaggaagagagagacgcaagagatggaagtctgtggatgccttatctcgtcgactcattcggctcggctcaatcgccctataggtgccggtttttaatattaaaggttttgatttttttgaaaaaaaccgacacctataattgcttaaaggtgccggttttttgcgatttcaaccagcggaagtgtggaaaggcctatagatgccgattttagcacttccggcacctatagtgctgacacctatttgatgttttgtagtagtgcccggctccggccttagccccgtagagtcatccaaatggaaaacggggacccggcaggtgagcgaggcctcgcatcgggcggcaacatggagaacatggtgacatcattggatggcaacaagcacttgtttgcatggctggttgtcgacgaagggatggaggcacgcccggcaacccttccttggctgggaacgaagcaagtgacgggaaaaaggagaggacatgcggagacatccagcaaggggaacaagaagtcgatgacctggcatggagggatggaggccggaggagaggacagtagacgacgaggagggagagcgcttctcgctccaacggtgtgaccgcttctcactccaccgcttttggctcatgaatctgatgatgacttgcggcacatgtgttggggagaaatttcgggataggataaggggagagttccttcttaagcctgatgggccttattttcataacgggttatcactattgttgaatagtcccacattgcttgtggaagggcaaaggatctaagatataagtaggggagcccctcacctcataatctagctttttggggtgggaaaggccctttacgatcctataattggtatcagagcctggctagttcaacatttctggcccgagggacaaagtgtgtaaaggcctgatgaaccgtgggtgcctgcggggcccgtatacctgagggaccatggggaaatggtgaaggggcggtgaacggctaagggacaccaatgtgtgaagggggagattattgagtagtcccacattagttgaggaagggcaaaggacgtaaaatataagtgggggagcccctcacctgataggctagcttttggggtgggaaaggccctttatgatcctacaactatattttcactctataatgtaatcctaaggccccgcgggtggagatgtttccctgcccccggctccgcatgatgtcggggccctgcccccgtatcacctgcgagtagcatttcgcccccgtccctggccccgtaggggcgggtacccgcgccccccacccccaaacggggaaattgccacccctagtcaaagaggagagctaacgactattgacggtcataatagaccaatttcgactgtcaatacatccggaaataaaagagaattagcaatatttgtatgcatatttgtttaagaataatttatttccacttgtacttggcaacgtatttgtatataggcgatcttcatataaatggaggagaaacgatggaaaataatcgttcaaacaatcaaagctcgacgtgtggcagacttaatggatggatgggcccacaaacccattagaacacctgtaatttggcccaaccatcatgccactaagctaaggatccatcaagcgaagtccaggagaaaggatgtgccagcccaaggttcagccgaaaccgccaccagcgccgttcatcctggccttccacgtggacatcctaaattgcttcccaatgatgtttgcagggtgtttaggacattttcaactatcataaccatcattgagcctataaaaggatcactacatctccatttcaacacacaccaagaaggatcaatcaagaaactctctagttatttactttgttctaatgctagtggagtagaattagaatagttttcttagttcttcaagtcttctagagatttcaggtatcgctctactagctcctctctctctcttgtaagacttaattcaataatgaaatattcttctttatatagttttgttcctttacttcatttatataattattcgagtaccgactttagttcatacttgtctcgtaataattatgtagctagcttactagagatatgcaatggtattggtttggtaatcaattatttgattgttctatgtcatctgcagagatatagagtagtatgtagtaatgtaagcacaatgcttagattattagataccagtaaatggtgctatatgtacggatctatagaggtaggctgctgatggtgacatcttagtacatgtattcctccacgtgcgtatatagggctaagagattttcctagtgtgggtactcctccgtatctattaccaattggatggccatgacggataaggaactcggcaattaggcgtgatttctcgatattacaggagggcatagttaggggtattggctgcataattgtataatagaaagtgttaattaaaatgactatatactataagtacaggaattatgcttttctatttctttctccaattagcttagactattatttcagtgagagtattttggttaattctttttgtgtgtcaatcaacccttgtccttaaattgattaacccctgtattagattttgatcaacataagtgatataattgttattataatactctcttctcatatctttccttaggactaaataaaatacgatcccttggaaatacttccggatgaaatgctacagcagtatattcgagcgtttgcagattatgtctgtaactataaagaataataagtaatatttcgggcataattgtttggaattatatttctagtaattttttaagaaatattaagaacgacaaacaagaaactccttcacctgtgatttttgttgtgtgctgagctggagggaaatgatacttactaataagaaatcaacttattttaagatggaaggtgcatattaataccatgatcatatccacaaagaattgtgaactataatgaaaaaggaaggatctttcgatcttagcaattagattcacttgttaggtataggcctataatccaaaataaaaacagacaaacatgcccttagtatctcataatatctttgtgtttttttaaagaaagacacagacaagctggttttcttaaacaataagctgttgcttatgtgttctacccacgtgctcttaattatatggtgagcatggacactcttgattgtcttaggaggagtgttaaggctgtgtccgggaggtggaatttggaactccatctccccacactgaaaatgtggtggtttattaatgtataattaattaagtatcagctaaaaataacttaaaatagattaatataatttttgagacaaatttggtataaaactttttttaaaatgtaccgtttagtaatttgaaaagtgtgtacgtggaaaatgagaaagattagttgggaaatagaagaaaagaacttagagcaactccaacagtccccttatcccaatctccaagttaaattttagcaagtttgaagaaaaaaaaacactccaatagcttctctatttgactggccaagccatctagctggccaaaatggctccttggctggccaaacttggccagtttgcctgcctagccaaacttggttgctagctgtgggacccacgttgctccccacctcaatatctctttcccctctctttcaccgcacagatcgatcgtcgccgccatcatcgtcctacagcgccatcgtcatcctgcgatgtcgctggctcgcacctgcacagtcgtcgccgtctgatttcctccgtcgccgagggagctccgcgatgacgaggcaagagcgagggagggtgtgttggcgacggcgacgagggaggagcgatgatggggaagaagcggccggatccatcatcgctgtcgatggcctcctcctccggcaccactgtcgtcgtcgaggtcgccgtcaccatcccctctgcatccgtcgtcttgagggctccgctgtctcctaccccgccggattcggccggcggcgtgtaatcgccggggggtgggggtggggggcacgtgtggactccgctgcctcctcccctacgcggatggcggcgtggattcgccgggacgacgatgtgtggactctcgctgcctcctcccccgccggattcggccggcggcgtggattcgcgagggggggggacctctgccgtcgtctggccgccaacctccgcgcatccgccgtcggaccaccggccgctgaggttgccatcgccatctgccgcaccgtgctcgtcgagccattcaccgctgttgccatctagaaaaatggtgagaaaagagaaaggggaaaagtagggggtaggaatagcataggctgacatgtgggtcccatttgtcatagatttataatggagatggtagataaagagactgatggagcaagcaacgagtttaactagtcaaatcagatggagagttggctatatgggtatttggagagtgggatttggagaagctgttggagatgctcttagcctaattagcaatgctactaatgctatttaacactccctcccctctctatctccctctatcgctctctctcgtatggagtgttttggtgttgcatgctgtccctgctgtgcataggctttgttagctagcaaggcagctgcagttgtaggtggtgcagctcagctgggggctgggcatacagccccaaaacactgtccttggcccccctcctgcacagattcccccttctgccaaacccagcaaaaggttccct

SEQ ID NO: 2677 - DNA, 899 bp, Oryza sativa
tactcgggtacttttgcaattattaagagcagaaaataaattatcttatctctatgcttttgatttattccgaataatacttagcaccttgcgttactcggtccatccaacgagcccccgggtgctacgaatcggcctaaaggcaactatccattggcaaaccaaacggaaagcataggaagatggaactccataactcgataggcacttttgtactcagaatatgtcgcaagcaatcaagataaatattataaaaaatatgatataatatctgtagcccccgactcactactcaatggaggaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacggaggcaggccggcggtgaagtagtagacgcccaacagcggcggcataatagaccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataatagaccagccgtgtaggcggaggcaccactcggcggcgacggaggcaggccggcggtgaagtcgtagacgcccaacagcggcggcataatagaccagccgtgtaggcggaggcaccactcggcggcgacggaggcaggccggcggtgaagtcgtggacgcccaacagcggcggcataataggccagccgtgtatgcggaggcaccact

SEQ ID NO: 2678 - DNA, 611 bp, Oryza sativa
cggtgaagtcgtagacgcccaacagcggcggcataatagaccagccgtgtaggcggaggcaccactcggcggcgacggaggcaggccggcggtgaagtcgtagacgcccaacagcggcggcataatagaccagccgtgtaggcggaggcaccactcggcggcgacggaggcaggccggcggtgaagtcgtggacgcccaacagcggcggcataataggccagccgtgtaggcggaggcaccactcggcggcgacggaggcaggccggcggtgaagtcgtggacgcccaacagcggcggcataatagaccagccgtgtaggcagaggcaccaatcggcggcgacggaggcaggccggcggtgaagtcgtagacgcccaacagcggcggcataatagaccagccgtgtaggcggaggcaccactcggcggcgacggaggcaggccggcggtgaagaggatgtcgccatcagcaacggcgacggtgcacaccaaccgtggaggcgtgtaatccaatcggcagcgacgagggcggccggcggtacgtgcgttaaaacaatagatcaaataataattagtgatctgttaattaatctatttcacataagaaaattt

SEQ ID NO: 2679 - DNA, 26820 bp, Oryza sativa
  unsure (1)..(26820): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcaatcggattatacaggttcgggccgctatggagcgtaacaccctactcctgtgtttgggattatggatgagttttacaaagatttcttcactctaaaaagcgcactcgcttcctccctcctggagttttggttttttctccctctctcccctttttctttcttttttttcttgtctcagtgggcagggtcctccttttatagctcaaggggataccacatgcgccgcctctacctaccctctatcggagggggatcccaattcacttttcctgggctttaaaccgtgccttctccccgaagctaagcaacaaccgattctcgagtggaaccaggcgccgccccccgcctgacacgggggacaaccctgtcattccctcataaatgaacgatgacctgtgacagcccttcctcgagtgacgctcggacgtgacgggtcatacccacccccactctgccgggtacaagggtgacgtgaggacatggttgccctatccgtcggatgtgacggtgccaggccggtcacagaccggtcacatccgttggatagaggttagctaggcgcgccgcacgtctgcccttaccgcattaaatgcggtgagggacagttggggcgtcgcacatttatagctgttcagcctgtgctctcgctctttccctccgccgcgtggcagccgggtgagggcctcggggcgaaaacncgggatagcccgagggggtgacgccatgccccgagggccccccccctcccccccgcggcttccacgactcgcgtgacgcgcgaatggggctaacttgcagagtcacgtggccggaaggaaagtaattcccctctacttcacatacccccgggaccatatctccgacagtagcccccggtgctatatcaggtattgatttcctgagatcgttctgacatggcgcctcacgactcctcgagctggggttgtgggcccggcaggggatccaaaaggatatcaccgcgtggccaggttggcgtgccaaccataacagcagtttgaccgccattgaccgtgctcatgatgaagatacttgaggcgcgataatcccgatgggtcagtcagaccacgcctcgattctcccgctcgctactcgtgtggcggtagtggtgatggtttgctcaacctgcgctcatagccattgtgcactccacctcgaatgcgccactgacagacgcactaaaggcgggaacggatacaacgggcgacatgatgattgggcgcaagatgcgaagagacaaatgcgggcgcgagaatcgtgggggcaagtatgggagcgcgaaacgaggaggcaagtgcggatgaagcgaggataaaagggggcggaggcagagactctgcccccttcctttcgccaaccgcccactcgtcatttcgcttctcgaaccctaacattctcgccaccttatactgtctcgcgctccacgctctccgccacttctccgccggttgccatggcccaagacaccgatgacgcagtgcttccttcctcctgcatcacagcagacaggcaccttagccttcccttcaagatcatgccggacggtgccatcatgcgggcgggagagtcgcggccgcggccgcgatatccggagcgatccgtgcacctcttgtccttcgccatgacgggcttgattccgccgttctccagattcttccatgaggttctggatttctacgaaattcatgccttgcatctcgcacccaatgccgtgatgacgctggccatcttcgcgcatttgtacgagatgttcattggggtgcgaccgacgatgcggttgttccaggccttcttcattccacagctgttgcaaggcgcggtggtggggggatgctacttccaaccccggccaggcacagcgggtcagtacatcgagagccatctccgcaagaaatgggaggactggaagaagattggttctacaccgcgttgctggaccatccgcgacttcgagttcccgctggccctcctgaaaggtccgctgcatggctggcgacttcggagctgggcgaggaatacgacgcggtgtgggatcgccttaggggcctgcggagcctgggtctcacgggggcgatggtctttggcgattacttccgccgccgcatcgcacctcttcaggaatgatcccgtggagcgtgggaatacattggtcccaacgaccccatgcggacgcatgtgggcgagcgctaggactggggtgcggaggacgcgaagatggtgattcggcgagtgctgggcctagactctgccgagccaacactaatcccagatgggattcttcccctctgctacgaccgcgaccgggagagcattctggccgtgatgtctgccgtcggcgccggtaggagccggtccagccgaggcggcgccagcagtagcgtcgtcggcacgggtggcggtggtgcgaccacgggcgggagccgggccggcggtacaggcggcggtggctcaagggcgcctggatcgagccacggacccggagacgattccgcctgtgacccaaaggggaaacggaaggtggcctattcccggccgccctctccactcatgcctttaattcctttttgctgtgtgcccgtagcaggcacttcttgtatttaggccattgtaccatcctatcttgttctgcaactgaaacttctttaacccctcttactcttttaccttttccattggatgcctgtgacatagagagaagaaaaaaccagggcaaaaggggataattagactgcctgcgattgacatgtcgttttgaccccccccctcgggcttgttctagcgagaagataaatccgcgctcggtccatggaacctaagtggtgataggcaagaccatcgccctgctggagccgcccagcgggactggccagaccgaggctgcgacgaccgggggtcggggatgaccgtatgtaggcccttccgatcccccggggttcggcacaacccggggcgcggcccgcgctcgtgctccctttcggcgattttcaggccgccttacggcacttagggtttagagtaaacacggattatcccttgaaccgggacaagccagaggaaggggagaaaaacggtgtccacaaaaaagtagaaaaattcattgcttgtaaaaggatacacagtggtagcccccggccagtcccgcacaaaccgaggggttgtgcgggggctggcccgtgctccaggaaagcaaaaaatctcgatgtcatggatagaaacgacggaggtgctcgatattccaggggttgggcagctctgtgccgtcctccatggttaaccgaacggagcctggccgaggcactttgatcactttgtatggcccttcccacattggcgagagcttgctcagccccaggcgcgactgaacgcggcgtaggacgaggtcgccaacttgtagtgatcgggcccggacgtggcgctgatggtagcgtcgcaggctttgttgatagcgcgcggcacgcaaggccgctccccttctctgttcttcaagataatcgagatcgtcgcggcaaaggtcatcctggttggcctcgttgtacaacacgacacgaggcgacccgagggaaagctcggagggtaggaccgcttcggcgccgtacaccaagaaaaatggtgtttcgcccgtggcgcggcttggagtggtccgattttcccacaacacggtgggcaactcctcgagccatgaatccccgtgcttcttcaggacgttgtaagtcttggtcttgagtcctttgaggatttcggcgttggctcgctcgacttggccgttgctcttggggtgggcgggtgaggcaaagcacaatttgattcccatgtcgtcacagtaatcgccaaacagctcactggtgaactgggtaccgttgtctgtaatgatacagttgggcactccgaatcgagacgtgatgcccttgatgaacttaagagcagaatgcttgtcgattttgacaactgggtaggccacgggccacttggtgaatttgtcgatggcgacgtacaagtgctgatacctgcctcaagccgccttgaatggcccaaggatgtccagcccccaaactgcgaaaggccaagatagtgggatgacctgtaaggcttgggccggctggtgggtctgcttggcgtggaactggcgtgccttgcaccgttggacccattcttgggcatcttgtaatgcagttggccaataaaaaccttgccggaaggccttttcgactaaagttcgtgaggccgaatgggctccgcactcaccctgatgagagtcggctatgagctcgatgccctgctctcgagaaatacacttcaagagtatcccgttggcggcacgctggtatagggtcccttctataaggacatactgtttggagatgcgcgcgagcttttcagcttctgcgcgatcctcaggatgagtattgccttcgagatacgcccggatgtcggtcatccacacgacctgatgaggggggtcagggttgaccccctcgggccccgaggggcgcgggtcgcccggagtcgggtcggtgggcgtgtcattggggtccctcaaagggctcggtcgcgccgatggttgtgcgagcctttcctcgaaggtccctggggggagtggggctcgtgccgacgcaacacgcgacaactcgtcagcaattgtgttgtcgcgccggggcacgtgccggagctcaagtccatcgaagtggcgttccatgcgccgtacctcgtggacgtacgcttccatttgcgagtcggtgcactgatactctttggatacttgatttatgaccagctgggagtctcccaagaccaggagacggcggatgcccattccggccgtagccctcaatcccgcgaggagcccttcatattctgccatgttgttcgtggctcggaagtcgagacaaacgacgtatttgaggacatccccgtttggcgaggtcagcgtgactccggcacctgcaccttgaaagttgagggagccgtcaaaatgcataacctagtgcccgccgcgaatgtcggcgtttggatcctcttcttctccgggaagggaaaaagggacattggacggaacaggttcgtccatcggggtccattccgcgatgaagtcagccaggatttgacttttgatcgcgtgccgcggttcgaactgcaaaccgaactcagccagctcgatggcccattttaccactcgtccaatacccttgtcacaccctaaaaattcaaaatatataaattgttgtttaattggaacttttagaatttattttaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttcataaataatttaaattgaaaaaggttttaaaaagtcttcttttggctttgggccgaaagtcggcccaaaacccttctctctctcctcggcccagtccggcccagttcaccgccgcgcgcgcgcgtccgcccgctgacaggtggggtcgtcgtcaacctccggccgccgcagcccgaaaccctagtttcgcgccgccgccgtttccttccaaaatcctgccgctcctttccgtttccggtgaaattgattgaggggaaacaatctttgggatctcctctaccttttcccctttggaaacgtcggctaattcgttttggaagttcgtggaatcaagttcgattcggatcggtctctttccttcaaaccccgatctttccttcccgtcgccggccgccgtgggccttcgccgtcgcctcctagcccctttaaaaggttccccgagctctcctctacccgtcgccaccttcgccttcgtctctcgtcgtccgtagtgccctagcgccgtgtagcttcgagccgccgtcgtcgccgccgctccagccgtgcgccgccgtcgtttcagccgtcgccgtcgctcgggaaggtcgccgtagtgatcgtcaagtcgccgccgtcctcgtccgccgcttcgccgccgccgaagaccgccggagcaccgccgtcaccgccgacccgatctccgccgccgtttcaacctcatcgccgtcgccgtccgttgctcttccgccgcctttttggtcgccggtgagttcgccgcgtcgccctctacccgttggtgccctccgttcgtgccgtagtgcagccgttcgccggcgagcatgcgcgcccgagccgccgagccgccgtcgccggtggtgacgtcatcgccgacgtcatcgtcgcccttccccgtgagccggtcgtggaccgttcgatctcggccgtccgttttggatcaagtcgatctcggccgtccgttcgtgtgaaccgccgccgtgcgcccggtccaccgaaaccctagcccgctgacgcaataaatctctttttccttttcaaaaataattcattattgcgtcataattcaattaaaatcaatataagtgttttaatccgatttaatcttcaaaaattcataactaattcatcttagctccgatttagttggttcaagtctctaaatttttctaaaattgagatctacatgttaaaaatatccacatgtactgttcatgcttgtttatgtgctgttttggtgattttgctcttttctgtttagattccgtcgtttccggagagtccgttttcgcaggagaagagtttgaagagttccaaggccagcaaggcaagtcacacagatcccaaacaaccctttgagcatgttgatcccgtttaaagctattgtttctattcaactattgcatttattttcgaatgtcattgggtggaattaacctattctttgttatagcccttttgttcttggttactttattccttgataccttgggttattataacttgactagttgagctttatatattggttcagctagatattagatgtgattgcttatccatgcttagaaacattagcacactattgggataacttatgactcactattattttaatgatggcttaatgattgttcacgatggtcaatcgtgactggttaattaattacttgccaactaaaacctgataatggtgggttgtgagcacatggttttgatggtcgtgctcatgacaattaaggaccggttcacgagtttcggttgtgaaacattaaccgtgccaaccacaagccagcgtgggcaacggctttatcttttgtatagcatagttcattgcggagcaccagactgagaagtggcggagataagcccacggaggtcgctggggagtccatgccttgtttataagggggtgattatgatccaggaaaggtgcgctgtagtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacttctcaccatagtaaatgatgctataattggtaataatttgattagctcctggtttggaatggtatattcctggtttggagatagaactgtgcagccgggatggttgttcagaatggttgggcctatgcaacagggtatgttgtatagcgttgggttaatattgtttaatacttaactgttttattaaattctcaaatgtttgctgaatgctgcttttgcaaaaagatgaaaccctactatgccatcctttgttatcctgtgcacttgcatatttgctgtgtggcttgctgagtatgtcatatactcaccttgcaatcattcatcagaggaagagttctacaatgatgctgatggtgtggaggattaggtgtagccttggtcaagctgcttgtggagtggagccgtctgcgccgtttattttattttccgctgcttagatctttattgattgagaggaactatctacctctgtaatgacattttattcgcctattaattagagtaataattgtactctattatcaatttgttattgtgtgcctcggctgattcctggacgagggttcacacacatgtaagcgtttggaattttagatagaaattccgggcgtgacaaccctctcggttgtgcaaaatttggccaacagggtatgtcgtcactacggaaacccgatgcgcttggaagtaatgacgcaacttccttgaggccattaagacggcgtaaagcattttctgggcctgcgaataccgggttttcgcatctcgaagtgccttgctaacaaagtagacaggccgctgcacctttcggcgggaccaattcgtgttgtcaggggctgatgactcggagcgcgcctgttcggaggtctcggggggatcccggactgcctcaggatgatgaggctcggggccacctgccaaagccaccgctcctcccttgggggcctcagggtcctcccgggggctggaaactttgggcgctaggccttcgggggatgagaggccattgcaagccgaaggggccacccgttcgccttcctcacgctcaactactaaggtggcactcaccacatggggggtcgcggccaagtagagtagcaatggttcctccggtcccagggccaccaagatgggggggaagtgaggtaagctttcagttgattgagagcttgctcagcttcctccgtccatacaaatggcccggagcgcttgaggagcttgaataggggcagtgccctctcacccagcctcgatataaatcgctcagggcggccatgcatccagtgacgcactgcacatccctaagcttgctgggggggcgcatcctctctatcgcgcgtattttctcaggattcgcttctatgcctcgggaagagacaagaaaatcgagaagtttgcccgccggcacgccgaacacacacttatcggggttcagctttacgcgcgtggacctaagactatcgaaagtttcggccagatcctgtagcaacgtgtcctggtggtgcgtctttaccaccagatcatcgacatatgcctctacattgtgccctatctgattacttaaggtaatacgagtcatgcgctgaaaagtagggcctgcattcttcaacctaaaaggcatagttgtataacaaaaggtgcccacaggagtaataaaggcggtttttcctcatctttcctagccatacgaatctgatggtaccctgagtatgcttctaaaaagcacaaaaggttgcaccccgcagtggagtcgattatttgatctatgcgtggtagagggaagggatctttggggcatgccttgttgaggtcggtgtagtcgatgcacattcgtagcttgccgttggtcttcgggacgaccaccgggttcgccagccactccggatggatcacctcgcgaatgaaatcagcctccaggagccgcgccacttcctccctgatgaaggcctgccgctccggggcttgacgccgtactttctgccggacaggacgcgcatctggccgcacggcaaggcggtgctcgatcacctccctggggaccccgggcatatctgacggcttccatgcgaaaacgtcagaattcgcccgcaggaaggagacgagcgcgccttcctatttggcggtcttggacggatcgtcgccaagggggatttccttgatgggcacctcgtcagccgaggtgaggcgcttcttggaagcgcgggacgcagaggcttctgggcctgcggctccgtggccaccgccaagttgtctgcgcgctgctccgcgcaggcgagggcgaccttgacatcactaaggacggtgatgggaccagcaggacccagcatcttcatctggaggtaggcgtagtgggtggcgaccatgaacttcaccaacgcaggtctgcccagaactgcattgtagggcagattgaggtccgccacatcgaagtcgatccgctcggtgtggaagttggtggagtcaccgaaggtcaccggaagctctacatggccaagcggccatgtgtgcctcagagtaacgccattgattgggagcgacggctggagcttcatccccggggccttgagcgcatcaaaggcagccggggagatgatgctcagactgcccccccatccaccagcacacgtttcatcttgacattgtggatgctcggggagaccaccagggccaactgcctcccccccccccgagcaacaaccgtcggatggtcgctctggtcgaatgtgagctttacttccgaccagcgcgccttccggaccgcctcatgcgtgggaacaacggccagaagctcccgcttcatggccttgaagcttcggcgagaggcgtgagcgcaagcccccccgtcgagcgtggcgacggtcccctgaggtatctggaaatccagatcctcaccgtctccaccatcatcggcggggcccttgtccttggcctcccctcgccggtcaccggttgaggtcgcgggggctttgccctcccgtcgaccctgccagttttcctcatcagcctttcggaaccgctcggccaaattcttgaccgagcggcagtcggcgagactgtggcggtaagtgttgtgtaccgagcaccacttatccgccgaccggccctcgccggagggaacagcggggctcggcttatcgccggtggcctttcctttgcgcggggcccgcgtgggcccgtctgctgcaaggacatggtcctcgtcatcggagcgggctggtttccttttgcctctcctatctcgccgcttagagcggggggcagattcgggggtagccgcagccgccgcaccggtgccgggggagttccaggcccatgcctcctccttccgggccaccttgtccgccagctcgaagagctcggcagtggtcttgggctccttggaggcaatcttctccagcatgcgattatgtcacacgccgttccggaatgcatatacaactgcgtgggctagaatgcacggaatagtgttgcggacctgacagaagcgctgtatatacgaacggagggactcatcatccttctgccgtacagcgtgtaggtccgcctcttcccccgggcggggatatgtgccctggaagttcgtaatgaactgctggcacagatcctcccaggagtgaatggagccggggggctgggtcatcaaccagccacgcgcctgacccttgagggctatgggaaagtaattcgccatgacccggtcgtcacccccttccgccacgataaccgtggtgtagatctggaggaactcggagggattgatgctaccatcatacttctccgtaaggttggggcgaaacttcgggggccaccgaacattccgaagactcgccacaaaggccctacaacccgtccccccaggggtgagtgtggggggagggccgccccatgaagaggagcgtggcgctccagatgaagaggcgccttccccgatacgggcagctcggcgctcgtctcggcgtcgctcgatgttgattcgagcgtcctgcgtcccgtagaggccgtcatgatgcctccggctttctgaggcccctgacgatgttagaaccgtggatcgcctcgagatcgtggccgattgacaagcccttcttcttgccgacgaggagagggtgaccgaggtacgcgacgtaccagcggcagcggatcggccactcgtggctaactgccgctgggcagtagtgaccaagttggccacgtcgtccagccaacgcagaacaggagtctccggctccgggttcaccgggggatgccgcagaagggcacctgctgcctgaagcgcgccttggggcgaaccgccgtctccatagtcgagacggcggcgtgtcccggcgcgtcgcggcctccctccgccagggggcggagaaagagccgaatcacccgaacgagtgagatcctccctccgcgaaggttcgcggcggggaggagttggagaaccatggcgatggtgacgaggacctcggctcgcgccggaattcccactcccggatggggtgggagtaaacgccaccgcctcctcctctacttccaggacctcaaccatggtcggctaaggcctggagaaaattgggacgaaagaaagcgacttcctctcggaatgcgcaggcgccccctacctggcgcgccagctgttgaggagagatcctcaatagcggggaatcgtgagaccccccatttgtgagttcggctaggggcggaggctcatctcttggaaatcactcactcgtccctaggatcaccggcaagcttgcacgcaatcggattagacaggttcgggctgctatagagcgtaacaccctactcctgtgtttgggattatggatgagttttacaaagatttcttcactctagaaagcgcactcgcttcctccctcctggagtttaggttttttctccctctctcccctttttctttcttttttttcttgtctcagtgggcagggtcctccttttatagctcaaggggataccacatgcgccgcctctacctaccctctatcggagggggatcccaattcacttttcctgggctttaaaccgtgccttctccccgaagctaagcaacaaccggttctcgagtggaaccaggcgccgccccccgcctgacacgggggacagccctgtcatttcctcataaatgaacgatgacctgtgacagcccttcctcgagtgacgctcggacgtgacgggtcatacccacccccactccgccgggtacaagggcgacgtgaggacatggttgccctatccatcggatgtgacggtgccaggccggttacagaccggtcacatccgttggacagaggttagctaggcgcgccgcacgtctgcccttaccgcattaaatgcggtgagggacagttggggcatcgcacatttatggctgttcagcctgtgctctccctctttctctccgccgcgtggcagccgggtgagagcctcggggcgaagacgcgggatagcccgagggggtgacgccatgcnnngagncccccccccccccccccccccggcggcttccacgactcgcgtgccgcgcgaatggggctaacttgcagagtcacgtggccggagggaaagtaattcccctctaattcacatacccccgggtccatatctccgacaatagtagattagaaataaaaattatacagggcatgttcggctgcactacagcgagctgcgacagagccgccttgcacagtattttgtgtagcacagctgtgtagcaggcttgctgccgctgtaacgtgctgccgaatacagccacaaagtgctattttacaatattatttctattaatatctatcctacatgaaaaacatgtattggtggtggttgttctccaccactagcgcaaacctgacagtgagccctttaagtgggctagcctcccactctcccatagtactgtcatttcgctctctgttttatttaaaagaaaaaaaatcagtgtctatattcgtggtcttaagtgatataggtcgtgggcataaatttgacccattgcattatatcaatgacatgtgactaatggatggaaaaccacaaaaatcataaaagtgttgttcgctttggtgtactaggattgataaccctttcttccataagaaaatttgttgcaacgcatgggctatttgttgtcatataaaactttcgaagcaaaacgctggatttttttctagttactgattattttacctttagtttatgcgttcattttgacacggcttatgagccgtacttcaaactgataataactagcactggctagtactactattttccttagattcccagccaagaggatgccatcgcgtgatagcatacatagcatggtcctcctccctcaatcagattcttggaatacttgcattgcatccaagtttcatcggtgcggccttcttgtctggtcagaaactaacaccctagataaagggctagctaaaacctaagcgcgagaccgcgagagcgaaccaaagctatgctagccattattgcgacttggcaggatttttgacatcttggttatttcagaaatcatattttataaataaaacctctataaaacttaatgaatatggctctctacctcgattctatagatatgctagcgctgggatgggatgtctcggtgccgcatacactagtgcgacattgaacctcaacgccgatgttttgacgctgacctctcctacttaatgacaactctcattttttaaatttaaatactattgatttgctttcatattttggaaaaatcgaataaatcaatgtatcgtactttattggtttgtttatactactttagaaaaattctaatggtccacctacttctgttgtattgtagtttttacatattatcatcttctcaatatcgatatgctatcatattttagaaaaactgaacaaatcaatgtatcttaattcatttctgctagtttattttatttataaaaacttaatccatgaggagtacgtaggttcctccctcttccccatacataaatcctattaatttgctgtcaaattttgtaaaacaattacaaataatgtatcatcatatcattcaatttaccctatttgttttcttaaaatttgatagcaaattagtaggatttaggaatgataaggagggagggagccacatcctcctccaagattaagatttaatagaagtaaattagtagaaaatgaattaggatatattgatttatttagtttttcaaaaatatgacagtaaattaatttgatttggtgccgaaacccagcgtgtatttagcgccaaggcatctaacgacgtagggatgcatacaatatctttttaagctaatctatttctataaaatatgtttttaaaaggactaaaatgtcaaaaatccagacaacttgcggcctctccttcctttcactcttccactgcccaaaccgaaagttcccttggaccgtgtggcaccggtgcttttcggcgatgccactctccgttgtgcccaccggccggcgtcatcctcgcctccggctttttctctcccggcagacggcgttcgcttgtaatggacgcacacacatcaccctgacctcattccgatgtgtccatccatccaatattctcgcgccgacccttgtcatgctcggaggaaagcaaagtcccattcgatactcttctaaccaaactggacaatcatgagtcacaaagtttgtaactaaagattagttagtgtgctctgtcagttggtaactacaggagtgctcactgctttatgtgcagctagccagctaacatggcagcagcagcaccagtgccagtagatctctgttaggtgcttatagcaatagcagtgtgtctgtgagaattgtcggatctcacatgccacctagatcaagaacgtgttaagctacatgattcataatgcaagttacttgtagtaggtcctaccagtaccacatttttcacttttcatctctctcatctctccctttccccaccggtaccggaggaagtcaaggtcggagagagcaagacgccgagcggagtggcccaagcagcaattgtaccgggctaagtggcggtggctagcagggtggccctagcattgacggcactgggtggagcagcggcagggcgaacatcctcctctctttcccttatcctcttccccttccggtctcgtcctttggctacaccgagcccacgcagtggcggcagtcgaggagctccttagcagcacagccacgtggggcagatcgagctgatgcccgccctccctccccaactctggccaccaccatctgtgtgtgccataatggtcacaaccgacgagctagggacatatctggcaatgtcggcgtccccgctcctctcctctctccagtctcatcccttggctaccctgagcccacacggcggtggcagcttccttgagcccacgcggtgacaacaatcttctcaagcccacgtggcggatttggccagagaggtgatccagacgatgcctcagctcattggtggcaacctccccaagcccacttgggggatctagttggaaaagtggtctagccagcggcagcagcctccccgagtacccaatcgatgccgccgttgttttcggaagcttggccgacggcagcagcctcggcaatggcatcgttgttttcctgcggctcgatagtgacggataaagctgtggcttcatacccgcttcctatatctagcttgctttttatgacaaggccggccgaagaacgggtgtttctttggacgcgtgagcttcacgtgtgtagtgctagaggcaaatgtggcagcgaatctccaacgtgtcatgctcaagctgaatgccatgtcgggcgcattttgaacgcccttagactgtctctggtaaaggtggtacatatcttctactttctttatttttatgagcacgtttatcgaagcgatgaacaatatatttatttttaaaaaaatctgtagaaaagttacttaaaaattatattaacctaattttcaagttaatttatagcttgtgtacttaactaatcatacgtaactagcacataatcttcccatccgaactcattctgtctgcgttctttgcctaaaggaaaatttctcgtacacgcaaacggagaaagctgcacataattaattaaatattaactattataaacttaaaaaataattttatttttaaaaaatcttctattgagattttgttaaaaaataaacaatttaaccatttgaaaaacgttttaatggaaaatgtgaaagtttaagtttagaaccgaagaaaaagacagggcatctaggctaacacgcaaacatttgtactgatggctggttacactcggctactggcacatggattaatgttttttttccttcttaactttttaatgaaagtattagaagaattgatcattgatgtgaaccgtagttgattttgtgtctgtgtgtgtgtgtgggggtggggggggggtgcattctgtgaaatgcattacgtgccgagcgatggatggtgcgacggagaattggatccttcgctgtcacgcccccactttcgccgtcccgttcgagacgtgacaacctactacccaccttcctcgcggccttacacaaacacgcacacactgacaccgcgacacgcacaaatgtctctgtctaatggatcgtagctgtgcttcctatatatatatatatatatatatatatatatatatatatacagtacgagcgtgtcttgtaccgtttcgtactctctttcttctcttttattcgtcgcacacgtctacaagagagtatccaaaagcttacgcagaagaacttaatatactcgagattaccgtgataatacaattattagagatgtgtagttttaacctgaggtctcgtgttcaatctctatacactcacaattttaactcaaaatctctctcttattttaattcaatatacaacgtgcgtatttgatatttatatactatagttgattgaattctaaatagctgactttccgcccaacacactgattctatttttgttttacatttttctgtataaaccttcacttttatattaactagcatgattgcgcggctagcatcattatattttctctcatataatagtatatatggtttctcaatgtattattcaaatatattaaaatgataacataattttaaattttgtactaactttacgaaactactaatgcgtaatattcgtattgtattttatataggtgttagttattgattatttttaatatcaaattttagttatttgtaaattatatttctatatggactctagactcctctttcaatattatttttaatttcgagttttcgttatctgtaaattatatttctatatagactctagtctctaggctcttcttccaatatttttcatttttaattctgattttttattatttctaattgtatttctatgtggactctaaactcatctttcaatattctttaatttttaatttttaatttcagttacttctaaattgtattcctatattgactttagattcgtcttcccatgttttttaattttgaattttagttatttgtaaattatatttttatacggactctaaacactacttttaattttattatgtgtattccgaattttagttagttttaaattcctatatggagtctatactctacttctaatattccttatttttaattccaaatttcgctatttcctaattgtatttttatatggactctgtttttctttttctccaattaatatgagaatttctagaccgtgagagcgaacatagaggctcatttttctatacctttaataagttaatagattaatcttgtatggtgtatttccatctgaatttttttttgtctccgtcattggcaaaactagagtcattggatcattgctactaatcgccgacagtatttgttacgtttttttttcttttcatcacatttgactttgaaccgcaaataagtagtaaaagtgaaaaattacaccctaaaattatttttcgtctcatacgtaataggcacacgtctttggttaagccatagctcaaaaattgcctaccatcttttgcacaatatgcggtgttagagtctgtttggatgggactaaaaatttttaatccatatcacatcggatgttggacacactaattagaagtattaaatgtagactattgacaaaactcattccataaccctggactattgactcgctcttacaactttcaagctggattttcttttttttttctttattacattgtttcatatatggctgactataaacgtaacgcttattaacgataaaaatatattttagggtaaaacttatatatatatatatatatatatatatatatatatatatatatatatgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgttcttaactatgtactaccctcgttatagaatataaaaagttttagagttggacacagctattaagaaagtgagtagagttagatatggagagattgtaattggttgagaagtggaggtaagtgaaaaaagtgaatggtggagagttgtaattggttggtaaacaaatattggtggagaagttgttatattttgggataaattctaaatgctaaaattgttatattttggacggagggattactaaacaaccaataaataaactaccatagaaaaatcaaaattaactctaaacattacaaggcagtcatggtgttagaatttgtatatggaatgcatatacaaagtcaattatagtgtaggatttggagttgttctatgtgtttggataaagttagtcgaatatgtcataggctctctctgaaatacagtggtaccaccggttgtaactgcacgacgactgcaacaactggtcggcagcctagttggtcgatgatagtggataccttgatatactgtagctatgttggattagaaaggagtgttttcataatctgtgtttcaaggatgttctccctccgttcaaataaacgaatctaggaatgtgacactatgtccagattcgatgtactagaaaatatcatatccagtcctatgttgattttttatgggacggaggaagtaggttttgactaaacatcgctgacaaatatcatgatttgttgtcttcatcacttcaaggtcttctatggcatactccctccgtactcgtaaaggaagtcgttttggacagcgacacggtctccaaaacataactttaacttcttgtttctataaaaatatttattaaaaagtgatatatgtatacttttatgaaagtattttttaagacaaatctattcatataatttttacattttcaaactcaacaatttgagagttattcatgatttatattcccaaggtttgacttaagcattgtcctaaacaatttcctttataagtacggaggaagtacttcataatttgggtatcgatgttgattttagagtcggtttcctaacacctagaaaaactaaggtttaagccctaggcttgactccaaaactctaattaaatcttttagaaattggatgaaaattttgaaaatgtattacgtctaaccaaaactgactaattcaaccctaggcttgcacgttttctgtctgggtcttcaaggcgacagttgagctaaacacctagcactcacctcatttcaaatgtgcttggatttaactttcttggtagaatttgtatattctcgaaaaatagctatgcttatttgagtaagaaaatgttgttagctaatagttgggaaaatgctttatatcgcacgtccgacgaaatggaaatatcggacgtctcatctaccccactggaatgctgcaaatcgacagcatgatggatcggaagaaccctgtcaccgtaacaggtatgactagctgtttctttttattcttttctcctctctttaaatattttttcttctaaattacttatccgatctacgaaccgatcacaccgttgtattcgttgtaattaaatctttacaacaagatatcatatgatcatattatgtcaaaagaaaaacatgtgtttcaaactgttaaaactaaatgtttcatacgtaacagtgatatgtttcaatgtacgccttcagtgtgtttcacaaaattcctgaaactacctgctactactctctctccacctcatccatgcacacatgcatgtattttagcaagcttcaaaataatttttctctcaaattaattatccaatctatgatccgagacatcattgtatttgttttaattaaatctttacaacaagatatcgcatgattattttgataaaagaaaaacatatgtttcaatccgttaatactagttgtttcatacgtgacagcgacatgtttcaacgggtatcttcaccatgtttcataaaatatttaaacgtttcagttgctgattttttgtttcacttgttggtcaactgcaacatttgaccgtccgatttttttggcatcggacgtccgatgggtagcttcctcctaagagcccctttgaattggaggaaaaacatagtaattttggaggatttcaatcctataggaaattttcctataaagccctttgaaacaaaggattgaatcatatccaatcctttgaaattcctatggaatggacaatcctatagaaattttggaggaaatttagcaagatcaacctcttggtaactttcatttgagtctatccctctcatccaattccagtttaatcaaacggtcattcctgtgtttttcctgcgttttaaaatcctctgttttacacttgcattcctatcaaaatccattgttttttctattcctacgttttctcaaaggggccctaatagttgttaaaaaatgttctttaacggcttaacctgatcacaatagatgataatggtctattgttagtgctagcaacggtgatcaaatttcagtcctctaaaaaaaatctccatgctactgggtggcacagaagatccaatcttcagttgatgtcgcccttcagactaagtaaattggtacggctctcgatgtacttgtgttgccagccaatgacaaggccagcgtacaactaagaagtcatgacaccaacaattaacgacaagtcatatgattaagatgtcatgtagtagacctaagcaaagcactgccgaatctcatctctctagcgtacattaaatattcagatcgtcgtcaaaaagaactttcgcatcattagatattttttccaacttgtgctaccatataataccaacgatggataatagttgagcaaatgtatggaagttgcagccaaaaatgtcgcacgaagatgaaaaggagtatctaatttgtaggaaattgcctctttgtaattttaaatattacttttacttaaaatttgctggataaaagaacataagttttttttaaaaaaaaatcggccaacgagtttgtgtgaaacctaagtacaagcccgagtaggtcgcccacaactggggactttaccagtgcgctaaaattttcagtttgttaatagtagatggcagcgcgtatccatggaaagggaacatcctgtcaattttctcttcttcccttatttctctgcgtctgatgatatattgacatgtggactgcaaattggatcttgttatttctaatggtctccaattttctaaaaccattatttcgatctccatcttgcaagagttgagcaagctctttcacgtctttcctcattcaccagaatcaaagttgagttggatgtttgaagtggtgaatatcctatttcctctggtcagtagtcatggtctcactggtcttttcttttttttttctattttcaactggaccctactcttgttagcttgtcactatggcctttttgtatttgaacttgtttacttgattatgttgagctatgaaatggtagtacacctgcaattattgggtctctttatatgtttattattgaccattgacacgttgaaaggtggttcctacatcaatgcattttttaagagcaagtttaacaatgtagctaagtgctagcttcaaaaatgctacattatctataaccaacctaatactttattaattatgaatatatactacctcacatgtcctaaaatataacaaattttagcctttataatttatcctataatataataacatctaaatcaacattctattctcaacaaccacaaccttccaccattcaatttccctacctaccttcatttctcaaccaatcaaaatcttccaccatttaattatatatactttcttaataattatgtttaactctaaaatttcttatattatgagacggaggtaatacatcatcaatacatggctcatctctctttctcacatggtttattagggttgtattgtagctggttataaatttgatctcattttttcattgccctctctgcatataaatataagagtgataatttttatgcctgtttgtatcattttgttgcactaaataacaacggatacttctactgtacactgtgtagtgagcagggatgcccaatagtgagagtgcgatatgcagctctacagttcctcacctcttttggcaatagatacaacagcaaggagttgctctttggggaaatgaagggataccattgcataaattaatcgttctttgcccaggcgttctgatgcctccatcacatgacctcacaaagaaccaaacgagcattttggatgcattgcaactccattgccaggaagaaagtacaccaaatgctgacacaagagcttggcctggaagaggattcccctcatgtcatttgttttgttcaaaaaagtgacttttgctggcagttttgtatgacaaaaccattcaatttctctccttgttgggagaaagaacaaagtagggagaatcttagggaggttggtcatcagcattgctggcggttgatgcggttgaatattgcgaccttgatgcgagagcatttgctcaaggaaggcatctggtgctgcttatggcagaaacgagagatgcatcttatttggttagaaagccagccaccgaagaaaaaacgatgtggaagattcgttcgtcatgtaagaagatatttgatgagctcctgaaaactcatgttctctcttgagtttacctggccgagaaggtagagtttgttggacttaattcagcccatggctggatgctcatacatgttcggaaaaaaaatccactttacgtctcacaagtttggctgtttgagtcaactttcatttatgcccatcaactataaaactgggtataaaacatccttcaactatcaaaaccaatgcaaatcaaatctctcgacaatatttagagtagtttgggttgatgtggcatcatagttagtaaaaagaaaataaaaatacatagggacccacatgtaagtggcggtcggttcaccttcttcctccctccccctctctccagggaaaatctacaatgaaaattatcggatgtcctgaacctatcaatcataagtataatgctttatttttgtgctaaaatgtgtcctatgtatcatatggattgtacttgtatgtagatctgctcctgcctctcactttaacctctcctctctcttctctccctgtgggcattgttgacgaggacgaccgtatgcaggacaatgtcactgtgcttattgctccatccaaacgatgtagccgtcgccggatgtgccacttgcgtggccttctccctccaccatttaggttgtgcgtgagcgcatcgtttgcaccccttgatttcattgtcgaccggccacagcgcgacagccacgattgcattgtcacatgttctcaaccttgtctctccgtccatggatcggactggcctagcagttgggggtaggtcatgcaaggaggggtatcgctgttgggagaggagccaagagtagtgcccctcatggagagggattggcaaaaggactcaatttggtgacgggtgccgtcgattgatgttgttgttaatgcgaagtagtagatctatcgagatcaagagcgacgacaactgtgagggggtggaccagagcagcttgtggatgtcctaaaagagagtggttgaattgtttccctcactgggttttggggtggcaggagaggagggggagcgagaggaatcatcatgatcgttaggcggtggtgggggaggagggaagagagggttgtgtgtgaagaggacaaggaaaaggcccgaaggaggagaagcttcttttgaaggttgatgcggcagagcaccatggcggtggcagcatgtgactactggcccaattaggattgacttgtgtagcccatgaaaattgtatgcacatgtttaataccacattgctaatttagtaagggtgaaatcaacttataagagtttatccatccaacaatataactctttggtttatccttttacatgagactaaggatggaagtgtaagtaagtccgctcgttggatgggttgggctgcacctacgcggttctagagggcgggtagtagtggtacaagagtactagtcaggaccaacgcctagctccaacgatcagcgctagccgcctttcttcccaccatggtcgcttatgtagcgacatccccgtgctcggcagtgccgccgtatgggttgcgaccaacatcaagccgtactaccccatcatgggacatctctcttgtggccatctacaacgagatcatcagcacgatgatgaagaatgccttcatcaccggtctcatccccgtcatatgcatccttatctccaagccacactccctcagcaacgtgttcatctctgcaccaccattagctagttggtttctcgacgtccttgactgtctcgtgttagggctgatgctcgagttccaccacacgacgagatcgacgttcgtcaacccctacctacttcagttacaacgacaacacgataccatacatgctagcatgtgggtcccatcaagttttttttattttttgtttctagtgccatgtatgcgtcatgtcggacgaagactaagtcaacaaaccatataggcaccacgttaatttgcactgattttgtaaattgggggacgctccacacctggttttggaggcgagcgacgcgaatgaaattagaccatatagttgagggataataattggacttttacctagatgtttcgaaaacattgtggaatcataaaatgaaggcccaacatgcgttgcaaaagttgccggcctgcagttgcggcccatcgaaatcagtccactgttttattcggccatatgaggccttcgattcagccggcggtcgccccccgttttcgccatgttgcggagataccgggcagtgcggcgtgccgccgccgccggatgtcgatggtggcgagtcaggatggcggcgcggcccgaaacagcggctacacagttgaaaggtaataaggatttggccgagccgtgcgagtcgctggcgttgacgacgcaaattgacgcgacgcgagcccaatactccccgtatatatctccagtttgcacgaccaactgccagctgcaaaaggcgagagttcagtggaaaaaacagatggtcgctgttcagaccgtgcatgcggcgctcttgccgtcgacgacgacgacgcgcaggcggccatcaccgggtaggctaccgaggcgttcccccatccgcgcacgagccggatcgtccgagacatcgtcgccacgcggccgcgagaactggcgggtgcaggaggcgctcgcacgggtcgccgagatccaggttctgaaggtccgcatcgccagcttcctcgacgactgctccgagaacctgctctggctcgcggagaacgcagcgctcgacgcgacggcacaggacagctgagggtgctcgacctcgacgg

SEQ ID NO: 2680 - DNA, 17084 bp, Oryza sativa
tgggtcgttcgacgacgcgcaagcagaggagaagtggatggacttgatcggcttgggcatagacgaaggtgtatccgttgaaagcatcggtgaggaagccaaacatgaacatgtgctggtggcaagggagagcggacggtacagactcgcaggaacgtttacctcggtgtcatgggattgatctgggttggcctgatgcagaccaccgtgttcgcggcgcccaacgtggagttggacaagtttgcggccctgtgtctcatctttcttgcccatattgttcaggtctgcttcaaggaggaaactgataagaaacaagtgtgtgtaaatcatgagactcagatcagcggaaggcagcggtagactccaatcatttggtttggtttaaagtagacagggatatgacaggcaatttggacagtaatgatatgttacatgtaataactttacacgtcgtaaaattatagcggttgatatagtttacttaactgtctggtaaccaatggacaatatccttctctttcttcccccttctccttccaagttattttagcctgagtttgatttggagatgagttgtgatggtttaaccctatccttatttttttttagagatttgctccggtccaacaggtataggtacgtcacaataccaaatcgtttttcgatcgttggatctaacaatttggatgagttgtgatcgttggataggcattgttagatccaacgattgaaaacgacttggtttcatgaggtaccggtatctcaagatattttttgctggattagagcaaatctctattttttaataagaaggtttcatctatttatttggcgcaagagatagaatgatcatattttttaaaagaaatgggagggtggtatgtatatcaatgagaaagataaagaagctgatccggatttaaaggaaatattcttttttatagattatttcatcctaactattctcaaaccaaactctataaaatgggttcgtcccgaccgatcatgtaatcatgttcttctaaccaaacacatgctaaactctataaaatgggttcgtcccgaccgatcatgtaatcatgttcttctaaccaaacacatgctttaaatggagccagctgattaggagtcacctggactccaatgcctagtagtcaatgttagtaaatgcttttgattgcctgagctcgatgatgttgttggctttaccactactagtaaatctcccaatgcaaatagatagtgttacatgtagacttccgtattccctccgtttaaaaggaaccaatttcatcactagttaggaattagttcttttgtaacggaggaaatattgtttggctatgtaagagtgcgcagcccggcccaccaaccgtagaccacccaggttatattgggcctgctccaccacaagcccaaccgaagccacaactttaggtccgcccggcacaccaaccgtggaccacctaggtcatattgggcctgctccaccacaggcccaaccggagccacaactttaggtcctaggcctatacaacccaaaaagactagtcatcgtgctcctccatcatcaattaccgatgtgggactaaacccaacgtcacacatcaacatcaacccatgtgaccccgaagacttgttatctagcctccccaccatgtgacccataaaaattgttccgggttccaaacctccccaccatgataccacatgtaacccatagaaattattccgggttccaaaactccccaccatgataccacatgtaacccatagaaattattccgggttccaaacctccccaccatgataccacttgttgcagcctgctccagcacagacccaaccggagccacaactttaagtcctgggcttacacaaatcaaaagactagtctgatgggtggggatcgcccccaccttttaaatcgtgctcccctatcatcaattaccgatgtgggactaaacccaacaggctagctagtaaccatggtcgtttttgtctcttcccgaactgaatcttgacacgtcaaatccggacatctatgtccgtatccaatgtccgtaccccaaaaaaaagaaattgttgggtcagtacaacacggtgtcatatcggaagttccgaaccaagttccacactttcactgttttcaccctgctgactgggccttgtggcaagcaggagcacatgccggcccgtcccgccgtgcacccgcgcgcgcccacgaaacacaacaccgccgcggcgttacggcccaaaacagggagccccatccgccgcctcctcgtcatccggcggcgccgcgcggctgtacgcctcacgagaatgataacgacttctgctgatccgccgcgtccctttcgtacgccatccaggccccggggggatagcatacgctgcggcgccgatctgcagtgcccgccgccgcctgacattctcacctctctgctgcctgctaattcatcggccgccaccttgtttttactgccatgcatgtagcagtggtaattacagtatgtcggtacactcattgtcatgcagtaacagccaggagagttctgactgcgcccatgtgatgaactgatgatggggtttgatttctccctgcagatactactactgcagtactgctatcgctaaacatgagagggatcggggcccctttctcctacgtccagtccaattcaggtgcgctttttaatttttcgaattgccgaatcattccttgcattttttttctagtacacatctaggcaaattagttacagtatgtaacctgaacaagaatttcctcctatctagaagtgcataattaattagcatactttatgtaccggagaaacgttggtttctagataagttcggaagaaaagatttatcatccgtggaaagaattaaaagtttccccttggtacgcactcttcgtttgcttcacgatatgttcagtgctggagaagcgttcagcattcatctacagcatcctttgatggctcatgatagctttcataggaaaggccaagcaaagtatcgagcatggacggacgagcacattgcacccacaaaccacaccaactctctcactctcagccacaggagcgaggcgtgtcgagacgctctcgatggcacacgaacagcagctactccagctcgcactgatccgagccgagcatccgatgcagaaagttcatgatcccctatgattgtacacctctcggtcctgtttggcgaagcttaagattctgagaaatagatgattggtagccagtttctcagaatatggaaaaagtgggtttcccagtttctgatttttagttcattttctagattttacaactatatctttttaaaatttaatataggggagcttttattctataagctcccaagcaggccctcattatctctctgaaactctgcagtacgtgcaaggcagcagcgcaacaccaacatgcgtagcagaggcatcagcagcagcagcagcagcatcagcagacagtgcacccgaaatccaagcgggaggcaatgattaggggaaggaaaatccggggggatgaaaaaaaaggttaatctttttttgcgctcgtatgattcgatgcgtaaaagggatctttgatcgtggtaaaccatcatcatgagcgattagtagcggtagtaggcgcctcgagatccgcgctgggccggagatgccttccatgatgctgctgggcgccgatggatcatggatgggagccaagatgatctgcctgctcctcctcggctcctctttaccattctgcatctctatgctttgctgtagtatagcctagctttcctcgactctgctttgctagggggcatttaactatctgccacttttattacatggtaattaaaaatttattactcgcagtctataacgagctagctgggctcctttgagcatgttatcttaacgagttaatttggcttgattcattaatcttaatgagttaaaagtctagcttagttcttgagcggtctagttaaattcgttagttttgttgacgcgttaattatataaacctaataattttaaattttattattatctcatatactaacttaatactccctccattccaaattgatctacatatagtttttttagattattcctaaataatcttcacatttgtcttcatttattaagtctattcgttatttgtgcgttggagtaaatagacattaatgcatgcatccatgcacacaagtatttatagcccacaagcaatatcttaatttgctattggctagaaaatattggggatggtacatgcatcgaatgtattgctagagtaaatatagtatgagagaattattagtttttcttggttttggtgtacctattaaatatgtagatcaatttggaatgaagggagtaccaaatactaactaataactcacttaaatataaatagtttggatgactaatcactagttaagacacactaactatataaagatatgatgatgatagtctatatcaatgagctaaatgagcatcatgcgagttggctcgttattcacgaggtaaaaacttagatttgtttgactcattgtaactccagttctagccaatccagcttcgctcgctacgaaccaatccgagccataagtttcgagttttgttgaataatttgacgatgaaattttgatagcaaataatagttatagtgaagtttgtccgggttcaaaaagttatctagctccgccgctggccggctgctgctagaacagttctaccgtctacgaatctacagggcagtacactacttccactcaactgctactactgcattgttctctaccgcctagtatgctatacaacgcacgaatgacttgtggccggggaaagggtggtgattaaagctggtgcaatgcaatacatgcatgcactctctttgctcgctttttctacccccactttggttgggagcctttgaaccccagtgtggcatgcagcagcagctgatgattcccatgcaaatatactccaaatctgcctttgtgaggatgtgtttgttgctagctactgctaccatctctccctcatgggccacatccccggcctcctttgtgagctccaaggcatgctgtcctcggctattattttcaagctccagcagagccgcatgccaattgctaatgctccatcattgggcctatctgctgctgtttcatttagacctgtttcaggttcaggcagtcacacatgctactccagattcttttaaccgagcatcataagtcatttggtaatttagtatagccgtgctgcaattatggttgcaacttcaacatgctcgtatgagtatttagcgtagaaatccgggggatcttcgcgtagaagaactttctgcgcctgttaataattattagctactcaagttatgaaagttcagtattgtttttcctcttgatctttatacgtgctttcgatcaaagttcattcttaaccatccacttgcgcattattggaaaaattgaggacgagaaaaggctggactgttagactgaaaatctaaaagccagagagttctgtcacaaaaaaaaatggctctgtttcagtgacaacagcatctacgagtatttctttttgcaggcacaaggacgcagaatttgcagacgcacactccaaaaactatcgtgctgatgaggatatctcaggctctctgcatgctggtcctgcacactctgcctctctcttcccaactgtgcacgccatgccatgccatgccatgcaagcacacaggttgcaggatcgcgagcttgcaaactgcaacacacattctctcatcgggatctgcgtcgaatggcggatgcgagagagagagaaagggataacaacaagcaaagcagcgccgctgtgagcttttgcagtagcaagttggcaggaaaaatcctaaccgatcaaacggatcgagcagagattttcagatttcagtacgacgatcgacgcgatggcgaaaatttacagcgagagagaggcttagcatagctacgtactagtacttcttctagtactagctaggcttaaagatgaacaacgaatccgtccacatgttaacgcaatcatcatcagtggcgcgggttgttgttctttcgcacattcccatacgttttacatgtgcagtgcctcatttctttctcctattcttcttctcctcctcctcctcctctttctcgttctcttcttttgtgttttgggtgtatgtgcatcctttgatgccgagctctcccttttgtcagcagaggaaaaaaatggcgagggagaaaggtgttgcccgaaaatgccacggcgaggtatctgcttctgtgtgtgtgtgatactgtgatgtgatcgatcccgatgcgtttcgccgatcgatcaaaggggagcactgttcacgatcgcggcctccttttgctttcgttgggcttgctcaaaagaggatggggggtatgtagcctgcctagcttagcatcttcttgcccggggatttcatcagtacaggtgaaaatgtcaccgttaggccaatcattctcctgctgctgcccatctgtttaactgtttttgttcgaatatctgctgcctgaagtgacatcagacgtctttttttttttttgtgtgtgtgtgtggtttggtaaaattggtagcctgaggtatgagcagataaaaccagaggcaaaattttcagatatctattgttagtgcgatttgtaactaggaaattcagtaagaaggttcgttgtttatatttataagttaataacaacggaaatgctcagtttgattcgggtggaaacgtgatcttccaagaactgaatcttgctcatatcttgcattgtctgaacaaagatccaggacggcgattaatataaccacggctgtgaattagtttatggcacagcgttatctgaaccctctattccttcctagaagctcgtaacatggcccgtttcatgctttggtttctcactaatcaagacctgtaagtcacctatagaaaaaaaaaagatgctcctgtgtgcattgaggcacatcgcacatgtgagagatggagctactgttcctgatcaaagggaggctaggggtgcaaaagataaggtaccatgattaattatcattcctaagctcgagaaggggacaactttggcctcccatcatgtgcccggaacgctccctttcaccaatctgctaattagctcctcctactaggagcttgtttgatcagatgcccatcttttgtcctaaactcgcctaagtaggacaaatctgaagtggagaggacagtgacaaccgggtgccacttttgttctcttgctgtttgcatctgtttggttagtcttgcagggaaaatgaccatcctagcctgcaaaggaaacaaggagatggggataaaaagggaaagctggaaagggaaagttcatatcggctgtcaagaagaaaagcgcttcagaaggaatgtgatgctttcagattttgctttgactagctagggagaattacaatttacctgcaggtggttacttgtaggtttgtatgaggaatgacagtgctttcacgactgcatttgtttgttctagcactcaaatggtacttagcagatgtaataagattccattaacgagattccctgcaacggttctttccacgaaatccacaggccagaaaaggcctgcctgctgagtggattgactctggctgatttatggcacgaatgcgctaaactcttttaaaaggaacgtttgaatgtttgatattctcactgtgcattttagagtgacgatggagaatgaagttgtggagagatagcttcatgaaatatctgaagaaacatctccagatttatcagatatttcacgtggttcagactttagagttcacatcgtcacggcctgcccttttcttcagcttctcgtgtgttcggggcatctgcctgggaatatctgatgaaacttacgcgtaggacataatcaagcctggtgccccaagtcataaggattttttacatgcaacgcgacgagcgctgtctcgtgaaagtcaaataaaattgttgtagaactctacatgacttcatatcgctctcctgataagggcaaaaacaaaatacaggaaagtaggaaaccaaagactgtcaaccagtgctgttctctagtaaaataaactggtatttttggcatggcgttgctcggacttaattgatcatcagaagaattgtactagtagtgcttttttagactgatgaagctttcagattctagagtttgaactcgaagaaaatgaaggaacactgctgccaaagcatttcttcggaaaagggaatttggtatatacgtcaacattcttaacacgtttcttgtttgctactagttgccaagcgtgcaaacatcattataatgtttaatacagtgtcaacgggtccggcttgcctacaagattccttaggaccatatcaaatgcaaccaacaatacatctttctgttcctttttcattcctttccctgatgaataaatagtacagaacccactattgtgttcgatgattgccttttctaatcataggttaggagggaaaatacaatgatattgatgcatgtacatttattggcaagcctatcaacacagtatcatacggtgaagctaaattccttttcataagattggtctgagttataaaacaatgactacatgcatgacaagtgaaaaaaaaaagagagaagaaagtaaggtgatcaatcggccacccaaaccttactaacttgtttagttttaatggagtgggagcgtccctcaaacctaaacaactgttttatccttctcaatgtagtacttatttttctagcaaactattgtgcttcactcattaactacatcgtaattacctttcttaaagaaaacattaatattccataattatactaagagtactagtgcttgtatggatacattgatgaagggtaagaaggaaaactacatcattaaaagtgctttagaatgtgagaataatagcaagtattttgaaacaaataaaatactagaacaataaataaattgaaacgtatggagtaacatattacgaatcaagaaccacaagatataaaaattctcgtttgctaaactatgacatattagtacactctctctctcggattgataaaaaatagacgaactgtgctcaacgtacccagccaatgcacaaaatataaagagaaattgttttgttggaacagatctcataatttgaactacattaaaacagatcttgccatgcatcctcgaagaagaagaataagatcttgtggtccgagttagatctcaatctgatgaaaacattgttttgaatgtttagaacataaccacaaattaacaagaccatgatgtactcacaagtaggtggaaataactccaagcaagtgattgcaaaacaacttagggcagtcacaaccctccacctaggatggtgtctatggcattaactacattgccatgtagtacttttagcttatgtggcactatattaattaagagagagagtgaagagaggaagaaactgggtctcatgcaagacacagcttcaacacgagaacctatgtactagacactatcaagttttgcattgggagagaatagtgtcttcataatagatgaagaataaatatgattggtagaaaagagagatgatctatttattaatggcccactttaagaaaccatgggttgtagagtgtagtttctattgtgatgtcttattgatatggcaccatagacactacttatggacactatgggttgggactgccctaataagggagcgaacaccgcatcgcccctatgcaagggacttgagggatgattgaaatcatagctactgccattcttctcatctcctccacctcaccgctaccggaaaacagtacaatgagctaggatggtggcgccgaggattggtttgccacctagttttggtgcgaagaaaggaaggtgcaaggtgacgatgaagaaggcatgacgttgaaagcgacatgcccgggggggagggggcttcctccgtgagcatagatctggtgcctcctcgactcggtttggctggaacacgtgatgcgaccttacgatggtagacaagcaaacgattggtgttgagtaggttgccaatgtcaatgacggcatgagtggccacagatggcataggcaactgacacaggagaaggaagcgattgcggctgaggtgttgccctagggggaagggggggtcatagagtagcgtagtaagaaagcaactgagatggtgcttggacgaagcaacatcctggttgtttggatggtgatgacatggaggtctctaccgcatacgacggcttagacgatggcaagtgggtttatcctaggagctcctccccttcaaacggttggcatgcttctaaacctgatcactaggagcttcaagcaaagagggaggcgatggttttggtcggaagggtgttgcttggcggaagacaacaacctttggcatcggcaacatgttgaatgaccttgtggtagctaggtgtaggtggttgtccaacacattagaggtactgtgctggagacttttgtgttgtggcggagtaaaaggtactacattgggtgtgatctaggatatgataacccacgatttcatgatcctgcaaggtggaggtgtgagtctggtggattttgtgatgatatcctgcatctttgttgtggtagagtcagagatgctacatcggtgtagcaagctaggcaatataacaacttcttcgctttggcaacgaagattggaaggtacaaagagcttagggaaaaggccatgcctggtcttagatcaatgctggcgacgtcaacgttcgtgggcaattgggcatcatttctatccttggaggcgttataatggcatttctcttgcttaaatataaaacctagtatgttgttttggaccgaccttgataccgtcgtagatgatgtatctttcttgaaggcttcgcctagaaggtcatgctatatgtttgtggtggttgttgcgactaacgatagctagttgaagctgtttgatcgttatgccatgaacttgacaacaaagacttgtgatgggtctcggtaggttgtcattgtaggtttttcgtgtttctttgtctgggtttttatcggtttcacttcaatttattgtgtcgttttaaagtttttaggccaagtttcacttataaactttgtcgactttagttttctatcaaagtaggagctctctaccctttatgatggatttttatgaaaaaaaatatatagctctataccataagcctcccattgtttgtcccacagcttataagtagttgcataattttaaattttaaatttattattgaatttggctttagttttttcatcatagtttatttttaacacattgacttttaaatcaccaagacatactccatttgtcacataaaaaatcaacttatgactataaatcttgacataagctaaactagctgggtggcccgcgcaattgcgcggctagcacccatacaaaattatctattttttaatatgattttacttaaaatttattaaataactatcttattgtcttaagactttaaaagacaaaaccttatcatccccatgcttctaattttatggtttttaaaagtcatatcaattgctacaccttactttgtcacgccttctttatttgcttgctcgatccactattgtttctatttattctttctttttagaacctttaaaaatcggaccttatagtttttaaagttcatttcttgttgggttacatttttataaattttagaagtcccatcaaacgttgctagtatactcctctatggccagtccattgtctcctctctttattgtctttgaggttttaaaaatcgaacaaaattatcttttgggttcattttttactttctagaagtcatgccaaaccatcagcagttgtgccattgtactctatacggctcgcccattacctctcctcattattgtcattgagattttaatatcaaacatgatgatcattggggtttatttttttactttttaaagtcctgccaaccgccgtgaacatgttgcttaatggcatgtccaacgtctatccttttaatcatcatcgagattctatttagggttttgttaatatttttagatgtatcatcaaccgtcaacactcaattgctttacatgtctcatcaaactgtcaacggcttcgttactatactcctctaaggcccacctgcttcctcccctctttatttttttttgagattttaaaaactgaactgattgtcattagtgtttatttttctactttctaaaagtcccatcaatcgtcgtgactatgctgcttaacggcatgctcatcgttcctcaccctaatcattattgggattctatttaaagttttgtttatttttcttagatgtcccatcaatcactaccattctacttctttacgcgcatattgtcttctctttttattgttatttgtcatcggtgttctagagatggacttcttttcttttctttttattttgaaaattccatatttttcattccgatggtttttatttataaactatattcctatctgaactcttttaattatttttttgtttttggaatttattttatttgttcttccgaatattagtatttggtcatatattcttagatggtcctttattttaatagtcattgttttttattgcgaattttagttatgttcatagatggtcttttatttcaatagtctttattttttattacgaattttagttatttatagattgtattcctagttgaactcttcgttttccttttctaattttggatttttttttctaactctatgtggcccacacaattgcgcagctagcacccataaagaattatctaatcggtgcggtgttcattggcaaattatcacgtttatggagtgagtttgaacggtgtcccatgggccacggctaaaaccacgaagtcgaagtgtcctgtagcaaaatttgcctttgtataaagattagtacactcctgaacgtatctaagctattattaatttatttttattatgaaatttattttctttagaattcttattgattcgtattttaaatttaatttaatcccgcattgtgtttcatttgtttttcatctgtacggtatgtacttggcggtagtaatggtggcaataatcactgtacataaattgatatatatacatgtcttacgtcaaatggaaatgctgctagggtacataaaaggaagtgcttctatgaagaaaagaaaaggctgagtgcctcaatcggacaataagtcctattcaaattaagcttaagctgccttggttaggagtccgatccaagccagatcgtatatatttctatgtttgattttataatttcgatcagaatttattttatttttttatttcaaatttaatttattctcatattggatttttatattgactcttctttcaatattacttatttttaattacgaatttcagttatttttaaattatatttctatatatagattcatcttttattttttattatttattataatgagggagtaagagaggaaattactgcatagtagagtcctaatgggacttctgctcatgcatgcgcctgatttgattcacagtagtatttgtttcggtgcccactatcttggttcgtattgctttcccataaatctatcaggaattcaattttcatataaatgattgtattttatatacaactctatcgatcaatctacaccactacaatctgaatctactataattctatttttttcttcttttctccgattaatgtgggaatttctagcccctacagtgaacgtggtgcctccttttaaagctgttttaataatataactagctgggtggcccgcacaattgcacggctagcacccatattaaattatattttttaaatataattttacttaaaatttattaaatagttactcgttgtcttaagattttgaaagaccaaaccttatcatcctcgtgtttctaatttatttcagttgctacctcttacttctgtcttattagctcgctcgatctactattatttctattcattctccttggaatatttaaaaattggatctaaaagcttatagttttatagtttttagagtttattgtcctgttgggcttcttttttataatttatagaagtcccgtcaaacactgacattatactcctctacaaccgtccactgcatcttctctttattgtcattgctattttaaaaatcgaacataattatcgttaggtttattattttttactttctaaagttccgccaaaacgttagtgactttgtcactgtactcctctacagctcgcccgctgccgccgttctttattatcattgagattttaaaataaaaaatgattatcattggggttttttttttttactttttagaagcccgaacctttaaaaagtgaaacttcttatagtttttagagttttattgtctcgatggatttcatgttttttataatttttagaaatcccgtcaaacactgccactatacttctctacgacccgtccgccgcataatctttattgtcattgggattgtaaaaattgaacacaactatcattggaattcatttttcacattccagaagacccaccaaccatcagcggctctaccattgtacttctgtacgacccgcccgctgcgtctcatttttattgtaattaagattttaaaaatcaaatatgattattattggggtttatttttttactttctataagtccccgccaaccgccttgactgattgcttcacgacctgcccgccatttttccttttaatcgtcattaggattctatttggtgttttattaatagtttttagatgtctcatcaaccgctaccactctgctcctttatatgcctgttacttaattaatctcgtcatgtgctttagatagtcttttctttcaatagtttttttatcaccaattttagttatttataaattgtattcctagttgaaatctttttttctttttctaatttcaaattttattttatttattattatgttcttttgatatttttattttttttattttcaattttagttgtttcaaaattgtattcctactttaactctctttttaatctgcctaatttcgaattttattgtatttttatttcgaattttaattaatctactattgggttcttatatgtactctttttcaatattgtttatatttaattccgaatttaagaattttaaattgtatttctagttgaactcttattttcttttcttttttctaatttcgattttttatttttttattcagaattttaattaatctcgtattggattcttatatggactcttctttcaatatttcttatttttaattccgaatttcagttatttataaattgtattcctactcgaactttttttttatttttctaatttttaaatttattttattattattccaatattaattaatcacgtattggtttcctatatggactcctctctccatattacatgttttaaatttcgaatttcagctaattttagattgtacttctacttagacttttcttttctttttctccgattaatatgggaatttatagcctccacagcgaacgtggtgcctccttttaaagctgttttaataatataatagaatagatagatccaggttagtagataaaagttgattttttttattgaacgacgtgagtaagtatcaacgtttcatccataaattatttttatattgccaacaaattattttacggctaactgcgtatccgcttaaggctacatttaaacaaaacatgtttttagctagtgattaattaagtattaactattataaacttaaaataaaattatttattaattaaaaaatatatgtttagcggtttgggagggtgcatatatgaaaaaggagaaaatagctcactttaacgagctagtaattcaaactcagccgagctcgaccttcagaaccgagaatggccaatagattatgcccctggcccttctgctgccccgtccatttcccgtccacttgacactgatgcttcgcacgagagcagattatgccgtgataatcacctttggatcaagcaaatcacgaaaggacaaccttgtccaaatcacagggcgataaatagccagaacatggcgagatgcacaacgaagcagagtgtgcaaggaagagagagcgtgtgctgtggctgtgctgtgcgcctgtgcagctgtgctgcgtttgatcccccttcccctccctcggaaacggggaaaagcaaaacactcccaaagcccaagacggccagagaggaagaaagcaagcaaaagcagagagagagagagaaacaaggcagcagcagcagcagcagcagtagcagaggctagcagcacagagaggggccccgtgattccccccccccccccccctcttcatctttcactttccccatctcttttttttcaccattttaccactactgctgcctcacgcagtcacgacgctgaagtggtagtagtagtacgctctcaaaacccaaccttgaatccgtcacgctcactcacgcagctcacaggctcacagctgcagctacttactactggtacgggctcagggccagcagccagagtgaaggggaggcgaggcgaggcgagccgtgtcaatgtccaagaaatgtgatggcgcgctccggtgaggcgactggttaggttagccgaggagggggaggaggcgaggcgaggcgagggcgagatgacactgcagatggagccgccgccgccgccgccgaggcggtcggtgtcgacgagctgcgacctgcacccgggggagacgttcacgggcttctgcgccgcgtgcctccgcgagcgcctcgcggggctcgaggcgtccaccgccgccgcggccgccgcgccgggccgcaggtccacctccgccatccgctcgctcttctccaggccattcgtcgccgccggcggtggcggcggcggc

SEQ ID NO: 2681 - DNA, 51336 bp, Oryza sativa
  unsure (1)..(51336): unsure at all n locations
cagacgatgcaagtcgttctcctgcggccgcggcggagacgtgctcgccggtggctgcggggacgagccgcagcggcggtcgtgcgacgtgcgcgggaggagcacgctctgggcgctgttccaccaggacgaccgcgagcgcgtccgcgacggcacggcgttcggggcgttcccggcctcgtcctcagccgcggcagcggcgctcgcctctgaagtacaacctcagccgccgccgccgccgccgccgtgcgttcttgaggtgttcctggaggaggagatagctatggctgaggagtctgacgagattactccagtggtggagccaatcttggtggtggacacctccggggagatggaaacggaagccaatggtggacgggaggccaaggccatgaaggaccacatagatctagagtgttcgcaggccaagaagccgcagcccaaggacctgaaggaaatcgccgggagcttctggctcgccgcctcggtgttcagcaagaagtggcagaagtggagacgaaagcagaagctcaagaagcaggacgccgctggcagcaaggcagcagccgcagcaatgccgccgccggagaagccctccaagccctcgttcctccggcggagtcgcctccgtggagaagcctgctcggagttcgccggaggtcggcgttcgtgcgacactgacccaaggttctccctcgatgccggccgaatgtccgtcgacgatgtaggcttctcctgggacgagccccgcgcgtcgtgggacggctacctgttcggcgccggcaccggcattggcctcggccgcgcgcccccgccgctctcccgcctgccgcccattctctccgcgatggaggactccccagccggcatcgtcgagcgttccgacggccaaatcccggtggaggacgactcccagccggagcccgatcccgacgccgacaccccgggcggctcggtgcagacccgagactattacgacacgtcgtcgtcaagccggaggcggcggagcctggagcggaccagctcggtgcggaggccgtcattcgaagtcaccgacgcaaagccagtgctgccggcggcggccgccataacaagcgtcaaagattcgccgctaattgggagctcagagttctaccacttccagcatgccgaggacctgctcgaacaccaccggttcagcaccagctccctcatcgaagacttccccatgagcctggacgccgcgttcccgggccccgacaagaagccccggaggtggcgcaaggcgtggagcctctggggcctgatacaccgccgcgccgccggccgcaggggcggcgcgtccgacgtcgcggacagggccttctcggagccgtggccggagctgcgcgtccgcgggtgcaacgccaggatgcagcggtgcaacagcaacgccagcgcgcggagctctttcagcagcaacagcggcggcctcggcagctcgaggcgcagctacgtcgacggcaacggcaacgtcgtcaagcggcggcgggaggagtgcgccctggagcgcaaccgcagcgcgcgctactcgccggggcacgctgacaacggcatgctgcggttctacctcacgccgatgcggagcgccagcggccggcgcgccccggggctaccggccaaaggcggccggcaactgaggtcgcaatcgttcgcgcgtagcatgctccggctgtactgagttgtgtttttcgttgcagcagtagtggaggctcaatggcaatggtataaccataaatctttttttacatccttgtgtagcgcagtgttaattccgttcatttggggggttggattggatagaatggaggtttatctcataatcacctcttaatatcttgtcttgtgccgtagtatctggacaacgtactaactatcgataacgtgtagtagtagctgtagtaatgctgcaggccagaatggcagatcgaccgatgatcgggatcggaggatagaagctgcagctacagctatcctgcaaattctaaactggtgtccaagtcatggtgaagaggggtcctactagacagtgccgaattctgaattcgtttgacatggcgctgccttgccaagcggcagctgagcgctactactaggctcggccccggccgctaggctgcacctgaccgaccgatcccttcgcgaactgtagctgccgctgcctcggaaaccgttaaagtcgcgctcgtattccgctggtcccgccgtgccacacccccaagccccaagtgctgtgcgcgcgggcgcgcggcgtcggcgtcgtcgcgtcgcgtgttgcgttgcagctcgcggcgcgggtgtgtttgttctaccgttctactagcgtttggatttggtcggttggcttcacgacgctgcggggtgcgggccgtgcgccgcggcgggcgcgtgcgtgcgtgcgcacggggtttgttggggtccggcatctgtgggatctgtggggaggggagattctgatttggagggaggggaggacgtacgtggccatgaggccatgagggggggaggctcaagtaatcggcggtgtgccggatctaaggtcgatgtgtggggattatgattatcttatgcgtcgccggacatgtgcacgagaaaccacatgtttggcgaaggactcatcgaactggtactggaacacagttttttttttttttttttgagattgttaggaagggaaaccggagtttgcattgtaagcgttgaatggttgccataacttgtaccatgtcatttctttttcagtttatttacacgatccgcttggaagcaagctttttttcgccccccacaaacccttaatcaatgttataacgacgctgtcgtctctaagactctgtaacctttttttttatctatcaatgaaaagttcaggtgggaaaactctcctttccagtgttttatcaaaacaaatagtttatttacacgaaacatctatgcacacattcctcgcaaaaaaaaaaaaggatgtatacacacattcactagtatgcctgttaatacatggttaaaacgagaagatcagcaacaaatatctggcctttgtcgctgaactcttcaatatttctctaccggcgtgggagttatatttaaccaaggacctaagaggcgaaccaattagctagtgatcagctaaatggggatgcaagtgaacaatcgcactattagagtgaaaacagacaggtacaatcatattatgatattctcatatcttaacatatattttcctttaaaatcagagccagagccagatacgaatagtactagataacatatcactcatcccgtattctattcagtattatttccttcgaatcggattcaggacaattatctatttgtatctctagtttatatatatataaatataagaggcaattatagtgttagaagatatacaataaaggaaaaaaatatacaatattacatgtgagctcgtaaaatagtgattaaccaatattttatcatgtttgtaggtggatttataatagacttttatatatgttttataatataggacatacggacacggctacaagtctttcatattctaacccatatttttcatggatggatattatcgagtatctctttttctcccatatttttctcgcaagtctcggatcgggtgagtggctgagaaatacacgcctcattttcaacccaacacattatccataaaaacttgcttaataatttatttagtacaaagtttgaattttttttgactaggatgtgttatgcaaggaaaaaaaggttgcccaccctacttgcgttcttacaaccagatggttagaaagagaatgtgtcggaggtgaggtaaaaggtgtattttttgaagactttttgtcggctgctgcttataaggtaaagatatgtctgaagcgagaaaaataattttaggataagatttacatagtttttctctctcaagttttagccatccaaaagccaaagctaagtaatatttttttaaaaaaaactattatcaaattgtcgacgagtggtacttgtggaccggatgagttgggtattgaggtacgttagaacgaggatctacataatacgatatcaagcagacaaaatacaaggtttatactggtttaggccccttgtcaggtaatagccatagtccagtttatatgagattgatgatgaggaaccacagattacaaaggaagtaaacaaaacagatgataccgacaagatcgtagtcgatgaattcgacgagatctcccggcgacttggctccgcgtactctggcttcgtgaactatggtgggtgtgtatgcaatgaaattcgatgccttgcacccctccctaggggtcccttttataccacggatcatcttgacccccaattaaggcctggagatatttgatctggtacggtataacataatctctatcccttccaagtaggattttggaaatcacttatctcgtagagatatttccgtaatttgcaacagattccaacgacgtatacggaaacaatccatatacgtgaaagtataccttatcggtatattccataagtcgtaggataggaggcatgttttatccgtaaccctgacacaaattaaactacaaatttagaagttggttagttcaaaaaaaaaacatccggtctggagagggagttgtggaggagaaagagaggcgaaatgggttagagttatcaactgtggaatagaggcagcagctcatctccgtcatcagggagtccaaatctagcaaaacctggtctcgtagctaagcccgtcaccctagttgtcttccacagctcgtagccaaatctagccaaaaagaggagatgaagaggtagtatctcgaccaagcagtatcccttgagcttgcgagtcaccgagccattcttggtcgtccctcacttcgttatcatgcttcttcaacaagcacctatgcacgagggagagctggagacgaagatcattaaggatccgtcatgatttgaggttgtttggaacctctttgttgcaccaaaccacttgtcgctatcggggttatccggaggagcttgccgtgcggcagccagccaacagcagctacattgctgcaaccagccagcagaagatacatatgttgcaaccagccaagacattagcaagatacattgtttcctcgaatccgtccgctgctggcctgctgcaatctaacggttggcctgcgcagccgcaacccagggcggtaaagcagctccacctaataaccctatcgtagagtctggatttagactaaggtgtagatctggctaagtttgtgttgctcaccgttgtctagatctgagatatatatacggtggatcaactcatcaacccttaggttagtctccttccccctatctctatctcatctcgttgtcctcttctcccattttaaattcatgcctcactatttctcgtgttaccgcactatgttagttcttatattttgggataaattttaaatgatagatgtagctatatattttggtatgtagggagcatttcacgacacctaaacttttaaattaatgatatgttgttctctttacatttgactttaaaatgtaattagcggtggaaaaacttgaagctcgtgattcggatcgacttaatcttgtagtcataattagtcgaaccgaacgggcttttagctcatgagtttatcaagtcagttcgcgagctgctcatttaggttgttagcataaatatcacaatatctaattatactttgtgccgtttagccagtgcttaatctttagcgacatcaaatcaattttatgttcacatacgtataaatttaaaattatagaagtggtataaacaagatgattttttttttgccgggaacaagatgaaggttgttaactacttcctctgttccacaaaaactcaaccttctagtaaaatgaatgtagacaaagagatacccaggttcattgcactagaaggggtcacatcccctcgtaggtttagtttttttgaatggagagagtagtctactcgcgagtcgggctgaatttttaatcgttaaggtcaatgagctaagttaaacccaaatgagcctaatcttgattcgttaagggggtgtttgggtganaggtnctatnacccanacacccctaaacattcctacatggtcatcagtcatggacagttggagttggacacaaggcgattctttccgagagcgaagcgagagtccatcgacagggctataccacggcggaatgaatacgatgagacttgattgggcattcagatgtgtacgtgatggcgagtgaagtggcagcgcagcgcaggcgggccagctagcgcctctgatacccccgctgttaactctcgcattcattgctctggctgccgcagtgaaggcgaacacatacgagcgaatatatggtgatgctggcttatcgcatcgacgttcctttgcgtgactcttcgctcgttgtctcatctcatcttctcatggagagagccatctacatccattccattccatggacttctcctgttaacagttagtaggcaaccgaactgacccgactgttagtatacgtgaagtagtgagactcgcgtggcataacgtacaacatgttgggtttcggctgttctacgtgggccgtgcagtcagtcacacgtagtactactctctcggctgtggatatactccactgtggtgcggtgaacaagaacagagatccacggaacaagtgcacggtgcacggaaggcgctgtactgtacagtttgtcacctccgagttccaacccgtttccattacggcgaactgtttcggtcttttccgtccggcgagtacttggatccatggttcagacgcagtaatcaactgccagatggtagtaacagtagtactactagtagtacctgtctcagtgctggggagcgggaaaaagaacgcacagattcgtctgaaaaacatgctcgtctgaatttttactgttgcctacccaagactgaatatttgttcatctccttgcggtagaggccgtgttcgacgtcgtcggcgttgttgacgacgaccgcgccgacctctccccgattgcgtgccgtgccatggccgtcggacatgtcgggggcatgctctctgctgatctctctaccaagatcaccggccgccatgcaccgtcgcgatgaaccatgtagatcttggagcagaagagggaacattgaagcagaacaagtagcatgaactatctgcagggtcagcattggcctggttagagttgactgcggaacaatccccaggggagcacaaaatcgttctccaaggagcgttgctcccatccagcaacttgtaccggcaggtactggtaccggcaggtatagagataaattcatccatccatgttagaagggtacgatcggtaaacagagaaaggagtcgcaccctcgctttctcctttttgttctttctctgtttcctccctccgtgcggcgccgctttctcatctaatctccttttttcccctccctccgagcgcaaccccacccgtgcgaagcccgcctgagccgcgcgcatgctcgccccgcatccatgcccccgcctgtgcgctcgcttgctcgccctgcatccgccgcccgcggcggcggaaccagcgagctccttcaccagcggcttcattcacacccttactcgaattgcagtgatcagtaaaatgatattgcagagaacaagcaacgattgagctcatcaaaacatccaataaatcgtacaatacaaatcctataagtaatgaagaagaagagcatatgcagcccagaaaataaaagtatctactgctgcaaccaaccgaagctaatgatttagatcggatgaaaagaaatcaatgcatacactgcacatcgcctgctaagatgactccatgaccacctcgccgctgcagccgccacaacgccggctccgacgaccacctcgtcaccatggccggcaccatcgcgcctgtcaccacctcgcagccaaggctgcccacacaccagccgccgccgctacctcgtgaccgcggccaccaccaggccaccgccgcgcccaccaccagcagcaccaggccactgccgcgcccgccaccactgcacccaacacaacctcgccgcaacgaaccacttgccgccaccgccgccgccgccacctccgcctcaaacggatcagacgccgccgcctcaaatggatcagccgccgccacgccgcctcctcccacgaagcaagttgccgccgacgaagcaacttgccgctgccacgctgcctcctcccacaaagcaagttgccgccgccgacgaagcacgaagcaactcgccgctgcctcccctgaacactcctacgcgaaaaagacaaatttacccttccaccactcgaaattttttggtacctcctcatgggcaaatttgtacctagaggtaccacttattttccaccgtccgatttcgctgattgaatggctgggatttggtaccggacagtcccgatggtacctgctggatgggagcaaaactcttctaagtggttttcttgctttgtctgaaaatgctctctctttcgtgccaaaaatgtagtattgacgtaaaaatgacaagtcagattgatcatagcatagttgagttagccatggaaaactgttcttcaggccatgctgccatgttagaacacctgtaaggattttcttcgaagctacgtaaggctgatcccatgtatgagtgatcgcagtgagacagttcttcaaatcatttcagacttcacgttttcatcacagcgagagtgccagtgacttggggtttttgttcatgccttcacagaatcacatttcctccggtgtaacgcaacgtcgcaacgagtgcttcgccttggttggtgtagttgcggacgagtaaagacggaatgcattttaaaatagacatactctaacgattatggataacagtatgtctgataaatgtacaacaattaatagtatgcccttaacaggtgtcaaatactaaaaatttagtactactagagtattaaattttggtaggagacgtaaatgaatacaggtgttcagaccccttacacctgttctgaagtgaatcgtgagaaaattcatcattccaaaccgggtcgtcaactatttcgatgagagaattgatcagcatatgtgagcgctagagcttgttaccttgagtgggctttcaacaagatatatatatagaaaaaataacaatcgcggtcgttcgagttacccccctcaactctaataccagttatttttaactctaaactttataaaccggatgaattaccccctatgtcgatccagggcagttttgatcctacgtggatgcatacatggcactccagtcagcaaaacaaataaaaaagatatgggacccgcttgtcagccaaaaacaaataaaacatggtgggacccacctctctctttcccctttcccttcctctcaatctctctctctctctctcagatgtcaccgggagcggcgactaggtggccggcgatgggcgaggcgggcggcaggcatggcggagagcgggcgacgggcgcggcgggggcgggtgtggcaagagcgcggcgtcgcggcgaagggagtcgcactcgaggcggagggcgtcctggcgggagcggagggcggtgtcggtggccgcgtccatgacggcgacgcacgagatggagctgcacaggagggccgcggccgccgctcatccctttcccctctccttctcttccgattccctatcctttccagtgcagcgacggtggtcgggctgagaaggcggcgacggcggtctgggcaaagaaggcggcggcgtcggcggtggttcgggcagctgcatgtacatgaggcaggcaggcaggtagcaagtaaggtgttgatgagagagaagaagaagagcatatcatgcaactaggagtaggtaggacgggcagccggctgctcctcgtctttgtagtagttgcaggtgatgaagacgccgccgttgaagcactcggcgagggcgcagccgatcctggtgaagttgagcctaactatgaagacgaagtggccgcacttgtggaagtcgacgccggcggtgcagttgccggtgtccctgtcgtacaagtgctcctcgtacaagtgccgcttaggcaatctctgcctccgccgccggactcccaggcaactgaggcaagctccgcctccgccgctggccacgcgggcgatctccgcctccgcagccggacttccggacgagctccgcctctgccgccggtcgtccgagagtgtgtgcctcctccgttaccagccgtccgagcgcgtgtgcgagacagagagagagaggattgggttgatgaagggttatgacaggtaggccccaacggttactttttttctgactggattgccacgttgacgcaacgtgtacaagttgaagtcaaaaccggtcaaaaacagtgtgaggggggttatatgtctggtatgaatagttgagggtgtaatatgtctggttttatggtttaagggggggggggtaattcatactgtcgcaattgttcagggggtaactcttactttttccatatatatatgaaaaactcctctctgggctcttcaagcaaaaatggcccaatgggcaatgcccaatatggtgttttcttgtgttgtaatatggacttggctatggcaagtctgaccagtttgccattggtactctctctaaaaaaaaaaaaaacttggccattggcatattaaaaccttatcttgtgttgtacacttgtactatgattcagtgaagaatactagcacagtagcaccactatctttctcaaacctccgacgaatgcattcgaaaatttttgcaatggactattccttccgttctgaaataaatcaatttagagttggatgggatactatctaactttatattttaattctagattgatttattttagaacgaatggtgtataatgcgatgctctgggttatggtacctttattgcgtcgttaactcgttatcttgaattatccatcacatctgcgtcggctggtgacgtgcttttaatcatgcaaatactaaattatccatgatcatgtacgaaccacaggaaaaagaaatagctctctctatctacaaatataagcactcttgtctcaactaatatggtctagtggcatatctagtggatgtgcgtaatccaactaacatagaaatacttaaaacaacctaagtacataattgatcatgagcttctttcctttttcgcatacttctcttctcaggttttttttcttttttctttacatgcatgggtcttgggctaggtttttttcttccaccgcctaactagccactcagacacgctttgcgcgactataagcactgacataacctgtttgtattattagcgggccatcgagaagagcttgtggttctcttcacaagtggtttcaatagatgggaattagaccagaccttgccgatgtgcgctctagaaaggatgtattgttgtcccacgccagctcatcatatgtggggcagctatgacacaaaatccccaaataaaatcaagtactacctccgtcccaaaataagtatagccgtaaatatctgtgcacaacgtttgaccgtctgtcttatataaaaaatttataaaaaatttaaaaatatttagtcacacataaattactatttatgttttatcatctcatagcaataaaaatactaatcataaaaaattttcaaataagacgaacggtcaaactttgaacgtgaatagtgcaaaactgcacttattttgggacggagggagtagtagtatggctgtgtttagttccaccggtaaaaaaaattgccaggtcacatcagatatacggatacacatttaaagtattaaacgtagactaataacaaaacaaattatataatccgcatgtaaactgcgagacaaatttattaaccctaattaatctgtcattagtaaatgtttactatagcactacattttttagatcatggcgcattaaggcttaaatgattcgtctcgcaatttacactcaaactgtgtaattatttttttttaatatttaatactccgttatatatgttcaaacgttcgatgttgcacaatatgctctgagcacatgctatggcctgtcgctagatagtacagtagtttattggaaatagcacaagttcagaaaaagattatagaccggaagcctgctagagacctctagaggaaaaaaaatcagatggtacggttttgtttgatgacatggcgtaatacgtagtaatttataggtaaattttgctatcggacatcgtaattgtgtggttttagctcagggtctctgaaagtaaagttttgggggaagacatcccataaccgtggacatttgcctatggacaccgtgccatctgtcgtgctgacgtggcggacgggaggcccttttttaatgtggtcggacgtaaatacccctgcgcaagagataataaggttatgtggggcccacttgatagtgtccccctcctcttctttttcttctctctcggcttcttctcctctcgatctctccctctcgtttccctttttccccacgcgcgtgcgcgcctgagcgggatggcaggcgcgcgagccaagagaccggccgtagcggcgcgggccgaggcgacggcggcggcctgacggcgtcgggtggatggggaggcagcgtggcggacggcgacagcatcgggtgacgccggtggcgaacaagccgccgagcaaggccatgggcgacgccgccgtgacgaaggcggacacaggcggcacgtcgcggagtgtgcgccagtcggcactgttgcacttgaagcctgagccgaagccgatctgccagacacggtggccgcgatggacgcgccccttggcctcggcgtaggcaagctcataccagagcgagccgctgctggtgttaattgcatattaggctcaacatcccatgttaattgcacatgcggcataggcacattaggctctctctttgatttcctgcatcaatcaagctaggcttggttaattaatcaactcgcagattattgtatatcactcatcattgtttgtactagatcaaacacttttgtgcgtgcggttacctcgatggcgggagcaagagcaatggcaggcggcggcggcggcgcgagccaaatgcagccgccgtcttcgctccaccactcggctaccgcccgaggcagcagctccacttccgccgacaggcgtcgtgcgggccggcttggccgcgcgcggggtcggcgctcgcagcgtggtggtggccccgagcaagacgaagatggcggcggtccgggtggcgattcgtccgggcggagatggaggtcggaggtgctgacaatcgtggtggcgaagcagcagtggcgcgcgggtggtgctcgcgcgggagatgtggccgcgcgtggcggcagcggccaagcgtggcgacggcttggcgcggcggcggagaggtgaaagaggtagttggcggcggtggggagtggcctgacgagaggacttttttttttctgacgtggcataagggtatttacatccgaccacgtcaaaaactggacttccgtccgccacgtcagcacaacaagtatcctttagacgatacagtgtccatcagcaaatatccacgattatgggatgtcttccctcaaaacttcactttcacggtgtccctgagcttaaaccacaaaattgtgatgttctgtagcaaaatttgcctaatttataagaaagctcgctgttttcactattttagatatgctactaatatggtcttccatacactcctttgaccatgactaaatgtaaaattgaattatttcaaataaaataatatcagcatattatgatagtttgtttaacgataaatctatcaacatcatttctatgtcattggttgttatgattttttttctttcaataggtaaagttaaaaatatttgtattattattattctaaaagtgcttatatttatacatagagagagtatctaaaacaatataaacaatataggagtatatgacaaaccccgaggttacgaaatacgaacatacttgaaagtcatgccctaatcgttgaacttctttttgcattataatataaaacgtgatcttacctgagcgtgaaatttgccatgtaatcccaatatccttatgaaatagattcatgtgagacgtgtacagactccacagaattagagtagtacgccagaaacagaaaatgccaaaaagaacaaacgctttagaccggcatcggaggtagcaagatctgtttgcaactttgcactgcgacatgatcgcggtggcagaccaacaagatgccaatctatattctctccgtccttataatcgttgatttttgtttctataacgtttaatcatcatatatcatatttaaaaatgtagtataaagtatgacttaagataatagtttcttcaataataaatcaagtcacaacataataaataatatttatgtaacttttaataaaacgaagggtaaaatcgacaccatcatacgtttatagagggaatatttatctttttatatattttcttagtctcataaaaaaaaagtaaattccggctatgaatttagacataggttacatctaaatttatggctagatgttgattttttataacacggggaagtacatgtcttgtcttggttatatctaaaaatttatggctagatattgattttttatgagacagaggaagtaactgtctttgtctttggttacatctaaaaatttatggctggatattgatttttctatgagacgaaggaagtaccctgtcttgtctaaaggcaatttgactgtgttcggatgtccctttttccaaccctccctcccttatttttcgtgcgcacgcttttcaaactactaaacggtgtattttttaaaaaagtttatatacgaaagttgctttaaaaaaataaattaattcattttttaaaaaaagtagctaatacttaattaatcacgtattaattaatgaatcgcgctattttccgtatgtaccgtagccggttggaaaccagcgtctgcgaacacaccctgaatgaaggaggactgggcggcggtcacaactccagagtccacaccaagcagccccccggcgcgctgctggtcgcacacgacaagggtgcgcgcgcgtgtatcaccggctgcactcggccagtccgccacctcctcctgacctccccactcagaaacgtaggtaagactaacaaagaccagtccaccacctggccggtcttacattctcagtttctcaccacggtcacgccgaacgaacgagacggcggtctcgctcgctcgctcgctcttcgttcggcctcggccgcgcgaggtaggtggcgcgactcggcgcggctcggctaccgatcgcgcgtccccgcaatccttgaccctttccaaatcccaccaacacgagccctcgttttaaatctactcgtgctacgcttacttgcttacacttgacgaaccaacctcactttctccccgtagctggctgggctgtggctcgctgctctctcatccgccacctaccgccaccaccttccccccacggtccagctcctcaccgtcgtcgttcgtcctcgccgagtcctaatttataccaacccatccaccgggcgatcacacgcacgcacgcacatggtcgattggttagctctctttcccattgccatgggccgccgcctctgatccccctcgcctctcgctaccgagttgctggccattggttggttggtggatcgggtttgtctcgccggggcgcgggggggggggggggggggggccccatggcgtcaatcaggtcgtgcgtgtcggtgaagccggcggcggcggtgagcccggtcaagtacaaatccgcgagggtcggggcggccgggttggacccgaaaggcctgaggatatcttgctcttcgtcttcctcgtccttggccgcaggtggtggtgatgggtgcagggatgccgggtgcgccagtagcagcggcaggggcagcggtgtcgttggttcggttggcgatggttggtgggggaggaggggcgggcagcgggagcgggccgtcgccgccatgtgcagcgccggcatggagggggtccggcacggcgccgccgccgtggccagcgtgccggcggcgtcggcgtcggcgttgccggagcgggccaaggtggtggcgctggtggcggccgtgatgctgctctgcaacgccgaccgggtcgtcatgtccgtcgccgtcgtcccgttcgccgcgcagtacggctggtccagctccttcttgggcatcgtccaggtactcggttcggggtcttctttaccttcccagttcatgccatctctttcacttcacttcactattagtagcacatcgcacaggttccaattcatcgaaccttaggcaagaatctctgctctgtcactagcaacaaaatgtccaaaaccataattagttcatcatatagcaacaaagtcaacgaagcatcaacgtcacaatcgcgacaagagaatgaccggaacattacaattagtagcacaaacagacaattatggcagtccagggtattagctcctttctgtgtgcaggtccagtgcaaccgtgtagcaaccaagttatcttaatacgattgttttgagagtggaacctgaaatgaaatttgctatgtgcttcacacatgaatcgtgatgcagttttctatttataagatatatgcttagctttagtggcttccacatagatagtgtagggtaccaatttggaagaaaccaatctgtgcaggcataaaggtcagggagcaacttgaggtggtatcgaataccaatatctcctcatagtggcaatattggaatttgataactggaatactaaaacatgcaacccaactgagttaagcattgcccctcttttttggtgatggagttcagcacttcagatttacttggtgacagaacatgaatgtttcataacaaattaccagctagcttaaataccattgcaacatttgaagtcattcgataacaaaaaattgtttccctcaaataaagaacggcaaaagaatttgtgcatgcttattgtatatacacttgggcaacaatatgtcttgactagatggaggttcacataaagaagtcatcgtaaaaaccaatatgccgtaacactaccggttctatatgaaattgtcaatgtgcataactaactaggccagaacaaacacagcttgctcttttattattatgtcatgcgtgattaatgatttccagatggattgacttgaggttaatcttctcatcacctgtacagtcatcttttctttggggatatgttttctcatccatggttgggggagctttggcagaccgatatggagggaagaaggtgatggcaggtgctgctgccctctggtccttggccactttcctcactccatgggctgcttctcaatccacaattatgttgcttgccatacgtgctctctttggccttgcggaaggtgttgcatttccaacaatgagcactttcttaccaaagtaagttgctctatattattttctgtgatgccaattctagttgttagagattagagattctggacaagaatttattgatgcaatcaaacacaatctcatttcgggctttcaatctcactttgaacacaaaacaggtggttcccaacacatgaacgtgctactgctgttggcatttctatgggaggattccatcttggaaatgtcataagtttcttagcaacaccgatcatcatgtcacatataggcctcgccgggacatttgccttctttgcatcacttggttacttgtggctttctgtatggttgttcaatgttgaaagtgaccctcttgacagtcgtacaataagcaaatctgagctgcaattaatcctagccggaagaagtgcatcaaaaattcagggtagcaaattcccatccttacgagaaattctgtcgaagatcgaaatgtgggccatcattgtagctaatgtggtcaacaactgggtaagattgataaatcagttatctacaaattggtgttgacatatctatctaaattttaacttccgtgagttcgaaatactatgcagggctattttgtactactatcatggatgcctgtctactttaaaacggtatgttgtctaaggtgttcaaattggtcactgtgacaacgctgctattaagctaattcctgactgctatcctacaacaggtttataatgtcaacttaaaacaagcagcatggttcagtgccataccttgggcagtcatggctctgtctggttacgtcgcaggagcttctgcagatttcctgatcaaatctggtttctctgttgcattagttcggaagattatgcaggtaacagcaacacctgaaattagacttgtgcagcacttggaagttactgatagcttagcacagccagaaacataaaacttaccacaattttgttctctattcatgcttggtacagtccatcggttttatcgggccaggcgtttcactgctttgcttaagatttgcccagacgccatcagttgcagcagtcctcatgaccatcgccctgagcttgagttccttcagtcaagctggatacttctgtaatgtacaggtagtgtttcctgcattaccctgctcataccagattccgccttaactcgaacaacctttttttttcttcttgttcaccacctcaattgcaattgtaccctatctgacggaatgtgttcttcttgattgttcgagcaggacattgctcccaaatacgctggatctctgcacggtgagtccacaaactcgatcagctgtacacaagacccacaccaaatgaacgcactccttggatcctgaaatctgacatatcttcttctgcttgaacaggactgacgaacggcatcgggacagtggccgccatagttagcaccataggaacaggctacttcgtgcagtggctaggatccttccaggccttcctcaccctcacggcggtgctttacttcagcgccaccgtcttctacaacacctacgccacaggcgacctaatttttgactgagatgatgacattacccctcgtgtaaaatctcgaagtgtagtacttccaccattgtttctctcctagtcctatggctgagccaggaaaccaataaacagatgttgattgaaattgattgattgactgccatttttggtgtaaaattgagtgcaaccgcggttacttttgaggaagcaaatcgttaatacaggaaaaaggggtggagccgctcatacgcggttcaggtgttcgacgaaattaccgagccacgcgcgcggaaggaagcgccggggaggggcatggagcggcggtacccccatggcgcgcgcgcgcgcgcgggggggatgctggctcgccgccggtggcgccgcgatggaagacccgaagaggcgagcagccgactgcgcggcgtcggcggcgtcgcgcaaatccatggctgcgaatgcaacttttcggccgtggatgtggtatgtgtggtggggggcgcgtgcgtccgttgctctcgggtgagaaacgtgggccggtggattgagtgggattcttcgctttgggctatgtaggccaatccttcgtccggcccagctaaaatttggcctgtacacgtttggctattcaccggatcatcccatatcctcttggtatttcctagctcgaaatcagaatgaccataagctgacagaactttttatctggcaatgacccattttccatagacacacggaaaatatccttacagcaaagagaaaaaactgacagaactggtactctatccacttacacggttacaccaatcattcatgatactgagttttgagtatgaacagtgaagttgcatacgacaagttcacataaaacacgatgaagagcaggacagattcatgccttataaaccttgcagttgcagcgctttcatttctctacctttctctgagttcctccgatatacagaagtggctgctctatgtgctctttattctcttcagatgatttataaaaagattcatacagcagaagggaacccggtcaggactcaggagtcactcctgctaggcttgtttgaaactggaataacctggaaaaggaacacagtagattagtaagtcaccagatgaccatatgcaactcggtattggctagtccacatacatttttactgccataccgtctctgaggatggtatccaatcatttgttgcagggttgctcatgcagcggataatgctgtcagatgagtaggcaacggttgtcacgttgaaggagctaccattgggtctttccactttgataaaccctgtaccagtctgtaaagataacaattaactcaaccatttcatagagtattgtcgttttgttacagaatgcgcatggtggtgaaattagaatcgataatctgttgttcatggaaatgtattctatataaggtacacatgtttttttttttttgcgaggatataaggtacacatgttagtgcccctgatctgaatgatatgagccatcacatgtgacacaagaactccacatcagaactttggaattcctaacaatcatcaaccattagttctctttgcagggcctaaactatatttatgttttccatgccagtaccggagtgagcaatgaactgctagctagatacaagaggcttcggaaatgcacaagatattactggcaagtggcaacaaaatgcacggcaatgagtttaggtatgtaatggttagcatgtaagttgttttgagaggggaagactacactatacttaattttcatgacagactaaagactccagatttgtgtatgcattcgactagacagcagagtctattaagagaaatgcttgtgcaagaaggccagtgttccggaatcgcactgggaaccagaatcgacagatatacagcttatttgagcactttggttgcaatgacggttcgttgcaggcttgcagccagttataacattatttgatagtatttcaagggaaatgctatggtgctcaagtcttttttaaggttctcgtgcaaacaaactttcttctctaacgaatttatgactaacatgcgtcttctcggaaaattctagccattcaattgaagactaggtaacatgttatttatcgacaggtatttgatctcataaaacaaaaaggtcctgaaaaatattactaacaaattctttactggtatatcaaatttctctaaagaactagtatatgcccacatacccacatctacgtgctataaatttggtgcttggtaggcttcataggcagttaggcacaacaatactacaaagcttaccgtgtggtgttgcttgtcgatgcaattgagcccgttgtagtattgcgtctccacatactcctccccgttcacatccccaccgtccagcaccaacttctacagcaacagtcagtaccaattagtaccaaacagcacgctcacatcgatcgattcagcagcaacaaattaacaaaaccagaattccacaaggacgaacagatcgccaacctggggtttggcctcgaggtcgcggagcctccgaagctccggcaggtcggcgtcggcgtcggcctccgccccaccctccccggcgtccgacgggtcgctccgcggcggcttggaagggcgcctgggggccatgctgtcgaagtagccccgcacctcggcctccacccgcgccgcctcctccggcggcaggtgcgggtcgctgcgcgccggccgcgtcgtcgccatggcggctcagctcggtccaagactgggttggcgggcggtggagtcgccggtttccggggggcggttttgcgagcgcgaggatgtccggctgacaggtggggccctggtacgtgggcaaggtggcgatgccgtgaatgtggatgagatgagatggggacgtttgatcgcgattagctggggttgggccgggcgaggtggcccactgttccgtgagccgtgtgaccgcgacgcggcgtgatggattttgcgagacggcgaagtcgagaacagtaacaatcttcatgtgcccgtgcaaatctcgcgtgctagcgacttcccaattgtaggatgtgatgtgtttctatcattgttcaaagtacaagaaattttcctttattttccaagttctctgtttttcactggcattcatgtattcctttttgttcttttatttctgaaatcttacttgacaacatgatatacctttctaaattttagtttggtttacgtcccaaaggatttccaaccgaccaaacgaataccttcgcatgatatcgtgaaagggaaaagtccacttttaactctctcaaataaagatcgaatctaattcatgtatcatcaattgtaaaatcgagtgtaacagctatttcaactattaaaaccagtagaaaattactcctacgacaatattgagaataatattggttgacatggcatattgaccacagtcaaaaacaccgagtcaacaagaaaattgagaatactatatggagcccacatgtcatcctcactattctcctctgtcttcctccttcctctctcccccatctctctcttctccttttacgaaggtagttgttgatggcaaagaggtggatggggaatcggtgatggcccagtcccgcctaatgcgcccacaccactttggcatgtcgtcatctctactacgatagctggactccacaaaagcagcggtaactaacgaacctgtgataaattttgtggtcagtcacgcatccagagcttggcaagcccatgcaacatctttctgatataagtgtgcaggatggaggggcccaccgtatcccatatctaggaggggccggcgatgggggccgaggctgattgacctcccttcacgtcggtttccactgcagtcactagcctgtagcccagcagcctcctctcagaagccgcccacatctctttcttcctcctcttcctctctctgctatggtaagtgataaggcccatgagtcggagatggatcgagcaagggagggacccgaggctagtggttgcaacagggccggtattgtcgaaggggaggtaaagcggtggggcagcgcaaagaggaagatgcttttctgcgagcttgattgcaaaatccattggagaagggatgggcccccgcgagcatgagactgcatcatcgtcgcatagggtggcagccagcaggtcacggctgtagccacagatgatactaccaatgctggaggagaaggcagcatagaggctcatggggagagagcgatggcggcgacggaaccccgacgtggtcggaaggctatgctaggggccgctccccttccttctaccatgccttctccttcgctcctggcccgccaaagccgtcaaccaccattccccaatcgagctcgtcggcgtcatcgctatgtgcccatgtggggaaaggaaaagaggacaaaggaacataaaaggatgagaggagaagaaagagccggtgacactaacatgtgggcctcacatgctgactcaatcaattagacctagtcaataagtcacgtcaatgaaaaccactcttcaaactgctgagggagtcaaaccacaacggtttcgatagtttgtcaaaccactcttcaaaccgcaagatatacgatattgtgtttaggggcacgaattagattggaggtatactcgagggagctaaaatagacttttccatcatgaaaagccaggctaagaaatttgttaggtttccatcatgcgttagtttccagatccaaaataaagccgggcccaaaatatattcctcgatgcaatttgtcatggatcgcgattactgctagcgatatgggcctaccttgatcaagccaccaccgcgtgggttttagccgtcggagctgcgccgccgaatcccgccacacagcccatcatccatcagccccctgatgacgcagcgccgcccctcctgcggccgggcttccgcctccggcgagggccacgtgatgcgcgccttcgtccgtacgccctcgccgtcctcacatcgcatcgtcaaaagcttccgcaacatttcttaggctgtgtttagttcatgtcaaaattagaagtttggttgaaattggaacgatgtgacggaaaagttggaagtttgtgtgtagaaaagttttgatgtgatagaaaagttggaagtttgaagaaaaactttggatctaaacacggccctaattccattccttccaaatttacaagtaaggccgttcacaatgcaaggagctggcattcagcctgagtcctccacgtccgccagcacttaagattccatgccacatttcttgatggcccaccgaaatgaagagaacctgtgaacctgtgaccaaaacctgccactcggtctttgatgatatcaaggcaattgcagtgcgtggggctttgcctcgcctttgctctgcatggatttcgctatgtgactcttgtgtcttttgaaggtcttcatcctacttgtcagttcaggacgagcaaaatgcaaaacgcattgctattgcccttaacaagctacaaattggtagagggggacggtcttagtccttatagattacatcaattggtgtgtaaactacaaagtacaatcttttaatgtgtattcccatcataatctctgcttgtgatttttagaatcgctgtcagcgacacgctcaatacacaccgaaggctttagctgaagatgacacttcacctgtgcgatctacatcttacgtgatgtggcacggaggaacatagctgccgccacaagtgttcagacatcacagaacgctttttctggagtaaatgagaattatacttctactactaggtgtcagtcgctcagaattcagaaacatatcaagaatcaaagatgctgttaggtgcccggtggaacggacgcaggtatgcgtcatttctataagacatgatccctccatcccaactgcacagatcagacaagttgattggtaaatacatatagtgagaactgaacgctgaaagagagttgtaaaattacaccacattggaaaatacaagttgattggtggtgtaattttttttcgttttttcctagctacgacccttcagagttgtaatcttatgattttttttgttttatccatagaacttcgcaccgtttcgtgcgagtcgttcgaaaaaaaagctgaaagagagttgtaaagctccagccagcagggccaagtgttcatatgttccatgtttctgtaagtagccagcctaagattttctcaggtgatctcaccgagcttgaaaattctgcagatggtgatttctgcagccatgaatgattcttaagccttttgcacatcatctttccctctccctgctacgtgctggtttggaaacctttgcgacctcatataacaaagagcagccacaagctttggagaaacctttatgagacctttcagctcaacaatccatattgatctcacagcgtgcagtttcggggtgcggaaaagcgacaggtatagcatccctgattggtgtgtagtgggatgaatcacgctaaaatcagttcattcctcctaccgataatgggcgacgcactgatgaggtgcagaataatacaagattgggcgtcggagatagcctataaaccactctatggatttgacacgcaggcatgtgtgcacatgatccgttggggctaagatcaaggaacacatcaagaagcaagctctttgaccggtgatgtatttcttatacgggagttaagctagtatcactctctaagtatgaatcactgtactgtattaataattcactggcgtatagtagtgctttagatagttagatgatgatctgacaggcaatttgcttgtccatgggcatgagttgggctgagctaagtgtgatgtgagcaaatgtcaacatctgacgatggccgatctcatcttcattcatactctttaatttagtcatgcaaaactgataaaaagagagacaaatcgttcctcgtcactcacttattggaattgatcaagagcaccgttgacaccaaactagtccacaaatttgtatgctcttttttttttccttcatgctgtggcctcaaaagtcatctttttttttttccttttcgtggtcgcgcgcgagttatgattgcattttattcagaaggggtcctaatgagtctggacgtaagagggcggttgcagaggccacttgttgttttgtgtaataaaatttgtgattaggacgtgggggagtttggattagaaacatgtactccctccctgccccatattatatactccctcagtcccaaaataaatccaatcctaaagattcgtatttagaattaaatttattttgagacgggagagtataagttattttggtttataagttaactttgtttaagtttgattaaatttataaaaaatgtgataacgtctacaatataaaatagatatagtactccatttgttacaaattacttgtcgttctaggtttgttctaaattaaatattttaatctttgaccatcaatcttcataagctcatatagtttaattttataagaattacatttttttattatatacttcacatgttattaaactacatagatttctaaaaagtaataatcaaagaaaaatatgtttgacttaagatatacacggaacaataagtaatttgaaaacaatgctgtggagattatgggtaccccatacccacacggcatggttatccgactagttataggggataacttatatatatgtaatatgtaacagatcatgacttgggtgttacgtttccttgtatattacggaacggcctaaagtcctgatctaggaaaccgataccgtattggttaaggtttctatcttgtaatcctgccccccatcctatataaggtgggcaggaggccctctagggggcatatatgagacaacctgatcgtcagatcaatacacactcggcggattcaaatccctaaacaggagtagggtattacctctcattgagagggcctgaacctgtctaaatcctttgtctccacatccatccacttttaggtctcgtgcgctaccccgtttcattattgccgaattcatgtttcgacagttggcgcgccaggtaggggttgcgtcgagttttctatcgacgagtgcgatggaatcaactccacgagtcgccggtattatcttcgcttctgtatcgtgagatccgccgccgtcgacaccacccgccgatcaaatcaatctacagagagattcaatctactatggctgccaccagcttcacttctgtcttccccaggatctttctggacttcatcgctgccgccgaaaatccgaccagccccaattagtcggctaagagatcatacgtggcatagcaatcaacagcgagatacaagactggacagctatggagttttttcttttctcaagatcagccgtggagatacatgcatgaatatgattgaacagcatacaccggagagccacacatgttttgatcggtcttatatcaatctaaccgtacatgtttcctgctttatcgctttggttcttgccacatacaagaccatgtcgatctcgtttggtcgccgttgtattcatcagtttcgtcaaaaaggttgccgtactgccgcagtcatcatctgtatcaatctactcagcgatgcagatcggttcccagctgccaacgcctcttgccgactgatatcaaattatctggcaagattgaattactagttcaaagcggaatcgacatggacacagagacagcgtcattagcaactacacgtggcatagcaatcaaccaggaagtaatgatctacacatgtgtgctcctgatcgtgcatgaattgggccaccgctgcgcactccaaaaccggccgtgggacaacatacgtgcatcaagataaactactatcaggtttatcgttttaaattttcttatgtgaaatagattaattaacagatcactaattattatttgatctattgttttaacgcacgtaccgccggccgccctcgtcgctgccgattggattacacgcctccacggttggtgtgcaccgtcgccgttgctgatggcgacatcctcttcaccgccggcctgcctccgtcgccgccgagtggtgcctccgcctacacggctggtctattatgccgccgctgttgggcgtctacgacttcaccgccggcctgcctccgtcgccgccgattggtgcctctgcctacacggctggtctattatgccgccgctgttgggcgtccacgacttcaccgccggcctgcctccgtcgccgccgagtggtgcctccgcctacacggctggcctattatgccgccgctgttgggcgtccacgacttcaccgccggcctgcctccgtcgccgccgagtggtgcctccgcctacacggctggtctattatgccgccgctgttgggcgtctacgacttcaccgccggcctgcctccgtcgccgccgagtggtgtcttcattgttattgatggacgactttgttcccacattggccacttctgccatcaccaaggggaatattacaaagctaagtcatcatttattttattctttatatgatatttttccttttcctctgcctcactacaccaattggtcctccattgagtagtgagtcgggggctacagatattatatcatattttttataatatttatcttgattgcttgcgacatattctgagtacaaaagtgcctatcgagttatggagttccatcttcctatgctttccgtttggtttgccaatggatagttgcctttaggccgattcctagcacccgggggctcgttggatggaccgagtaacgcaaggtgctaagtattattcggaataaatcaaaagcatagagataagataatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagtcgggcagagcgtttaaacgtaataagtcatctgctcggggaaatcaaacttgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctctaggaatggatcagtcagaacatcaccaccggctcgcctcgaccgccgccgactggtgtttccgcctgcacggctggcctattatgccgccgttgttgggcatctacgtcttcaccgaccggcttgccttcgccaccgccgactggtgtttccgcctgcacggctggcctttatgccgccgttgttgggcgtctacgtcttcaccgaccggcttgccttcgccgccgccgactggtgtttccgcctgcacggctggcctttatgccgctgttgttgggcgtccacgtcttcaccgaccggcttgccttcgccgccgccaactggtgtttccgcctgcacggctggcctattatgccgccgttgttgggcgtctacgtcttcaccgaccggcttgcctcgaccgccgccgactggtgtttccgcctgcacggctggcctattatgccgccgttgttgggcgtctacgtcttcaccgaccggccgcctcgaccgccgccgactggtgtttccgcctgcacggctggcctattatgctgccgttgttgggcgtctacgtcttcaccgaccggccgccgcatccgccgctgactggtgtcccgcctgcacggctggcctgttataacgccgactgatgctatcttcttcacggctggctacatcgcagtcactactaataggcatcagtatcttcaacacaagctgcctacgtttgccatggctgccgactggtttcttcacttccatggctgcatgattctgccagtgttgattggccttaccatcttcatcgccggtcgtctcgtctgctgctgactagtgccctcgcctctacatctggtttatacagctaccactactgatggacatcatcatcttccgtcgccgactgattatgccgccgccgactgagcgacttcatctttattatcttcggcactggcaaactctattgctgctacttcgcaagttttgctacttcaccaaccacgacgtatttgtgagcctcgacatctcggcatgcgatgccatgttattttactacaacaagaggctctccaatattcatgatttctacttggacatcttcaacacatatcttcaatcaagcaataactattcgacgacaagaggctacagttttcgactctatgttcagttgtttcccaactaatcaaagagtcgggggctacacaaatacaaggctcaaaatttgacaaattttatgtcaagctgaagaaatcaattcatcaacccacgagtcaactccaggagtcattatcttcatctttgcttcggagcaaacattctacttcaacggttgacctactatgcaaatgctgatgagcgtctttgtcattatcattggttgctacattgctattggctggatcaccgacatcgtcatcttcatcatgtcggttgcgtttgtcgtcgtcaactacacaactttatcgctgagcgccttcatattcattgctggctgacctgactgccgccgactggtttcttcgcctccatggctatgcgacttcagtacttttgattggtatcactatcttcactaccaccaatatttttgccacctctggtgggcaatattctctctatattggttgtcttgtctctatgccaactgcgtcagctaccatcaatgaacaattgtgactacgtgctcaggggcttactagctcaaatacaagtattatatcttcaatttggacttgctccggatacatgcaacatgaattcatgatcatgggtctattttctatgctcaaagactggactatttattattccccgtaagggttatcaaccgaatacttgcgccagtcgggattcaatttttatatctattttggagtatcccataagggataatcactcagatcagaagctattcatatgagctacgcttggtctatattacccggaagatttattactcgggagcatgttacatgtgtcatcctttaaagggtgtcgagggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaaggtgctgtttgggtttttaagcaattgattggatacaatatcatcgcttttcgccacgtaagtgtgcatttttattgaccaatattatgacttaggctaattatatattgtggccattttctaggcggttggtaaatcctttatgagtttatttactcggattttacaccacatatgccatatatttccaggtgtggtgaaaccatgtgtcttctagggacttaagcacatctgttaaagcagtgtgcgcatggcgtatgcccaatactttgaaaatttctttattcacaatatacaagcttctttatagctattttgctatatcactcatcatattttacaaagcagttggtatatcactcggatcatgttatttggaggattcacaccgcatatgctatatattgatatcaagtcacttggttgagtacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggagattatgggtaccccatacccacacggcatggttatccgactagttataggggataacttatatatatgtaatatgtaacagatcatgacttgggtgttacgtttccttgtatattacggaacggcctaaagtcctgatctaggaaaccgataccgtattggttaaggtttctatcttgtaatcctgccccccatcctatataaggtgggcaggaggccctctagggggcatatataagacaacctgatcgtcagatcaatacacactcggcggattcaaatccccaaacaggagtagggtattacctctcattgagagggcctgaacctgtctaaatcctttgtctccacatccatccacttttaggtctcgtgcgctaccccgtttcattattgccgaattcatgtttcgacaaatgcctaaatatatttaatgttggatttaataaaactaatttggtattgtaaatacattttttataaacttggttaaatttgataaggttaggagcctcttctacagtaattttcttttaagaaaatttaaaagtttgattcaggacaaattaaaatgacttataatatatgaagcggactgggtagcatttcttaattttatctctagaacggaactaacttttcactaatctgccagtatacctctcaacagacttatttttccactccactgtagcacaaagctggtacgggcaaaccgatataaaattaacctgcaagcaagatggcgtgaaacatattctggaaaggaaaaagtagagagcgagtattagtattttgttgcggagaaagacgacaagaacaacacgataatcttgtctgagatagccgccacagcttagtggtgcattgcacactaggctctaggtgattaagtggtgtccttttgctttctgatgttgggtgagtgtgtgtgtgtatggagggggggagccggatcgagctgcgttgtgtgctccattatcccggcgcatgcgaccatccataccctgaaaccgacctgtggcccgacggagagtgacccatacttgaccatgcccgacccactatctatttctttctctgtgtggatgttcgatggtcggcttataaaccaaagcgaaatttaaattttaaattaatatttttagtcttatttttaacagattaagaatataaatataaaagttgtaccataaaatcatcatttctagttgtttcgtttattttccacctcttgtttattgttgtcactgctggagaaaccatcttcactcccggttcgcagcccctcacaaattcacaaaaacctcatagatcatatcgccaccacccactaccgaatcgcgtgcggctcgctgcctgtggcctgccagtgacgcgcctcctcccgctaacgcccacgacgcgcctcctcccgctgacgcccgcgacgcgcctcctcccgccgacgctgccgacctgcctcctcatgccgccacacctccacttgccgccgcacctccacctgccgccgacgacgctggcggccagcctccgcccgccgccgcccgtggcctgcctcctcccgccagccgcgcctccaccaccgctgccgacgcggctccgccctcctctagccaccgctgatgcccgtggccagcctcctcccgccgacgcgcctccgcccgacgcccgctgacggagagagctggtaaagggaggaaggatctgaggagagggggggatgtcacctcggagagggctgggaaggggaggaggctgggatctagaggagggaggaggaggacgaagagataaaagactaaggatgggagcgcgaggagataaggatgaaggaggagaggaggcgcatgcggcagcgttttttttttcaatctttggtcccggttggtataaacaacttggtactaaaaatagtgaggggcctgacacaacttgacaacatgttgaaccgggactaaaaatgatctttagtcctggttggtaacataaagtgtcgtgccgcttttgaaccggggctaaaaatgtttttttgtcccagttcctattcgaaccgggactattgtggattttgcaccacctagcaaagatcagtttttcagtagtgtgtgtttaccttttcgattaagcgccagatcactaccctcggcagtatgcgggttttcataaatgtttatcaaaatttgacatatttcgatcaaaatttggtcaattttaatgttttatatttgagttctcaaaaactattcggaatttcacccggagtatactttcttggggtatcgaaacatcaaaatttcgcgattttcggtcagttttcataaaaatgtgaacatgattattgctcaaccaatgagatatagtttgtgtagtccattgctacatcacattctggtgtttatacgagagttacgatgactatgtatgtgtacatgtacgatagtctcgtgctctcacttaacacgttcagcgcacaaacacaacattattgttcctacatagatcacgcatgcgtacgttcaatctgtttgtgatatatatatgcatctaaaagaaagtgagccattatcacgagatctgcatatatacatgttagtatattgctccgtacgatagtcattggtgcgtgtcaacttcggttttgatcgctcgacgagtcgatgataggcatcaatgcgactttcaggtcccacgccgtggaacattgcctcttacaccaacccgatcaatcatcaatcaaggccagcaattaaccccaaccgaaccctgcaccgtagaacctatcttgccatctgtacacaacatgtacacaagctcacgctcgaatgttcgatatatccctttcggcttaattaattacacgcgtcgcattaaccactcagatgatgaccaggttaaccatctgttattagttaatttaccggacaaacactacttagaaaaaacattttttacagacggccaaaagtaatttttccaggtagggaaaggaccgcctgcagatcaacgactacgaaaatcattcatttttataggcggcccaatggcccgtatgtaaaaatcctctagacgaaaaaaaaattgcgcccagccagccccgcacctcgccgccgccgctctcccccggccttcctccggccagatttgtaaggagaggggaggggagccgcaccggagccaccgtcgccgccccacgcggcatcgtcttcgccccgcgcctcgttgacgctgccctccccgggcctccctccggccggatctgggaggggaggggaggggagccccgccgttgccgccgtcgccgccgccgccccgcgcgtcatcgtcgccaccccgtgccccgcgcctcgccgccgccgccctcctccggccggatctgggaggggaggggaggggagccgcaccggagccgccgccgccggcgccctgcgtcgtggccggccccgcgcctcgcctcgccaccactacccttccccgacctccctccggccggatttgggaggggaggggagccgcgctgagagccaccatcccgcgcgtcgtcgttgccgccctgtgcctcgcctcgccgccgctgccctccccggcctccctctggccagacctgggaggggaggggagggaggaggaggggcccggtggggagaggagaagaagtgttgagggaggagagagagttacgagggaaatgagtggtggaggggtggcaggagaagataagagttaagtggtccgtctgcgaaaatcattttcgcaagcgccgcttaagtgatccgcagcgaacttcaccccaatttaaatttttataggtggttatttggctaaagggttatgtccgcctgcgaaaaaaagatcctatgtcaggaaaagtgatttttttagtagtgaaaccaaatggcaaaaatatacctgttcgggagggttttaaatcattaaatctaactctaaaaacggagtatggaacggacatatgaagcagcctaaattaaccgtgttgaatcggttccactctttcatatcactttagcccttcgttttctgggtgaagtttaaatcatttgattggactttaagaagagatgaatctagagctagcggccggagcctgtcaaacatgccttaattataactctcataatctaatattgcgctggttaattaagctggtgttactttctcacttgttacacgggacccatccgtggatgtgattagctgtagagccatgctgtgggctgtggcatggtaatgatggtacgaaagccaaggcggtgccaagtcaactactagctgcttctagtgtagctttggcacgtacatacaacggcaaagtcagcttgtatatatacacggcgcgtggcaaccgtagatgccagtagagagagcacgaaaaattccagaagaagaagcgtacgctgctatacaaaaggggccttcacgagaccacgagtttcaaacatgaatttaaaaattccagctctgctgtatgcttcaaatgtcaacgacttgcacgagttgaatcaacggcaattaaacaatttaatcgcacgtttcttgaaccattatgttttgcctatttcaagtcactactacataaacctagataggtaaaactagataggggtcgaatttttcaaccgacacatagaaagcataacatattagaaaaatcaaaggtgctggttacagaaccgacacctttaaggtccaaaaaaaagaaaaaagcggcttaatgcatgggctcgaatcgagccgatgcatcgagcagctccccttcacccgatttcacccaacatttaattcatacaatcaattggcatcaagaattcaagaacattgatccaagaacttcaacaacatcaacacaaacacaaaacacagagaagatggagaggatggacgacggcctccgtgaagaggatggagtggcatacgagcagcacgtcgggtcccatctcgcacagctcgtcggtggtggcgaagaaacagatctagcagcacgtcggaaggcgttgcccgtcgttgccgcctcacctcccaccatcgctagccgcacgccactaccatcgcctccccccccccccccgggtcggatctggcgaaggggagggtgctgcccgtcgttgctgcctctcctcacaccgccgcacgtcgttgcgaccaagagagccgacagagagagagaggggggaccgagagagaggggagaggatgcggtggagattataattaagacggagaggatatggatagatggtgctgtgcggtttggctcagctcgattaaggggtgtcagtttttttaaggaaaaagtacgttttacccccgtactattgcggttgaccgaaacccccccccccccaccgaactcgaaaaccagtcatttcgtaccccgaactattaaaaccggatagttaaccccccttaagcacacaatggggcggttttgactggagtcgtgcgcacgtggcagtccaacgtggcaaggcgggctgagtcagcatagtcgcgcctggtttatagacttgacccagaaaaatttcccctccctccctttctctctctccctcccaaaaatttccccttctctcgaaaaccctagctagcacaggcgatctcgttggcgactcctgcacggcggcgagggtggtgcgctccaaagcaggtgggtgtcgtggtcagaggcgacggggccggagatctccaccacggacgcggcggcgacggtctgcagtacggccacctcgacctcgttggcatgatgacgagctcaggtacgtcccggggctcaaggtcgtcttcttgggctggaggtcgtgaacgaggaaggatgcagccgccagtaccatatagggaggggcctctcgattatgagccgccagtgcggctaggtggatttcgtggagtcccagtaaccccgggagaagatatttcacatgctacaatgcgcgtgtgagtaaatttgtatttatttttgatttggctcatttgtttggtttcaaactcattcgatcttggattatacatttatttgtgtagtctggttggttgcgatttttgggagtggcatgaccctgagtcagatccatattggaagcaattcctgcttgatttgaggaatgctgtgtggactgtaagagaaaaaatcaatgggctaaaggctcatctccaggacagcaggaatgaagccttgaagaacaggtacagttgggacaagcttctatattgcagtgcaaaatagaacagtgaaatggaaatacaaagaaataagagcactagttatagttggtggagcatctggctgaacaactttcgtacagcctgctaggaatccctgtttgcaagcagccaggcaaatatatatccttttgaatataggactaggctggtcagtatctaacttgacaacaactgtactcccaggattactcctcagcaactctaactgatagtcaaagattctaaagtattcacccctggtggactcatatatcttcctgaatacaaatgctttggctctcttgcactgcccaacactaacatttgcaaacatttcctctgaaacagtggactgcatgctctgtatactccaagttggattatctgtgatcatcttctcatacttctgagcaatcctcttgtatgtcactaggtggttatccttccttggtgggcaggtgtgttcatcaactagactagctatttgccagctttctgtcctgctattctttgatagcaaacaagcccacgggcaagttgccaaatcacacttggcccttgttctgtaaccttcatcctttataaaccttatgaacctcttgctgtccagtgcaagctgcaccactgcctctttgaattctttcttgccatcaaatttcattcctagtgcaagcctagcaattggcctattcacattaaatctgggggtatttggacttctttctgaccagctgtccatcactatcctcttcataggaatcatcatctgcactgctattgtcatatgggctagcactgtcatcaccctcaatctgaaccaaagctctactatttgtctgcctagatgacccctcacatataacatcatccaaattccctacctcaccatccttcagtttcttcttgaactctttgtaagccttcctgatttgctgaacctcttcatcttcttctgatgaacatgagtctccaccaacataatcactgtcagagtcagaaatcacaggtttcttcggcctctctttacctactaccactgccttccccttatcactaggttcagctactaccattgctttttctttatcaggtgtacgaaatgctcgcacttgttccagatctctctttgtcttctctggtgtagacactatgacaagaacttccttccctatattcaactcaaacaaatcctcatcttcctcatcatcccattcatcatctgcaggagatatgtcctgcagttcatcttcaaagtcactatcctccttgctgccagactcactggacccctctgccattactgtctccacataaatatcagcaacaccaccttccccaacacagtttgacatataattgtagacctcatcatcaatcaaaaccctcagcccatctgcaagttctttgccaggaaacaaccattgcagaagcatgccagggatcacttcacaatgatctttcaaatgtccaactatctcaggcagagagaccttatcacgtttgatgtaggacatcccctcagatccaccaatataaaaggtttccctcccattgttaatgaaatccccaccaaagtgaaatctaacaggtaaatactctagaggatccattcttaacctaaaaacaacatagtaatggcagtacacaatcaatccttttgcctaaatcaattacaaaaatcaaaggaaaacaaactctcacacatccaactgattccatatgccctagtaaaaaaatcctacacttttctaggatctacatcacatacctgcaaagcctagctgcgtcgctcttacttcatcctcctcgacaagcagctggtgctggccgatgtggagagcgtggccgccacgaccgtgccgcagagatccctcctcgtcgcctttgagcgtgccaccctcgttgccttgggcgcagctcactcgccggcgtggagtgcgccgcccatcctcaccggagtcgccgacgagatcgcctgtgctagctagggttttcgagagaagggaaaatttttgggagggaggggaaatttttctgggtcaagtatataaaccaggcgcgactatgctgactcagcccgccttgccacgttggactgccacgtgcgcacgactccggtcaaaaccgccccaatgcgtgcttaactattcggttttaatagttcggggtacgaaatgaccggttttcgagttcggggggtttttcggtcaaccgcaatagtacaggggtaaaacgtactttttcgtttttttaataggtgcatattttttaaaagaaccgacacctatttttatattataggtgtaggtttttttttcctaaaattgacacctctagtgtttaaaggaaggtgtcggttctgtatatttttcatcgtgtggaggtgggaaaagatctataggtgccggttggtacctatatggccggtccttatgagaatttttgtaatagtgagtttgcaaaagtagtgtactgagtactgtacgtacgtaaaataatgtctaatcaaggccgtatacgaagatctggacggttagtttgatcagtttttctcggccaagagcagcaacggagcaaccaaacctgacttagtcgcaaacggataaataatctcataaatttataacgtacgatcggtgcatggtcttgctcgtctaacgaactcctcgtccctgctactgcaaatcatcgaaactccagttgaaaattagttgggcttgcacacaagtgctgtcctaacatatgcatcagctggaccacctccactggccataaagctcacaatggaaaatcttgcacctgttttaattagctatgatccaccatagtatgtatatggtccatacatgcatgcaagggcacataattagcttaattaattagctagtccttttcctgtgcctcaaaaagtgacaaaacatttcttatgtgcggctctagctagctaaggtaagtggacccatcaagttcgagatgatgaaaatgcatgcatgtttgtagaatgaggctgatttgtgaaggtttaggtggtgtttagattcagggaccagtcctgttacatcagatgtttgacactaatttgaagtattaaacatagactacttacgaaactaattgcataaatgaaagataattcgtgagacaaatttttaagcctaattaatttataattaatacatgtttactgtagcatcacataagctaatcatggattaattaggttcaatagattcgtctcgcaaattaggccagagttatgaaatgagttttatcaatagtctacgtttaatacttgtaattagtgtcaaacatccgatatgatagggactaagaattttagtgccatccaaacaaccccttagtttgcatgttccaagatatactttgatgatcatcgacatgcatgtgggtgtaaattggatttggatttgtcttattgatgctctaccatatcaggaaagtagtcttagacattataaatagacgtgacatttttcataaaatagggggatacactgtgatacgggtacaaattaaactatacaaatacaacaagacactagcttatttccatccaaagtcatgtatataaagcttgtttcggttagaggaaaattgtttttttactgtttaatctgcagattgaatattgcaatcagaaggatgaaaaaaaattaaaattggtgcgtcacacgaagttgctaaaattacagacatggcatgttctagatcaaaattgttgtaagattcccattggcccaatttgccttacccacaaactgaattccctttccggcatctttgtctagcaggggtaccgagtgccgagtacaacctaaacgaccaaaccgttgcaagccctgctctgaatcgatcatctccatgactcctttctggtgttttggaaagcaaagtcttgcaccttacctctttctgtcttcagtccacccggggtcaaattgtagatgcctctctgcttccgtttcttgggtaactgttcagcactcccaagttccaactccaagtgatcatgatagcaaaagaaaaggggtaaataataaggaaaagaaaaaaacaagacgcacaacaacgcaaacgtatacagatcacatgtacactttctgcatttcttaaacaaaaacagtacaaagaacattccattattccatataccttcgagcatgcttgccatataaaggtgccatgtctgagtcatcctaccaaagtagtcccaaggcaaacccaatcaacccgacctaactaacgccctccgtcttatcatagccgtccattgccacgatcgggcggccgcgcgcgtagtcaccgaccttttcgtaacaattcagttacaatgtagtactagtacaagtctattgtagcacagcttcacgttgccgaagcagaggttgcggtgcggtgccgccggtgcggctgtcacgtatatgcgcgcagcgcgcagacgatcgattcgtctgcgcatacgagctgacgcccactactaaaaacccacggaaacaacgccacgcgcggcgtgagatagatcgattcgttcgatcgaggcgcgggactcgcccggtggatcgcgttgcgtacgagcgtacgagggagaccgacgctgcagcgcacgtacacacgggacgcgacgagacgctgcagcgcagcgcagcctcgcgcgcgcacggcgaggggaagaaacacgcacgcgggggctggatcgcgcgctggctggctggggggaagcggcggttggcgagcagagcagagtgagttcccgtttctttctttgtgttcccgggcttttctcccattcatccacgcgccaccacgcggatcctattcttaggctcccgcggccggacctaaccggggcggttaagcgagggccgcacgttcgcgggaggcaggctatggccacggccgcgacgacgacgtcgtccacggcaaccaccaccaccaccacctgctcgtcaccgtcgtcgaccaccagccccatccacccggccgtcccgcaccggcggcgcctcaacgacatcgagcgcgtcgactacgcgcacggcgccgcggccgacgactgcgcggcctgcggcggcgtcgcgcccgacgccgccctcgcggacgacgacgagtgcggccacgggcaccccgtcgtcggggccgtcacgccctgcggcggcggcgggagggcggcgctgctgttggcgcggaggaagcgcgcgtgggtcgtcggggcgggcgggcaggcgtggatgaggggcgtcgtgctgtgcctgctcggcctcgtcgcggtcgtcgggttcttgggatcgcaccggcgaggcggaagcggcggcggtggcggtggcgcaggctctggccccgttgccggcggcggcggcgacgacggcgggaggctcgtcaagaaggtggaggtggccgacgccgacgtgatggggtggacggaggagaacctgacgggttttcacgcgccgcccgcccgacccgccggtgcgtacgtgcactcgccgttaatcactcgatcaactcttacttcacttgatcgacactcttttattaccaagatcatttagtcggtaataactactccgacataatcacacctgctcttggttttactctgggaattcaatgaactctctgaagtgtgtttcttttctgatcaaatgggactaatgttctaatctaaaagcattttttagtcaatgtctaatcaaaaccatttttttttgttacaaaacattggtccaaagggaaaaaaaagaagaaaaagaagatacagaggtgtgcttgcatctaggccagctgaggattgagtatatgagagaaaggatggatgataacgacaaggatatttgcttgtatttgttgctagcgtgattcattggcataaaaaaaagggaggcagagactatatgacattatgacgttagtttcagagtctagaaacaaagcatcccatttaaggcatttatctctcgactgcttttgtgcaaatgatttccttgttctttccgctgtttatttgtctctgcaaataagacgcatcgctttagttcttttttttctggtcgctgttgggcaattgcggcctcgcaagctagtagtcactcgtaatgagatgttaggacctgactgacctgcggttggtgccgttgaggttgctttcacttgtaattgtcaagtgatgcatttcaaggtgtgaaaaaggttttagtgcataaacagaaagagttttgctggtaaaatattaatcaatatcacatttctgttctctaaactaatgttaagttttattgcacaactgagtttaattgactaaaaagggacgtaattttccatcagacagcttaatattgtaatgctcttcttttggggtttgtgattgatagacttcgtaagattcatatttacccaatcggcggttctcttaggcgatcgttttgagtcagaatatatattgagaaacccttccttacctggtagtggtagggacatcaagatttatggctgtataggtttaggacagagctggcagagactgtccgaaagcaatattgtgcttatgttcagacaagaaatttcattcacgaaagcaagacatccattcaaatgccgtgctgtgcggcctgaatttactcgagtttcctttataacatcgacagatacctgagatatggatgaagccagacagtgagggttatagccaatgcattgaacgcccaaagaaccagcgcagtaatttccctctctatatctttcacttcaatctgttccagctccagttccatgctcatgttctctagttgggtgctcttattgcagggactaacaatgcaactgtcggttatctaattgttgatgcaaacggggggctaaatcagatgagaatgggtgtacgtatctatttaaacggtttaacatgcaacgcttttcagctaacccatactccttcgaaattattcttacagataagtgatatggttgcagtggcaaagatcatgaatgcatcactagtaattcccactctagatcatcagtcattctggactgatccaaggtctgtaccttttctactcaaggatcatccctcatgcccttataaaacatcaagtaaactgaccataagtccttgaatatagtgatttcaaagatatattcaatgttgagcacttcaaggaaatattaaaggaagatattgtaatcgtggattcccttccaccaacttacaaaagggtgaaaccctatatgagagcacctacctcctggtccagggtaggtgttcaaaaacatttgttcctgcaattgcatagcttagaaattcaggaaatatgagcaagctaatgaattgatagctccattttgcaggcttcctattacagagatttttcaaggatactaaggaagtacaaagtagtgaggtttactcacacagattcacgtatagtcaataatggtcttgctccttccctccaacgtctccgttgtcgtgcaaattacaaagcacttcaatataggaaggagatagaggagctcggtcgcaccctggtagatagactgagaaatggaatggatcattatattgcacttcatttaaggtattgaaaattcaaaacattcagagaccaccttacttcatttcctgcaaagaaaccgtttacagatcagcaatcttccattttgctttgttgattgatttacagatatgagaaagacatgctgtccttcactggttgcaatcacaacctgacagtacatgaggcagatgaactgacggacatgcgactcaaagtgagacactggaaggagaaggagatcaacagtgaggagaagcgactccaaggcggttgtcccatgactcctcgtgaagctgctgtcttcctcaaagctatggggtatccttccaccacaaagatatacattgtggctggtgaaatatacggcgcacatagcatggatgcattaaaacttgaatacccgaacatctacacacactacagtctagccacagcagatgaattagaacctcttgagttgtatcagaacaggctagctgctgtggattatatagtagctcttcagagtgatgtttttgtatatacatatgacggaaatatggccagagcggtgcagggtcacagaagatttgaaggattccggaaaactataaaccctgataggtatgtaccttcatacaggtcaagtttttttttctggttttcaacttacaatatatatatttttatctgtaggctgaagtttgtagagctcattgataagctggatgaaggttccatggactggaatgaattccaaagtgaagtgaagaagcatcatgaaaacagacttggaggtccatatgacagattacctggtgaaagtccaaggcaagaggaatacttctattcaaatcctatccctgggtgcctctgcagaaaggtacaaaagactaggtaaaatagattaatctcaaagggagatgattcagtcttcaaaaagacatgaattgtacagtcttcaaaggaaaatagtttcgcagctgcattaaggatggagatgacacttcctcacaagtcacagattgcatcaaagtggaagtcctagtaaactgacagagaccggtcattttgattatttatcctagactgacaacactcgtagttcagggcgtggggccaagaagtgctgcattttcaaagaaatgttcatccaaggaaggaagatgagattctgaagtagttgaagaattaaatgtatcatcgattataggaacagccagaaggaaaactcttcatggaggctgattgtagttagtccatacacacttcccctgttcttgacgttatctgattcgttgtagtgggcatcttacatctggatggattcataacagtaatggaacaaaccacactatcagtatagaatgacagacaaatatttcagtagcttaggtcagatcaataattctttgtaatctagcaatgtgccaatgtcatgcacatcagattagcttcttgtaaaagtatgttctttgttgcagtggcatctgcatctgcactatcctctaggaggaatcaatgtgagtttcagaaacaaattagaaacaaagaaatgcatgaaaacaaaaggaaaaccgtctaaggaaggtggcttcaccccatgagacgtttaccgaggcaggaggcagtgtcgaggcggaagtcgaagacggcggagaggaggcctcagacgcagaggaatcgggacgagcggaggtggtcgggggatgcgagtgtgccatgacgggcctgagcgagctcagcgagcagtcggaatccggcactgaccacggccacgacgcggcggcggggttcggacgaggcgaggaatacaaacctgccggaatcgggtaccccactcggccactccccggaagagtagcgggagagccggcggcgatccggcggcggcgcggggcgcttctccgacacacacggagaccggcagccggagaggcccttctccttccgaaagacacgggccgcgcgtcagccaaagtccagttccagcccaattaacagatttaacacagaccgcacgtcatccgcagccccattacggcccaaccaatattgggcctcatcaaacataatactctttggaataagttcatcttgggtcccttcattttacaccgaatctcaaaaccagatacaaccggtccctgaactaaccggtgcaaacgagatctctcggcattttggattttggaaggcggttttgtctgacgtggcaccttcgtggttggtttgactaggtctccgttccacgtggcattgacatggcgcttacgtggcaattatatctcggaaaaataacaaaaaccatgggcccacatgtcagctacacacaaaaaaaatttaaaaaattgtgaggcccacgtgggccccacatgtcatatcctcccctcactcaactttccctcttcttcctcatcgcgccgcggcgccacctcacagtcattgtctaagtcctcaccgcctccgatgacaacaacggccgaagcatgccggcggcaggccgcaggcggcagaggtggccaaagaaggaagaggcagagaaggtcgccggccagcgcggcagttgtggcgggttatctcctcccaccgccgttggtcgctcgtcgctcttattgctgaggtcgggcgaggattttctcgatgccggggaggggtcggcagcggcaagccgcgggccgcgggccgcgggcggcggaggtggctggaggaggaggaggcaaagaaggaggttgctggcgagcgcgacagctgtggcgggttatctcctcccgccgctgctcgccgctcatcgctcttgttgacgaggtcgggcgaggattttctagatgccggggagggatcggtagttaggaggatggggggtcggcagcggtggtagaggggtagagatggcggcatcgttgccaagaacgacctccaccgctccaacccggctgacacccaccgaaaatagagctcctcgccggggatggccaggcaccgtgggtgggggttcgatggtgacgggcgaagggagaggtgcgcaacggccgagcgtgtcctcaccgccgggatccaaggccgccgtcgccagtcccccggacgacctcgattcccgcgagctatccgcctgcccgccgccccgttgtcgtcacgcgccgccgctcgccactgctccttgcagactgcagagcaagggagagatagatgggggatagagagaagagagaggagtaaggatgacatgtggggccgacgtgggtcccgccattttttattattttatgtgtgaaactgatatgtgggtcccacgggtttttattttttaatcaaattgccacataagcgccatgtcaatgccacgtgggacgaagatctagtcaaaggagccacgtagcacaacgtcagccagaaccgggaacaatattgtccgagggacctcgtttgtacggttttgtaagttaaaggatgcattgtacccgattttgcactgaagggacgaattttggactcggcaacaaactgagggacgtaaggtgaacttattccatatctttagttggtctctgttctgtaaattggcatatttcttgttcttttgtttgcttgatctttttttttaaaaaaattagttaatacttaattaatcatgtaataatatgagcttcgttttgtatgccggggagaagggttgccaacccctccttccgaacactacaattcctagttctgtacaatgcatatggaactcttgaggcttatttccaacgttatcgaagtgcttgctcttaattgcccatcctgaggaacattttgcacaaagttattttgactgtattttacgaattttggtcttttcctcggtgaaatttgtttgagcatacacgagccactgaccagagcggagcatgacaaatacgggcgtcgaaatgccgattgcatccttcatctggatctggattggcccattatgtctctataagcttatttgggcccataaatttcactcaaaaggaataagtccattttacctcccacatctcttgcccttcgtcgaataacatccctcaactaaataatttttttaaaaaccggtgcaaatcaactccacatgtggttctgtaagtggtttatgctgatgtggcagccaggtcatcaaagcgattgaaatagaagtgggtcccacatgtaagtgacaaatgctaaaataaaaaagtggtggggtccacttgtcagccctattttttcttatcttcttcttcccatgtcccttctatctctttctcgtagccgcacgcgcggagtctgattcggccagccgatggcggtgaacgttagtcgggggtggcctcggagggcttgaagacgtgactcatctactcctaccccccgtgtcaccagggagggggtgtaagagatggcttcatgctaaccttcctgaaggcggcgaagacgaactagggaggctcttgagcagcgtgcccggtggcagtggcgcccttctcatcccagcgagctcctcctctgcgctcggtgggccgcaaccacccgatgagctccccggcggctggccggccgtggcctcccgatgagctcctctcccgcgtccggccggctgcggcatcccggcgagcccctcccccgcgcctggcccgccgcgccctcccgacgagctcctccccaacacccgccgccgccgctcgagccgatggaaggcgtgaggctgtaagatatgaggagatgaaagagagatgggaggggtgataggtggccccacgtgggtcccacctattctttttattgtgaatgccatctagatgccacgtgggatgaagaattagtcaatgtgccatgtggatgccacataagctataactggactcaatactgtcttgggggtcgatttgcaccggttttcggagatgaggtagtcgttatacctggtttatctaccctatagttcaacaaatgcttttactcattcatcattcatcatgtcacacatccaatggcccaaaatcaacagaggaggtagatccgaccgcccagcgcatctctcgcatctcccaccacacagagccgcatctcctctcctcgcgctctctccgcatcctccaccatcagcgccgcatctcctcctcggcgtcctagcgctctctcgccccctcgccgccgtgcgcctccccctcgctccctcgccgccgtgcgccggatttttcattgaatcgacgcgctccttctccggactagggaggggaggcgcggcgatgggcgccggcgcggcgatgtgggggaggcgcgacgagggaggggtggcgcggcg

SEQ ID NO: 2682 - DNA, 16291 bp, Oryza sativa
tccaccgcgtctccgccgcccatcgctctccaccgcgccgccattgcgcctacgccctccctctctttcaggtcgcctcccccgccgattacctcgcgattcccaaccctaacccccgccgccggcgcgtagcgccgccgccgcccctgctgcccaggatccccccgccttttctccttccgcccacctgccaccgacgccgccacccctggcagtgactcctcctccccgccgccaacgccaccgccgtcgacgcctactcctgtggcagtgtggaggactgctgcttccctgtctccatcaggtgtgtgcacgatttgtgtttgttaaaatgcttatgtgaaaaagctgtgggtatacaatgatatgctgcagattatcttttcctgttataggttgatcaataatggtttccttaattcaactttcatattgctgaatcttttggtctacattgatagctgatgcattggggtgtgattatacaaatgatttctgttggtaatgatttttccctaccttgcagacagaggaataccggacagttttttttctttcttttcttctgttggggtgggttcatttcagaaatacccaatttgttaggttgaccacatgtccccattttgatctgcaaggtcacagacaattctcttgtaatgtgtatgtgcattgtttgtcagaaacctgtcgaatgggaggcaccatcataattatatgatctaataatatgaagtaaccatcaactgatctgagtgtggaggtaatttctaaccctcacctctgatgtttgatgaatttcattttctcgtatatactttgtttgaccagatttcctgctatgtaaatacacatatatgattgtgtacatactagctagatctttcctcttagagcatggacaatataatggttcaggcgactattatctacataatctagaccacacaatagaatattttaagcagatttttcataagtgccaaccactgcctatgttttgctattaatatatagtatagttcctttcgagaatttgcacaaagtctatagaaaatcagaatataagtgcgaccacggccttcctgaaagttagaaaaatcttctcaagcatatagcatatagtctgatggtcatttcataaaaatctcttgatatgattttataagtgaacataccaaattagtttgaatgtacttgttcgttttcacgggattccgacatccgttgtcagtgatcgagatcctgttttcactgggcacttttggagtgagcttttccggttggctggtgtcaaactacatatgagctcggcatttcagaacactaggacaaataacatgttgtatacattctgggatgcctgaatatatggttgcttatgatggaatcagaaaatgataagttctgcagtattttcaaatgcggaagctgatttagaatttgagaatgttggctcatgatgacaacaactctgtacatgtacattctgcagatagagaagcttttcttgattgaagcattttaagacttgtactacaccagatgtgcccccttgagaaacaaaggttagtgttctgctatcgagtttttttttagattgtagcaaatagagattttgttaatttttaatcaaatgtgaagctaaacttctcattaatctgggattgttttccataattgtcccggtgtcagagattgacaattgatttcacaaccaaatgaaaggtagtgtttttctgggaatgccatcaggggcgcagatctgagtgtagtcaaaatccttcaatttttcaaatccgtttggtaaaagttaccactttctgaattccatgcaaggactgacttatgaaaattttactgtatattattgttctataatttgtttataaaagtaatgcagtaatgctataggaatgatgggaccctaggagttagtggcatatatcatcgacacacttgcatggccaggggaattataactcaggtgctcaccgaggatcaactgtccaggatccaggatttttagcatttgttttattgaacgctggaattacttttctcctcgtgccatctaaaggtaacttcaaagctaaatggctggccatgtataatcctaggagcataaatatttttacaaactatataaatttctttgtgaaattttaatagtgattcagtgttgcaacgggaaatgctatatacatggccagccatttatattcagtgtttaagtcgatatattgaccacagatttggtttatatcagtaaatggccatgtttttttcccaagttatgtttctaaatatgtagactgtggtacgatatttataaagttcaagttgtctttgtttcccagaaaatcttaggtctagcagacttacttagtttctgtttacaaatgaataatcgggtagtgaatactatacctgtatatttgtactactctcttatttagtaatgtatctaaaataatgtagactgtactacaatatttatttagatgcatatgctcaatttttatataagtatatgctgcttttacattacttttgtttgaatgtacatgctgatatgaaatttggagagctttcttggaatgtacgctgttaagaaaatttagataaattaaatccttatgccttatattgtttcttaaacacacctataagtttgattggagaaggggacattaaccaattgcttgaaaaaggtgttttgttagctcaagatatggtggaatatttacaactgttttagtaactcccagataatctttctctacatacatgcataactaatttctctaggataatgacacatttctgattcgttaagggcaaactttgaagtacatctgttatgcgcgagatattcagtttatatttctaaacttgggtgcactttgaatcaggacgaataggctcagttggatcagttgaatataaagaagtggtgtgcgattagttttttttgtaaatagctcaagttagttttcttccttgtaggatagttacaaaaaaataaggtaaacttgcatttcttgcatgagcaaagttcattacaacctatctaagtataatttcctgaagagtgtttatagctgaagttgtttcttctaattttgctgaggttaaccctcctatggcatgcatccttctaaattttgctgaggtaaaccctcctgaaattagtagggtgcacgaaatactactgtttttttaatttttgtacagtggcattgaacatggttttgctctttgagatatgatgcttccctcatgatcaatgaagatttgcattactttaggtgatctgctcatgtttgggtgtttgggtaaggaggagaagaaatggctggggtgtcggtggtaatgaggttgttgtttcagttatacagttccgcataattgtgtgacgtcctgactaatcctgactaatctgtatgaccttttcttccatttacaaatgcttgtgtctctccagttcacctgtgagggagatatgaaatcaggtatgagtaattcttgtggttttgcttctttttctggacacacttattttcatccattttgcagcaagcaatagttaggtatgagaaagaatgtgccttacaattaactgtcagtggtacacataaaactattcatttactcttctttcctggtcatattgatacaggttagtttatgctcttactcgaaaaaaaaaacaaagtacatggtcttactatttgaccgtttgattaattatataagtttctgagaaagccctgaattcgatgtactagactcgattgttataggcaactaagtaaaaaaaacaaggtgatccaataaagtattaaaacacccatggatcatgttgctaccctgtggtgatgaaaagagacataagtgctagctactattttttgtttaatcatgaaacagaggcttcatgaaaccagatcaagcaagtcaaatgggattgcatcataggtaagatcaaagttttcccctttttgacatcaacagcgtattcttttgtctgtagagattgtatatttgttttcattcatagaggttacatcatatccaagagagtgccaaatctgtcatgtagcatttgtctttttttttttacccggcctctacatccaactggatatatgcaacctttttaaattaagaacttagccctcaaataacccaatctgaaattcgctcctatagcgatttaaattcaggaccttggggtgctactcaggttactgcaaccattaggctacatacccttttacatgttgcatttgtctagattattgcatttataagcagtaaatctttttcggagcaaatagcatttgtgcagtgaccaagggtactatcttcttgatttgcttgcagtctcccattgtttgctgagaccatcaatactcttgcatggatgatggttcaattgaataattaggaactgcaatactggacgaggcttgtttgagttttctttagttctcttcaataagttacctctttaattatatggcttcaaactttttcatattcccgagagcatgtctgtatggcaccaaactgttcacctgagcaaatggtccaataatgaattgtgctttgtcatggtacgttgctaactgtttgggccttctggtgcaattttatcattgagatattttgtgcagtgatgaaatgcatatttgtattgtacgatacttttatattatcaatagtaatttactttaattattttttcaattttaaaagttgacctgttaaatgaggtttcacaggtgcattaaaatttattgtgttacaatgaaacctgttgctacaacaatcctaggatatcaatgtgttacctaggtgcacttcttgggtgatgagttgtgggagttgtccatatcctcctggaaaatgtgttgacaggttatgcgaggttctaggacagagacatggggatatagttctaggacggaaatatggggagagatatgtatatcgttaggcgtgaagttctgatggtaaatttatggagaaaaatttgatattgaccgaatgtatctgtgtgcaaattgtagataaaagaatgtcaaatgttctgttttggagaagacatgaaacaattcgtgttataatattggtgcatataccttttatgcaaatatttaattaatttatattctgtgcatatataagatgcgattaattgctccatctaaatttactactccctttcacaaaaattaaaacatatgattttttgaattattttaatttactactctctttcacaaaaattaaaacatgcgatttttgaattattttatcttggggttttgcgtttgactacaattttatatttcaacaactttataaaatacaataaatttgtgataaaggggagttattattttaatgataaatatgggcagatcatttagcattcggataaagacatgtatatcttgcttggatatttgtattttagacatgttttgaatatgtttcttcaaaagttattttgatttgtattgttaaatattaccgtagcgttagcacgggcagattactagttcgacgaaggcaagagatgagggaggtaaaatagacttattcccactcaaaaagcttaaaatgacataagcccgatactaaactaaaggcccattattagtataaaacactgctggcccaccgcgttcttccgcctttactgtaggagtgttaggtttagggcttccgccgccgcctcctcctccaaaacctcgtcggcgcgccgccgcggccaagccgctgtgctgtacaagaaccggttcggcgacaacgtaagttccgtgcccgacgaggtatttgttcgctgccccctcctcctcctcttcagtgttccttttttttctccgagagcatcggtgatgttacatccatctaaactcatccttgcactatgaggtcaccggtgaagaaaaaattgggggaatatgtagtctgagatgctctgttgatcctctccttggatcattcttttctactgagctgatgacgcggctggagatttcagctgctgtttgttttcgttttctgaagcctgagagcaccagtgatgtttacatccacactcatccttgcactatgaggttattaccagtgaagaaatcattgggggaatatgtagtctgagttgctcctgcttttcctttctcgcgattctgctttaatttgtggatttatggttgattttttttggctttgcctttatgcttcttgattcctctcgtggatttgtggttgatttttggctttgcctttatgcttcttgggttcctctcgtgaatactgatttcagcttctttctgtggcttgatagccaccaggtagatggggaaggcaaagcgtgcgtcgatttttatcaggcttgtttcagcagctggaaccgggtttttctatgtgaagcgcaagaatcctcgtcggatcacagagaagcttgaatttaggaagtatgatccacgagttaacaagcatgttctctttacagaagcaaagatgaagtgagatggtgctgggcaaatcttctccacaatgtgcaaagctgaataacctgcaaaaaaaactcgtgtcaggattcaggaacctgtctactgttaagaatgctatgatcagtttatcaccctgttctggttccagcgttttatgcagacaatttcaacaagtatgagtttgatcttgattagcactggaattctgatgttatgcatgttggttttgttttttggaatgggctgtaagcctgcaaactaggaatgctttgattgttttaccatatccccgttaaagcaaaattctatcatggcaacttgtagataggattcaccatactgaatttgactgtatgtattcctttaaacatgtttgtcaatacctggaagttatcttgaatttggccatgatctgcattgagacaaatgattcagtgtaccttcttttttttaacattggtttggaaaacactacaaaattcctttggaaacattgtaaaattctccgatccaaatggagcctaaacatgtgtgatttgtaagattggcaggacctggtattcttcttgaatatgctgcaacctgtactgtaagttgtaacagaagtagtttagactctacaatctgaacttgtttgacaagaactcaagataaaggacttcagctgctccacaagttttacctgacctggcgatatctgctgttaagcaacactgggacttctccgggcttctcttcatcacacggatcactggacctggcttgctcattgctgcattttgatcatggattttatcgtcgatggttgctgaaagcgtttcagtgttgcaaatttacatttctttttgtgcttacgacctttcagaattgtaatattgtaatttttctcctgctctatcgaaaaaaattacagccgttcgcatctagaatttgtgtgggccgtttgctttaaagctcctgtaccgaaggcttcttgtatcgtcttgggcttgtgggacaacacaaattcgcaattgtttagctcaaaaaccttgttactccaaacaaaatgaaacatttcaatcgatcagttagacagtaacaaagaaacagaagaatttcctggagaataagcattcgtagtggtggaccaaatcgctcgtcagaatgtcagaatctggctctagcgacgggttcctagtttcaaaggagggccaaacttgggcctttccttttgccgggcgtgttacagcctggtaattgggcttggtcttagcttatgctttcttctgcaacagcaaccgctcgtgtgacctggaccactttgcctgactgaaaacacttgaacctctgctacaatttcacccaaaagaaactacaaacttctgcaaagtggatagcacataacagcattcttttgggtaccctaggttgtctttagtcctcgtagtgctcgattgacatctgatatggtagtacagtagttcctcatcttttagtgaatttctccaatggtggttgcctggttggccctggttagatgtttcaaaaatattcagcatgtataatgtattaatccaactaaactgtgggagctcgacaagactaggctgtgtatcacaggtgcagacttgcagaactaatgctcaccttggttttgtttttgttttgaagaaatgctcatcttgttcctggacatctgaaatactacagtttttttttcgcaaacgcgtaaaaaaattacacgtcatcatattagaagagagcaagattttaatatacaacgtaacaggccatggagacatttgccaggggaatggaagaaaaaaaaaagaacacggaaaggaaacgaaaaaagaactgctaacgaaaaaactgctcctatatagagggaggaaaaaacggtggagccaccctaatgtcccaacaagtcttcaaaacctacggtgccaacaacagaccacaaccagacttcctgaagaatggactccaagaccacaaagaccgagacgaaagagaccacagagactacagttcacaatcagtaaatgatcatatcttgttaaaaggctgcggcattatctacttacattttaacaaatgcaacgcaattatcaccgagacaattgcaacacacgcatgttttcggtagcttatgtattatggattatcacggtgcacttcccaagcttttaaacggtacaccttttgcaaaacctttcttcgttcgtatttcttagagaacttttcaaaattaacttatgaactttacaaaatgcaattccctcgagtaaactcagtttcatttcaccatccactgtttataaagagtacgcgttttctaatttcgcttcaaatccttacaggtaatccccttttaaaatgatgcctacaacaacgatgaacgatgataaattgggtagctgccatatgcacatgccacttcatgacgactattccctccgtcccaaaatataacaacttttggttggatgggatatatcctagtactatgaatctggatatgcctcttgtctagattcgtagtactatgataggttctatccataaaaaaattactatatattgggacagaaggagtacaaagctataggtagctagccctgtatagtgaaataaatctagaggattccatgatcttgcttgcagccctgcgccgtcagtacagttttaatgtaggtcttagcttgatcgtcttcgacatgtctgcctccggtacgttgccatcctgcgttgcaatcatggcgcgatcgagctaacctgcaacctaatccttgccatgattctagtgtctcctcgtctctttgtcacgaaatgttgctcctgtttttatctgctcctactcatcttattcatcatgttttgaggcattaatttcttaccacaacatttggtttgagtgttcgccaatcgacgtccatgacgccacaacatatggccctatttacatacatttattctgcgtgattatattgaatcctctatcctgcaaagcctacctatatatcagccatggcattaactcgacctgattcttttcacgctttagtaatgacaatgctgctgctacgacatccacagtgtgcctttgcatcaatacgtgcttgtacacatgtagtactgtcatcgccactaaatgtgctgcaagtacgtacttgctagaaaatctctagccattatagactgtaatatcggttgctagtacacacctcgcctctctccgttaatttatagccttccattggttgctgtctgaatttatggagacgcaagctagctagagttcctacttcctcttataattcggaagattcttctgctctgcacactgatattacatatatggacacaattgttcatacatgcatgtcattgttttccttttgccatcttgcttggctgctttccattaataattggttgcaaagctccagtaattgtctgctatcttatcttttacaatacatatcaagtgcaacaaatgtctgaggaaagtgtggtagaggtcaccaaccaaaccatctttagttactgcacccaaatcactactagcattcactatacatatatgcttctgttggactgattatttgtttgctgtgcatgcagcaggagtgtttcaatactcagtgggagtagaaagactgagcatgcagctaacagcctaggaccaagagagtaggtatcaagcctggctccaaaggcacttgttagctagaaatgacttaacaattaggccctgtttagtttccagaaagtttttttcaaaaacatcccatcgaatctttgaacacatgcataaagcattaaatatagataaaaacaaaaactaattgcacagttaaaggcgaaattgcgagacgaatcttttgagcctaattagtccatgattagccataagtgctacagtaacccacatgtgctaatgacggattaattaggctcaaaagattcgtctcgcggtttccatgcgagtcataaaattagtttttttattcgtgtccgaaaaccccttccgacatccggtcaaacgttcgatgtgacacccaaaaattttcatttcgcgaactaaacggggccttaatcacaccttgcttagaggttacaaagactatctaggacttaattgatgttgttagtatgctagcagtacagtgtatggattgttcctttgttaattattgccattgtgggacggttgacgcctaaccactgctagctaatccccttttctctttcagggcttcaaagttcaaagagagggtagcatcatgcttgctttagtcagaagaaagtcactcacatccctactgttctagctttcagttgagatcaactcaatcaaagatgccatgccttcgaactatacaagcaaatcgcatgcccctgcttatagtcactggacggagggtcctatgatctttgggccccactttcggtgacattatgtacttcagaaggatggagaaattagagaatttattagaagtaggagtattgtatatgtgtctccgggaatggaccatatatggggatatggatagctgaatggaaacagcacgaaaacataaaatattttttgaactttgccgtttggatagtagcagggttggtgatactttgcgtctttggttgttaagcagttagcatgacgttctggtcattttgctgcttctattatttcgctagattccctctactttgcctttgccggttttgccatgcttttaacagtttcctgttgtgcttccatgcatgttactgaactagttagtatcgtctaaatttgatgaacttctttctttttttcccctttttacacgaaaacatgagcttatgttcgttggatagcagcagccagcaagattatagccttggatagctggtacgtcttacgttcttaaataattgattgtttaagtttaagcttgttttatcttcaaaaaaaagtttaagcttgattgtctgtctttttttttcctgaaaaaaaattataaatgctttgttggtgctagatgggatctgcgctccgaactccttgaacttgaacagtagtacagtaccatcaagattttgttggtttaatatacaatagtagttcacaatccccttaactagtttctaaaataataatggatacgtggaacaggaggcaataacgcacacaatgaaaaatatgccactacttcaagttccgaaagcaacctttatgggatggttttagccaattttcgtatttagggcccctttaaatcgcaggattgagaaaacgtagaaataagaaaaacatagaattttgatagaaatgtaagtgtaaaacagaggattgcaaaacacaggaaaaacataggaatgaccgtttgattgaaccgcagaaaaaacaaaggaattggatgagaaagatagactcaaaggaaagttaccaagaggttaaagttcttgctaaatttttccaaaaatctctataagtttatccattccatagaaatttcaaaggattgaatatttcaaagagcttcataggaaattttcctataggattgaacctccaaaatttctatgtttttcctcctaataaaaagggtccttacttttgcagagtagaattctgaatgaattttgagatatttgttcttcaaaattcgtgtgaagttatccatgatccaaacatataaaagggttatgactgcttagcaacaagaggtaccaaaagataccaagaactctacactatcttctcttttttttccttcgagaaactctacactagttaactataggaagtatcaaagagttactgaaagctaagggcccctttgaatcttaggattgagaaaacataggattttgatagaaatgtaagtgtaaaacagaggattgcaaaacgcagaaaaaacacaggaatgaccgtttgattgaaccgcaggaaaagcacatgaattgaatgagacagaaagactcaaaaggaaagttaccaagaggttgagggcccctttgaatcgtagaaatgaaaaaacggaggaatatgaaaaacataggattagtgacaggaatgtaagtgtaaaacagaggattgcaaaacacagaaaaaacacaagaataattgccaaggagtgaacctctctagcgggaggacgtgagaaccccctttgtgagttcggccaggggaataaggcgcgatgatcaagagcgtatcttcgccgtgggattacgctaacgtggtggatggcgatcgagaaggagacagaggatttatccaggttcgggccgctgagaagcgtaacaccctacttctgtatgtggattcaagcttatgctgttgcaagagttctcaaaccctagggagatggtcggctaactttctcctaaggttcaagcttccaagagtcgttgttttgctcggtgggcaaggtcctccttttatagttcaaggggttaccacatgcaccgtctctacacatatcgtccttggaggggggcccacatcaacccgggctgagtagccaaccatgccttaggccggaagtaaggtggcagcttgtcctcaggtgggtcccagcgctatccttcgtctgacacgagggacatcccccgtcattccctcttaaattcatggagactttggcgaatgcatgcacaggagaggcaccaattgtacattggtctccgagcgttgatgggacggggcatacctgcccccacgctgcctgacacaaggcggggcgtgggtgcgctgccgcccatcccatccacctgcggccggtcttagcccggtcaaggacgattgacgcacgtcaatcgattggacgtcgcacgaccagccacgctgtattaaatgcggcggtggtggttgggacgccgcccatcaatgcgcttggcagcgccccttcctccacccactcagctgcgacgtggcagccgagcgtgggccccggggcgacgcagcccctcgggcccgaggggtgcaacgggataccccgagacccctaggcggttacgggcgcctttcggctacttactacctgcgcgcccgacccccccccctctcgatggggcccaggccgcgcagccacgtggctaggggaaaggaccctttccccttagcatgggtacccccgggcccatatcatcgataatgatcgtttgattagactacagaaaaaacataggaatcggatgagagaaatagactcaaaggattcttaccaagaggttggacctcttgctaattttcctccaaaaccaatatgcaataagccattccataggaaatttataggatttggaaaacttcaatcctttaaatcaaagggctacataggaaaatttcctataggatttcaatcctatgaaattccttcgtaatttctttgattcaaaggggccctaaagctctggctaaatttcctccaaaaatctatataggattgtcaatttcacatgaattttaaaggattggataggattcaatcatttgtgtcaaagggcttcataggaaattttcctataggtttaaaatccaccaaaatttctatgtttttcctctaaatcaaagggccctaacctaaacactgttccctgaatgatttcttctatgattacgaatgatctaccagaaactccatgcccctgacagcaacacaccaccagatagcaacatcaaattggattttaggaattaagcaacaagctactctagtatagcaacaagacctgacaagtttagccagggggccagccagcctctcccgacgaacgatcgaagccagctgctgcattattagtgtgcagtgcagagctctgtagcaactgaatcatggcggactccttcctgcctgcctcccttccaaagctagccattgcgtgctggagcgatggatcgagtactactaagtagtactccgttctagtggcgatcgaactgccgatccatcgagcaacgtatgcaactttggggcacataatgatatacgatcatgtactgatgtaccgagtaaaaccatggacaggccagtacttgacaatatgtactccttcctccaaaaaaatacctgcatcttttgttactatcttcaaccctgctaagtacaggggaatctacaattacccatgtttaaatgcatgtgttaagctgcaccctgtgaaatctgtgatgtataataacctacaaaattaagatgcagtcatgcagacaatcaatcaaagtggatgcattttgttaaaaaaaaaattcataaggctggtagcctcattatctgagaaataaggctgtcaattctgcttcgttgtttgctggtttgagtacggattgagcatgcttcactgaaatcatgaactggttcttcccgaaatgagatcatggaaggcttgccattcactcatccacaaccggagcttcttttccatgataacagtatgggtctcataaactatggctctgtgatgtattccttacaaatgagtcccagaattcgacaaacacaattgtaaatgatcttataatggaatggccatgggtcaaacatttgctcctaaaattggtgaatcattgataatctaggagggccaagacatgataggtgtcttcctttaacatctcccctttttctgttgttgcccattccctgctgttctttctcagaaattttaccctaccatgctaccagcagtttatgatttatgcttgatttttacaaaaacacgctatgaaacaaacacttaattttcacctgacaggtaattaacaggtcccatggtatatgaagccatgaacatttctttaatttcttaaaacaaaattgttattaatcgaacctttctgaagcagtcttaagaaaaatagagattttctttaaccaaaacatggacaggaaatcacgatgagatatgttccatccgtctcaaaaagaattaaacgctacgaatgtccagaactccagattcatttctaagatttgaattttttagaatgaaaggagtataaccttctaattgcacacagtatttggtagtaactggcatgagaaattgacagaacatatgattttttttctctgtttcacgaaaaaaaatatcttttttttgtttggttgagtcgttgtttgcctactccacagcatccatcatccacagctgagagatttgataatttaacactcttttcaatgggtttcgattatttgacatcctggcccattttcattcactcagatggtctcatatatcatcctcacaaatgttaattaaagtaattagacaacgaaaaaatgtcaaattattaaatttttctccacagctacaccctcctcctctcccgaaccccaatcaccatggccataagacgatgagctgagagagagagagagttccaaccatctcctctcctctcttctcttctcttctcttctctcttctctctcctctccccgacaagcacagggctcgtcttttcctttcttcccctcactcttttccccttcactcacacacagtcacactgtgcgagcctgtgtgggactgtgggtgttggccattccagtacaatccgttctctttattcctccctctcctgcttgtctcgttgcgtggccgtggccttgtgcggttttatggatcaagaaacctcacgagaaccccgacgcttcggccgtctggtggcgcggcgctagccatctctttggatcgctcctcgcgatcgcattgcggccgcgttctttgatttttggttttttttttgtccggtcaaaggttggttcttg

SEQ ID NO: 2683 - DNA, 7304 bp, Oryza sativa
  unsure (1)..(7304): unsure at all n locations
tgttggtagatactggttcggattgtttcttggaggaggaggaatttcgcgtcttggtgagttgggatttgatctttgggccggctgaaattgggattttgttttgttttgattgagttgcggtttgttttgtctggattaggagcaatggcgggcggcggcgggcagtcggcgatcgccgctgaggacgacgacctcgagcgcggcgcggagcgcgacgaggaggaggaggaggggagccaatacttcaccgacgcggaggaccaccagtcgtgggcgtcgcactcgcgccacaactccaccgcctacgaggactacatctccacctgcgcctccgtccgcgcgagctcctacgacggcgaggcggaggaggaggaggatgccggcggcggcggcggcggcgtcgagcaccaccgcaggaagtcgtcgtgcgtgtcggagtgctcgctggacgacgtcgacctggaggccgggctggccgaggtcatcaagggcagccccgagaaggcggagaggtgctgccgcatttgccaccttggcctcgagaccgcggcggcggagtccggcgccggcatcacgctcggctgctcctgcaagggcgacctctcctactcccacaagcagtgcgccgagacatggttcaagattagaggcaacaagtaagctccagactcactcatctaatccactctcaattactatttgattagatgcaatgttcgaagtcgaactccatatgttagctcggataaatcgatgaatcaattagtttattattattggataaggcatcacgcatcagcgtaagagcgaagtaacacaagatttatttcagatatatatatatactagggcatatgggtgtatgaacacatggttaaggaatcttgataggtgtctgtttttttttccctttgctttctttgggcggacaaaggtaaaggagcagatggggaggaaaaggcgaagtagtggattaattagtagtgttgtaggaatcgggaaggttgagatcattggagaggataaaggtaggattcgttctttcaatctgcttttctcacagattctccgtggcatctgattgttcctctggagtgttgtgttgaccaagtttgtttgttgatagattgacatggtctgatactatgatgcgccagtctatgtgacatgcctttttttttccttcgatttgatggtgcgagggaggtgtgattgtgtcatcttccattctgaaagtgtttgtttcaacacaattgtagttaggtgatccactgagtctcagtcacaaccataatgtgctccacttagccttgatccacttaataaaattgttgttaagagaatcaaccatagtgtgctccacatagtctcagactctgaagtgataaccgcttccagcgtaggaaaatggcctattatagacaggggatggttatagacaaaattggttttaaattttaataatcatggcttagttgctagtcagtgtaaaaaaggtgttgggcaatacaaactagtctgcaagtctaatttttttagtggttggtgttttctttctcataaaaatcggtagcgcaaaccgacacacaagtacctgttttgttcttgatattattttttactttatttttgcttatatattgttgccacagcttgatcactgtaagatttgctcaaactactaacaagaacatttgctgactaatgcagtttaggctaatgagattagttcaacaatataattacactaaagtttgaaccacagatattgtaattggaaactgtgaaccacggcaactcttactttataaaattatttcgattctatttctagagccaaatttctcaaatgagtctgaaatttcagaccttggtggtaataatgatttacttatgtgacatcagcttcagcaatattcattgcaccgattattgttttcacactatgagatgtaatagtgagccctgaaattcctatgctgctcccatgctgagaagaatagactgaattctgatcactgtgtttgtctgcacttggatctttttggacaattagtaatttttaagttttagctcctaccttttttccgtttgcagtacaaggctataggaaaacactgcggtaattcttgcaaatatatctatatttactgaggcttttatccttactcgcccaataatcaatgttagagtatatggtggttagagcaataatgttgttagattgatttatatcgtagtcttccttttctgtagatccctccttatctccacaccttttgtactcttaacaatcaaaattgcatcaatcatacttgtactgcttaaatcatttttttacactgcttaaatcatacttgataagttgatatccccaacattttacactcatttaatgacataacctgtcaatcaccttatcaaatttcagtaaaatagaattgaatggccctcaataatttcaatcttacttcaagtgcgaaggtgataggttttgagtacatttaaactaaatgatctatccttctgtttgccaggatatgtgaaatctgtagctctaccgcatgcaatgtggtaggcattggtgattcagaatccgttgagcaatggaatgaatcgaacagcacagcacctgcacaagcaccaccagctgaaactcagagattttggcaagggcatcggttcctgaactttcttcttgcttgcatggttttcgcctttgttatctcatggctctttcatttcaacgtcccgggctaagttttgaaacacatggtcctcaataaaagctccaatgccattactacacacctgtgggttggatttagtaaatctgaagaacaggctgaggtgaaggaaagttatgaagtggtacaaaaatgttgggtggggcatgttgatcttaactgtgtcaatggcaattgcctcctttcacaacgaccaagattccattagacaagaagctggaaggacaatttcctcctgtttcccttgtctggatggagatgaaaacaaagaatggagaatgtgtttgttccgtcaatagtgctgtcatggttttcaggaagagattgtgctgtatccattccctatcttctcaggcaatttatcatttattctgctgatttggtgtaagtgttatcttccaggagaaaaatgtgctgagttcggaagcatgtcgccagaaagaataaacaatattgtgaagttcctgggcatatcgccgcacatgaaattgtcgattttgtggagataatcctgtaatggtcctttcgacgtttgtgactccgtgttcggttgtttgttggatggagtacatgatgaaatgtcactctttgttggacgttagtactctttgttggatggagtactacagaatagtactagtagaatttttttatccatgctcattctaaacaatatatcatttcatcagtctttttcgtggtactaatgtggatatgtttgaccacgaagagaactgttgagttgaagaaattactgacttgtggcccaactctctctgtccttaaaaaagccggcctcgtactgtacgtgatacatatattatttctagattcgttatactaaaatatatcacattttaatacaggattggtttcttatattttaatacaaggttggtttcttttgggagagacagagggagtagcgggggaaacccatttggtccatgtcgaagcttgtactgctctttttgtcttaaaatataaggatctggatttgtatcacatccatctaaaatcccttatatctgggacggatggagtacaaagtacacgtggtacaatcttgcgactagagattggaactcctgtgagtgttcgattcagtgcgtgtctggcataaacacgcaataaattgcacgatacttggtggacgtatactggagtacatactaccaccaccaccgtcttttagtttacacacttagaccttgtttagttgcggaaaatttttgggtttgattgtcatatcggatatactaacacacatttgaagtattaaacgtagtctaataacaaaacaaattacagattccgccagaaaaccatgagacaaatttattaagcctaattaatctgttattagcaaatgtttactgtagcaccatattgtcaaatcatgcgtaattaggcctaaaagattcgtctcacaatttacacgcaatctgtataattagttttttttcctacatttaatactctatgcatgtgtccaaatattcgatgtgacagtgtaaaaatttttattttggaaactaaactaggcttacaccgtgctgcagccaggcccagatataaatgcaaattggttgctggaaggccacggtgccaagacacggctacaggttgatgttgaattgttgatgcaggttgaaagtatggacgcgtatgatgagatcgcgtgctgtgccaccctgcggcggtgaagaaatttcacttttttcagtagactgtatcgtccactcgtttaaaacaccgaaaaaacagatggtccctcctgcagttacttccaagttcatccatccatctctgatctcactctacccgtgtcactccacgatcatcaccagtggctctatccaagccggtgatgtgaacaaagcctaatcacacacgcaggggcggatttagcatatagctgatggggtctaggactttagtcaatctttacctatgagatgtggagtatattcttatgtgtatgacctgagtccccacattatctggaaagaaggcctccactctcagtttttgttactattcttgcaatctctgtttgtgcatcgaggcgttactaccaagactcaaaccaatcactcccaatcccctcgatctaattggcaatcaacagaaaatcaagatgaggaacaaaatttgatgcattctacgctcgccgaaaaattcttgcgcttccacagcccgcaatgtgtccaacaagtagccacctagatgccggatgagtcgccactcatgaacgctggcggcctgtggtacttccttccactactctccgtctaacagcaatgtactttcctattcaccgggtgacgtcgcatgttgtggccgatctctgcgccacgccctggtctgctaattcttagtgtacctataaaacccacccttcgcattacgctgtatttagtttttgaaattagagagaagttaggggaaagttggtagtttgaaaaaaaaaagttaaaagtttatatgtgtagaaaagttttagatgtgatgtgatgaaaagttgagtgggggaagtttggtgtgaactaaatagggctttagttattaagttgtgattcgatgtaatcccgtgccccgatcaatttttatcctccatccgcctctgcacacaggctctctgtcgtgcgattgttgcctccacctcgacgcggatagccgagctgcgcacaccatcgctctgcgctcccctacgtcgccgttcgcgcgacgcgctggcacgtggtctcccgctccgctcacccacgctgtcgccgtgcgcgtccgtgccacatcgcgtgagcgacacgctccaggcgaaaagcatgtggggtgggcaaccaaaaccgtcggtgagtgtgccaatacacgaatgaacaaacaattgatcagaaagattaagctggccactatgtacagcgacagctagtgactccgaagaacgtactacggcggccaagatcctgattcctgaatagcgtctaccgcccgattgattagagcaccaaatcatccattcatttcattcgttttatctgcgatcatgctatagtaccaggatggtggatgagcagaaatcgacaaggaaaccatgtgtaatgctgcctctgccgctggaatcttgttcaggatgtgcatgcactatgcagatggaccgggcggttgttctcaatccgcccccagaggattctcctcggggtcgacgcgagaagacaaactcccggtggaaagcagatgccgcggctcatgtaccaccattgacagcagcgtcggagagcgtgctgtgggcgtgattgatgtcttcatcgtgcctcccgttcatctgcgcgcgctgtcgctgaattgatagaaacagacacgtcagaaaaaaaaagtgcaatgtgacagtttgttccagtatgcctagtagatggctcctccaatcaagatcgaggtttttgttgtaatccctctcccaaaatataatactaacctaaaaccagattgaacgtatatatccagattctcatagtactagaatacaatccgatactaaactactccctccgacccaaaaaaaagacaaaccctggtttccgtgtccaacgtttgaccgtccgtcttatttgaaaaaattatgaaaaaaattaaaaagacaagtcacgcataaaatattaatcatattttatcatctaacaacaatgaaaatacgaattataaaaaaatttcatataagacggacaatcaaagttggacacggaaacccaagatttgccttttttgggacgaagggagtaagctgctactaggttacgtcaaatccagattatctaagtatattctaggaagtacttcctccgtcccaaaatgtaagcattttttaggttggcacgggtattaagaaagtaggtgagaatgattgaataaggtgtgtaattggttgaaaagagaaagtaggtgaaaaaaaatggttgtgattggttgagaggagaaggtaggtagaaaaatagcttcattttgggataaagtactgtgctagaaatagctacattttgggacggaggtagtatattattaggatggagggagtaattaaactagcaagggttgtacaaatttagtagtactcgctccgtctcaataaacaaatcatgagatgtgacgtattctagtataatgatctgagcaggttatcgcatctcataatatgtttgtttattttgggacggagaaagtaggatccagcatagtataaagtataggcaagttcatctaatagacaggctgactgtactaagctaggcttgttcagggagtatatagggagaagactttacaatacccgatcagtaggatccccatggtttccgtttaatagcttatggaactcttccttcagtctgctgtctttctcctccttcaacctgccatccttttccctggtactcaatggaagcaaaggtactccatttgtacgatccggcatttctgtaaatatctcaacnnnnnnnnnnnnnnnnnnnnnnnnnnnnnnnnnnnnnnnnnnnnnnnnnnnnnnnnnnnnnnnnnnnnnnn

SEQ ID NO: 2684 - DNA, 605 bp, Oryza sativa
cctattatgccgccgttgttgggcatctacgtcttcaccgaccggcttgccttcgccaccgccgactggtgtttccgcctgcacggctggcctttatgccgccgttgttgggcgtctacgtcttcaccgaccggcttgccttcgccgccgccgactggtgtttccgcctgcacggctggcctttatgccgctgttgttgggcgtccacgtcttcaccgaccggcttgccttcgccgccgccaactggtgtttccgcctgcacggctggcctattatgccgccgttgttgggcgtctacgtcttcaccgaccggcttgccttcgccgccgccgactggtgtttccgcctgcacggctggcctattatgccgccgttgttgggcgtctacgtcttcaccgaccggccgcctcgtccgccgccgactggtgtttccgcctgcacggctggcctattatgccgccgttgttgggcgtctacgtcttcaccgaccggcttgccttcgccgccgccgactggtgtttccgcctgcacggctggcttttatgccgccgttgttgggcgtctacgtcttcaccgaccggcttgccttcaccgccgccgactgg

SEQ ID NO: 2685 - DNA, 27876 bp, Oryza sativa
  unsure (1)..(27876): unsure at all n locations
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaggtctctatagcgaaaacacggagatgacctaactcttcaaggtcaattactttatgtgagattgcattgaagaaataacacagttttgtgacaaccatctttacgtgtactagtttgattactttgattgcaatagcaatgaatattatgagcattacatgacagtcatgagaaatgtagcccaaaagctataaatccttcatcgacactagccgctttatgtttgaggagaaaccggtagggactctcacctcgtgtagggatttgtacaatgccattttctcataatttgtcaaggtgtaataagtcagcgaaaggtgcactcttgtgacatcctggcctagggcttaataggattaatagaatactcataccatcaggttgcaacttattttccttaaccgatctccaaataactcagaggttaagcgtgcttggcgtagagcaattttgggatgggtgaccgaccggaaaattcttcccgggtgcacacgagtgaggacaaagtatgcagaaaagacttgtgttggtctgtgagggtagtctatgtccaagataagctaccagatgtaagtaggcctggcctaggagaggcgggatgttacaactcttccattaccttcatccgcaggtgaagctcttctgttatctgcgtattcacaaggtccttacatgtgacaacctggcccaattaagatatggcctatgtggtactccctccttccaaaaatatgagacctatttctttttgcatcaataccaagaagcaattaactcactcaccatatggcaaaaccaatgagcatgcaaccaataattattagaatgacttattggtttctgatcaacaattcaatttagtacatagtgactacaaataggacttagattttgagaaaaaccaaagaatgaaataggtctcagatttttggaaggagtacatgatagctgtgtgagcatgtttagtaccaccttgctagttttgcttgtcccttcaaccatatcactccctggttaaccctattacacgaagcaatgacgaaagtgtaagtggagtggtatctgtaagtgggaccgcccgttggacgagctgggctacacgattctggagggcgggccattacaaaatggtatcagttccgaccctcgcggttgcttgtatgggtcagtgtgcgggtatatggcacatgtgggctctatgtaaggcggactgcactaagcattaagagggggtgtgttcctagacatttacctatatgcctgtgtgtgactatatgggtaaattgggccaacggggatgtcgggtcctttgaggagggtgtgtgacatcctggtataattaggacatggcatgtgtggccaataagacctgtgtgcgtatatttagtaccatcttgctagtttagcaagagtgggcttgtccctccaaccatatcactccagggttaacacttttatacaaagcgaggataaacgtgtacgggagtggtatgtgtaagtgggcccgcccattggatggtctaggctacgcggttctggaggacgggctgttacattatgtgacttcagtccatcatttgtcttgcttggtatggctactaaagtcccaatggttctatagaacacatttttctctaggtgcatgacaccgataaaatgatgtatctatatatctattgaatagaacgcttggtccttccgcatttcgcttccgcttggtttccttcttttttgccttctcaaaaaaaaactttgagatttttcgtcatttggaacactctatcacccttgcatggtcctggtggatcatcaagctattcagtgttgtcgaaatatgctgctttggaacggtatttgtgattccttcttaagaacctgtatacggtaccattcacacagataacacagcctatcttccccttgatcaatcatattcgcttccgaacatcaacttgtgtaggaacaactttcatttgaacctgccatatgcaaaaactaatcttgccatcaaacttctcaatgtcaaatttgatacatgacatgttggagaaacaattccagatcaaaaaatatatataatagattccaaaagaaaagaaattccctgatataaagtctttgtggacgtacaaaaatccaacaggaatttggaacttcacataaacacgaagcgagcagtatcttcaattgatttttcttcctcctccagagccgtgcagctatgcgctgctgctttttcggtggatgcgtggtagcaaaaaagaactccgcttcggattgctgcgccgaaaactcaatcacgtcgagccgattaactcgatgagacgacaggaggacgcacgcctgccgccaccaaccagattcatcaaagaactcgccgtgggatgaagcgcgtatgctgccgccgatcagatggatctatcgaagaacacaccggtgtcagaattgttctcgctgatcagatcgaacgacgagaagatgaacgcgccgccggttctgaaagcagatcgatctccctagctaagacacaagaatttggtaaaacgggctataaggaagggtataaataatatgatcattcttagggcatgttctatttggaagcatcgaaacgcctgtgttttcaacgaggctgctccaatcatcttctcgactagttctagcgagtgacgaggctcacctattgagcctaggggaatttcgttgattatagatcccggttaagaaggcccatgattcaggttgttgggagagcctcggttaggcactttgttcttcttttgctcgtgttttgttttctcactttttgtcttttctgattatttgtatttgcatcttacgcctccgttcttccattaatgcaatgatacacaacatctcatgtatatttgagaagaaaaacaatcttaattactaaagattaagttgaaattgattgcatctttttatcttgttttggaacattttttcacttgcaaaatactgacttgatcttattcaagtgttttcttgaaagatacatctcaattgatccaaactcggattgaagcaactcatataagcaatatgctttttcaattatacacagggtattacaaattttgttacaaatacagaaaaaacagcaataaacattagataggaactccacaacatcaatacatcaccggtaggtcataattccacttaagcatgcagaattgatttagtgtcatgcattgattaattaacatataccgtaataagataccagacaagcataagatagtggcaattaattttccttaagacttcatgagagtgggttacgcagcaccattgcctctattgtgatacctggtccaaaggctagcattactccccactcaagttgttgatgctgatctccttccttctcccgacggcgacgcaagtcatcaagaacaaacgcgatcgtcgtgccgctcatattcccatactcgttcaacacatggcggcttgccgcaagctttgctggttgcagctgaagctcgccttctatgttgtcaaggatcgcacggccaccagggtgcactgcccagaagaggtcattccaattaggatccatgtttccaaccgatcggaatgtgtcaagcaagcactgccggatgttgtccttgatcagtgttggcacctggatagagaggtggaaatctatgccactggcggtggtctgcatgccaagtgcatgctcagtacttggtatcgttgtttgcgaggcgaggaccatctcgaatagtgggcgctcttcatcgaccagtgggccagcgccgacaatgattgctccggcaccatccccaaacagtccatggccgacaattttgctttcatctgggtttgagaagcatattagcgtcagctcggcacaggctacgagaacgcgtgcatcacggttgttctcggtgagctccttggcaagttgaagtgccctaccgcctccagagcaaccgtggaggctaaggatggtgcgagaaacagaagggttgaggccgagtagtgatgccagcttgaggtcagcgctaggagcactgcacccggagtaggtgctgaagatgaggtgcgtaatgtcaatggccggacggccccactcggcgatggccttccgtgtggctgactcggcgagcttcgggacctcagtagagacgatgtctacacgagtttcaagggagggcatgtgtttgtcgatgatctccgggtgctcacagatgagcttgtcatcaaggtggatgtagcgtttctctattcccgatctgtgacctgaaatggaaaaggatgcacccacatctcttacaattagtacatagcactaagagattataagaataacatgagacatttcaattaagatgccgaatatttacaaaacaagaatatatgatattatgcaagcattttccgtaataaaacaaaaatggtttatatatgtcctatttttaggaagataatcatgagtttaatgttctgaaagattggattagcacatatgtttcgttcaaacatggtctaatgatgtacttgtgggtgcataactctatccactaagactcaattcccggtgccaacatatagacaagtaagtgctatttttcagtacaaatttattaagatccacggatttattgctatgactactctgtagatctcttgtatttttgttaaaagcgtagtctttaaatctatacgagtacagtggcatgggtgcgagatggtagcctgatgagcaggagggacattatatgacaaactatcatatttaacgaggtattagtggtggatccaggatttcagagatggagatgcaaaactttactgttatgattcaagataagagataaagtgaaaaaaatatactagcaaaacacttaaatatagcgagtacaaatacaatgacataaataatgtagaaattcaaatggagcatatagtcctggatgaccttaagtgggcctcgtattgagcatactgcgtatatgtaccaagtatatactgtatatagtagattttttttcaaaaattttgggatgcaaccacaccccatgcatccacattgcatcccacacgcgaaataaagaaaatttggctgaactccaacatcatttcactcttctttctacgtagtatagtataaatatttgtatggtttataatgaattatggcaggagtgtcctaaaaatttaagcgcttgcataatttattctcattagagtttatgaaaaacaactaacgataatgatgatcaatgcaacgatcgaaatgaaaggattgttctacttacatatcctcttcattttgtccttcagctcaataagatgctcgctcttggttagaccaaagtagtagtcggcaaacccatcttgatagacgatatttgccgggtttgcagtgccgatggcgaggaccgcagcagggccttccgcgtgctgtgtgcacaggcggctgtcaacaacagcggcagcagctgctccaggcatggctgatggaatattggaagaacgtgtgcttttgcaactagttgagggagatggcagtatgatgtgtttattgatggatattctagcttgtggctgtgtggctttatactagtttttcgacaacctggtccaagttaacccccaactatgtttgcattagtaaatgacttaaaagaatatttaaaaaaatcatcacatgctccatataatatcatataacttaccagcagaatatcatgcttaaatctgaacaaaatcttattttaatgagaaaactaaatttatggaagttctaatttgtccacttcgtttttcgagaaatatatattttagtccagttactaattaaataatttagagctgccgatttcaagtttgagttatagagtttacagggatgccaacatatctacccatgctgttgttattgttcttcctggtttgtttgcttcagggtgggacacagggaggctcttgggtattggagtgaatactcaaaagttgtccgaaaataattcaacacatgtaggtatattacgcattacatatgtatatacttaattgggccaaatacgttattctcggtcttttttttctcaacaaatctactcctcctgacactattttgttttgttgtgatgaattttatcggcaatatataattatagagtgaatagcaagccttaaaatcataagttcattattgctttgctttactgaaaaataagattacttatttgaaaatttatttatttggtcctggtaactttctggagactgagataagtattatttgctttttcgaagtggcggtccataaaaagatagtatcaacaatatattgtaaaatggataatacaaaatatgatatcacaccttaaattttggaactactatcttgttcctaggttcaataataatagccaatatttcaagtttaaatgactgtaacttaaacatgtgttccaaactactctctcggtttttaaatatttgatgctgttaatttttaacgtgatatttgatcatttatcttattaaaaactttaatggaaatgtgcaaaagtatataatggtccaagtacatttaattattaaaaaagttcaacaccaaatataaatgttagttttatttaggaagacaaatgtaatatcgaaatgttaacaggcttatgtatttattacataaaaacggaggtagtataaataacgtacgtacaaaagctcagtgaaatgctttttgtaaatttttttggataattgtgggatgccattcgatgcacaaagcacaaaggagaaagacaacaaatcacatgacgaacttgttgtccacttcgtgtgattagctcacatcgtgcaaagtaggcaacgagattgccttattatattagaagaagcagcaacgtggccgatatatatatccattgcatctgcacgggcgcacggcattgatctgtaattcgtaattatttttgcattccaggaaaaatattccggccagctcaagagtatcccgatttgcacgatagttttcatactagagtatgtaattaaataatatctagtactagattgcatatcccgatcccaattttctctggtgtttacatatcataacgtataattcgagatcgatcgatcaaatcatagagcatatttttcttatttcgttcttgatcgtcaagctattaatgtagacatgtagtccaaaattgactcactcaaatattaatcttccctgcacaatcatctcttgatcgatcataacttcgtaagtggtcgtgactcgtgagaatcaaggacctaataaataatattgatcaaatcgcgcccaagaaatcttaagtctggtaatataatgttttggatcttcagtgattaaatgcagaataggaagatatcaacacataatcatgccctgacaattaaatggcctaaacttcctcaacctacgatagtgggcctcgtgcatctcaaaggaatgtcgattgtggagagtcgtttaaaaagtaactgttttcctaattaactttttagattgtctaagttttgcctaaaagactgtcactttttaaacgcctagaattgcatcgaggttcgtgtagactatttctatctcgccctatctcttctacacttcttatccctgtttcaagcacgcacacatgcatgatgtatcacaaccgctgatatacatcaccaccgcctccttcccgccgaacaagtccaaaattaatataatctatacaatcccttaaaataattatttgtgctgcacaatcacccacgtctcatgatcgaccataagtgatcgtgataatcaaggacccaataaattaaggaatatggatcaaatcgcgcccgagatgtgttaagtctggcaacagtactctggatcttgagtggttaaatgcagaataggaggacatcgacacataatcatcatgctctgacaattaaatgacctaaacatccccttcctaaggtggccccatgcatctcaaaggaacggtgatcatggagagcggcaagtttggctgggtcgtcctacaggggtggctcagttttcctaattaatttttgggagtgtctaattctcagttgccccccccccccaaaaaaaaatcaattttttttgaccatttaggattgcaagaattgggtggactctttctctctccccttatcacttcttccctcctcaaccccgtttcacctatgcacacatgtatgatgggttgctgctgactcctccctgcacgacgatgctactcttggcttgtcggcttgccaaaaggagtcaacggcgcaggtgaggcccacaaaaccatataatcctcagccttttcctcatccctgccatcctccgtctctttctccataatccagcggtagtgtcattcccgtatgctgtcggaattgttgtcaccgaccgcacagttaccatatggcctccctcgctcaggttgctgccaaccctgcccattgtcggcctccatcctcacagctccggtggtgcccccactgccttgctacctgcccattgccgccgcacaccgccagtccaaccaatgtccaaaccaattgctctaaaagttttacagcatactaataagaagacatagtaataaagagttctacaacacatgaaacttcattactccaccagtaggtgataatcccacttcagagtgaacagttcatactgtgttattaatataaccctcacaaaaatacatgcagtaaaaatacttatacaaaaacgttggagatgaaagcggatatattttagttaggaaaaatttacgacagaacactccaaaaatgtgatatttgctgagggacatcgtaagaacgtgaatttgtccgagaatactcataaaacacggtaatttgctaaaggacacaataagcattaaaatataatatttacttatgtgaggagggagaaaccacgtaaattgtctattttaccctcgtatttcttcttcccaagtcggccgcccagaaggaggtgttgccgctagtcgtcaagccgtgctctccatcatctcttccctgttccttattcacctcatcatgtcgaatgttttaacttttgacctcaccctctgtcatgcagcggatcgacaagaaagccgtcatgccgacgtgactccggagcgagctctctgtgtcacagtcaagaccatctccacattctgggcaccatggcgcatggtcgggccatccatcgcgccatcgtcatcgccgagaccctaggagccctccgacccaagcaattgacatgagatgtcgtgaatcatgagatcgtcatcgtcttcccaaactctggccaaccgctgccatcttcgattccgtctctcaattcctcatgaatgtagcgtctctacgtctctacaaacatcttggtagcatcgaactataagctccttggctcgaccggactagcaccgtcgtcaattctggccacctccggctaaaagacgaccaccgtcgggttcgcaagaagcctgcacatctttctctatttggccgcatcgtccaaggagctgccattcactgtcagcgtcgccgtgaaggagtgccagccggcaaggctctgcctcagctactgctctctccctcctcgagacaatgacacacgggctccactccatcaaagcaccagggacttgatttgtaaagaaaacaaaactctttgtactaattggtcctaggggcaaatctcccatgttgtgaaaattctccctccaaaatagcaaaaagtcataaaataatgtgtatgttgtctaccaataaattaccacattttttgagtgtccctaagcaaattcatgttcttacgatatccctcagcaaaggccatggtttttcaatgtcctgtagcaaattttgtctttttgttatagatcagcatgcataagtttgatggatttgtaatacaacctataaaacgcatggagaaaaattaagttgatgggagatgatatgcgggtatacaagtcattcgcacttagtgtagttaatagcaactttctactttctcgtgcttccacgtcacctcattttatcctagccattggatctcaatcgggtgatcaaccatgcacaccacatcacatcgccctttgtactgcactgcatcgcaccctccacccacaccacgtccactccctctcccttttcttatcctcctatccttcttttagttcagccactttgtccaatttatcctcttgcatattagttgatttaccaagcaaatgaaaattggaattttactcttgttcgtggaattatgctcggtggattcaaaataattaaatattttccactcttacgagtggttatataggatttgccacttgaccaacatatcatagacacatgagatagatacatgagggcccacacatcatacacagcgagtggcaaatcattaattggcacatcttaaaagtggcaaataattaaatgtcctagttcgattcatatacatctccacaccattatcctctccaatcgctccaatgttattgatagggaaaatagatgcaaaagagatacataattttatgtgaaaacatccctctaatatagagagaaaataaccatagaagacaaaatcaactatgatggttcagggttacatgtagaagggtggcccatatatttagacacatattgaacaagaccctaggactaaatatatttgagtcattatccaacaacctttccttgactcaaaaaccctataaactagatgataccctgcgcgttgcagcagaactttctaaatgacaaaataatttctaggaatgtaacataagattgttaactaaaagaaagaagaaaggaagcaaaacacacatgtatacatcctggcatggttgattatgtaaaagcacctagctacaaaacaaaatggtgcaacaaagagggatggattcacaatgctcagcgaaagtaaatcgataactagaataaaaaattgttcgagttaccttcttttttggagagaatcccttatatgccactagaatttgaccagttcccttgtatgccactaaaaattggcttcccccttatataccactagttcaagtttttccaacattttatgccactcccaccactatagtgttagttgactgttagtcaaaggttagtttttttcgtaaatgaccaatatgccctctcaactaaaaaatgtgtaaacttcaaaaattcataactaatttattttaaatcctttttgagtgaagaaaattttgtcagaatcagtgaaaaatgctctttatattaaaaatattattggaaaactgcatgtttcatgcttacattgaaaatttatttgtgatggtaatggctaaaattgcatgtgatgcagaaaaaaatcaattttcatatgttgtatctagtagctatattagtactaaaatacctattattggttgtatactaattctaaagggcaaatgcgtctttttacaatgaagttaacggtcaactgacggtggactgacggcaatggcataaaagggaggagaaacttgaaccggtggcataaaagagagaagccaatttgaagtggcatataagggagctggttaatttagagtggcatataagggattctctctaccttcagagacaaccatgatgatctctttgaatgtacatttagctatcctattttagttgaataaaactaattaacttcacatagaaatatatgaatgctatatttatccaaaaaaagaaaacacacctatttaggcaacaaagtagttgtttgcacggtagtaacatgacctgaaagaaggagagcagcacatttcaggtgtcaatacagtagaaaatcaaatgacagaaacctacagcaaggcaaaatgccaagcgcatgtttaatgaaaacatagtttgattatctttacggtttgctatccctcagtagatcgatatgttgggttgcttaccttaccaatagtaaaatccaaacataatcgatgtggagaaggatgtgtgttgtacagtaggagtgtagggcaaaagagaatatatatattttacagcctgactgtctgatagtcataatttcgttgaaagcctgctaagtttgcctaagcttcaatagccgtaagagcgtagcaaagaaaacccgcttcatacctcgcactttgcttcgtctgtctcgcgcaagaagcccatcgaccatagcatgcatgcctcctccgctctccaccacctgctcgtctcttgcttcgttaattatgccgtccaatcgtcgatgctgtaacctactccaaagaggcgaggcaagagagaccagtagcccggaaccccctgcgttgcaggcaagcacaaattgaaattagcaaaatatgaaaatacagaaagaggatttcccgactgttgacgctgccttctgagctggaggggatggtgcttgaggttcatctaaacggaggatgaattgtagggagggaataaatggaattaagcccattattgatggtggtgacggttttttcctcgcagttcgtcttccaggtggcttttacggcggatgaaagaaaagaagcgacccaaatccctgagccgcgccgcgctaggccgaactcgagtcgccaccatggccccatcgatttgttgcaggggttaggagaagaagcgacacaatgacactgcatggtgtgccgtggggatgaaaagtgataaagacactgcatcgtagtggatcgatttggattccatggcagctgcgggagtccaagggaggcggggccgagccaaggagacagggaggagtgattgggcaaggaatcgctgggagggagatgcagtgggggcggcggagagagatgcgggagagggagccgatgtgggtgcgctcgcgtgagagagtagcaatgcggtggggccggcggagcgagacgcgggggaaggaagacgtacgcggatgcgggatgccgggatggggtgtggatcaattagattagatccaacggttaggaaaaaatgatgaggaaaaaatgatgacgtggaagcaccaggaagcagagaatttctagtggtggggatgatttgtataggtatataggatatgttgtagaagaaaatgtctccaaaaccctgaagggctgctaagtaccacaaatacctactaagtataggcaataattgaacttagttactgagagtaactttgtaagcatatctacgggattgtcatcagtatgtatcttcctcataaaaacttgcccttgagcaacaatatcacgaataaaatggtgcttaatatcaatgtgcttggtcttggcatgaaacatatgattcttggtcaaacaaatagcaccctgtctatcataataaacaatattaacatcctactgaataccaacttcaggaataagacctcacaaccaaatagcttcctagacaccttcagtagtagaaatatattctgcttctatggtggaaagagcagtaacagactgaattgaagctttccaacttacagcagaaccacacaaagagaatatccggaaatagaccttttattaagaacaaaccaaacaacatcatctatcttcaccttattcatatcaaacattaagccaaaattagaagtaccttttaaataacgaagaatccacttaacaacatttcaatgttctttgccaggattatgcatgaatgtgctaaccacactaacttcatgagctaaatctgcgcaaatggaaatcataccatgcataagattgccaacagcactggcatatggaacatgcgatttgtaatctttgtcatcttcattaatagaacactggcttgaagataatttataatgtgaaacaaaaggtgtagaaacaagcttgcaattacgcagattaaattagtcaactatcttatacctgtatcttttctgatatggaaataattaccagccttgcagtcatgctgaattttcgtgccaataattttctttgtgagaccaagatctttcatctccaattcatatctaaattgagccttacactgattaatcggtgacttctcataagaagcaatgagcatatcatcagcataaaacaacaaataaatgaaagatccatggggaaatttcattaagtaaacacaattatcataattgcttcatgaatattgttgtgcaatcataaaagaatccattattttataccactccctaggagcttgtttaagaccataaagagatttcttcaaatgacaaattaaatgtttttttcctagaatagcaaaaccttcaggttgtatcataaaaatcttctcttctaaatcaacatgtaagaaagttttaacaccaagttgctctaattccaagtcaaataaagcaacaaaagcaatcatcacccgaatggagaagtggcgtacaacagataaaaaaacttcattgaagttaataccttccctttggtcaaaacatcaatgaagttaatacctcattgaagtcttgcagatttaactctagaaatacaatccttcttatcaatccatttgcacttcgaagaatttggaaagcttttccaaatcccatgtatgatttttatgaagactctcaatttcttcacttatagcagtcaaccacttagaagaattttcacatgagatggctttagaattagaacatggttcaacagtatcattatcaacttgtgtagtaagaacaacataacaagccatatcattagagtcacgatatctagcacacaattgaatatatttttcttctatttctatctcaagcaatacaatgatcatgtagaaaactaaatttatggaagttcaaatataacttacaaacataatatcatgcttaaatataaaaaaaatcacattttaatgagaaaacaaaatttatggaagttctaatttgtccaattcatttttggagaaatatttattttagttccgtcgctagtttaataatgagtaaattgcatcagcggtacacgaattgttaggtgggtgcaatcttgtacaagaacttgtagaacactcgtttgggtgcacaaacttgtttggtgcatgcgaacaaggtcaaaatcgcatggcaaggttaatcttgttgattttgttgttgatttaaactctatgtaaatatgtatcgaagaaggataaacacataataaggcataatgattgcataaaaaaataaaaaactgagtaatgatgtaaaggatagaaacaaagaaagataaagtggaaactaagtttataaatataacctttctactatgtgcatgcacgtcatctactaatttataatttataatgttcaacatagaaaaatcggtcttgtcatgccattttagccttagtttgcatgtatcagacaagtttatgcaccaaaacgagcattttacaagttcatatactaaattgcacctacctgtcaagttcatgtacagctaatgcaatttactctttaataatttagaactgtaattattaaccaccaaaataattaaggcctggatgcactttcgaagtgttctctttaaaaatacatctcaattgatcaaaactcggattgaagcaaaccatataaacaatatggtgttttaaatatacacatggtattacatttttttacaaatccagaaaacttaacaatcaaagagcatattaaagcaataaagagtttaattacaacatatactagagttgagtagttgacaactcaaatatcttcacaaacattcggtaggaattccacaacatcaatacatcactggtaggtcataatcccacttaagcatggacaattgatatagtgtcatgcattaatttattgccatataccgtaataagataccagagaagcataagatagtggcaattaattttccacaagacttcaagagagcgggttacgcagcaccattgcctctattgtgatacccggtccaaaggctagcattactccccactcaggttgttcatgctcatctccctccttctcctgacggcgacgcaagtcatccagaacgaacgcaatcgtcgtgccactcatattcccgtactcgctcagcacatggcggcttgctgcaagctttgttggctgcagctgaagctcgccttctatgttgtcaaggatcgcacggccaccagggtgcaccgcccaaaagaggtcattccaattaggattcatgtttccaaccgatcggaatgtgtcgagcaagcactgccggatgttgtccttgatcagcattggcacctggatagagaggtggaaatctatgccgctgcaggtggtctgcatgccaagtgcatgctcagtacctggtatcgttgtttgcgaggcaaggaccatctcaaacagcgggcgctctccatcgaccaatgggtcagcgccgacaatgattgctccggcaccatccccaaatagtccatggccgacgattttgctttcatctgggtttgagaagcatatcagcgtcaactcggcgcaggctatgagaacgcgtgcatcgcgattgttctcggcaagctccttggcaagttggagggccctaccacctccagagcaaccgtggaggctaaggatggtgcgagagacagaagggttgaggccaagtagtgatgctagcttgaggtcagcactaggagcactgcacccagagtaggtgctgaaaatgaggtgggtaatgtcagtggccggacggccccactcggcgatggcctttcgtgcagcagactccgcgagcttcgggatctcagtggtaacgatgtctacgcgattttcaagggaaggcatgtgtttgtcgatgatctccgggtgctcacggatgagcttttcatcaaggtggatgtagcgtttctctattcctgatctatgacctgaaaaggaaataccaacatcttttacaattagttcatagcactatgaggttataagaataacaggagacacttcaattaagttgccgaatatttacaaaacaaaaatataggatattatgcaagcattttccataacaagacagaaaataactgatgataatgatgaacagtgcaacgattgaagtggaaggatcgatgtgcttacatattctcttcattttgtccttcagctcggtaagatgctcgctcttggttagaccgaagtagtagtcggcaaacccatcttgatagacgatatttgtggggtttgcagtgccgatggcgaggaccgcagcagggccttccgcgtgctgtttgcactggcggctgtcaacaactgcggcagtagctgctccaggcatggctgatggaagtagaagacgtgtgattttgcaactagttgagggagatggcagtctgatgtgtttatggatggaaattttagcttctggctgtgtggctttatactagttttttgacaacctggcccaagctagaccccaactatgtttgcattagtaaatgacttaaaagaaaacctaaaaaatcatcacatgctccatataatatcatataacttacaagcacaatgtcatgcttaaatctgaacaaatcacaatttatcataattaaatttatgtatgatttttccaaatcgtttttggagaaatatatattttagttattttagtttttgtactaattttataattcagaactggcctcgacccatttctagtttgagttatagaaaatgggtagtgtaagaatgccaacatatctgtccatcttacagtcaaaatgctcttggtcttcctggccatttgaattatagagtttacagaaatgtttaggaatgctaacatatctacccattttacatgcaaaatgctgttggtattgttcttccttgtttgcttgcttccggggtgggcacagggaggctcctgggtattgaagtacatactcaaaagttgtctgaattcaatacatgtaggtatattacatgttgcatatgtatatacttaattaggtctaatactttattcacggtccttttttctcaacaaatctatacctccagactctaatttgttttgttgtgatgaattttatcggcaagaatcattgagtgaatagctagccttaaaaccatgggtccagtatttgctttgctttaccgaaacaaaaaaaaaacattacttatttgaaaattgatttttttagtcctgataagtttctagagattgagataagtattactccctccgtcccaaactatgagcttttggactccgacaaagtcttcgagatgctactttgaccaacaatatctataaatataaaatgttttaaataaaaagagttgcatattgtaatactttgattaatgataaatctagtaacatcaattttacatgattaatctttttttttatttttttgctattaatagtcaaatttgaaaataattgacttggcactgtgctaaaaatacttatattttgggacggatggagtatttgctttttcgaagtggcggtccataaaaacggttgtatcagcaatgtactgtaaattggataatctaaaatgtggcatcacgccttgatttttgatgcgggatcaataataatagccaacatttcaagtttaaatgaactgtaacttaaacatgtgttccaaactactctctcagtttttaaatatttgatggtgatgatttttaacgtaatatatgatcatttatcttactaaaaattttaatggaaatgtgcaaaagtatatcatggtccaaatttaatattaaaaaaattcacaaccaaatataaatgttagttttatttaggaagacgaatgtaatatcgatatgttggcttatctattactccctccgtcccataatataagggattttgattttttgtttgcaacatttgaccactcgtcttattcaaaaaattttgaaattattatttattttatttgtaacttactttattatctaccgtactttaagcacaattttcgttttttatatttgcaaaaaaatttgaataagacgagtggttaaacgttgtaatcaaaaactcaaaatctcttatattgtgggacggagggagtacgcacaaagctcagtgaaatgcttttttgtaaaattttttggataattgtgagatctgtcattcgacacacaaaggagaaagacaacaaatcacatgacgaacttgttgtccacttcgtgtgattagctcacatcgtgcatagtaggcaacgacattgccttattatattagaagaagtggcaacgtggccgatatatatttccattgcatctgcacgggcgcacgtcattgatctgtaattcgtaattatttttgcattacaggaaaaatatcctggccagctcaagagtatcccgatttgcacgatagttttcatactagagtatgtaattaaataatatctaatactagatttcatatcctgatcccaattttctctggagtttacatgtcataacgtataactcgagatcgatcgatcaaatcatagaacatatttttcatatttagttcttgatcagttaagctattaatgtagtctaaaaatcagtcactcgatcaaatcttctctgcacaatcatcaaagcatctcatgatcgatcataacttcagaagtgctcgtgagaatcatggacccaataaataatgttgattaaaaatgcgcccaagaagtgttaagtctggtaatataatgttctggatcttcagtaactaaatgcagaataggaaatatcgacacataatcaagccctgagaattaaatgacctaaacttccccttcctaaggtggtgagcctcgttcatctcgaaggaatggcgaccgcaaagagtcgtttaaaaattaattgttttcctaattactttttagaatgtctaatttttgcggaaacgctctctctctcttggacgtcctgcggagaagaaacatatcaggtcttctcaaccactcatttcacacccgtgacttttcccctccctactttttctcctttgtatcgctcctctctccctctcccactaaggttcttgtggagcggcagacatggtggctgccacaagcagtggggacgtcctcccgtgtggctcaccgactaggtctcgcaacatagcttaaggccggggagcttggaggaagatgacaggccccccgtaatctggagctgaggcagcttccgtttgcccgagtagcaacaacgacatagctgagggctaggactggcaatgacggggtgatggtcaacagctttggtggagatagaagggcccatggtgccctagcttggatttgcaaatgagactgaagaaaccggtggtcactggagaggaggaataagctagatctaaaatggcaaaatttgtgatttttcgatgtttcagctaatgcatcttgatgttcttggggttagatcaaaatgttgcatgggatactttgatattgtttcacttttttgtcttcagttcttgcatatccatagatgtttcagtttttgaagcttgatgcttcatttgtgaagaacaaaatatttcaatctttgatctaactttgtttcatcattttaatatattgaaacatttttatcttattgtcgaaacatttctctattagaggtgtttcttaactagctccttgatgcaaacgaatctgttgatgcttcaccggtgtgaatgaaatgtttcagtcataatttgaatgtgttttagcattttaacaaaggtgaaacacttttctaatagcagtgaaacaacacccgatttttagggaaacgcctgatatgtagttgtttcgatttgtaaaaattctctctcatgggggcccggcggataagaaacatattgggccctctcaaccattcattttgcacccatcactgttccctccctaatctttctcctttgtatctctttctcctttgtatcacttccctctccccctccggtgtgaatgaaatattttagtgatgatttgaatgtgtttcagcattttaacaaggtgaaacattttttatctagtggtaaaatattttttttctagtacgaccgattttttaaaaaacttgggcacccaattttttgttgtgtcgtaacccgaactgagcaatttgctgctgcccacctacgaaggctgggatgcgccgatgctgccgcttgctgattggcttggagaagctggaatgtcgttgcctactgtgctataccactgagggaaaatatagtgcaaatcacatatatagtggaaacctaaaaactaccgttggattgtaaaatggacgtttgagattcgtctacatcaccaagtaaaacttttactcatgagtaaatatacgagtaaaatttttactcataatgacgtgaactactctcatacgtccatattttccctacaactgatgggttagcgtgttgtatacctgtatatgtgttgcgagcttgcaagcaaataatgcccagcaacaaagacccaagtttggacggggccactacacttaattaactgcaacatccgtcctataataaaattaaattagagacagattagcagcatacacaaatgaccacaatagttatatttaatgagatcacactgcacgcacacatttcatacctaaacttgattcaaaagaagtttgagattgggatggaaaaatgggaggctaggaggcaatatatcccatatttaaatttgttgggttccttcgtgactactaactagaaagacagatatttattttacaaaacttgaaaagatgtccgtgcattgcaacgggtgaatgttattttaatcttattattgttatacagtttagctatggtgaaatttactgtgggaattcgcttggatattttttttaagataatcacgagctgcagttaggagtctgatttttatctcaagttagtatgcaagttttttaaaaaaagattttttatatgacttatttcatatttctaaaagcaaatgaatttaaaatccgactcaaacacggatatgtattttcaaaagcgaacggacttaaaactaactcaaacatcaaaatatagatgacgtaccaaaatactaacaaaaatatttttgatttttataatagtagatatttgaatggtagaaattgtcgatgggtttgatccgatcacggtattttgggattattagtacgctggcaccagggtatacgtgttaccgaatgtccgagatttgcttgattatcttattaaaattgggttcagagcgtgcggaataaactgtgttttttttgttgtttttcagtttgctaatcctagcgcgtgtcatgccgcttccgccctcggtttccatcgcacagttactgatactgcaggtctgtgggtgtgcagggctttggatttggtgtgcaccacggaggcattgtgcagttgtgttacatttatgtctttttcattttctttttaagagaaattctcgttcaccagccacctcttctacaaatcaatgtagaacacgagttctacatggcaatggcacactagtaaaataaaatttatggacaaacaccctaataggttaaaaataggctataagtgtccgcgtctacaattttcgtatacggctctttataatacccacacacaaaaattaatttttcaaatgaaccacttataacgtccacatgtaaaaataaggatattttcgcacatagggctcttaactcacccacatgcaaaaatacccctcctcttcccactattttttttattctctcctccccccctctctctctctctcgcccggcctcacccgctcctctcctcttcccaccctcacccactcttcctctccccgctcctcccgacggcctcctccatgctcccccgcgcatggtggccctctccggcggcggagggcgcgggatcaatggcgggcttggaagatagtgacagtggtggcggactcgagtgggaggctggcggcgagtctcccccatcctcctccgcgcaaatttggcggtggtgtggatccggcctccacacaccgtgatcggccaccggcgatgacgagaggtgtggatccgccggcagcgaagatgggagaggcggatccgctggcgacgacgacggcggcggccgactagagttagggttagtttttttattggaatttttatttttctttttgagattttccatttttccgtgcgggcagcttatgcgcccgtacacgaaaatctgattttcacatataggtgcaccacccacacgtaaaagtagcgattttcgcataccatttggtgtgtgcggttagccataccgcatgcgtgaaccccttttggaccgtatgtaaaaaccgttttttactagtggcatactagcattttttttatcccttcttcccaccactgtttggtttttcagctatagggctctattaagtcctcttaaaaccaacgcaaccgagcttaaccgattagtttctttggggtgaatcagcttatccggatttaagtcctaaacatgctcgcattatgtctaattattcttttagtgttaaacaacttacctgtcttatggagttatcgtggtaattttgtcactctcaaaatatgccggcccagtctttcgaacgtgtttataaggataaacatataacggtccagtgtttctaagatactcatagaaatagagcgtatatgtgcacgttaacagggtgaatatgcatgtatagcaccagtgtttgtaccgtatttttaaaaaaataccacatttaggttttcatcttagagggcgattgtaaaaataaaaaatgatgtaggggtggccatacggtttatacggataattctgtttggtttcttgggttttcataatttcgattttctaaaattgccaatagaaatactcttcaggaaaatacaaacagcaccgaataaacggtgcttttgtttcggtttggtttacggttttacaaaacaaacctggcaacaactcacagtgaaattcaaacacgcaacgacggattagaaaaatcatcatacggatcgcaagacaccagatcaagatagggggtggaggtttttcagtttttctgacctcgctgttggcaagcccaagagcctctggagtcatggagactggagaggagatcaatgccaaattgccaaggcgatggtgtactggtgtggaaccacaagccagcgacgcgggacaagagcagtgggcggtggcgcatggtgattggtgactgggcctggtttggtgcctgacattgggtgggcaggtagttcgatggcctggaagatttgggctttaggtgaactaatgtgggggtactttgaaggaacaagtccacttcacgtccgtcaagtttaaataaaatccctgaacgtcaataccgggaatcttgaccctccgacttgtaaaaccaggtaaaattagatcacatggcagtatggatagatggttttacgcattctagtcagcaagaataaaatttttttaaaaaaacatatagggcccacatgtaagtggccaactctactctcctctcttcccctcatctcctcttccaagggagtggcagtggccggtgagcccgttcgtaggaggagacagcagcagcactggtccacggcgaactcctcttcttctcccgtcgatcctcttctgccacagcttttaccgctgatttggtcaccacgccggcaaggcgactggctgcagccctgcggcatttgcggtagtcggacatgacggcaatggctcggggacctcctactgccagtgcatggagaacgactgcctctggccctagcctccgctgacccccttgtcggctgccattgatggtcatgaagcttgctagcgcaatcactgttttgttgccgcgcgcgacgagcccgccttagctgttgccgctctcagagtagttggtcctcagacggcgacgatgactattcgatgttgcacccgcatccgctggtctatccgctattggggcctcttcttgccggtgtcgtctcgccataagtagtgtggcggtggtacggcgagccggtgtagggggcggtggcgcgtctcttggtccgtgcttgtggtgggatgaaggaggcctccgggttcccgatggggtcgttgtggtgcagcagcgacggcgatgacgactgctcgacgctgtacctgccaccactagtccgtctgctgttggggtctcttcttgccagctccatctcgctactagcggtgtggtggtggtatggtggccttgtgctccaacctcgaggcacggatgcggctttgtcgggtcgcacatgaagagaaacaagtcagttgcggaaaaagaactctacgggagtgacaaaccagcggcacaacgagccgaagcatgcggcctagctccatgactggtctggctcaagagtgacggtccggctcatcgcagcaaatggggacaagagagaacaaacacgagcacgggtgactcaaagtactgacaagtgggcccaaacatatgccatgtaagagaaaataaaggggggaatagggtatgtactgccgtgagaccaagttgtatgcttttttttttgtacagtttaagaatgaaaatttctgattttaggattagggatatcaatcaaactcgacgtaaagttgagggacttcaagtggacttactcctacttctattacttagtttcttcggttcttgggaatagaagatcgaacaagaaaatggttttgctagattttctgaaaggaaaccttccatttgtatactattagatctgcatttttgcagccaaaatggtagctcgctcatgcaaggattcgacctagcgacctcatgtacgctactagccaaccgagcaaagggttctttttttctatcagtaacatagacatagacataagttacaatactattatataatgtaataacatcgtaactatccccagaagattaaaaaaaataccactctcctcgataaccattcaaagattagaacttaatatatcttgatacggagcatggtacgtgatatcttggccaaataacaatcgtacatatggagttgatctcctcccttctttccctcctcaatataaagggactgtttggcatggatccaactccaactccatcccaaacacggatctagctccaactccacctttctattagctaaagcctaatcaagcggttttagctccacttaaaaagggagtgaagatagctggagtgttctcatataataaactagagaaatggatctgtgtttaggctgcttcacaatttcactctagatctaagtatctaaccacaggagttaaatttaagagttgaaactctacaaaacgcaaccgggccctttagtctatatggcacgtatatatattgttcagcttatttattactcacccagtcctaaaatgtaagtacttttagatattttacgggaatttaaaaagtatatgaaattgagtggtggaatgtgattggttaacaaaagaatgtaggcagagaaattaaatggaagaaggttgtaattggttgagaaaataggatagttgaaaaaatagctacactttagaaaaaaaaatttgactaccttagtatatgtctcagtggtatcacaaggaaaatttttaaagggaagttattcctcagttcgtgaatttagtaatctgtcagggatggatcaatgaaaagcttacgaggaaattaaattacaccacgatgactgatcgtctgatcctgagatagagaaatcctgatgcagttgaaataacctggacaccgattttctctaaacaaaaagcctatgctcaagaaaacaatctgcatgccggcatttaaggagacaaaagatgttgtgccgacctcaagacatgatcgaactagagagaaagctgcttgtctgacccataatttctcagtcgaattatgtacttatcccagctgagaaaaggccgtcatggccggtgcaaaatctgagtgaaagaattaaagcgactcttggattggtaaaaattacacctattgaaaagcatgttgctatgtcagcaatgcaattgagcatgttaagtgcaatgaaggagagaaatcttttttaagaaaaagcaaaaatcaacggttaataatgtgctcatggataaacatcagccggcctacggaaaaactacacctatccagtcatacatattcggcgcggttgactttaactatgaaatttgatcgttcgttttatttaacaaaattacattaatattatttgttttaatttattttatcattaaaagtgtttagatttatactttggtactccctccatcccacaatataatactccatcccataatataagacatggtaaaagttacgcagtctccaaaactaatctttaacttataatttctcatatgctataaggtttgtagcaacaaaattataatcatatgaaagtaaatttaaatgtcaacctaatgatataatttttaacaaataaaatttatttcatattacattaaatatatgttggtcaaatgttttaaagtttgaatcttgaaatacgctcacgccttatattatgagatggaggggggattttggatggt

SEQ ID NO: 2686 - DNA, 38931 bp, Oryza sativa
acagacatgactgtaaatagtgataaaagtgtttatattttagtggtagcgctaatccacacgttgcgcgcagaatattagttcgagtgccgcataacgctccctccttctagtttttcctttttttactaccccacgtttacttcttatcccacctttcctagttcatttttttttcattttttaccacatcaccttccatacttcttttcacttttccatcttatccatgcttcatcaaagggcccagtaaaatattaaccatccagatttttccttttttttccttctctccagtttttcagtttttgcgttttagaaaaatatttaccgtctagtttttctttccgagttttccatttttctagtgtctcacgtttcaaaagtaacgaatttactccgttaagttttccatttactcctagcctcccacatctgctcattcaaaagtaacaaatttactcgcatgaatgcccccttcaaaagtaacaaatttacttgcataaataccccaacattatacgacactcctagatggtcgtaaaagaattactactagcttacaatgctagtaattcttttactagtgttataaatattgtttacatttcatagtctgcgagtaaaataattacaccttcctctcgatatagcccatgatctcatagccaccatgtagtaatatgtttactgatgtgttcaatacacaatataagagtaaaaactgagactttgtgatctgcgagtaaaacaattaccacatttctctcgatatagcccatgatctcatagccaccatttagtaatatgtttactgatgttttcaatacacaatataagagtaaaaacttatactaagagtattgttaatctatatcacaaaatggccgtacgaatgaaaaaattacaggctcaatcacacacaagtgataaaattactcgcaggtaaatcaaactagaaaataaaaaaatgattcagccaaaaatccatcatgaaatttggatcttggtggctttgctggattttgctataaggatagagcggttgttctatgtcttgtgactggtagtggagagggcaattgggtggcgagcggtagtcaacgatggaatcatggaatgatgtagcagcgtggtgagatgggctcgacattgcgcagtagcagccatctatcatctagcacgaaaaaaatacaaaaacattcttattcatgttatagagacgacgagaaaaaaaaacaaacaaccaccatcatcttacccctagccaccactcgtttaacgagaggcatttaagtcttatatatatatatatatatatatatatatatatatatatatatatatatatatataatttatttctccaacgttacagttgtaatttattacttcatctatcttaaaatataagaacttattactagataagatattttctgtgtagataccttatattagaaaatgtctaatcggatcctaagttttttttaaggataaaggggcaataacactagcaaggaaaaaggaccaaaatcaaactggtgcagctaggagcagtactagctttttcacataacctaatttacagatagataggacggggcactagggtacgtcgctggcacacgcagagtggatggtcggcttaacgagagagccaattggcgtgtgccttttttccgtgcgtgggtcccctgcacgccggtcacgttgtgtgcaatatgatgtacggtacgtcagggcatgttaccggctttgcttgtttgcttgcccttccgtttccatgaaaggccgccatgcgctcatggatgcaagctacagctaggatggaacggcgtgcataattgtagcttattattgcgtcaaattatcgtgttgactggttgtgcgtatgatttgaatcgataacactacggggagaattgatatttcgtcgaacggttcaaaacgcaaatatctaagctgttataagcgccggtactaaagatgattttcactaccaggtaaatattagacccgtcccactatagagataaaaaagattgtatatatgattttcggatgatacggaagagatgaaaattaaaatgaacgagcaattaacaggaagtacgtacttttaaacttgttttgaggaacaaacataattaagaggagaacaaattttagtctagtcgtctagatgatacgtccattaactcttgccaatgtctaattgtgtcatcttttagctttcaaatcagataaatatgcccctccattcgttcaattgtggttttgacctacttcctccgtttcacaattaaagtcattatagcacatcaaaatgaatgtggaaaatgctagaatgacttacattgtgaaacggagagagtactatatacgtggagtttacacagtgtggaaggtggcacactggcactcgcttaattataatggagggaaatagagagagatagaaaaattacaataaaggggatttagttttttctataatcaagtcaaatcgttttatagaaagctagctctacggtcaacttggatcccatatggacgccatgtggtcatttgccaaatgacacgaaaaaagaagagaaaagttttgtccgatttaaatgagttaattgaggcacgatattaaattaaaccatttccggatttaaggaacaagaaatagaattatccctagtgcttttacatgttggattaattgatctgtcagggttatggataccacatacctaatagtagttgactaaactcggcaggacccaccacataccatgacttatacggaaacaaacatcatatataaaaggagtttcggataaggaaggataagaagagttctatatgaaaacgacaatgactactcggattgtacttatatttatctccttagtcttacttagacaagaaggcatctacgggtataaatacaagccccctaggaggagagaggacacacccaccatagacgccacaaagccacaagccaacacaaaccaatacgccgtcagatctcgacatcagaaattagcctagccataccccatccggcacctacggaggccggcaagagggatctagcgttatctctgatctcgccgagttcgtattcgaggaggaagaccaccctgccgtcgactacgagttggttatctagccgccaagtcgacgacagttagctaggttatcccagatattgtatttgtgtgatccagatgaataaagagcaacaccggcttcggccaacaggatatagggctattacctgtaagatatggggcccgaacctatataaaaacccctgtctccatctcttttacctcaatctcgcatataccctggtaccaacgatccccaaataccgtacttgcgatatcaaacgtcgacatgatcgatgttgacggttgcttgtatttttatggtacggccatcagcacgattgatatactccctctccatcccataatatgagggattattcccttttggataagtttaaggatagcaagacaatactagaatgtccctgttaaatgatatttgcttataggtgagtgcgtagttgagggttaaaatgggtaaaattttgaattggaattgatggatgtgataagtaggacactaaaatcccttatattataggacaagggcaaaatcccttatattgtgggacggagggagtatctaaactcattcatgatgaagtagcgagaatgtagcttgaagcaacatctaaaattgacaccgttgatctatagtagcgattgagacggatctatatatagtactcctatatacaggaaccgatggaaacgatgggctccagacaagatgatgagcttcaccgatgttaatgaggccgaactacatgatctaggggtgtgtctagatcacgctaaaattgaaagtttggttaaattggaacgatgtgatggaaaagtttgaaatttatgtgtgtaggaaagttttaatgtgatagaaaagttggaagtttgaaaaaaaaaattagaactaaacaagggcctactttaatttctcagaaactgactgcttgtaacaagggaataatgacctttcaaaggaaggagacaagggtcatatagaaatgtcagaaggacggtggaacttgtgggaaaattgaggtttggtgtcactaaatttcaaaaacaagagctgagctggggcacaataataggaaagcatttcagaaaataaattcgaagatattaatggatgcctgttgatgttctatatcggtaagtattaaagggacagtgaactagatctaaaagtaaatggattgctagaacaaaaatttagacagaaccaaacccttccgatgagaggtaatacccaattgttatttgaggatttgtattcgttaagtgtattatgatatatgataatcgagttgtggtatactctcagtccctaaaaaaccaactactattagcaactactagtaaaatacagacaattttacataccattttatatgtagtcctatcttatagggtcatataaggtagtcggataaacctatcgtgtagatacctgatatgcgtagttgttcgcaatgcccatgctaaagtatttgcgtggctttaaggccatgtttagatcaaggattaaattttagatcctgttatatcggatgtttgatactaattagaagtattaaacgtaaactaatgataaaaaatccattctataacctggactaattcacgagacaaatctattgagcctaattaatctataattaacctatgttatgctacagtaaacatatgttaattatggattaattaggcttaaaaattttatctcacaagttagctcttatttatataattagttttattattagtctatatttaatacttctaattagcgtcaaatatccaattcgacgggaactaaattaaatttagtcatagatcaaacaccacctaagcaatgaaaaccatctgactgagatgatgcccatgctcaagtaaaaagacttaaatgtggagcccaaacatatatcaaattgcagtttggtctgtgttcgctctcattgtgctgttgtgtgtttgcgagtaattggcctgtcgcactgatgggagaaattatgacagtgccaccaaaatggatatgcctgatgtggaatagggttaattagatacataccattaaaaatttatcagttttgaaatataccatcagtattcacgtatttggaaccatgccattacaattttacacatattcaagatatgccactacctaccatttacgaaaaaatttagaccaaattacccttctttgcttctttttctcccctctcctttcttccacagctcagagaacaggcggcggcggagcgagcggcagcggcggagcggcggcggcagcaacggcagcggcggcagcggtggcggagcggcggcgagtaacaacggcagcagcggcgcgagcggcgagcggcagcggcggtggagcgacggcagcggtgagcggcagcggcggtgcggcggcagcagcatgcggagcggcggcgagcagcagcgcgagtggcgagcagcagcggcgtcgagcagcagcagcggcggtgacggcgccggagttgaagcagcggggagagagagcttgaagatgagagaagagggagagaggtagaagatgagggcattttcgtccaatacatgcaaaatacgtgtcttagtggcaccactgaaattacaaacaaatatcaatggcatcgttccaaatacgcaaatagtaatggtatatttcaaaaccggtgaatttttaatggcatgtatctagttaaccctgtggaatatgcctaggaaaggggacccattcaaagcctttgactgaacgtaaatattgtgagcaaatgttgctgtcaggagaattgaaggcctaccaaatcacgggtactccagtagttctttttttaaagagacacaacggcatcacataatttacagaagggaaattgttctgctcccttcctctcaaatatatgcaacctccattttaaaatataaaatgtttaaaatgtatttgaatagaacatgttacattttgagatgggtagtagctattcgaacttggacatataaacgggtaattgcacaagcttatttcagaattttctttctctgtactggttaccgcatatcagcacacaccttattcacagtagcccatgagttgagatgaaaacggtcggaaaatccctataccgattttattttcatttttttctcgaaaatggaaatgaaatggtagacccaaaaagatattggtaatatcggtatattggaaacgggaccgtcagaatagaatataccgatactggtcggaagtcgaaaattcatgtcggaatcagcggagcctggcatagcacacattttaactttattcttgcattatcaccctcagcataacactgttagattaatgatatgataataagtgtgacgaacaatatagtcaagttcaacaatacttcaacatcgataattggaaaagaccaaagttcagcaaaatacacatgccacgtcatagggtttacaacattttccttggtcactttcctttttcataggctgcaagtctatcaagcttccttcattcgtgggctttcgatgggttgggttggcttagccgctggagaagtttcggaattttgacggaaattaccgtacaaataatattatcgaccaaacggtcagaaaaacctccatcccatttccgctactatttctgaaagatattaccgtttccttttccatcaccgtcgattaccgataccgactgaaacggtcggtgcaaactggaaacggcagctaaaaatctcggaaatttccctaccgttttcacccatgagtgcaaatcgtttaacaataaatgcatttattaacttcactacattactttcaaaagggttcgctaaattactattaaaaccatatatgcgtgtgtgcagttgtcaagatttgaaccacagtagatcgagttatatatatatatatatatatatatatatatatatatatatatatatatatatatccatgaagccagtatcgtacttacttattagtgtttcccatgtttagattcttttttctttcactggcatattcaaagtgtatgcaaaatttgacattattttagaaatacaaagctgtgtctgcgtacatggttactgaattgttaaacgatgtattttcttaaaaaaattctagagagaagttgttttaaaataatattaacccatttttgcaagtttaaataattaatacttaattaatcatacgctaatgactcgccacgttttagtatcttcaaggctgtgttctttctcatgggttcccaaccggccacatctttttcgcgtacacgctttttaaactactaagcagtacacattttgcaaaaagtttatataggaaagttgttttcaaaatcttattaatccattttataaatttttttaagttaatacttaattaatcacgtgttaatttatcgttccgttatcggaaagaacacagcctaatctttttctttctcctcctaaacgtccgatgatcaaagttcaaaatggtcatctataaacctggttactgtatggcatgtcactactatacaaaatgtcgatatgaatggctacgagtacaaattaatatacacagtttccgatcaatctacgtgaaaggatatgtactccttatatcgtactaaaatggaagatattttggttggatgagtcacatcctagtattacgaagccgagtagtcttcctatctaaattgtattatgggtgtatttagttcatgctaaaattgaaagtttggttgaaattagaacgatgtgatagaaaagttggaagtttgtgtgtgtaggaaagttttaatgtgatgaaaaagttagaagtttgaagaaaaagtttgaaactaaactcggcctaagatatatttcatccaaccaaaatttcttatattttagtacggataaaatagtaataaaaaagaacaccatgaccctgactacaattaagttgtgcccgttgccggtgtttcacaaaaccgatgaaattttgcaaaaaccggacttctttcatgaaaccgttagatcaaccggtcggtattaggtggttttgtatgatgttgaccaaaaatcatcggattttatcggttttcggtcggatttcgataaacctgtgagaagctgtatttacttcgaaattgaatggttaaaccctggtcgtagctatcacgtcgttgccagtagcgcagccgcccagccatcgccatggcccatggagatcaaagctatcgctgtggccttaattcccgagccacactaaaggggaggaggtgatggccactggtaccctaggtgtgtttagaaccagagtttggattcaaacttcagtccttttccatcacatcaacctatcatatacacataacttttcagtcacatcatttctaattttaaccaaatttaaactttgtgctgaactaaacacagccctagtccacttgcttgaagctgccattattgcccaacatcttggccaccgtcatcatcaggttcgcccatcgctgcattgtttgaggcccctattgcggattcatctaccgtcgagtcgatcaagaccgctattgttagatccgataggccaccaccggccgtctctgctcgatgccaccatcatcattgcctcctcactcgaagaggggatctataaagttgattcatttgtatcataatgtctatatcggtatcagaatatattaattatacttagattatagtgttataatatatgtgttgacactttttcgtggccaacacaagatcacctaacgatttacggtgtaaataatagagtcgtcaaaatggaatgatcaaaatccgctagtgaaaccgatttcgagattaattcactttcgtgaaatcacacgactaatttacaagcaaattagcaaagaggataaatatcgtacttacgtgacgatgaacgactagtttccgagcaaactaataaaggataatcttctcgctttcgtggagaagcacgaccgtttttcagcgcaaaacggtaaagattaactaaattctagggttaccaaaactcaaccatgaaaacaaaatagaaaataacaggaaagtatagaaaaggaaaatagtagattgataattttgttcgggggtccttcaatcgaccgtagacctgtacatatacagataccatggtccaaccgaaaagaaaactaactgataaaatagaaaatctatctaggcatgttcaatggtagagacgagtatggtctcttaacaatataaaattatttagagaccgtatctttacaatagttgagacaacaaagactctaattattaacttaaaaaatattccttttattaatattctttctattttttttacccttgtgcaaccatatttccatattataatgatcaagagtcgttgttaagccgttgttatgtataacaacgatgttttgtctctcctatttctctttcttccatgtcaaagtattcctaattagcaatgctaagagaccattattgacaaccattgtacatgcccttatcttcctaacagccgtacgcgctaatcacgcctcatcatctccaaaccaacgccactgatccaaccttcgcgcaatacgcagccgcacaaaacagccaagcgagagcacggcaaatttctgctcgcctgcatgtatgtgatcatcagcccggccagaagcttgtcgactatagcaaatttccacttgcaaccagctgcacgagtcttcacctctctgatctctatctgcatgctaatgcaaatagtactaaataacgcaaaaaccttccttgactatggttaagctcagctaatccataatatttccattctaagataaatgctaagcctccctagccatccacgcacacacatttaatcggctctcaaaccaaccacttcaaatcatgacagctaaactaaataatctggcttacccaaataaaataaactattagccaaattatgctacaaacaatatagatcataagcagtttaatcataagttttgctgaaagtcgtcggtgtcgtctgataccgacgctaacactatatatccgcccctgctggaaatccatttttatactgcatataaattgtaaatgctggtaactagccgaattgctaaaattggaatcaaactggctgttgttggattccatcaagagatagtgctccaaccaatctattgggtctttaatcatgactatatatatatatatatatatatatatatatatatatatatatatatataggactagatatgccgatcaccctaaacgataaaaataacggaaaccctaaacataggctgtgtttagatatagggatgtaaagttttgacgtgtcacatcggatatacggacacacatttgaagtattaaatataatctaataacaaaacaaattacaaaatccgcctgtaaactgcgagacgaatacattaaacctaattaatcattagcaaatgtttattgtagcaccatattatcaaatcatggcgcaattaggcttaaaagattcgtctcgtaatttatacgcaatctgtgtaattagttattttttttgtctatatttaatactccatacatatgtccaaacattcgatgtgacagtgtgtaaaattttacggggggccataataagtttttagttagtttcttagtccctctattcgtgtgagtgccagacgaccggttgaccatattagatagtagtagcagcaaatatattgagaaataattttaattgcataatataaatacaaatttttaattagtttctggttgaccgctattattattctatattaatatataatggtataaataataaagcaaagtgtattactcactccgtttcacaatgtaagtcgttctagcattttccacattcatatatcaatatgaatgtgggaaatgctagaatgacttatattgtgaaacggaggaagtaactaagatctatgtctactctccatgacttgcctccacctcaacagatatttcttaatagtgtaacagcattgtgataaacaaagatggttcacgattgtatattattaattattttttggaagctcttaccgcttcatatggtaattttccatctcgatacatagagttatcttgtaataccatggtcaagtgggacctacctagtacataaatcaattttcagacagacaaaaccgatttctatatgcggcttggcggcccgcctacacctaggtgtctgcaaaaatcaatattttttcttatgggtagcccaaccacatgcaaagacaggatttgcgcatgctatcacctatgccaactgtataaaaaaataatttcaacgaaaaaaatccctaaaaaaaatagcccaacccctatatccccattctctcaaaacactagctcatcctcctcatcatcgtcattgcaaccaccactgccatcgttgttgtcgcagtggccaccgctgccgtcgtgtcgtcgtcgttgtcatagctgctaccatggccgctcgctcccactgccgctcctgagggcaggggcggcggagctaccccgaggctaccggatccgcacgtcggcgccgctctcgagggcgggggcagtggatccgctcaccaacgtccctgaggctgcctctgtctcagtcgcctgcccctgagaccgccgtgtacaccgtagacgccaggagtggagaagagaaagggaagagatgaggtgaggtgagggtacgggagtggaagggaaagagatgcggtttaggatgagaaagagaaaaaaagagtgatacggtgggacgtgtgggctcacttgctctccaagttgaccgtttcacgtgcagtcccttaaaatgtacgcctacgataatgtatcttcgagatgggcctattaaggggacgtctatgaaaatatatttttacatgtcacccttaaaccatcccgggggagcgatttttgcaatttgaagagaacatagttcagaaaaaattaattccgtagtagtactagcttcaacttcaaactactactacatgtgaatattgttggcgagttttacatagtatgaaaaacatatgaaaacgtatgtagtaaaaactaaaaaactaccgttggattgaaaaatagacgtccgagattcatccacgtcatcatgagtagaaattttactcacggatttactcataagtaaaaattttactgtgctcgtgatgatgtggacgaatctcggacgtccatttttcgatccaacggtagtttctaaatttccactacatatgtggtttccaccacatattttcatataaatgtataccgagcacacataccaaagtgtggtggtggagtaattttcatgtagggtttaaatcctagtttatacaaataattaggcacatgaatatgtgtctttaatagaaatttagttattgggtatgcattcgcgaggtgtatgcgcttacttgatcaggggaaacccgtaaaagcataccccgaagcagcttaaaatgttcgatgcacaactattcctgcagtataataaccgaatcgaaattccagctgtttacatatcacaaataaccgaaatggggaacaaattgagcaatatagcagtaatagtgatagacaatcatcaatcatcgtcctagcgatcaattcatatctctatctcaattgtttaacgcgtacgcgtacttacgttaatttcttgtatgacactgtacttaattcttagtactacgtagtactccctccatatctaaatatttgacgccgttgacttttccaaacatatttgactgttcgtcttattcaaaaaatttaagtaattattaattctttttctatcatttgatttattgttaaatatacttttatatatacatatagttttacatatttcacaaaagtttttgaataagacgagtggttaaacatgtttaaaaaagtcaacggcgtcaaggagggagtatataataactagagatataatcaccaattaattacgcctggtcagtctatcgcccggacatcgccgtacgtacctgccactgccgccgctgaggtaagctagctaaattaatactccctccgttttcaagtaacggacaatgttaacggtatggtttcacatttgaccaataattggttaaaccatgacaaactaaagttctggacttatagttaggatgccatacaatttaataatatgaaaacctttttagtattattcattttatagaaaaaaaacgagcggtcaattgttgaaaaatatatttctatctctgttacaaattatctttctaggattcaaaaattagctcaaaatatttatcactttcaagtactgttggtcccatcaatcatctcccatttaaattccctctattctaccctaacttccactataccttaatttatagttctaaattatttaattatttagaatgataagtattttacggagaaagtattttaaaaattataggagtatatactttgcatatacatctccctgagatgcagggcaatccaggaagcgaacgagtggcccgtggggaaacaggtaacctactgtccgaccacatgaatggcctaccaacgccgtttgcctgccgctaccgcctgtattgcagatagtatatactccctccgttttaaaatgtttgacaccgttgactttttagcacatgtttgactgttcgtcttattcaaaaacttttgtgagatatgtaaatttatatgcccacataaaaatatatttaacaatgaatcaaatgataggaaaaaattaataattacttaaattttttgaataagataaacaattaaacatgtgataaaaagttaacggcgtcaaacatttcgaaacggaggaagcagtactgtatttgctttcattgacatgcaagcaatgtcaaacacaatcaatggcaatataagcgattgcaatgctgggcagatagctacccatatccatccatccatagattgcttagatctggatctcatgatgcatttacactgccgcggccagccaggcatgatcgatcggcagggagcaaagcatttcttattccagggtgttttccacgcaaacatgtaaaaggatagaaatatgccactcacttcatccgaaatataagcactttagttttttagattaattaagtatagagattttgtatgataaaatttacaagtgacacatactgccgagataaaatccacagatttatattgatttgccataccactaaaatagacaatacaaaattaaaaaaggtaaaattatctttctatgctactattgtatagggtaattttataaattcgcgatacaacggaacaacactagatgtttacattcactcgatcctaattcctcattccccatcgtccactcgttcttcaccattgtgaggccatctccaatccagacactgccaagtagtttccatacttaccagtgatatagaatctatgtatagaaactactatatattcaatagatggtgtcttcaaatcaaattcttattcaatcacctctcttctctcttcttttatccatctatatccccctgtttttattcttagtacttgtgaagaggtggttccttgcatgagaaataatttcttcatctttttacctctctcctcattaattttcttggcacatcaaaattttgcttatgtgtcaatatatttaatgctatgaacactagatgacatgtagggttggggatggcctgagatggtgctattaaaaattattacacaaataccatgtctcaattaatactcctagaattattgagatactccacctatacttttatgttttaacatagttaacttttaaatatatccttcatttttatctattaactaggaaaaagaatgcccgtgcgttgcaacgggtgaaagttgttttaatcttattattgttatacggttaaggtgaaattcactgtaagaattagcttggatatatatttttctagaaaattatgagctacggttaggagtccgatcatttcaagttagcatgcgagttttcttaaagggatttcttatacgactccttctgtgtttctaaaaacgaacaaacttaaaacctgactcagatacgaatttgtattttcaaaagtgaacgaacttaaaaaccactcatacacggaaccaaaataccggcaaaaacatcttcagtttttataatagtagagatagagatttcttacaaatatgaaaagaaattaagtaatgcttaaattacataaattttaaataagataaatgatcaaatcgtagattaaaaagccaactgtgtaaaagataaaaaaaaaaggagtaacaatcttctttgcagccctgtaggctatccactattactccgtttagaaaaaaatgattttcaactgtaaatctagacacatgacatagctagtttcaaacttagaaattaaaattttgatataacaaaagggagtactatatgtttataaatcagtataaatcatattcattttgcctgtccgtatttgcagccgatacacgctggtggcagtaaccccgtattaaaaaccatttcgtccttttgcatgacgtcatcgcgcgtcaccattttttgccgtgtcgaggtgaagcaccgaccgcgaccacgacgagccacaccacccacacacgcacacaccctcatcaggcccggtccatgcccaccccccctaccgcgtcgtctcgcgcccacaccccacttgcgcgtggggcccacatggcagcggcccatcgctcttcctcgacggcatgcctctttctgccctgacggtgaccagctttagaaaaagggcagagccctccctccgattattggcacggcgaaggcggggaaaaaagaacagcgcgctcacgtcactgacagggtggggtagagctgcgtgggtcccacatgtcattgtccggcgcattgaatgcaaccgccggcacaataggcaagtcggcgctgcgaccggctttggcaggttatctagatattgtaaaaaaacttgcgaagggtcccacgagttgtgtgaacaaggtccatggactcggtcatgtactcatgtggtttcctgcttctgaagcttcgtgtggttccgctttacaaacaagggtctgtgtttgtcacaatttttaagttgaagttatacgccgctaaaccaataaaataatttttcgcgtactatgcataaatgtgctcatatttaggaatatcacgtgcgctagtacataatgacttattagagaatatcacgcctagcacaataacttacttcctccattttatattataagactttctagtattgtctatattcatatacatgttaatgaatttagacatatatttgtgtttagatttattaacatctatataaatatgggcaatgctagaaagtcttataatataaaacggtgggagtattaatgattacatagtcaattttatgtttgcattagacatgttcaatcattggttttgcggctacaccacggccggcgccaatagtatccaaatgcaacggtagcacaataatactccctccattttacaatgtaacactttctagcattgcacatatatatatatagatgttaatgaatctaaacacatacatatatcaagattcattagcatctaaatgaatgtgaataatgctagaaagtcttacattgtgaaacggaggaagtagctgtcggcctgacaaccaggccctttaacatctcttgagaaaccctcgggaattctagtgatttttccttacatagtacatttcttttataatcagaattatgttcctattaagcaattatactttttgaattaattttgcaaattataggtattttaatcaaactatctaaaactatgcttcctccgtcccaaaacaacctcatttttcacctatctcagacataccaataaaaaaaagactagattactcccactttattaaatttcaatctaattattccctactttatctactataaataaatttatcttctactttcacaaactttagtgcaatggctattcaagagtgaacttattttgagacaaacggaaaaaaaaggcaacaatgaacttactataggatggggaaagtagatttaagatgttatattacaaaactataaatttagcgataattttatcatgaaactataggtttaaggttaagtatcgaaaactacaaattttaatattgaaggtatcacaaaactataagttgtagagttttaatccctagcattaccgtcatgttggagctataaagttgtagttttgtgattaaattgatactaaaacttaagttttttttactcaagttactacttaatttatagttttatgaaactctatcttgaatatgtagttccgtgataattttattgctaaatatataattttgcgatatacagtcttaaatctatagttttgtgatagtttaatcattgtaacaaaatttactctatacttttttatatggtccattgtagcttagatttgttacaaaataggaaaaagttaatatgatcaataaaattctaatataagtctgtatatcacctagaatatgatataaagaacactttgaaatatgaatatattagtatatacttttatactaaatatacttataatttgacaaatcactaagtcataattactccatttgacattttaaaattagcatatgccttgtaaaatgataatttcaatatttaccattccaaaaaattccaaattaatcacacccaataaatatgatagtactaatctatctttttctaaatgaagctacaaaaggatctttttagaaaggtggcacattctgaatccaacttatgccactaggatatacacccatccaagttgacaccctaatactatatgcaaataaaaacaccactaccttggacattagtgctccccctcatggtgccaaagatattttccaagttacccaccgactaacctactacgaaaaacaaaaccaaaacaaacaactcaaaccccctattatttttctttaacagaaatatcatgggtgccctcgcggctaagcaaaccctttaaaaacgacccctccggtccatgcaccgggctcacgcacgcaccctccccacccctcccgccccctcggggtccgcgcatggataactcgtgggtgggccccaccaccccctcctcccctcccgcagatttttgtacccgcccgtgtgtgtgcgtgtgtaagcaaacccaacccaccgctaccctcttctcgccgcaagcgaggcgagccaagcaaacgcaagggccgactttgactacgagaagaaggaagcgcagccactagtcccggcggcgacggcgacggcggcggcgggtgatcggaggaggaatggtggggcttgtgggagaaggaggttggagggtcggggataatacggcgggtgggggtgggggaggagcggtggcggcgggggctgcggcggcggcggaggcggagcacatgcggaggctccacagccacgcccccggcgagcaccagtgcagctccgcgctcgtcaagcacatcaaggctcctgttcacctcgtgagttccacgactcacgacgccttccatcctcttttttttttctgttcttcgtttggtgtttgttcgattggttgcgtttggtttggctacttggctcggtggttgctccttggatctgaattttttttatactttgttttggcgctgggtttggtgctcgtgcggctcggtttgatgcgtagctgttgcctgagatatttgttcggttgattggtactagctcgaattgaatgtgcgaatttcgccgtgtttttggccgctcgagatcccaaaattgtatgggatgttttgacttgtttcttcgcggcatctgcttggttgattgtattgttggtgatgggagtatttgattgtttgatcgattgatcgatcgctgctgctgctgcaggtgtggtcgctggtgcggagcttcgaccagccgcagaggtacaagccgttcgtcagccgctgcgtcgtgcgcggcggcgacctcgagatcggcagcgtgcgcgaggtcaacgtcaagaccggcctcccggcgaccaccagcacggagaggctcgagctgctcgacgacgacgagcacatcctcagcgtcaagttcgtcggcggcgaccaccgcctcagggttcgtgccactcgatactgatacccatttctgtctactgctctgcttttttttgtccctttttagattagataatgtgctctgcttatttctgccttcttaattactaatccagtatgattggctcactgcaagtatatcatttatgccttcttaattactaatccacagtatgataaactcactgcaatccagtatttttagaaatcttgttttctgttttatcttggtagcaaatgtttggcattataacctctgcatatggcatgcctatctagatttagaatggatatgggttctggaagtcacattggttcatccatcgttttgattggatcagatgatagataaccttgtgcttcattatttgacctactaatttctaggaagtaatataatcatgagtagttttgacttccactagggatagaatgaaaaaatggacactgggaaactcaaccctgttttccctgttcttcatttgggcttcagtttaatgatttgcgatgtgaattccaatacgtcgtctgctttcttgaaaggcaatgacctactagtgtggtctgcatgtggccttgctgtttcttgaaccttacttgaaaaataagttgaccatgttgccttaattgaagaataatgattttaggttcttgtttatggacagctaggcactcatgatctttacgacttgtcaaagctttattttgatttgtactgatttctgtctccccactccttcagaactactcatccatcgtaactgtccatccggagagcatcgatggaagaccagggacgcttgtgattgaatcatttgtggtggacgtgcctgatggaaatacaaaggacgagacatgctactttgtcgaggccgtgatcaagtgcaacttaacatctctcgccgaggtatcagagcggctagcagttcagtcacccacctcgccacttgaacagtagggtcatcactggcacgggacatgcgaactggcatgaataagaagcttcaaatggttgctagagatttaaatctttttgagatggtagttcctccattgtcttcgatatatatgcctcttgtaaggattagtatgtagggttaattatctttagttgctggctagtgatgggcttaggtctttttagggactgcacctagctaccttgtagttatgtatgcatactgctagtagtatgtgtataaatagggaagcatggagtggtttttgcctctttggtgcacatgtgaaacaacctcaagagttctttttcctgcatttgagctggcttcccattgtagtatagtattgttgtgttcttggatgacattccgctaacacttgggcttggttgggggccttttgatttgggtggatcttggattgtgctgtaatatatacatatgaaaggagttctcctttgcactatgaaatcctttcatagtcaaagaatatgcttattgaaccagtataatattcctgcacatgaccatgagttcaaagacaaacaagatacctagaagtccaagattaaagtcagccttaaaaggagtttctgaattctcatgttgcaacagagaacagaatcgttgagaaaatatctgggttttcctgtgtgaagttaggttgccaaccctttgaatgacaaccaaaaatcatcaaggctgaaggaggcaagtccatcctcgcatgcttttgcaatccatgccctctttgggtgctgtcagttttcaggtcacttattattatcattaatccaagtctacccccattctaatcctctcgttacaagtagctttccaagcattgtttgagacaaagcaaaggcggtcactttcagggccagaagctcctgagatggcttctcgagaaaagtcgatgctggaccaaacaatgcacaagctttgctcgcgtctgttcttgtttgtagctttgtttggctgagagggagactctgacggtgacttgctcctaccaccaaagtatggcggttttcagagaaaaatgtgttttggtttatacaagtttgcatctttttttttcccctctttatctgtttgttcactgcagcgatgactaactaacgattggtcgtttttgttccctaagatggtaaggatgatatcgcttgttttgccgtttatgctggtggacagaatgagtggcatcacttgtgagagtcatcttgagactacgttagtgcgctgcggggagtacgccgtcctcgcacatgtttgagtgtttgactgaagaggttgtctgtctgtgtgtgcaagataattatggacatcaggatattttccgattacaagacacccaccgcgtgcaagtattttagcgagtactcctactttcctgtacacacactacttatcgaaaggagcaaacatgtgcgtggataattccatggccgtggtacccatgggaaactaatgtagtgcagtcttagcttgtgcttgagacatgggtccacatgtcattgacctattttagagagtagtggagtatatcagaggataactcatccataccaaagccagaaaggctcgaactgatggcaagaaatatcgcaaggatttggcttcgatcaaaacccctcaagagtagaattgaagctactaacaaattaatttgtagagcatgacttggtagttggtaccaatccaaaatgcccataaaagtttagtaaggtgtacaaattgatttgtggaaatccaaattttgggagttctaaaagttctctcataaaaacactactaaaatttaagaagaagacatcgaactaaacacatctaactcaaccaaattttatgtacactaaaacatgtaaaaaaaaaacaataattttagctacaaactgaacaaaccccactaaactcctcgctccatatccatcgcagaggacaagtagcagaccaatatgcatcgacctcgcacgcagctatagctattatcgtgttacgagaatactccatctctgcatactctttggccaaacaaaaccactgcactacaatactacacagaacatgcatatggaccggtctgcatcaaccatccgcacgtacagtcttcctcaccttttttgcaaaagagaagaggagatcgatcgatgttacgcgaccatctcggagaggggattgtcatcgccgtcgtcgtcgtcgcaacattcgcatcggtcggacgtgcgtacgtgtgccgtggcgccattggccgcggcggtgtcgcgagcttatccggtggccattttgttggatctttggatcggtggggcgccatcgcccgggagcgaggtgggaggccgccattggccggcgccggcggagggtccttcctgatatggcatgtgtcaagggaggtagagatggcgggttgaaaatgggacatggaatctttggacctgtctcatcacaaagtgtttttttttttctgttgcgtgtaaaagtttgttgaggataaaatcaaatttggatatatctttcaccaaataagatattaaaacggaggaattagattatactacgaaaatacgtgatatatgtaatataatagctgcatatataatcatggtattcacaggaaaactaaaagcaccgtggtggaaccaaaggagtatgacttcattgacaccgctcaacatggtttaaattaaggataagtccattttacccttctcaacttttaaaattgttcattctacctccttgcaaaagtcaccttgactttcaacatccagtcagcaaaaaagtaaagaagaatttatcgacaggttgtaatcgcctactgtcgagccaactatgcatcttctttttgcctctattgatgaagcaagccgtggaagcagcgatggcagcaaaggcggatctcggcagacgcagtgtatggataagttggcgaccgagctcatggtgagaaagagcccaaagagaatatgacactcaggattcagggaagagaggaactcaaggagttgaccatgctcggtggatgtgggaggcactccttgaaagcagaggcggtatgtggactgtacttgtaagttgtaacgcccaataataattagaggaaaaaaaatactactagaaaagaaaggagttgggccttgcaagcaagcagtagtgctagtgcagctagcagaccatgggccttgcatccttgcagcgagcaatagcagttgggccaaagctaagctagctacggagaagcagcagcagcggcaagatggtctagagcatctccaacagagtggctatttttgactctccaaatatcctattgggctacttgccaaaaatttagagaaccaaatttacgtttcactctgacagcatctccattacacttctccaatttaatagtgggacccatacatcagtctcctattcttccctcttctctacatttcggtgcgggatggaggcggcgccggcaggagaaagcgcggggatcgaagcggcggtggtgggagcggcgcgggtggcggaggacgacgggagtggcgcgaggatggaggcggcgccggtgggagcggtgcgggcggcggaggccggtgggagcaagcgagcgacggcgaacaacaacgaggcggcggtctcggcggcagacgacggcagacgacggcagcgtcggcaacggatgacaacacctcctccgagttacccgtatgttctttctctctcggtgcacgataccaggctgcgagcgggaggccacgacgaagccctccctcgctggcccctctaccacctcgtctcccatctcactggcgccgccgcttccttcacgccgctgcccctcatcccttcttctctctcttcggcgctcaagagggcacggcggcaaggcgacagaaatcagcgctggatgccggcggcgacaagtgggaggctgcggcgacgctcgccgtcgtgccgccatgccaccacatcctcttccctggtttttccctcagcacggccgcaagcggatctcgtggcgacggaaatcggcgcgggaggtcgtggtggcggaaatcaacattggggaaaggcgtggtgcccacaatttgccagtcagtttggctggccaagtttgactagtgggaggtgaagtttggccatccatttagcttagccattcaagtagagagactgttggagtgagattttttttgctaaaatttaacttggagacgatgttggagatgctcttagtcccacctctctcagccggcagccaactagagcagcactagtttataaggtggcctacctagttactattattaactccattaaactttttatgtaaaatgatgatgaaaacacaagagagttaaaagcatatgtagctgtgataagtaaataagttgaacccaaaaacaatattgtttttgaaccctaggtgataactaaataaattaggcccaatacaattccagccctaagcgttacagtggctctctctgaacttttcaccaccatcaagccgacatccaagcagtggcgtggccaggaatttttcattgggtagtcctactcacaaatacacatcacatatagctaaattttcaaatgtcgtaaatcccatatacgagtacaaatttaatgaagtcctaaatcccatatacgagtacaaatttaatgaaaaagtgataggaatgtaacaatattgtctaatatagtcaatatttgactaacttaacaagcaagttcacacgttcaaatataaaagatattgggcacatatagaaaatcacagtgccactatcttagctataaaagttgttattctcatgtcttcttcactaacttcggaaaagatatctcacttgatacatgtgacgaatcaatgattcaataaatcataggagtatattgtttctctgcgtggtcatcactagattaaggctaacatacaaacgagcaattccatatcaacctcatgtttacaaatcctacaactacaatagtaccaaatagcaacacattcacattcactgattcaccaataaaaatagagtaaatttcgcaaaactacatgttttatggtttaagttgcagaaaaccacctatattttaacatttggcacttaagtatatatattttggtagtgtagtttcacaaaaccacactatcaataaatggattcacatgtgagatgacgtagttgttacacctaggatgagaatatggcatcctattaatttcgtgtgatggctggtaataagatgccacgtcctcgtcataagtggaacagccacgccatatcacgggtgaatcaattcattgatagtgtgattttctgaaactacactactaaaatatatgtacttaagcgctaagtgtcaaagtatatgtggttttctgcaacttggaccacaaaacatgtagttttgtaaaatttactcataaaaataacattcacagattcaccgattcacaaatcagagtacactgatttactcacctaagcacgggactctaaggggtagacagaaggaaagcatcgaggcaggggatcaactagggccaggccgccaggggtcctgggctcccggctcctgacgctggcggccggtggcggcgccatgtgaggagccccggcgcaggcagcccacacctgggcagcgtggcgtggggagcggtgcctctagcactctgccattcggcctctgtagatcgagttagggaagtggtggcggcggctcgacggcggcgcggcgaggaagcgacgacgcaagcgcgtagcaaagacggcgaggaccaaaggagtcgagatggcgtcgtggtgtgtcggatgcctcgactcccaaaagatcagacctagcgctttttcccttctctctttgtgggcttgttttttttggcttgaatgagaaccaaggtttatgggcttttttttcggagggtggggtatcctgggcaaaatcgggggtagtcccgagcccaccaaggattgttgtggtgcttgatgaaagcggaggtggagacaagcctttgtaggcttgtagccaactagatccagactttaggacatgtcatgttctcagtggacctaccagcttagccagcatctgagtagagaagctctagccaatcgcctctaagtgtcacatgcaggggaaaagagctttggatggcgtataggtgggcttggatggctgtgaatatgggaggcaaggagcggcgtggatggacaagggctctgagcaacaacggtagtatgaggagattcaagctacgtataaacactagcaaatatggactaagcgacgccggcagaagactggataagagctccggtcgacgtaggaacttgcgctctaacttacaagatgcacaagaagatataagagagcgatagggagagagagggaaagaggatgagtggatgacatgttgagccaacaaatttttttataaaaaatattttcctcattagtttggtttggaagaggaaataaatgaacggtcgaggatagaatgaattgttttaagaatttgggtgtattttaagattaccataatagttgtaatattttcctcattagtttggtttggaagaggaaataaatgaacggtcgacgatagaatgaacagttttaagaatttggttgtattttaagataaccataatagttgtgtagggtaaactttcggccataagtgagcagtttttgataaaaaaatgaataaggtccaaagattttgatcctggtattggtctctctgagcacgtgtattgaaaggtcgagccttgcaggtgctgcatgtgccccaacaggtcaactttattttttctttgaaacaatatgtcaacttttatttgacattgtatacaagttaccaacacgaagcatttcttgggactattttatgtactctgttgagtttcctactacaagcaagagtggattaactccgatcataaatatctcacttttaagacatgatttaagttaaacgacatgtaaaactttaggaaaaagtacgaattacccccctgaactatcgaggtcgaccgaattacacccccgaactcgaaaaccagaaatgctacaccttcaactattgaaatcggacaaataaccccccgattcaatccggagtggttttgagtccacgtggcagtctagtcagtatttttttaaaaaaataatcagtgggccccacctctcagttctcaccactctctatctctctctactctatcccaatctctccctctctctctcttctcaccccaccgtgctggtgagagccggaagcaggcggcgctgccggcggcggagggcggtgggcagctgagacggaggcgaagcgggcggccggcagcgggaggcagagctcgcctgcgcaggttgctgtgcaggttgaggtggcggacgagcgcgagcaagccgagcacggtcggcgcacgtacccggacaggttcttctggcgatggcgacgccgacaagccgtggcctgacgacgggcggcggcgcgaggacgggccgcggcgggcggcgaggacctcggctcctcgcatcgtgacgtctccacgcttagcaccgcccacaggtcatcccgtctggccgttcaccaccagcgctccagccgctccattccaactgctggcggtctactgccacatccgcgccgcgcgcctttccgtcggtcaccgcggcgcgaccgcgcgaatgcaactgcgacctgccctgatatttgttgccatttgctgatccgccgtccgccacccgcagccagcctcggcctctgtccccacccaccgcccgccagccgcctcgacaacgacgtgttgacgcacgtcacaccggcccaccggcacgggtcggcgtcggcgtccgaccacgacgacagcgtccccccgacgggtcatcggtcaccgccatcttgaacgccagcagcgccaccaaatcctccacccgtggccacggcgaaggacgggtagttgaggttgtacatggactaggccttgctctccgagcagccgtagctcttgctcctcgccacggcggcgatcatggtggatgtgtagttgagcgcgcagcgtcgtgggtggcgccgcctgctcccgccctcgtgcagccgcagccgtgctggtgagaagagagagagagggagagattgggatagagagcggtaggaactgacaggtgggacccactgattatttttttaaaaaaatgctgactagactgccacgtggacccaaaaccactccggattgagtcggaggtgttatttgtccagttttaatagttgagggtgtagaatatctggttttcaagttcgggggtgtaattcagtcgacctcgatagttcggggggtaattcgtactttttccaaaactttatctcgtcaactatcaactctacttaatttggatttcttgggctattttacatttattatgtcataaaaatactataattgagatcccaaacataagcataagacgacatttattaattttagaataaaaaacctaattaagggtccggatgaagtacaacataatatttttaaaatttattaatttgaaatatcagatttattaaaccaagttaatagtacacttatactccaaactgactacaatttggtatatatcaattttaaatttaaattatactacataatctatatctatatctgtactaatataaaaaggaaaaggagaagttgtccccctacaatcctactacccaaatcaatctggtataatcaccatcgtccatctacatccacatcaccttgatcgctaatcctaccgtccaccgcgatttcaccctctccaccgcgcgaagaccacgcctccgcgcaatttcaccctgtccaccgggcgaagattacgccctcctcgctcctcttcctcgcgtgtactgttgccgccgcctcactcaactgctgccgcaccggagccgaggtcgtccccagccgcccccgacggcgaggtccttcctcgccgccgccgcactccacctaccgcagcctgtccccgacggcgaggttgtggttcccccgtccaccggaccgccgcgactgcccccgatggcgagatcctttcctgccgccgccgcactccaccgcagtctggaatcaccggcgccgaggtggttccccttccaccgcacccgtccgggactgccccccacagcgcctaggtggaagtggaatgcctttccgtgctttcattccacgacttcttcaccggcttcctcgccgacgcctaccttctgcccgccatcctgaggtcttccttgattctcatccacaaggtacatccacaatcacttattctctgtacggtgatgatgtaatactttaggactttcgattcatgaggattgtcagctggaagagccatacatcttcactcagtagctttactcaatcttgttcatgttgcatacttgcttgcatatggttcgtctaaatttgtattgatttgtatggtggtcaggttttgatatgccggttgggatcagatataatgctttcgttgatatattctgagatactgaagatgctacggttatacggcttactggaattcagtttggatattttctatctacgtgatctcaacagtctgcttaggggcaacacaagagctaggtgggcgatggaacacatactatgaattcacttctgtctgaggtgtgttttgtcaatcttcagtacccatgttccattttgaaaggtcggtgtgttgtggtctgctacatggctgtacgcctgtacatatctcaggcaagatgatttttgcacttgtactggcatttagcacgccaaccataggcaatctcaaaactactctacaccagggaatttccatcttgtagctagcttgctagagggcaatcttttcctcaagctcctatctaccagcaaaaagattgctagcatttatgcttcagatttctgaacaagacttgaattggattgctgcttgaaaatttccaactgcaaatttctgttaatttccataactacagggttgaatttccatcaattacttgaatccaggatttaaagacgcgcatagctcagcaagcagtggattatactaaggtcaagtaggtcaacaaatttgaattggtgtagggcttgaagaagaaaaaaatagtattactctctattggaacttgaattattttttctaataagtttcttgtcagtgaaaagaatttgtggtcagttactaattaagaactgataactgatgggtgattgggtgttcattctatactgcatagctttttttaaaaaaaatgaagagaatatatttttgtagttgaagcagtcaatttctacaacaacagattactaggactttaaccttctctatcagtgtttttatgctggtatggactggtaatatcaagaagactgaatgcataaccagcagttttacatatttttcaatggcaacacaaagtaccatttatgtttatcacaaacacttgtcttcactgagaagtgccatttatggagtttgtttgcagtttgttcaatagattcacaacatttcaaatatggagttatttttcggaacattcaaagaagtacagctggctcaatttttgccgcatgctgtgagctcaaaatgtaagaggtcgcctggaacttgtgcttatttagtatcaaaatttcacctgccgaatatgtcatctcaatatgttctcctaaaattattgcttgagtatagtggtgttccttttgtgaactcactaagcatattttttttcaagctaagaatatacagatgaagcatggaaggagggatgcttttacattctggtttgttttgaagccttaaagtagtcagccaatgatcagacacctttcatttgagggccggagggaagtttgaggaaaaggctagatttagttatgattttgcatgcttcagtatgatatgattaacctgattcttgatagcttgtattttgaaaccaagtgttatgttaaatttacatcaaatattggtcatttataaaagcaggttgtctgaaaaaatgtaagtatgttggctttatgtatgcaggttgtctcaatttgacctccctttatagcttctgcctgattgtgacaccttttttagctgtacaagtagtgggaaacacaaagcaacaatgaatatgggcgaatgggcaagctgatgagcagactgtggtattgtttgcttgctgctgcgtagcactcacagactaagcatctggtggcctagggtactatgcagtggtgaggagtgagccatagccacttatctgatcaacgagcacctgaacagactgtaggttaaggtgatgtcctccttttctagatcctcaaataataaatattttagtgccaaatttgagtcatgtttttttttactgaaatctatattttttttatgaagttgccatgtatgatcatttttttttgtgatggatatagtgcgatgtttgattgctgatttgctccatgcataaagagcttctaatttaaaatagtttcacaaaagaatgatcaggtattaactaccaattgccatttttttccctatcttacttgagtgcaaaaatcagtttttatttgctcttttttcatggcaatgcaagaaggaatatgagatgtgcattatttgttaatacagattctatttggatgtgaaatatctttatctccttggaaattttgctctcttattctgccattaacttgttaagattcagaatattatggtcttcttaaatcttgatttgtcggtggccttgaacatcgtagatgagcacggctatcgctatcaagcaccatcatcttaaaaaatagtattaatctcacttcggtatacttcagtaccaagttctccatatatattgataaaaaaaactaagatgaaatttctcttaaataaaacattgattatgagcattagggagatgccaactgattggtgcaaactttttgtgtggagatggtgcctgcaataaagatgaggctcacaagctaaattgagcaccttcctttaggatatcgtggtacagaatatatgtatcacttttttttttgctacagaaggtggagcagtttttatgttcttagtttttgtttatatgtatttataacaattattcttttctagatcaattatttgtgtagatcaattatttacacctcttggaaaggaaccaccaaatacagcatatgggattttttttattgcctcatgattttttgtttatctatgccaacatttaccggcacaattgcctgcttctccatgtgctcccgtggtagattgggtatccacatcgagaataggtaattcagaaaacataagacaaaattttacttcaatttaattatactatgttatttattaattatactatgttatgtttattcttcttctttcaatcggtttctgaccagcgaagttcttatttacgggaaattgtcaagtaatctctattgtgcgtgttcctgatcgaagcatgtagcggtgcatatgtattcaattgtagtactctcaaacaaaaatattgagcatttgatgtacatcagaattgtactaagaagaacaaaattgtgtgccataatgaatccaagaatttaaatttgatctacgtataaaatctaattgtactacccaacagtaatgtactatgcaaactacatgaaattcaattttcaaaattattccgtagctctagacaatcttattactaccatcattatggtttttaaaataataaaatctaggtgatactccgcgttttgctgcgggattcatggatgagtatatgttaaatattgtcaaaatgatgaaagttgaaatgttaagaaaataatgtgaggaagatgatttgacatatacttgttgatctctataatataatattatagatgatgtgtcatacttgtatgagattttaataggctagaatagtaattgctagtgagtgaagatgtggcatgcttgcatggaattttaaatgatctaaaatagtaattgctagtgggtgatgatgtggcatacttgcatgttgagttttagcttctaataattgttagtgagtaccaactatataaaagtatagatgttctcccttgcagtttggcaagtttaatttaagcaatttgcccgatttaattcatattgatttttacgtgcattgtacgtgcacgataactagtaataataataaaagttatagttgacaatctggaatttattagctccaaatttcagaattattagatcataacataagtattgttgagactctagatttcgtacgaaattatcaaatcatgggaatactaaatttgagatttcaaaccgagtaccattcgcttctgcctagtatattagtaagaaatatttaaatcttccagcttgtatgatagacaaacaaatacacacgggcttacattgttcgtgcttagtttttttagaggagatgtatcgatcagtaagcactaagagcacccgcaatggtaaagtaagttgctctctataacatatgtacatctcagcaatagactatattaatagtaaacctccttaatagtatgtctacatgggtatcgatctattgcctcgttttatctatagactatctccaagttagtagatagttttgctctctctctcttcatttaatatcttccaagtaggaagatatgctgacatgaatctcttgtagagagcatatagataactattgtggatgccctaagcacactcataattatacaagttaaataaagataagaacgcgccatccatcgatttgtggaggaagcacgttgcaccaagctcacacaccattattgcaatatataggtggtgtttggttggagggattaaagtggggctaaactttagtccctctcacaaaaatataagtccctatgtagcccctctctcccaaacacccccatagcatttcctttctttcttaattagctcttgttaccacctggacctacccttctcccaccagaagctgagcgcttcttcttcttactcattgtcttgtttgttttgtgttcgtcgtcattattatcgtcgtcatcgtcgtcgttgtcatcaccatcgatgtcatggttagagtcagaatcatgatccgaatctgagccgcgatcaaagtccgaatcatgatctgagtccgagtcatgatcatgatcagagtctgaatcgtggtccgaatcggagtcatcaacagagtcccaatcactgccatcatcgtcatcattatctaatttcttgatctctatacctcggtgatgctcagcatcttggcctgatcctctaccgacgtcaagctcgccgtctcgccgatcaccggcttggacggccttgctggctgccttctcctcgccttcgtcttgcttcaccggcgaacttctcttttcctccatggtggcgccatggcttacctggctaattggctgctgcacggttgtcaacgggtcatctgaggcagcggatgaaatgacggcgaggaggaagaagacggctaggcaaatggcggcgcgcgccatgtgcacggtgaggtcgccggcgagctttctcgctccgatgaccgagcgggctatgtgtaatgagctgtgagaacaatgttgggagagcaaggtatttatagtgggtggcctggcctatatctgtttacataatgcaatatatttctttactagaagggggacgcacacacattgatcaatactccctccgtttcaaaatgtttgacgccgttgacttttagcacatatttgaccattcgtcttattcaaaaaaaaattgtaaaatatgtaaaactatatgtgtacatgaaagtatatttaacaatgaatcaaatgagatgaaaagaataaataattacttaaatttttgaataagacgaatggtcaaacacgaataaaaagtcaacggtgtcaaacattttgaaacggagggagtattacacaggcaacaccacacttatacagcttgcgaatgcatcccctctcacatgtttaaaaagacggaaaccaacggtacatccataatctcgctaaatttcgattgacagttcatttacgtgtacataatattcgtagacaccaggatttgaactctgaaattaatcatgtacccacgactccatcaccactccaccggtgcttccccataatgcaatgtaatttaatcgagcctctccatgtccaagacgtgtatgctgccatcttcatcagtgatctaatatcattgtagcatattattattattatttaccttcttctcccaggcgtgctatttcaaaaattatcttaattcgaggtgtgtgactttctctaatggaagctgagtcgatctgccggtacatatattatgtcgtgcttattttttttgcttaggtagtgcctcagtgcgctgagccaacgaactgcaacaaacgttgttgcaaagtgtgtggcatatgcctccattttgcactagcgcggcaagtaaacttttgtcaaactaaatgcatgcattactggattctgaaattgtttatgctgttcatcacgagatgttgtttcggtgattgttcacgactaacaacaaagatcaatcaacaagttgctaataactgtgtgatactgttgacgaaaaaaaatcgaacacaccgtcctgggagatctgcttagctcctgtgcagatccaaatattgacgagattcgagcgtaccagtcagtttgatcctgcaactgacaagatatgcaaatagtagatcgaaatagccgatcggctgacaagccgatggagtagttccagccgatgccgataatagccgatgccgataccagccgatagcgatagggtttaagcaatcggctatatgtccaatgtagataatgatataaaggcaattggctgacgacgatgtaataaaataacaatataatccagtataaaccaatcagcaaataatgatatgataaataagcatcgattcgaaggtcaaaacacacatcggctggaggtctgatgtcatgaaatccacaagattagattaaacactgaagcctttgttgtcatcggctaaatccaacttatatgtatatgcaatccttatgagccgatgcaacgtccagataactcaccagctgaaaccccgatgaaacccttattggcaatcaagaagcaggctagagattatggttctaagcacgacttagtagatcaaacttaactgatgcagcactaagtatgaaaagaaacataatatctagacaatcaagtcgttgactgagttttcagggtggtagatgtctaagctaatctaatctagcaacgcgatttagccgatgcctgcagaaaccctaaaacgagaagcagccgatagagctaaattgatatgctaagactagattaacagagatatatgataaataggtagacaagtatatcatccaaaccagatcaatccaagaggtcgaatgtactgatgcagccttgaacatgccgacgtaaacgatataattgcctgggccggcggaacattggacttatcccttcgccggagatcgaagacgatgcagccccgcgtcgggtgccaagttccgccggaacgtaaaaacaaaagtagaaataaaaagggtggcgatgcgccgaattgtattgatcgtggagatagattacatagaccccgggtgtacatatttatacccatgggttgatacaagtccttgtcggacaagaaagaaaccttcctaaagataaaaggaaaagataaagtccttataggacactaaacacactttcctaaagataaaaggaaactaacatactattcctaattaatagatacaactgccttcttcggactcgatccttacgtggcaatcatcatgaagcacgtcaactcaatccgacaatgattccaatatcatcttgccggaatcagctacatcggcttgtcttgtccgattcggtaactgccgatgcacactgtagccgatgcggttccgaagccgattcataccctgtttccgttatcgatttcctcccaaatccgcttcggccttaactccaaatccgatgcatgatttatcaaatttcatcattaacagatactggacatttgtaattgcatttggcatgattatgggagcagagggggggtacccatctgatgtactacctccgtttccaaattttttatgttggttagttcaatttgagctaaccaacgtgaaaactaaaaaaggagggaatatttgagatggagattatatatagcaggcactacataaatgtactttgaatggctctgagaccagagcagaggtgtcaagctgtgttaccattgtcggacggtaaacagtaacggctgatgacacttgtgatttatgaaggtaattatgactaaaccaagaaccaagttatactttgcacatttgagacaaggaccatgcattttctagaataactactaatattaaacggttggctagcttaaattataaagagtggagattttcttagcaaaagtacagtagttgagtctggtattggctcttaagcaatacacgccatctaaagattatcccctggcaactgtgagaactaagaaaggctaattctttggtcatcctagttgcctaggactaggagcattggaagcactcactactacgaaatcgatttttccattcagtcaaaaagggtttttccgtgcggaggtcttgcctgtctgcacccaggtgtctacgaaaataaatattttcacgtgtggacggcccaaccgcacgaaaaaatctatattcctgtacggtcgggttaagtggaccgcacgggataattggattttcgcatgcggtcatgttatgtcgcccacaaggaaaaataaaattctagaaaaaaaataaaaattcaaaaaaggaaaccctagaatccagcggcggcggcgcggatccggccggcacgcgtgcgtgcggagccagccgctccgctcccagccgccgttgccttctcgtcgtcatcggtaggggcggcgtggatccggccagcacgcttgcgcgcagggccggcagcgccgctcccggccaacattgcctcccagttgtcatcggtcggggcgatgcggatctggccggtgtgcgcgcggggccggcggcaccactcccggccacctctttgtcgtcatcgtcgctcgaggccaccacttgtaggcgggcctcacgcgaaaatcgattttcgcgtgcgggcctcttaagggtccgcacgtgaaaataggagtctgatttttgcgtatgcacgcaaaaacggtctgtgtgcgaaaatgggagctccttgtccaggaaaattgtttttttagtagtaactacaacgcgacatccttttcattttttttgtccctgatataaatcaagttttaagggcagttagagatgatgccttgtggtgtgcagtgtgctgtatgcatgggctaaacacaccttctggagttagggcctgtttggttgctaccctgaggaaaacttgcttgacctgagacaagcctgagttattttaccctctgtttggttgccaccctcagccccttttccacttgcctggcctgatgaaacctggcatg

SEQ ID NO: 2687 - DNA, 29170 bp, Oryza sativa
atggcaggctccctagatgggagcacgaaagcgccagatgcaaccatcaccatcaccaaggatgatggaaagaccaccaagaaggtggcaaatcctgctctcccgctgtggagggctcaggagcagcaagttctgagctacttgctatcgtctctgtcccgtgaggtgctgactcaagttgctaccttcacaaaggcgacggaggtgtgggaggcaattgaaaacctctttgcgtcgcagtcccgcgctaggatcatcaacatccgaatggcgctctcgtccaccaagaagggaacacgcactattgcggaatatgttggtaagatgaaatcgttagcagatgacatgtcctctgcaaggaagcctcttgatgatgaggagcttgtgtcttacatcttcgccggccttgacttcgactacaactcggtggtgtcttccatcgctggccgagccgactccatcaccatgagcgaggcctatgcactgctagttggctttgaaagtcggctagaacttcttcaaggctcttcatctgccttggccaattctgtgtcgcgaggagggcgcggcggtggccggggtcaaggcggaaaccctggacgtggcggctttggacgtggacgcggcgacggcaagccaaggccgacatgccagctgtgcggcaagatcggccacaccgtcatcaagtgctggaaatgcttcgatcactccttcactggagaagagaagaacgccaacgttgctgcatcaagctcctacagcgttgacaccaactggtacgtcgacagcagcgccaccgaccacatcaccggcgagatggaaaagctggcggtgaaggacaagtacaccagcaatgagcaagtccacacggctagtggaacaggtatggacatcaattatgttggtcattctactattcgcaccccaaaacgtgacctatttctcaaaaatatccttcatgtgccaagtgcatataaaagtctcatatccgctcattgctttactagagataatagagctttcatagagcttcacccatatttcttcttggttaaggatcaggtcacgaggacgccgcttcttcgaggcaagtgtgagtgcggcctctaccctctgccaactgacaagttgtccagcgcatcacataagcaggcctatggtgttgtcaaaccatcgttgtcccggtggcatagtcgtttagggcatccatctcttcctattgttgatcgagtcattagcaagaataatctaccggtaactagggattctagtcaggagtctgtgtgtgatgcttgccagagaggcaagaatcatcaattaccctattccaagtcttttagtgtgtcctccaaacctttgcaacttattttttccgatgtatggggccctgcaccaagttcagttggcaataaagtttattatgttagcttcctcgatgactttagtaagtttacatggatttacttactcaagcacaaatctgaagtttttgagcgatttcgcgatttccagaaccttgttgaacacctcctcaacaggaaaattaaggccatgcaaaccgattggggaggggaataccagcacttaaataccttcttccagcgcattggcattgagcaccatgtctcctgcccctatgcgcatcaacaaaacggttctgccgagcgcaaacaccgccatattgtttgaagttggcctttccctgctagcccatgcgtccatgcctctcaagttttgggatgaagctttcaccactgctgtttatctcattaatagaaccccgttaaaagtaatcaatctccctccggattactctctgttcgtactttggctgcgcctgctggcctaacctccggccgtacaatgctcgcaagctagctttctgctcccaacagtgtgtcttcctaggctatagtactctccacaaaggttttaaatgcctagacatatctgccgggcgagtttatatctcaagggatgttgtgtttgatgagtcatcttttccctttgctaaactccactccaatgcgggcgcctgtctccgttcagaagttctcttgctgccaccacatttgcttccaccatcatcattgcttgatccagggggcaatatagtacatgatcaacctatgattgatgatcctaaccacactaatcacactaatcaggatactgagcatgctgcaggacaaaatactgaaaacaacggagaaaacagcgatgaaaatgatgcaggaacggcggcagatgatcatgttttcgtgcaatcggacgaccacggctccatgcaaggttccggcggacaccacaccggtgctgatcccgacgcaagcatgcaggcgccgtcaggtggtgctgagtccgaagacgagcaagacacaggctcagtgggtgcgtcgcccatcgtgcagcctgctgtgcacagtcccgtgcatgcacaagattcctctgcacaccagtccggatcatctgtgctgagcaacgaggaaatcagctccacaacgcaagctcctgctcctggtcgagtcacaagatcaagacacgggacccgcaagccgaagaaatacgccgatgggactataaggtatgcatgtctgacagatactagggaaccagatagtttgcaagatgcactacgtaataaaaattggaagttggcaatggataaagagtatgaggcacttgtaaataataagacttggcatctagttccacctaaaagagggacaaatattatagattgtaagtgggtgtataaaattaagaggaaagcggatggaactatagacagatataaggctaggctagtttaagcagcgatatggaattaactatgaggatacctttagtcctgtagtaaaggctgcaactattagacttgttttgtctctagctgtcacaaggatggagtcttcgccaacttgatgttcagaatgcttttctacatggctatcttgaagaagatgtgtatatgagacagccaccagggtatgaagaggcaggactaccacatcatctctgtaagttagacaaagctttatatggtctcaaacaggctccaagagcttggtactctctcttaagtaagaaattgcaagaacttggttttacaccttccaaggcagatacctctcttttcttctttaataagaaaggagtcacaatattcttacttgtgtatgttgatgacattattgttgcaagctctagcacctcagcagtcacaacattgttaaaaggtcttgaaaaagagtttgctctcaaagatcttggtgatctacactattttcttggaattgaagttaagaaactaggaggtggtctgttgttgagtcaggaaaggtatgctggtgatatccttaagtgagttggtatgaggaattgcaaactgttagcaagtactcctatgtccatagctgaaaaactgttagcaagtgaaggtgtgaccttaggagtacatgatgcaacacaatatcgtagtattgttggtgctttacagtatttaactctcacaagaccagatatatctttctctgttaacaaagtctatcagtttcttcagaatcccactgatatacactgggctgcagtgaagagaatactaaggtatgttcaaggaacattaggacttggacttaggattgacaggtctttctctagcattgtaagtgctttctctgatgctgattgggctgggtgtctagatgacagaagatctattggaggctttgctgtgtttctaggtactaatcttgtgtcatggagtgctagaaagcaggctacagtgtctagatctagtactgaggcggaatataaggctttggcaaatgcaatagctgaaataatgtgggtgcgcaagttgttggaagaacttggaattccacatcccagatcatctcaattatggtgtgacaatattggcacaacctatttgtctgttaaccctgtgttttatgctagaacaatgcatatagaagtggattatcattttgttcgagagcaagtagcacagaagcaactggagattcgatttgtgtcgtcaaaggatcaagtggcagatggtttcactaagcctcttcctgttcggcaactacagttgttttgtaacaatctcaatttgggaaacttgagattgagggggagtgttagataatgtggtttctgttaagtcttctgttgagatagatagataaggatagaagatatagataagatagtttttctgtttctgttcttgttgtaactacacgcgctattatcttgagataatgcgtgattctctcacttgtaaacaccacgccaggggtgattcctgcgcctatattaacacgtatgcgaacatggaggaagggtatcgcttcaactcacattggggatctctttcttagcatcctatttctttttcacttctttgtgtgtatgctattaatttctcagagctaagatgcgcatagagtttggtcgatttttgtttcttcccatgaacacataattaacataaataatctaagcccaatcactttttctttctctcaggcaagtgtgccaaaccaaacaagcaaaatctcaggttgcctgaccaggcaaagcacatgcacttctccgatgtttctcaggcacctaaatttctcaagcacagcttctagggcaccaactaaataggcccttagtcactgggcttcttggtagccctatctcttgtatctcttgtttgttttggtatgttttttattttcatttttttcatttggatttttaccgtctttaatgaaatgatgcccatttttactgtgtattcaaggaaaaaaataaattaatgatctaacctttaatccaccaaaatattttgtttatcattccttcctttctgcagcctttagcagtacacgtcatctagagaaattcgctactacatacccttcattcgttttcttagccttatataatacttcctctatttcatattataagactttctagcattgcccacattcatatatatgttaatgatatctatatgaatatggcaatgctagaaagtcttataatatgaaacggagagagtagcaattttctcttttatcctatgctaacaatcgttgttgaacttaacattgatgtttctctcgcctcatcttttctctcctctctcgttcatattggcatattgatctagttgacagttctatggacaactattaattgtcagtgtacatgtcatgaggcctatataataacctagcatattcaacactgaagttctactcttttactgtgtttgatagagttatacacttctacttctaccacaacagctaccagctcttgtattttagcgattctttttttcttttggcctgatatgcgctgctgtgtgacattggatgattggaacgtaggcatcttgtgatgttaactgtgctctgtacagcaacaaaaacaaggatcactgtattcaagcttgatgtgtagcatagcaaatgaagacaaccgaaaaaaaaatgtcagctttcggattttaggtgtccgaagaaaacgagtcaggggctcacagccatatatcctctgcaaattgaaatggaggatattgtattggaaaacttttgttccgttttttacttctagctcaaccaaaactataactcaattaactaatcatatattccccccatttcacaatgtaagtcattctatcatttaccacatttatattggtgttaatgaatctagacatatatacgtgggaaatactagaatgacttacattgtgaaatagaggaagtaaaacctaatgtttttccctacaacatttgccctttttctgttttacaatcaacagcaaatgcaggtttcttagtccgtccgatctgccacgtgacaggatccagtccctctatctccctctaccagttctgccctgccgtgtggtttcttctccatggactcctccttcctttgccctctcccgatgggaaatttaactatttgccactcttgtgacatggcaattaacgatttgccacaccctgtcaatgacatgtgggccctcatgtgtctatgacatgtgggcctagtggcaaatcattaagcaacatccgtaagagtggcaaatagttaaaagcccctctcccgatccccttttgtgcagccgctgctcctcttcggttgctccacggagccgtcgccaactgaggggatgatggccggacggcgaactcaccgaggcacggctgttggagcgaactaatccggagggggtcaggactattttgcgccgccgcggaggcggcggcgctagaggcaggtcgagcggaggcgacagcgtcgggcgacggggtggtgcaaacggtgggggccgcccggctcgagcgacagtggcgccgaaggcggtttgagcggaggcgacgacgccgggtgacgaggcagcccaaacggcggcggcgccagaggtgggtcaaacggaggcgacggcgctgggcgccgcggaggcccgagtggagggcggcgacgacaatgcgtggcgggccttcctccgcgctgccccccctcgctggctgccggctcccgaagctccgccttcaccgctctgttcctccccagctccgccgctctccctccccatctgcagctcgacggcaccggcggcggcttgacgacggccgctccgtgcccctcctcgccagatccggccttaaggtcgccggatctggccttgggaggcggtggcggcggtggcggcttgaaggcggcagcagcagatcgaaggctgcggcagcggctcgactgcgggagcagcagctcgaaggcggcggcggcggctcgactgcaggaacggctcgacgacagccagcccgcgccccctctacagtgcagtagaggtcccatcgatcggtaacatcgattcactgattcttccacatctctcccttgcgccgcttcgtcgcccacattcactgattcttggaagcacaaacgaaaggatcacatatgtacgttactaccttttcctgcaaatacatatacaccacttggatatacatacccattctgccttgctttacatgttaattaacttgattgagcaaatgtttgttgcattgatcggcctgtatctcaaagtacaatgagtaagtgactgaaggtaattcattagccttttatgtctatatatgatcatagaatgtatgcagggtgcatcagacaagcaaaattatatggcaagtgatggcacatttcttagggaaggatttatgagtttaatgtcaaaatcctctctatcagttgcttatgcagctaaaaatagggaaacaacctatttatattcataggatactctatgagttcaacatcaaagtttcttataggatactctatgagttcaacatcaaaattatttatattgacatgttaatttattatattctaaatccatatgttattgagatgtgttctccaattgatctgaatgcagagtatcctatcataatattaacaatgttggaccatacttttggtgggtgctgcatgcagttattattatcaaagccatgaaaggtattttacattgttacatcttcttcacctttataggtttctaatagtgttcttgcttctttgagtggcttcgtttgctaattcctatgcccttcatatttcaggttcaaggcttccagctggttggcaattgctcttcagggtttctctacctgttaactgttattgcctgatattatttcagttttttgggtagttccttgggatgtcttatttgttgtttagtcgttatattcctatgcatgatcattatttagttgttttgataaatgaccttccctactctattttttatcatataaattagtattcggttaaactatagcatatatttttttgcatgaggcaatatttgtatttagcagcatctcactgactacattcatccattttcgttttcaggcatgggcacatggcagataccacaatgtgaggcaaacattggaccttagctaacataaatgaatatgtgatgccactttcactgatgcttctatgaccactagtccgggtaatttcaactttctcatgctgttatatgctgatgctatattacttagcatgctttaggaaattacagactatttcattctgttcaaattacatgttgttatttgtaatagtgtgggatatgcatgctcttcattactgtatatggcatgctcttcatcaaggttaaaccgtggatctattttccttttattattggtggctataaaatagattgatgctaattaatggcaagtttgcgaaaatactgaactctcatatctccaggattggctataaaatcgtcagttctgggtcatggaacagtaaaccttaatttctatttgtttttgctaatggccaatctgtatagattaattgtaaaacatacacaatatgagttgccactgtggttagggttgcgatctgcggttagggtttgggtatggaatagagcaagtgtgatggccaatgtgcatgacagagtcagctccactaaccaatgtctctagatatggttctactctgtgatctcccccatcatctccgtcatggattaggtctaagcttgatttaggtgtgtggctgtccagccatctgcgctcctccaatggcatgctgctggatatgcagccatctccagcttggttattctctgctgaaaaaaaattaatccctcctatcacatctaacatttgcttcgacccatgacaatgcttggtttggtatgccttttttcaccatcctttactctacaatccatgatttgcattcattgtttacaaggtaaatttattgaagagtggtctgttcttttgcgctgcagcattgtattgctcagaagctattttccagtcatcaaaatctcatttggataagcagctgtgttctgctatatattttttttgtccactgactctgtgaacaaccccgccaattatactaaaaccaaacaaaggtacacagctttgttattatatcatttcgttaagtacttgcagatttcggaattattcagaagctttcattttcgttgcaataatcttacaagcaagatgcatgaccctaatcatggttcagcatcagctgtctagaactctttgaaatatcgtataaaaaaagagaactctttgaaatatctagaagctaaattggctggacgctcatgtcctatatatgataacatatgtatgtacatacatagtatctacaagtatttgttgttggttagctcagtgaacttggttgtggcctcgagtaattaaaactatccatcgattttacttgcctttaattttctttttttgcttttgcttatataaaagttaggcctagattttacaactgataacaatgagctgtgtattctttttatttgcctagatgattcagctggacccgaatgtgtatcaacataatgcctagagttattctctctttactgttgcagtgtacctttaggctttctgatatagggaaaatttttgtggcggtgttatactgtattcttgggcacatgtgcatttgttcaccttacaacctgcattcttggtttcatgtatatttcatatgaatttatttgatcatagagatttttcatgtgttgatttgctccacaaattgtaatggtcaaatgccagtgtccataaaaaaaatggttgttcccatgttctgttgtaagctaatttttgtggcatttttgacatgtctaaccagttctgttttccacaggtacatgaagaacaatccgcctgcaaaatcatttctatcaaacacattcttcactttttattcaagagctaatagacaaacctttctaagacgtatcgtgtcttgatgcatctatttacatgtgtcctgaccggtttctttacttccagaaaacaatcctttgcataataatatttgtacagattccattggaaactatccttttcagaaaacactacttttcattagccatgttatttcccttttgccgacctgacagtaatagaaggaaaaacagttgtagtttcattatttcaaactcaatcgcacgtatgcagctatatatatgggctatatatatgggctatggtttaagtaggtggacctactcttgcttcaatctttctttgtggtatagcatttgagaaacattagttagaatgttgcataagtgtagaattgaagaactggtgtaccttccggtttcatgaaacattactgttgcctacgaattttcatgtgccatgcttaatatttggtgtccgtttttctttctcaatttacataattcaaatagaccttaccatatgccaatttgaaatacttggatgtgaattaaatttagatctcctttttccccggcacaacgcgtggggtgctgactagttaaacaaattgtccagatttcctgctaggcatcaccatttccagcaccaaagcaccaataggccgtaggagaagaacactacacaccaaaatacagaacatgtaggggaagtactagagggtgttgtgagggagttgtgtatgcatgaatttacccatcaaaacttaaactatggtgcctacaaattttgcacgccgatacacttgcattataaattaagtgagatttatggatacaacgatgcatgcctcctccgaaatatgttaaagggagtgtacttgcatttatggagtatgatgtgtgtgtggatttatcaagtaataaaaaagtagttgtgtggacttcaatcaatgggagcaggtacaatagtagactataagctagctataaatatattttaaggagataaaagatgagagataagagcagcgggctatagatttgtagccaactgcagcacagacttcaagatacatgtgtgtatgataagtgagactagacattaattatgtagtatatatttataggtaactattatataaattggctattaaattgactatagatgatttgaagccaatagttggctatactattaaacttgttctaataagaaaactacttgataccccgcgttttgctatgggatatatggatgaatgtatggtatacattattaaaatgatagacgtatatgtttaaataatgtgaaaatgatgtgaagatagtgaattgatattgcttgcatgctgagttctaaaaatacaataaaattacaaatgatatgatatgtcatgttttcatgagatctaaaatattctagataataattgctagtgggtaatgatgtggtatacttacattatgttacatgttgagttttagaagtcagtggataccacctgtatagaaagtatactatcatggcctgaatctgatctaaagtgaactagtcatattttgcatacttgggctggctgggcccaacatcctgggccagacatccaagcccattagtaggcctatgttttgaccactgttgtttagaacttgcctgcttactttcactcacatttttaacttttttttcagttcgtaatgactagaagatttcatatgaacgcactaaattagattccacatatttcgtttgtcaaaaatacttaaaaagttcccgagatctactactgtactatacaggcccatgcataggccggtgcaacatgtgcacatgctcagggcccccaaaaattaggaccccaaaatctacacttagtactaattgtgtatacttaattagcaaccactacctccgttttaggttataagatattttagtattgcctaaatttatatagatgttaataaatctagacatatatctagacacatatatgtctagattcattaacacatacttcctccgttttacaatgtaagtcattctagcatttcccatatccatattgatgttaatgaatatagacatatatatctatctaaattcattgacataaatataaatacagaaaatgttagaacaacttacattatgaaacggagaaagtatatgaatatggacaatcctattttataacctgaaactgaggaaataattaacagacccaagagcctaggaagatgaaatgttggaagggccaatcccatgctgggctagtacttacgatttgttttcaccgttgccgcttgctgctgattcgtatttcgtagaattttttatttttatttattaggaaaaagtctaaataccctctaaactttagatataaatctgtctagcaccctgaattttaaaaccggacacccaactccctaaactttgtaaaaccgtacgtattaccccctaaggtggttttgtacagtggtttttatctaatttgtatataaattggatgagtttgatcacgtaacatacacattggacatatgtattaaaatcttcacttaaatctttcttttactagttgttagctctcacttacaaacaagtaccaacataataatagtatgatatctgtcagggttatggataaggtatactctctatccttggatgtacggtgggtatcgatatggcatacccgcgcgtatacggatagtttccatatacgatgaggaaatctatcacgtgatagaaacaaaatatacggatgggaggagtcctactcggacgagactgggtctttaccatatcgtgaggggttcgatatcttcgagtcctacttggagatcaactgacccgcggtatataagggaccccctggacaggacctaaggcatcgaatattgctgccaacacatacacctcacagcctacggagccggagcgtgcaggagccaagtcgccaagagatctagttgaaccaactcaactacgctctcgtcagtatcatcgagttctgctattccctttgtaatctgtggtttctatcatataatcccataccaactggattagggctattaccttccaaggtgcctgaaccagtataatccttgtattctgtttgcttgatgtcgtattacgtagatcctcgtatcaatggaccccactatcatctatatccggtctacgggtatccccgtcgacaatatccctgtataagtataaattaatgacttacaactgatgatatgcaaatatgttatattagttatttaaagctgttcatttaaacttttaaaatatgcaaaaacaccatccaaaaccaccgtagggggtaatttgaacggttttgtaatgtttagggggttggatgtccggttttaaagtttagggttctagacggacttctatctaaagtttaggggggtatttggactttttcatatctattaaaatatttacaaaaataattttctatttgaaaaatttacaaatctagtccccattgccctctgggagtctagtggacgatttatccgacgtggcagatggtcgttggccctcgctttacagctggccaccgaggatggcgaaaatttacatgcagcccccttgccgcccaagtcgggttgtgccgggccggcccgaaggcacggcaggtcggcagcttgtgcttctttgagataagtctatttcacctccctcctctttgggtgggataacaataagtctattttgtgtccctcatctttgaaccgcgtcttatacatagctacaataagtctatttttccttactctttttggggccgtgccatatcttataaatcgatttcagggtccgatcccaagcatcccattgggccacgtggcatcgcgtgttgagctccatcggcattctcggctgaagaatgcgccacgtttcgcacccctcccacagccgttagatggtacatcgacggtcaaaaatcatctggcggatctaaatgtaaattgcaattttcaagaggggttttttacaaaacgtgtgaccttatctggaagagtccggattattggagaaaaaaatcgcaacaaaaaacctcgtactcaccgtgcggccgccctgcctcgatccacgccgctggcgcctgcatctatgcggcctgctccgattagatatgcgctgctaaggtgaggcgagagagagggacgggggagagagaaaactgagctcgacgatctggatgttgaggctgagcgacggatggagcagtcgagcagcgggggtttgctcgtcggtgggatttgggccttgccctcgatgccatcctcgcctccatcctgcgccgccggaggtcgctcccaccggcccctgtgtccgccgcgcacgcgctcctaaatggtcgcggtctctactctatagccatcttcgctgcgcactgctcacactgctctccgcgctcgcgtggaagtggatgtgggaactgggaaacgagtggtcatgggctcgcgggaaagctgcactttcctttcctacgcgctagtagtactactactattctcgtctgcttttttgttctttttttttatttctaactgttcgctgtaaggctgcactaaaacatagagaaatactagtagagtactccctccatcccaaaatgtttgacgccgttgacttttttaaaaatatttgaccgtttgtcttattcaaaaaatttaagtaattattaattattttcctatcatttaatttattgttaaaaatacttttatgtatacatatagctttacagatttcacagaagtttttaataagatgaacggttaaacatgtttaaaaaagtcaacggcgtcaaatatttagggaaggagggagtactacctaaacaaaaaaaaatgcgtatcaaatgccccctatgtgacttaggatctgtttagttggtgaaataatttttttttatgttacgtcagacgtttaaccggatgttagaaggggttttttttgacacggatgaaaaaaactaatttcataactcgtctagaaaccacgagacgaatcttttgagcctaattaagccgtcattagcacatatgggttactgtagtacttttatggctaattaattagactcaaaagattcgttttacgatttacatgcaaactgtgcaattaatttttctttttatctatagagtaaattgcaccgacggtgcatcaacttggcaggtgggtgtaatttggtgcaagaacttgagaaatgagcattctagtggcaacaacttggcaaatatgtgtaatttagtataagaactttataagtgatcgtataaatgtaacaacttgcaaggtaggtacgattttaatacaataaactaagaaattatgcgacaacttaattatttggagcattttctatatagattcaatttaagtaattattttgacaatatactagtgtggatttgtataagcatatttatatttttattataataattaataacttgaagtcaattaaactggatgtaaaaattattatttcggttgatatttgagaaggtaaagaaaacgaaaaaaatcttaaggtaattgaatgtaaattgtatgtgcaatataattattaaagattaaatttaatatctaaggtaatatccgtaggattactatgtagtggcattattgacatcgggaaaaaaaaactcacctagcatatgcctagccaagttgatgcacaacatcgggaaaaaaaaaactcacctagcatatgcctagccaagttgatgcacaaaaatacaaattgtcaagttcttgtactagaacgcacctacttgtcaagttgttgcactcggacgctcaattctcaagttctttcactatatcgcactcacctgccaagttgttataccgtgggtgcaatttactcttatctatatttagtactccatacatatgtccaaagattcgattggatatttttgtgaaaagtttttgggaactaaatcctatcggttgccctaataagttaaaactaaaatttaaattttcaaactgaattttaaagttgattttaaaaatattttcaatgtaatttctatttcagtattgaattttaagtcgctagcaatacatatatataaatgttttagctatagattaatttttatttctaaataagtttttttttacttattagagaatattgacaaccaataaggaccttaatttgtgttcgatggtgtgagaaagtggaaataaatcttgttttctgcatgcatgttacccgaattgataaatgacatgttttttcaaaagaaaaatctatatattttttacttaaaaatcatattaattcatttttcaggtttaaaatagttaatactcattaatcatatggtaatgacttaattttctgtatcttaccattgttattttttctcatttactcaaacacactctaaggccgtgttccgcctaatccctcgctcacccaaaacggagtaactcattagcacatgattaattaagtattaatgcatttttttttgaaaaaatgattaatatgattttttaaaaacaactttcgtatagaaattttttgcaaaaaatatatcatttagcagtttgacaagcgtacacacggaaaaagatagaggtgagtagggaaaacttggaaactaactcagcctaaggctgtgttagggaggaggggttcgcacgcaaaacgaagcacctattattgcatgattaattaagtatttgctaattttttttaaaaaatggattaatataattttttaagcaactttcgtatagaatttttttttttgcaaaaaacgcaccgtttagcagattaaaaagcgtgcgcgcggaaaacgagaaagggaggttgggaaagggaggtaacgaatgcagcctaagtggtggtgattttgggataaattttaaacccataatatcaactttttttggaacggatggagtaaattagcttatgattatcagccaaaatttgaattttcaaccttaaatttaaagctaattttgatggtttttcatcgaagtttattttagatcggtaagaacacgtatatgaaagttttatttgcatatcacttttcgtttgcaaatatgccatttcgtttattcaacgaataagcaaaacgatggggctgtagaatgcaaagtgggcctacatggtgtctatataattaattttcttatgtatggttcatacgataagcaaaatgataaaccgtgtgttttttttcgtaaatgaaaagaagagtaaatcactttgggccactttttatcggcgttgtttcgctttgcatcaccctttaactatttttttacacttttgatcgggttattttacctttatactggagtagcattttgtaacaccgtcagttgttttatccatctacatctaaattgtcatatatcatataaatggtctacatataactgattattgacgaataagaacaggggtactcgaggtcattcatatgcatgagaagagagtaacacaggcaagattacccagtctaaaataaaaacattggctaaaaggtgatcaaaagcgaaacataagcaataaagatggtccaaaataaaatttactctaaaagaaattttatagaaaaaatatcttaaaaacatattaatctatttttcaggtttaaaataattagtacttattaatcatatgctaataatttatctcattttatgtatcttatcattcttctcttcactcaaatacaccctaagagtaattccatccgtccgagaatataagcatttttagagttcgacaatgttattaaaaaaatatgtagaattaaatagagaagggttgtgattggataaaaagtggaggtaggtggaaaatttgaatggtggagggttgtgattggttgaaaagagaatgttggtgtagaaactgttatattttgggataaattctagaggctagaagttgttatattttgggacaaagggagtagttaatttgggacaaattttaaaccaaaatgagcggttatttagagatggagggagtaaattatatcgtgaagtgggctcataggtgcctatgtaattaattttcttatctatggttagtaaggtaaaaaattgaggaatattaattaataaaaagtaaattgcgtctacagtacacaaacttagtaagtgggtacgatctagtgcaagaatttgaaaaatgattatatagatgtaacaacttggttagtacgtgcattttggttaaaatatctctcttccacaccatactttttcagctatataaagaaaaagcagccagttaggtcatcttgagttccgaataaggttttagatgtattgcatttgcttggttataaatactaaaataacctattatttaaaattagaaaaataatgattatcaaaactaagtgcatgccaactaacaaaatttccaagcgatccatctgatcatacaaattcggtgatgagcactgtaaaacatactcattgccaacaattaatctagcagtcatgtttacaaatacaaccaataaaatacgatgaaccataggtatgtaaccgtgtttttatcaaaatgcacatgattgttaagtttatgtaccagtttgcttattttacaaggtttttacactaaatcacacccacctgccaaatttttgtaccgctggcgcaatttactcattaataaaataagaagacttaaatagaagaggtagagagctgacatacaaaatctaccatgggtacaataagattatcgtgaatcatgaaacatatgtgcttccattgtgaatatcttaaaagtgcacgatcttcacaggaattcaatgaaaaattgagctaattcctataaagtctagcaaaatattagcattaattacccttagcaattatagaagccatacagagagcatgccaactagcacgtttattttcccgaagagttggctcttgccttctccaagaaatgttaattatatggaagacttgctaattaatagtacggcatgtgaaacatttacataattgaccgaataaaacattctgtattctagcacattaatatgtttttacttgttggcccattatgcgtcaaagccaagtctcttttgagatgttattttgagcttagatttttttgcaagttttcatttatctaagttatcacaaaagctaccgattattgtcgcttagttaatttttactctatctcatatatatctaagaaatcaaactaattccaaactagtaatctgctcgtgctaacgctacggctgtttttgataatacaaatcaaaatatatgtctaaaaatacaaatatccaagcaaagatatgaagtatatgttcttatgtgaatgctaaaggatcaacacatatttagccttaaaacaataattccatattcttaaatttatagtattttatgaacttgttgaaaaatataaaattatggtcaaacgcacgccaccaatacaaaataattcaaaaatcatataacttttaatttttgtataagggagtagtaaatttagatggactaattaattgcatcttatgcatatgcacaaacggtaaattatttgaatgtttgcacaaaaggtatatgcaccgatattataacattataacctgaactgtctcatttcttctccaaaagggaatatctgacaattctttatccacaatttgcatacaaatacatctgataaatcttaaatctctccatacatttactatcagaacttccgcatgtctaaatgtaccagaccccgcataacccatcaacacattttcctggaggatatggacaactccaacagcttatcagccaagtgcacctagatgacacgcatattgatatcttaggattgttgcggcaacatatttcatataacacaataaatttcatagcatctttgaaacctcatttaacacgctgaacttttaaaataaaaaatataatcaatacttaacagtacactattattgacttgttcgtagttcatacattccatttgtaaaataaatttaaaagcatcttacaacacaaacatgcatttcttcactgcacaaaatatcttaatgagaaaactgcaccagaaggttagcaacgtaccatgacaaagcaaaaaaatcatatcatatattcattattggaccatttgctcaggtgaacagtttggtgccatacaaactcctgggaacatgaaaaagcttggcgccatataaagtagggtgagtggagataagtgtaggcatacatcatgacagattgaaataaacagtatcgatctatgaggtgtaaagtattttgtaggaaattgattagggagagaatagttacctgatttagagggatgctgtcatggctttaattcatgctatttggtccaattcggcagtcagtcaggattttctttttcatgattcttaaacaatggagccagaacagatcctccttatgtgaaatatgcaggtggtaatggaggaagaggtggtgatgtcattcttgagtgttcaaggtcagtctgggatttcagtggtttgcaacatcacatggtatatgtttaaaaccatcgtagtgtccgtttcgtccagagatgcatatactttttctgcacttactggtttcctgctgtttgaaaacatcatattgtgctagatttgggagtttgttcctaaaaacactgtgccgttgctgagaatctgaacttgttgaactaaaaggggctaaccctacccaatcatgaaccttaagattttttttttaaaaaaacaaatcatcacgaaagaataggacgaactccttgcggagagcttgcacttcttcgacagctatcacagccttgcccgcccggtctattctgaactttctccaagtcatgggagcttggccttgccttggcggctgtccttggatcgccggctgaggctggcgaacagagaggggaggtggttcggtaacttgaacttttgcttgagcttgagcagcggcgacggaggctttgtcgtactcagcttgtatagcttgtcgtcgcttggaatcctcctcgcctcttgcgaacccgtcaatgatgcgaagtaggtgctcgagcgtctgtggctccttgttggcgatttttcttgtgagttcgccctcgagcagaccggccgaagcggcgtttataaccgacgcctcggttatgtcttgaacttggcaccgggcttgcgagaagcgatgcatgtactcccttatcgactcccccggcctttggcgaatgccgagaaggtgttgctgcgtcttcggctcctcataggtgcctcgaaagttaaggacaaaaacatcgcgcaattgctcccatgagtaaatgctattggctggtaaattgaaataccaagaacgggcgatgccgtctagagcgagatgtattacctttgccttggtattttcgtcaccatgagccgctttgatcgctgactcgtagatggagaggaactccttcgggtcaacttcgcctgaatagcgcaggacgggtgggaacttgaactggggtgggattggacgagtcttgattcccccactcagcggtagccccttttcgcctcccgccctgtttaccgcaccttgctgcgggtacggtgtggcgaagggcaaaatcgcagcttgtgcgtgaggttgggccgtggcattcgactgcccggctccaactggaggtacttgctgagccgccatggatgggtcaaaaattggctgcgaccacgtcatggcagcttggattggtgcttggtttgttccgaagcctggagttggagcttgctgccgaacggttggcgcctgagcagcgttgacgaagtcgagctgcggtccttgattccacggcgaaactcccaggcccggctgaatcggtggcaaccaattaggcgcaccttgacttgtattcccctccgggtgggccgatgggattgtacttgaaatgcagtggggttggttgagttgctgaaggaaagcttgaagttgcgcctgcagagccgaagccccttccgccactgtttgtggcgcttggccaggtggttgatggtgtacttgggcagcgactggttgagcttgctgttgcacgtgaggggccggatgcactgctgcggccgattgctgcccggcgaagtacaccggcgcctgtgtggcttgtggcggaaagggctgggtcgtcacttgcggatggacttgaggtgggacataacctgccgaatactgaaggattggagccgacgtggccttggcccgccttgccgcctcgtatgcttgttgttgttcttgcatttggcgaagcatgtcttggagccatgtcatgttctatcgcatggcttccatgtcggcttcggcttgtgtttcggggtcagggctgacctgggcctgcacaacggcgagcgcagttggggccgctgccggctgcgatggagcggcttggggcaccaccagttggcctgtcgaaaggatctccgccctggtctggagtgcccttgccgccgcagccgccttcgccacgtcggccgcgttcggctcttgcacaaaggttgcaggggccgaaggcggttgtgatggcgcttgtcctcctccatcttcggccacgggcgccgaaggctctgctccttcctcggcggccatgtccggtccggcgtcgctttcctttcgcctggcaaccttctccttcacgaccctcttcggtagcattcgctctcagtggtttcgctcggaggtccccacggtcggcgccagctgttgtcgaaatgacaactgcatacgtcgaaagacgtggttactcaacagtggttggaaggaaacgaagtgtattgaattttgaattgttttctttctttttttcccctccccccattacatggccctaggagactattaatagccccattacaggtttttactattagggtttaggttgtacaggggaatttacatgattacccttacgaaagggacatttacaggggtacataatgttataggggctcatgggcccctgatgggccgtctggcgatcgctagccctatagcccctaagcttgttgggccggaaaggcttcctcggccctcgcgggggcgaacttgccatggcgaagtcgtcttccttcggcagatagtcttcgccttgcacccttcgcctgagacgcctctggcctggcaagacactcgtacgactcttcgcctcacgccgttcttgctccatagccttcgccacgggtttcggcagatttggtcgaagggcctcatgccatccgtcaacacaatgccatccgccaacacaatgaatggtccaacaacaatatagttgctttatattaaaaaagaattccatatgactatataaccttggaagaggtttcaaatatttatgaaacttatgcacatacggaccatgtcacgtagctgtccactcagctatttcattcaaacaaatagcgtgcagctataacatcagaagaagaaagttatttattttccttctctgttttttttttgcaaacatcgagagaagaatatcacaaccgcaatatatactaggaaaaagaaatataatctcagaactgtgaacagagtattcgggtttgaagaacctcggcagcgacccaaaattccaaagcgttattgcagaaatcacgttaccttagtccttagcacttcaatcaatcaaatgtggtcacagctgaaaactctgtgaggtttctcagctgcaaccgcaagcctgagacatcgaccttcccattaatggtggtgatgtccaccgcgacctccatctttcgccgactccgccatctctctggtggtccgctccgggtggaggctccaaatatctcatttttggtttctctgctgcttcattctgtgctagatcagtttgtcctggaaatttatagatcactgatgctctgtaagataatgtcatattcctcttgatcacggctaccgtacagaagcaacaatttcgatcacggacaaagcttccacgaactgcaatgtaaatcaactaacataacaacaaaactaagtatatctactccagcactaaccggacttagtaatgagcgaaaaatataactttaacttgaaactttgtatattaattaatgaattcggccatctcttaacatttgtttttaaaagaagggtgaatcctaaacgagtaatctataagggcagtcctagtgctccagtgctctaggtaggatagtttccatagatttaattatgctgccacataagctaaaaatttgatgtggcgcctgagctaatgagagtaaaatatgacgactcaagaaaactgcacaatgacatgctagtagttttcttgtcatggcctcctatagaaatgcggtgacccctacacaaatgtttgttatatctatttttatagaaaaaaaacatgaagaaactatgtattggggaggttaggtttaaattaatatttaatgtgctctctcatctagacactgcctatgacactacgcatcgagattgctcattgctctaattcacttcatagtttccttcggtggtttcacatcattaattagttgatcatggtgatcaccatcatatcatgggacgacaatgttccattgagccagccaacaaaaggaatttcttttttagattaacggactcccaggcagccacgtggatccttcaccaggatcagttgtctgttggcaagttattccctagagttgaccaggtttttaacttaaccagtcatatggtttcctaatggtgttgaaagcaacacattcaagcaagcatggtagattgtctcaaatattttaccaaaactagcgcctctaaagctaatcagtcatgcttgtatacagttaatctagctttccaccagacaactaatgtagtttatggaatgatgggctgtaaaactaaagatatgagagtgctaaatagtttcagcacgattggtgccagaaaggctgcactaatggaacacaaaaggagtggtcataattcacagcattcttaattgtataaaaaggacaccaataagacaaaaaagtttcagatccttataagttgcaaaagagggattaaaaattaagatggaacttgcctgtatcccttactatatgtagtggttgcctgcagattgcctctcctgcttcaatgcatactgtggaaaggtaaatagcttagacatccaagtttaaccgtaagtttatactcagtggaagtaatgattgcaatataagtgcatcataggtgtttaaacttccaaatactactttcttttgccatatccgtaattcaaatctcttgaagtgcacattgcatggtatgactcatatgcatgaagttgtaataagtcaaataaatgctgaccaaataaatgattagggtatgtttgcaccaatgaacaaaaaaaatagccaacaatatttgatggcagacaaactttgttagttgattctacaagctttattctgtgggttgtcatgttgtctttgcagttaatatcaaccaaaggacttattcccaaattaacaggagaaacatggccacattaacttattcctccacacaatattggagcaaacgaggccatgttccatctcaggcaaaagttctggacaggtgaattcagtagccccacgcagaatcagacatcccatctattttggtaccagaacaaaagaacctgagagggttggtcaccatgtgtttgctaagaaatgcgctgccagtagatgacaaataactcacaggattgtggtgaggtcgaactgaacaattggaggaggggcagcactcagattgaaggaggggacatgtacctataacagaaaagtttgttaatagtgctttagaagattcagaagaaaattagtaacgtcaactcaatagaaccaacttaatttagagagaatagagctaactagccgcatcagaatgaccacatgttaaaaaatatatacatagactgctttttcatcagaaaagttcatatatgaggttacaattgtagccatgacagcatcagatcttcaaggaaaaaaacaattgttctttaccagatatggatgaatcataaagaaccacaattgctacttcagtaaatgcactgcactctaattcttcaagagtcaaaaacattatgaaaaactcaaagttcttggcttcatgacctgtaaaactatttacaggtctaaaaagggttcatacttgaatctttcatctctctaatcatgagcatcttctcaaaagctggaagcaaaaccttagtgaagcttactcgttttagtgatgttcactaatgtcaccagaaaaagacacgttattcttgaagagtggcaagcaacagcatcagttctttcattggaataacggaactgttctatatgacggagtaatggagcatcatattaatggctgcttttcaaaattatgagcttaacttactgaaggaaaaatggataaaagagcaaagcaattgattgttttcatgtttgcttttcatcgtgcatcagaagtgccatccaagagcaacgattctaagctaatatttttgctaatgctgttccgcagggttcactatatcggtttagggcttttgatcgggggtctccgaaatcccgaaatttcggtccaaaatttctgaaattttgaacaaaatttagttgaatttgaacaaatattacccaaattcatgaaaaaattgaaaaattcaaaaatttcagccaaattaatatcgtttcggaggggaccgaaatgaccgaaatttccaaccctgctgttccgtatcttcgtagtcaattaaaatctagaagttgagtaccatattcacatctaactatgttgcaagtacaatagatactgattggctagttcgctagttcctactccagtgacggaccagattcaaaattaacatgaaacttatattattatcataggtacataggtgcaataaaatagttagatgctggtaataacatgaaagagaataccagcattactccatgtttgcaaaaaaactgtgttaaatctcatagcaacaaaaaaaaacagatattctaccttagtggtttgagcaatatctcgacattcccacattaaacagccattgcacattataaatagcctgcccatattgtaaacaatgaactatccaaaaatctagttccaggggcaacaaaatagcttcatcaatcagcacaaaagaatgtttcctgatatacgttttattgtgggaattataggtatttgcacccacaagctacttcgattaatttctttatgttcataacaccatactctttctcctgcaggatctgtagcttgcatgctcctctactcagcaccaatgtacccaactacatgtctatacatcataagctatactatgtttgcgcagtatataatgcattgcttgacacttgtttttactatgtttcctagattgacatttaaaagagtgataaagaaggccagtgtagaagaattctcgtgcataccatatatcttagctttgttcagctgcctcacatacagttggtatggttttcctgtggtgagctatgggtgggagaacatgacagtctgcagcatcagctcacttggggtgctatttgaaggcacattcatcagcatatatgtatggtttgctccaagaggaaaaaaagtaggtcatttctgaagaactcttctattgttccttcagcatttcaatgatttccatgggtaaactaatttacttctgtgtctatcaagtttttgaagttgtttgcactaatattttatattaggaatacaacaaaatatagtaagacgacaacagctgtataattatgacatattcagaagaaagtaggaacgaatgcaagcttttgcttggataaaatagtaaaaaaatctatccaaaattttgaactcaaatgaccatgtttctatctgtttgtactccaaaagcagtactatattcagcacaaagtcagtcatataagattttgttctttttagctctaacataaccatgtgcaaaggcctctagggaacttgtgcatgtgatgcagttttggttcaaagttgtgagattagaaagttctagatgttatatagtcatgacaacatgaatcaattaatattgataagaaccagaggcaaactaagtaagatccaaatcataagtacctagccagtagtaaaatctctgatctcacacccccaaaattttagcactataccaaaatagaacactaaaaatatgatgtccatcggtgcttcttgttctcttgaaagaaaggatattatgtctgattcttctcagacacacgtaagacagaacaaacactcgcatttccggttcagaagaaacaagaaatgattttatttcatagttgtgcctaagtggttataaaagtttgatgttacatggcatgttactagagagattttacaggatgtgaattttttgattgattatgttaacactgactgataatctcttgcagaagcaagtcatgctgatggcatctctgattctagcagtcttttgcatgactgtgtttttctcaagcttttcaatacacaaccatcatatacgtaaggtatttgttggtagtgttggtctagtgtcttccatatcaatgtacggctctccgctggtagctatggtgagtattgttacttatattgactgaggaattatgaaattcagataatagaatatcagcctgcaagataaaaccttgcaacattgatctcatactgaacttcaataaaaaagaaaaatgctaaaaagtaacatgtgcttcaagatataatgatgattcaatgaaatgctattcacatcagaaagtataatagaggaacaaagcattcaattagatatggtagagaaacaaaacaagacaacttctacacatattttattttgaatggttaaaaatataatatgtacttccataattgcagaaacaagttatcaggacaaagagtgttgagttcatgcctttctatctgtcattgtttaccctcttcacaagtttaacctggatggcatatggagtcataggaagggatccttttatcgcggtaaggacataatcaattttagccacaataaacttctatatatcaaactgacatgctttttttcttgtgaagaccccaaactgcatcggcagcataatgggtatacttcagttggttgtatactgcatttacagcaaatgcaaggaagcacctaaggtgcttcacgatattgaacaagcaaatgtagtgaaaattccaacaagtcatgtggacacaaaagggcataacccttaatc

SEQ ID NO: 2688 - DNA, 2046 bp, Oryza sativa
  unsure (1)..(2046): unsure at all n locations
agcccacatgtccataaattggaacttcatgaaaactgaagctatagcacaccatattcaccaggtgaatttacgatttgtttaatatattcacctagaagagttggagttgtttaacatcagtaaattggcaagttttcttgtctatcattcaaaaggttcatcatattacaacaaacattaataaaatagatggcttcaaaaccagaccattcacaaattaagtgatcattaccacctgacatatgaaatttagtagaatgtgaaaaataaagaatgggtttactgcgctcatagtttcatatcatgatcattcctacttcttaagttggggttaaaatctcaatttataaaaatatgattcttgatgcatgctattacaagcctacatttattaggatgttatttccagttgcccatctcactgagggccacagctcctggtcaattctaaagaaaacaaaacacaaggtccatatactggaagaaacaccctagacctcagcaagaaaacaactcctcaagcaaaatgaaaacaaacacagtaacgaagttcaaaggtacatcatacaattcaaatatataaataaaattaaggaaatatagccctttattcaactcatccaatgttgagcatctctatctcggaataagagtctacctcccatgctaccaaacatgatttaccatagacacaaggattgcatcaaagcatataaggatttaaaatgatttatcgtcaacattgggcgcagtggcggagcttgaagagaaattttgagggggataatgttcaaactattttcagcgtagggaccattctacagttactttctgctacctgtcacaaagtaaagggacttaattgtagtagttaaatcaggggagggctatagcctagataagcctctaagaagctccacccatgattgggtgtctactaagcaaaaccatggagatggaaccaggatgaaacaaagacgacagcatgaatgtaactccagaattattctaagaagttttatggatgtaacaccaggacagatttatcaattcttttgacattgaacattgtacagaatattacattcataatagcttacatgcatgatgaaacaaaacttccaaaaaaatatatatgtaggaacgcaaggtaaacttacatgcatgattgccaacttctgtacataaattcagcaccatgaatggatgtcaaaagatcttcatggatttggattggtgtaagttatctaaaaaatagattgatgttaaacaacagaaatcttgtacaaagtacttcatattgctctgatgatagcaaagagaaatcccttgataattacaaacttcactgtgtttacagttatgtttatacctacaattaaatcgtgatacccacagacaaattcatgactcgcagataagcagtattgcccaactatgtaaagtagtcaggataatgatttcaaccatggcataccttgacaagaaaacaaatagatgttggatgcggatgcgcaaatcaaaactagcatcctggcaaaatagctttctttcacacctaaatgataccaagtgcatgaacatattaattcttgccatcttagcaaaatagctttctattacatctaagtgataccaaaaggcatgaacatactaattcttgcaacaccctaaatagtacataaacagctaagttcaggttcctgctatggagttctgcacaaattttgcaatagctttaacagcttccatttctgcagcttgttgattcactccagtagactcttgatactttttgccgattttaaaggagtggtcaccaccatcaataacatgcagttcattcttgcagttcatcttcttgcgagtggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2689 - DNA, 2208 bp, Oryza sativa
  unsure (1)..(2208): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaatctgtccttaagtgcgagagcgggaaaccgtacacccgttacgttccccggtccgcggttttggaaattcatttagttcgcaagcaccgacccaggtgtcgggttttccaagtcttttgtaaaactccagttttacccaagttgttactcagattttaagtttaaaggcgaccgtcgatactcgcacagagtgcacgaatatcgagccgcaactgggtggttacaaggggacatggtataacaattaacaatggaaggatcaaatgtaacaaattaggtaggtctgccaatctgccttgcagacgggacaacagattaagtgtgatcctatcaatgcataatatttcgcaatcaatataattaaatttcaaatatagggtcaagatgttcaaaggtggcttgccttgctcgagatccggagcttgatcctcgaaatcctcgcactgcgggtcttcgggctccgaaactacacgcgaaacgggacaactcaacaaacggcgaaaataaagccctattaatgacctctaagcgtgccattagatagatctcgagatttgaggaattttggaagttgaacggagtcaatcgaatttacggttgggaagatattgaatttctaagattattggatttttggtctaaaggaaaaaggatttatttaaatcctttttttggaaaagaaaaagaaaagaagggagggagggaatatagacttttctcgggtggctagggtgcggcccaagagatttggggcggctcggccgagcttaacggaccggccggcccaagacggcccaagcgcgcgcgcgcgcgggagggaggagagagagggagccggtggaccgggctcaccacgcgtggtcccgggtgggacccgcttgtcagcggctcggctcaccgtgcggagggagtatgcggcgtacgcgcgcgggcggggctgggacgcagtgcacgcgcgcggttcgcggaggaacggatgcggcgggcccacgcgcagcctcacggctcaccgcggaccacacgcacggggagaaacggagggagcggctggccgggtcggcttatccggtcgcggccgaggtggcgccgacgtggcgcctacgtggcagccacgcgggccggcgggaggtagacgacgaaccggccgcgaatggacggcgggcgacagcggcgagcggcgtagcgagccacggcgataccggcgaaagcgagcacaccgggtggctgcacaggacgaggggagacgagccaacggctcggattcgctggaggttgctcgacggcggcggattacggcggcggcaaccggcggcgagggaagagggaaacggcgacgaggccacgaggggccgattcccggcggtgagagcatctacgcggcttcgggaactcgacgctagcgtcggattgggcggaactacgccgagcgaggccggcgacgagcgggtgctacggagctcgggcggcgatggcggcgagcacacggcgagcgatggcaacggtcggggcggcgccagctaactacggggaggctactcgagctactaccgaaatctaaggggaggagatggagcgaggaggaagaacggagggagacactaccgtgcgggacgaggcgatgtgacgagaggccgacggcgcgggag

SEQ ID NO: 2690 - DNA, 11052 bp, Oryza sativa
agagagagagagagggcgcccgggagagagagggggggccggggaagagatgggccgagcggaattcggcccatcgaacccgggggaggcaaactagacttttgcggagggattcgatttggaaggaattggattcggaattgatctcgacgatcgatcgcggattgagatcttgagatggcacggacactagacaacaagcaaagaaacaaatttcgcaattagggtttttaagagataattttcccgctaggcgccacgacggaacgggcgctacaccagacgtggccattctgcacgggctgggtgatccgggttagtaatgttgagtaggtaaagtgtaccccctctgcagaggttattaaactgttcgaacaactgtgcccacggtcatgggcggatgtgaggtgattcctagcgtagttttgtttgactactgcttgtgaaattgctgttgtggaatgggttcgatgtttggaaaaatctgcggtggatgggatcagccaggcccgggtggccgtttgaaaagctgttggccgggagccaaccttgatctaatcaaagactgatacattgtgtcgacgtttgatgtcgcaattctggtatttgcatggtatggggatcgtcggtgctaaggtatacgtgagactaaggtaaaagagatggagacagggatttttatacaggttcggcccctgagttgtcaggtaatcaccctacatcctgttggccgaagccggtattgctcttattcaccataatcacatcagtacaatatttggggtagccaatctaactgttgtcgacatggcggtctgacgatctgactcgtagtcgacaacagggtagccttcctcctcgaatccgtgcccggcgagatcagagatagcgctttcgtttctcctgacactatccggagacaccgtagggtattagccgtgcttatccctgaagtcgatatccggcggcgtgtcttggcgtatgtaggcttctatgttgattgtgttgggtgttgatcctgtcgggtgttgatcccgttgggtgttgattgtcttttccccgctctcctcctaggggggcctgtatttatacccataggtgtccccttgtccaagtagaactagggaaaccaatatggatacaatccgagtagtccttgtcgtttccatgtagaactctggttgtctttccttatccggaactccctcgaggtcagtttccgtataagacatggtatgtagtggatcctgccgagatttagtcaactactattaggtatgtcgtatccataacactaacagtagcccccgacttcgatgcaaatgaacgagttcatattctcaaccgcagactttggaggaactgttatcgagctcacatgaccgttctcggtgagtttagagataacgttagacttcctttatcagcctcgtgcgggcaccgaaagggtttgtctaaatcaatctccgatgtcgaccgagaaagtacagagcgtacgactaagtctcccgtcttgctgtaatcgagaatttggattgaagttaagaaattttatctcggcggtacaccatctcttcattccgtattccttgtcgagatccagcaaccgttctcgagtgatcgagaaggcgtagagtctgcgacggaaccttgtcgacatttgtcgtactcgccttagtcgatcttggtgtagaaccatagagacatggagtcttcgataatgtcgaatagaattttcctgaaatcaatactcagaaaagaatattagatagaaatagcccccgagcgaatgctcaaagggtgacatgttataatatgacagactagtgaattgaatgtacagaccagtgctttgtatatgagcgtcttctttcttaccgactccgatcagtcagtttgtagagtcatacactctccctagcccccagccttgtcgtcggagaattgttctcggatgacaaggctcttggacctttgacctgcctcggttgaacaagcactgatcctagcccccagtcatgaagttggaaaattcaatttccgattacacggcttggttaatacgcacggcgagaactcttacacgaccagatcttacatggtctttcgtctctgaaggatccgacaaggccttatcagctctgggcatccccagccgaagttccctcaggttcctcggaggccttgtcaagacggagtaaagggacagtaggataggtttcaacgctaggtgtcatctgggtaagggatctctgggtaaaacacttagcgatcttgtgcacctgatatcaactttgttgaagcaggggtaatgggagaatcactacatcgctggtcgaggaccaggcagtagtcgtaactcgaccacttaaagtggaagtagtgggagaaacgctacatcgctggtcgaggaccaggcagtagtcgtaactcgaccacttgaagtggaaatagtaggaaaattgttacaccgctggtcaagaacctggtgtagtctaaactcgaccactagaagtaattgtacgagagatcgctacgattgactggttgagaaccagtgagtaggtgtctcttgatcatttgaagtcgtggtgcgaggaccgctgcgttattactgtagtcgtacctcgaccatctgaggttgcggtacgagagattgctacgtactggttcgaggaccagcgaacgagtagaattatctctcgaacaccaacggaagctgcagtgcgagagattgctacgtactggttcgaggaccagcgagcgtgtagaattatttctcgaacaccaatggaggtgctagagttggtttattacatgtgcgtctcatgtggctagcatgactcacacacccaacttgtagcatatccggatgtccattcgcaatcatgtcgggtgatcaagccgacggcgttcgtgaggaattatccgttaacaaccttttctcgagtagtccagccatggccggtgctatgagataggtcgtcggtcttcgttggtaggtcggttgcgataactccgcatttgtcgagaatgttctcgataatagagtgtactcgaccacaacctactcgagtgctcaattgttcctgaaaaatattttctagaagacaagacatatagcagataatatcgagtatgtactcaaaaaactgcatggatcttctagtattattatgacataacgagtagatgtaaatgtcagggcattatgtgaaccgtaaataagcatgatttatacagaagaagacagcgagcccccagcgttagatcgtagtcgatttaacatcggggacacccgcgcaacagatattattgtataaagaacatgctctaggtaaacataataaattatagatctgacaatactgtatgatctgaataggtacgataaattgcagataaaatattgcgtacctttgtagatacatgccagatgtatttacgaaattagtagattgatttaaaaaaccaatctaccaattaccttgttgcgtactcgttcgatatcatgcgatctgacatcttttggtacgccgcaaagcttgaggcttggatgatctaaatagaccaagttgtcaatgacgatgatggttccgatctggttaggttggatctccccctcagctgaagtcgtcgagtagctcattgtcggagaatccatcttttgaacccatctcgtcgaaatcctgaagcaccaaaatccccctacctggcgcgccactgtcgacgtttgatgtcgcaattctggtatttgcatggtatggggatcgtcggtgctagggtatacgcgagactgaggtaaaagagatggagacagggatttttatacaggttcgggcccccgagttgtggggtaataaccctacatcctgttggccaaagccggtattgctcttattcaccataatcacaccagtacaatatttggggtagctaatctaactgttgtcgacatggcggtctgacgatctgactcgtagttgacaacagggtagccttcctcctcgaatccgtgcccggcgagatcagagatagcgctttcgtttctcctgacagtatccgaagacaccgtagggtattagccgtacttatccctgaagtcgatatccggcggcgtgtcttggcgtatgtaggcttctatgttgattgtgttgggtgttgatcctatcgggtgttgatcccgttgggtgttgattgtcttgtcccccctctcctcctagggggccctgtatttatacccataggtgtccccttgtccaagtagaactagggaaaccaatatggatacaatcctagtagtccttgtcgtttccatgtagaactctggttgtctttccttatccggaactccctcgaggtcagtttctgtataagacatggtatgtagtggatcctgccgagatttagtcaactactattaggtatgtggtatccataaccctgacacattgcacatactccgaccggacgagacgcactgtctcatccgtgtcgtttgagaagcactcatctagttatttcaaaaatgagtttaattaaaatcaatcgcaaaaacaatagcccttcctttgaagcatgcatttaaacacttaattcccatgacttgctgagtactcttgtactcacccttgctctatataaataatctccccccagttgctgaagaagatgaagtggatgtcacgaccggaattaacccaacgggcgttccttacgtgcgtgtattattccttgtcccaggaggcaaggtacaccgaaagttgatatatttcagagtttatcaagcggaagcgtaaatagttaatttattacatgggcggcgaaggcccagcacacacaaagacaaacgggaaacagcggaagactagggcgacgaccacaggcgcttgacggcaggcacgagctagacaccaaagccttcatcttccaggggctcctcttctgggtttgggaaaaaaattgagcaagactgagtacaaccaacgtactcaacaagacacacccacaagtgcaggataaatgcaagggagtaaagggggttataatataaagggttagggtttgcagtaaacagcattaaaagacacttagttgctcaaagctattttgtaaacacgattccagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataacggagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccctgggacaggtaggcaggactgagcccctagcagcaggacaccggccctgtgccatgacatctcgactaccgggccgcagctcgtgtagccttcatttgtcctagagatgtccatcgacccccaacttcgtccatctccatccgtgtacttttgtttataaccagactgagccacaaactaagccttactgtcacgccccgaactagtcccgaccggaactagcccgtgacgctccaatttagcctgttaatcgataccagtcccaggaaacagtgctggtatcacagggagacagaatatcacagcaacagaggtctctttattatagagtagaagtacagtcatgttgggctgcggacagatcccgagctcacaactgcattacaaaagggaaacggaagccaggacttggaccaaacatcacaggcgcgacttgggaactaggccgaaaccctaaaactcatcgtagccggcttgctcctggaagaactcctcatcagcaggatccgcttcatcttcttcagcaactggggggggatatttatatagagcaagagtgagtacgggggtactcagcaagccaggggaaataagtgtttaatgcaggcttcaagggaaggctgttgtttttgcaattgattttatttgaactcttttctgaaaacaactaagtgagtgcttctcaaacgacacggatgagacagtgcgtctcgtccggtcggagtatgtgcaatgtgtcaatctttaggattgcaacaaagttggcacccggccaacagctttttaaacggccacccgggccaacaacttttcaaacggccacccgggccaacaacttttcaaacggccactcgggcctagctgatcccatcagctgcagatttttcaaacatcgaaccccttttcacaacagcaatttcacaagcagtagacaaacaaaactacgctaggaatcacctcagatccgcccatgtccgtgggcacggctgttcgaacagtttgttaacctctgcagagggggtacactttacccacacgacattactaacccgggtcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaagctcccccgattagcaatttactcagccaggggcgtcccattccacccatgtggtcgtacttgtcttatgttcggatgaaattccaaggaaacggtccttaagtgcaagagcgggaaaccgtacacccggtaggatccccggtccgcggttttggaaattcatttggttcggaggcaccgacccaggtgtcgggttttccaagtcttttgtaaaactccagttttacccaagttgttactcagattttaaggttgaaggcgaccgtcgatacttgcacagagtgcacgagtatcgaggcgcaactgggtggttacaaggggacatggtatagcaattaacaaaggaaggatcaaatgcgacaaattaggtaggtccgccaatctgccttgtagacgggacaaacagattaagtgcgatcctatcaatgcataatattttgcaagcaacataattaaatttcaaatataggctcaagatgttcaaaggtggcttgccttgctcgagatctggagcttgatcctcgaaatcctcgcactgcgggtcttcgggctctgaaactatacgcgaaatggaacaactcaacaaacggcgaaaataaagccctattaatgacctctaagcgtgccattagatagatctcgagatttggggaattttggaagttgaacggagtcaaacggatttacggttgggaagatattgaatttctaagattattgaatttttgatctaaaggaaaaggatttaaataaatcctttctggaaaagaaaaagaaaagaagggagggagggaatatagacttttctcggatggctagggcgcggcccaagagaaatggagcggtccggccgagctaaatgggccggccggcccaaggcagcccaaactcgcgcgcgcgcgggaggagggagagagagagccggtggaccgggctcaccatgcgcagtcccgggtgggacccgcttgtcagtggctcggctcaccgtgcggagggagtacgcggctcatgcgcgcgggcgggggagggacgcggtgcacgcgcgcggttcgcggtggacgcggatgcatcgggcccacgcacagcctcacggctcgcggtggaacgcgcgcacggggagggactgaccggggtcggctcgacccggtctaggctgagctggcgccgacgtggcgcctacgtggctgccacgcgggccggcgggaggtagacgacgacccggccgcgaatggacggcgggcggcggcggcgagcggcggaacgaaccacggcgatacgagcaaaagctagcacaccgggcggttgctcgtgatgaggggagacgagccatcggctcggatttgccggaggaagcttgacggcggcgaatcgcggcggcgacaaccggcggggagggaagagggaaacggcgacgaggtcacgagaggtcgattcccggcagtgagagcatctacgcggcttcgggaactcgacgctagcgtcggattgggcggaactacgccgagcgaggccggcgacgagtgggtgctacggagctcgggcggcgacggcggcgagcacacggcgagcgacggcaacggtcggggcggcgccggctaactacggggagtctactcaagctactaccgaaagctagggggaggagatggagcgaggaggaagaacggagagagacactaccgtgcgggacggggcgcagtgacgagaggccgacggcgcgggagtgatctctccggcctcgggccgaggaagaggaagaagagggcgcgcccggagtccccttccgcgtccacgaacgcaccggctctcccggcgcttggcgatggacggcggaggcgaggcagagcacgggagcggcgacaacggtgaggaggcgaatgggagaggaaaggaagggagggggaagacgggtttaaaagggcggcaatgtcggtttgagagaggggaaccgacatgggcggtcaagccggcgagctggcgctccggctagcgtccaaagcggcgacaggaggtgacgccggcgagaggggaaaaaggggagaaaaagaggaaaaggagggacagaaagggggctcgcccctttgccgattcgggaaaaggaggagggagcggggcgactcggcagagggagaggggctctctgcctccgccccttggaggctagcgcgcggagtggcgggggccgggcgatgacgacggcgatgacgacggggcggtttggagcggcgcgacgacacgggcgacaggcgcgggctggcgcggcagagggtgacggcggcggcgaccgggcggttggccactcggcacgcgcgcgcgggaaacaacgggcggcgcggctgggcagcgggaccgggcgacgcggacggcgcagacgacgcggctcgggcgggaaaccacgcgggcgcgcgcgcgagcgacggtgcgcggggccggctttgcgagcggggagctcgcgcgagaggagggggcgctcggcgcggctctcgcacgcgcgagcagcgagcggggggggaaaacgcgccggggaaagcgagagagagagagagagagagagagagagggagcgcccgggagagagggggccggggaagagatgggccgagcggaattcggcccatcgaacccgggggaggcaaactagacttttcggaattgaactcgacgatagatcggggattgagatcttgagatggcacggacactagacaacaatcaaagaaacaaattttgcaattagggtttttcggagataattttcccgctaggcgccacgacggaacgggcgctacacttacccactagacatgtggaagtacggtagtgctttgcaacagaggcccgaagaccggtccttatatggccgaggtgctactatcaaaaccatgcaccccgagcccagcctaaaaccattttgaggattttgaatagagggggaggtgtgaatccaattccacaataatccatccattcaaaagtgtccaggtgatgagaatattcctaaagtctagagttgtaaaaccacctaatgttgcctaatgaaccagcgaagcatttacctaaaatcatactagtggtaccatgagtagagtgtccactagttggggttttgtttattctaggggaacaaggaaataataacaataacaataataaggtcataacaaaggtaaataggcatggctagataaaacagtgataacgcgggaatttaaataaagcgataatgcaataatttaaatcaacataattttataaactgggattcaatatgttcaaggatgatgtgacttgccttgctcgctttcccaaacgtcagcttcaacttccacgaagagcggatcttccgaagctacggcgtctacacgaccaacggaaaagaaaaggcttttactctaataaactccatataacaagctggaacaaagcacaaaaataggttcttgacttcttaaggaaaaattagagacttgaacggtccaattccgagttcaaatggccaagttatggtcatttgaagtttatatgctctttaaatgaatatttgcgaatttcttcatttaaattttaattttaaaagggcttattgcgtcagccgaggggagggggcgcgcggaccgggtccacgggagtggggcccacgcggcagcctcacggtccacggtggaccgggtgcacctgggctcacaccgaccggcgccatgggtcccacgcgtcagccgcacccgagggcgcgggcggctgacggccgggccccacgcggcagccactcggcgcgcccgagggcggccaagccggcgtagccggcgggaggcggcgcccgcgcccctatggtcgccggcggcggccataggcacggcggagcggcggccgagagaggggaagggaaggggaaaaagaagcggcggtccacggctcaccctaggtcgacagcgacgacgaaaaaggcagccggagcggaggaaggcggcggcgcggctcgggtcgacggggtcgacggcgttccggcggtcggcgagcgaaacggaggggtggacgaggtcggcgaggatgcggcgaagccgaaggaggcggcgccgaggtgggaggtggtccggggcgacgacggcggcggaccggagctcgacggcgacggcggagagagagcgacggcgcgagctcgattccggcgaggaggaagggcggcgagaggcggaaacggacggaggaggtgcggggagggtttaaatagagttggaaaggggagagagcggccggcggggaag

SEQ ID NO: 2691 - DNA, 13686 bp, Oryza sativa
ctttttataaaatcattttaactttttttatttcttaataattattatttgtgctctgaaaattccactaaaatttatttacgcattttaggcttttaggaaatatacaaaaatcctccaagccttatttgacttttaactttgcacattttaattgttggaggctttcacacggattttaattattctaggcataatttagaggatgtattttagagtcattttgggacgtgacagtggatcccgctgacgaggagttcttccaggagcaagtcggctacgatgagttttaaggtttcggcctagtttccaagtcgcgcctgtgataaatggtccaagtcttggcttccgctttccctttttaatgcatttgtgagctcgggatctgtccgtagcccaacatgactgtactcctactctgtaataaagagacctctgttgctgtgataatctgtcttcctgtgataccaacactatttcctggggccggtatcgattaacaggttaatttggagcgtcacgggctagttccggtcggggctagttcggggcgtgacattacggcttttattaaatgtcatctttttttttttagaaaatggatttaaacctggcctctacacccaaaagtgggtgtgtacatgtacagccaaaccttttattatgttcttaaagtactacaataattcgtttatccattgataagctctgaatattttgcggactgtcgaatgctatggccatggaaaaatatgcacgcctccttaaggaatatttaggatttaaatatatccaaaatatttttcactttagaaacatgtttaggatttaaatagaagttttaggcgacatagcctttgtggtgatctcgatgatgttatttttgacaaaaataaaatgatatatatttatcacccttatatgagctacacacatataaacatcatttggctctatatatgtacttgttcctgaaagggaaaaaaagactctggacttgttctttgatgcatgcaaaacaagtggtaaatatgagtttcttgtcctgttatggttggttgtccatgcttatgatggatagtttggcttttcttttaatcaggtaaagaaaactgttttggtgtttacccacaattaggaggtttgaattgtactctagctactttgtactcttgtatatctgaaaagaaagtgtgcatgcaagcattcacagtccttatagttcatcggtttttctattttctctacattttacagccctgttggtttaatttgagacttttttcccgcaaaaggaaaattgagacatttcaataccaacggcgcatccatttagcaggccccaaatttagctcaatcgccggcaccaaaggtttccccttgtaattaccccataccaaaatctatatactactacctcagtcccaaactgatcctaaaataattacaattctagattacttatcatatattaagatttgagaagaaaaactaagatacccttcattaaatggtgcatagctagtaagagtaggatgatgcctgaggatagaatagggataatgtcacaccccaatctgataccgccgtacaacggcacctgacaggagcgtgtcgtagggaaaacggcgcgaaccgcttcctacgaaaccgcgatctcggtaccagtcccaggacatagtgttggtacccacggtgacaaatatgaatcatagcaatccttaaaataaatagagtacttatttaccttaacttaggttgcagctcagacagcccgagaatacaaccgacgacacggatgaggcgaacaccaacaacaacagcagcagcagaaccaacggtctaacacccaacaccacaggcgacggctgggaaccaggacgaaactctaatcttcacttcactttatcttctcttcagggcggaggaactatatatatatatatttatatagagcaagggtgagtactttcgtactcagcaagtcacgggaacttaggtgtttaatgcaagtttggaagagaggcaaggttgttttgcaaatcttttatttgaagacattttgaaatcactaagtgatttatttctttctaagtttgggccgaaaagagacttgcgtctcaattcgactttaagagatgtttttcaacagctcatttagtaatgtaccgacctcccgggtcagatcattacttctcggctcccagagccattccacttgattaatcggctcccagagcctttttcattttctcggactcccagagtccagctacccagcagcacaacaatccgcttccactcaggaagcctagtctatgatgcccacagacatcccgaatcacacagattcgtttctgaccactcaggtcatccatctgccacataggctgattctggttacgattcccacaccacaacaacttttcacaaagcacaggcaaacaaatctacgcaacgggaaccacctcacatccgcccatgaccgtgggcacggctattcgaacagttagttaacctctgcagaggggtacactttacccacaagacccgaacttactccagacactggccggtgtcagaggttcgcgacaaagcctttcccaagccgacccagggatacctcatgccacatagaaggatcaaatcctcacataaacataggccattttaggcgttcaccaatcaaactccaaccacctcgatcggtaattcagcaagcttctcgttcttgcattaccaggaacccggtttggctccaaccgaccccgccccggcgttcccaactattggcatgcgaggtttccctgaaccgactagctacttagccagggtgtctcattccaccttgtggttgcactttgattatgttcgatgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaaacaacgatgtatgtgggatatttggtatacgtgctcagagagcacgaataccgaggtaccacaagggtggagcgacaaagaatcagggtagtacgacctacggaaattagtgcgactactgggtaggtccgtcggtttggcacgcaaaccgaagcccagcaagttaagtgtgtgattctaataatgcaagttgcaaacaaaataataatgacttttcaattataggggcaattgatcaaagggtgacttgccttgctcaaggtcttcacgaagcttcacgaatcttcgagaaaacccgcgatcgacgaaaatccgataaccgcaactatacgcaaacaatcgaaaacctaaacaaaagaccaaaagaaagatcctatttagactaattagtagtgccattaaatagatctcaatttacggaattattgcaagtggaacggagtcaatcggacgagcggttggggagatatggatttcctaagattatttggattttctatctaaaggaaaaggatttatcaaatcccttggaaaagaaaaggaaggagggatgtcatttagacttactcaggcggcttaggctcggcccaaggggtcatgcgcagcgcggtcaggccattgggccagcgcgggcgcgggtggtcagcccattaggggcgcggggagagagaggccgacgcgggtggacgcggtccaccgcgcgggacccacatggcggtggttgggttcacggtggggagggcgcacacgggggcgggcgctaaggtttcgggtgcgcgcggttcgggcgcggcgcgccgggtggacggatggcggcgggcccacgtgcagccgcacggcttgccgtggaccgcgcgcacgggagggaagacggagggagggggcggctgactggcttggcccggtcaaggccgaggtggcgccgagatggcgcctacgtggcagccacgcgggccggcgggaggagaaagaaggggcggccgagatggacggcagacggcagccgagttcaccggagctcgtcgcgacgattcgagagagagggagtacacctgaacgatgggacggacgagagggagtgagccaccggatcggattcgccggagggaggccggcgacgacgaatcgcggcggcgcttgccggcggcggcaaaagagggaaacgacgacgacgcgatgagagctcgattcctagggacttgagcatctacgcgacctcctgagttcatttctagagtcggattgggtggagctacaccgaggaaggccggcgacgagcggctactaccgagtttgggcagcgacggcggcgagcctacggcgagcagcggcggcggtcggggcggcgccagcttgctactggaaggctactcgcactactgcccagagctaaggagaggagagggagcaaggagggagaacgggagatgcactacagagtcgagacggacgctgtgacgagcggccgacgacgcgggagcgagctctccggcctcgggccggggaaggggaaggagacggcgcctggagtcccgcgtcagctcctcgcgcgcacgccggcttcaccagcacgcgcgatggaggagggaagcgaggacggcggtagcaaggcggcaagggcccggtggtggcgagggaatgaacgagagggagatggggcggctcggtttaatagatggcaatgtcggtttagggaggaagaaccgacattggcggtcaaggagagcgagctggcggtcatcgacgcgtgcagccaaggcggcgacaggtgatgacgccggcggtgtcgggcaaaagtagaaaaggaggggaaaaaagtgagctcttctctttgccgagttggggagggagagggataggagcgggagctcagcctcacggttttggcaggacacacgtggagcggctcgggcacgcgctgcagagctcgcggcaggcagcggggccgagcggcagcgtagcgcaggcgctgacggaggcggcgaccgggaggtcggtcacgagcgtgcgcgcgcgcgcgggaacgagcggcacagccgaaaatcgaatggcggcagcgggaaatcggcgatggcggcagcgctggcgcgggagagagagatcgaacgagagagagagacagcgagagagaggaagaggacgagagagcgagagaatgtccgagagagggaagggagagagagacagcgctctctctctctcggtggtcacgtgcggcgcacgtggagatggagggagttgagaagagatgggccagcggcatgtttcggcccaaatcatcacgagggaggtaaaatagacttttaccagaaggtttgatttggagagaagtttgatgtggagattgaatttgaattcaatttgtatatttgtacacgagggttcaaggtggatccaagggaggggtcaaggaagggcttcaaaagcgggaattttggtatttttgggatggatttatatttggcggcacgaaggattatttcagaggatttcaaaaagggaagatcattattcaaaaatggaacaagggagatagcggtagaatgccatggatagatagatagacagaaaggtaggttgataggtagagggacggatagacagatggattgacagatggatagataaacagatagataggtatagtagatagatagatggatcgatcgatagatagatagatcgagactcagagagagatgggatggaagagaaggaagaggtggaccggaaaaaggatgaaggaatccaacctatgagggaggttaaatagactttcacagagagatttaattgggaggttttagggttggagtctggattcgaatttcgaggttgatactcggtctcgggagaataggaaggagtcaaggaagggaacaatattcggagacgagtcaaaaggggatggataatttagagaaagagagtgtaacttgggagtttgagtttgactactcaacgagatatgtgggtaaggattttggagagaagtctgaatagaagggttcggacttcgagattatttcggaacggaaatcattttggggagaactcagggcgaaagggattgaatcttgggattttgagttcaagggtggaagtgatctcgatttgcatattcagacttggatcagaagttcgagaaagagaacaagggtagattgatgaaccaatacagggagaaagatagatgaatcaaaacctgagaggttgaattcgaatttgagaatcggtttgaaggaaccaaggagagagcttatgacgcgaaggtgaatccttagatgaagttagggttcgggcattcgacaaagttcacggatggggttccaggaggggattccgaatagaaggaatcgagcttcgggactatattgggatggaaattttgaggagacgatctttgataacagggtatcgagacaagggagggatttaaattgagatctttggcacaacttagactcaacactcaaagaacgaaattttcgcaattaggattttgccgaattagtttttaacgtctcacgaaaaacggagcgttacagagaaattcaaatcaaaagtgattaatgaaatagttactactctattatgataattattttgggacaaatttgaatcctaaaaatacaattatgatggaacggatgcggtatctcggatagatatctattaacagactcataacttaaaaggatactccccctttcaggttataagatgttttgactttggtcaaagtcaaatttctttaagtttgacaaaaaaaatagtaatattttcgacccaagataaatttattctaaaaatatatttaattattaacataaaactagtttggtaatgtaaatattactacatttgtcaataaacttagtcaaatttaaagtagtttgactttatcaaaaccaaaacattttataacctgaaatggtttgaaatgaagagagtatatcttagaggcggatatagtagctacttttagatttcttttatatatactagggattaaggcaagatgagaaattaaatagggatgatctgtaatattggttaacatgacattttaaatactgttatatttttagacggagtgcgtaaataggaatgtaatttcatgttgccttttctactagcctcgtacagcttcagataatgctcctttagccaagctagcacaacgtgattacgtgaatgtgtcacgtgaccttctccaagccgcccaagtaactagctagataaactggtcgatctccgctgcgagagcaagataatgatgacaagctagctctcagtctccacgaattggagcaaagctggcgtgcgatatgatgcagcaatggacaaattcaagcagcctcagtaattaattaactcactttcaacttgctccaaaacgtgctgattaatctatcagtttgcatgcatggtcagtagttgattatcatattcattgacaatgatagacaccgaaacaatcgatttcgtgtccgctctcaaagataaactggttacgacaaaaaaagatgcgcattttagtaagcccccttgcgtagaacacaggggatattataactggacgatacaggagaaaattaaaaattaaaactttggtagcacatgcatacaaacatatctgaatatatattccgttctgcgagttttaattttctacagtttttgaagttcataggacaactttgacacacttctatatatatctcgtattattgtgtctcgatcgatcaagtagtgtttattcaaaaaatatcgtacccgttcagtatacggtatgttaattatcatactacataattattaagtagctcgatctcacgtatcacctacggtatctgaccgtagaaaggatcagagttggaggtttattaataacaagtaaaattcaactttgtgtgcctgaaataattaagatagtactggcataaaatacacagtattgagatgacgtataatttgttcagatacatgcatccttaactgtcattagaatattgcataaaagcaactatattaattgtgtttgtggacgcatgtcatctagcgcataattgatctattttttttgctaggagtgcataaatgatatcaccgtaatatacacgacattttcttctcgatcaatgaaattgcacggaaagctcctgtttcgtcatccattgggaagacaaatattttcctttcgtagtttcgtttccaaaatatggagacgaggtactgaaaggtacatacatctagctttgtctgcgtcgtccatggtgcttaatggagtacgagtagaaacaatgaaaactaaacacggtatatatactagtggtcttgactattgactttttgaccggcatcagtaagacacaatagttttgacatttgaccggcaacacatgcacaagcacaggcacatgcatgaattcataaaagttccattattcctgtataggatgggatacttcttaggactaccaatctagacagattcattaggtagtgacaatttataacggagagatagtatatatatatatgtgtttgtgtttataaatatttaaattttacaaaactataggtactttagtcaaattattgtaaaactatagatttaaggtgttgtatcgtaaaactactgatttaacaataaacttatcacaaaactacatgtttaaggctaaatatctcaaaactacatatataataataaaattatcacaaaactaaacatgttggggtttaatatccaagttttgtgataaagttgatataaaacatatagttttgtgataattttgttactaaatttgtagtcttgcaatatttcaccttatatgggtggcaagttacgttggatgtcgtacgacaacaattttcataaactatatacccaagataatcggaaactcttttagtccctcaaaattttataataaatttcacagaaccataaatatttcgagcaaactatcacaaatctacaaatttaaagtgtcagatcacaaaactacagatttagcatgaaatttctcacaaaactaaatatttaagatagtgtcaaataaaattaagatggagtgtaaaaaataaagattaggtagcaaatttatcacacagctataggtttagcaccaatctaatcacaaaactacaccatttatatagctccaacataaagatagtgttagggatttgaactctagaatctctaattatatgatacttggcttttcatatgtagttttatgacaagttttttttttgttaaatatgtagttttgtgatagaacaccttaaatctgtagttttgtgtgatagtttgatcaaaatatatgttgtttgtaaaatttactcaaatttttataaatagtatagaaaatcaaatgtaaactcagtttaacatatcaagaaatattttaaaaaacaaattcaatgtataaacatatcggtactattcaatctaaatttatgctctatattgtgaaattttctccaccatttacgttaaatttgacaggaaaaaaaaagaagcatatgaggggaagaaattagaatcctcatcgcctcatgaacacagagtacagtatatatgcatgcatggcagcacgttcagtaccaatttggctaattggctacttgatgctcaccacacattgaagtcaacggctgcttaattaagctttgcctgcactgccattccataattcagtgaaggctatattttactctagtactacctactactatggagtattttactccagtagtaagaaaacgtgtcaacgaaaattgatctatctaatctatatactccatgcatcccaaaatattattacctccgtcctaaaatacctaaaatacttgtcgatttaagtttttatttgtaaagtttgatcattcgtctttttaaaaaaattatggaattattatttattttatttgtgacttgttttattatcaaaagtatcttaagtatgatttttttaatttgtacgaatgtttcaaataaaacgaataatcaaacattaaaaaaaatcaaaacgaccattaattttgatatggaggtagtacaacataaaaccggagtagacatatcataatactacgaatctgaaaaaccaatcctaatatcacgaatcaagatagagatctatctggattcctcggactatatatctcgtttggttagattgcaatattttggaacggaaatattatatattagttggactttaaaagaatctcacattaataaaaagaacagtgaataaatttagctattcatctaagtgcactgggactaaattattgttgtttacttgagtttacattagttagatcttcccaaatattgatgtctaattgtaaattaaatcaatatgatgctaacctgaaagtccaaaatatttaaaatttcatgtctattcattacgattttcaaattattaggtaaaacaactgagatgacaggccaagtacaactgtatttatgaactttggatttcggaattaatatatcaagaaggaatttaagttgtaactatatatatttgttatttatgggtccatgtcaattatgacttgagaattattaattgaattttataagaactaataaattaaaatagtaataaatcaaaacaccaagatggctacaactccatgcttatttttacgtttgagttttagaattattaaattatgaaaaactgtaatttggtacaaactgagtacaattttatttgtattaattttgaatttcataaatcatttcatgtaagaaaagctaaaattacaacagtataacaagtacaactttatatttattaattacgtgtacattccgtgcacatcaactaacaaatatcataaaaaaatccaaaaacaatcaatcaatagtattacacttacttataacatcttaacctgaaattcattacattttagtcgtaaaaaaacaaaaattctgacagatttaagactacaagtctattgaaattttgtctttttattttttttaacgacttgcacaagacgatacgaagttctatcgatagagaaaaaaaaactacaagattacaaccctgaagggtcataaccaggaaaaaggaaaaaatatgccaccaccccacacaccgataacgccaacacacaagtctaggagaaggctagcacaggaccggccaccgttaagcgtgaccgaccgccactagaccaacaaaggaacacagacgagatcgtcccttagggtatgccaaaatgacgttttcaagaagagaagcgacggaaaaaccgccgccgccgtccgtcggggctcaaatgagccaagactaggctttcacccggcaaccacccttgaggtgtgagacagcacgacaacaccctcaggagggtgaatgaatcatcgttgtcggtccggccaaggccggactgggttttcacccgccgctcaccacctgcgaatctacgctgacgcaccgatgctccaccaccactcaagctctgcgacatctgggacccctgcaccggcgccccccgccggccagccttcatgcgccaaagaccacgccacacccaccggcagttcctcctcgcaccgaggtcgcctcctccaccgccggccacatttctcgcgccaagccggcctcctccaccggacgcgtttcttgcaccaatccagcctccctccattggccgcgcctctcgcgccaagccgaccttcatctccaccgctcgcgcctctcgcgccaagccggcctccgctgccatcggctacgcctttttgcgccaagccggtctccaacccctcctccaaacgatgccgcgccggccagatgcagccgtctgccaagccctcggctagccgtccgaggccgtcatacctccagtgatcgcagtcacggtcaccaccaccgcaaccgctgctgctgaacgcccagccacctcgtcgtcgccatcctcacctcgccgccgtcacccaccacggccagtcctcctcccgtccacggtcgctgtccggcccatcgcccgtgcatgccgaagctgtggacgccgcctccagctgctgccggcgccgaccgcgcaagccacttggaacaattttttctagattttttatgatatttatagttggtgtacatggtgtattcatgatggtttacgtgcataggatatgttctcatataaccaaagagagatttttgtacgtaccaaaatttatatactagctaggatgtattccggtgacttctcaggagggtaagatcattcgtatataaattgtgcaaacatacaacttggtcgacggagaggaccagcaaacaagcacaaccatcgctttgatagttgacttaacgaatccggccgtacgtacgagtagggtcgcctaaacagacaatacgatatattttaagctttgattaattatgacggtacgcatctttttctctctgccttttaaaacaagatatttaaatgcatcgtccatccgtcatgcatttgtgtaactagcaaaccattttccatgattatacacgagctagattttatattcaaaagtggaattgaatagataaatatatttgtttccatttcgatataaatatattttatatacgaccatatcgatcaatatatatgagcctttatggctttatcatcgcctttatggctttatcatcttaacccgccacgatcgagtgatgaaattttttttatttcttttattaatgtgatatttttttaatctctaaagtgaacatagtggaaataaatggaccaagcatctagatggtcatattctagttttacgtagatttaaggtagagtttgaaacagattattcacatgtcacatattatctattcgattataggaatatattaaatatcttatgaaataaaccttacgataagtggtccaagcaatgcagcaaaatatttttttttgagaattcatatttagaaccattgagggcccctttgatttggaggaaaaacataggaattttgtaggattttaatcctataagaaaatttcctataaagccctttgaaacaaaggattaaatcctatccaatcctttgaaattcctatggaatggacaatcctatagagattttggaggaaatttagcaagaacttcaacctcttggtaactttcctctgagtctatctctctcatccaatttctacgtttttcctgcggttcaatcaaacgatcattcatgtgtttttcctgcgttttgcaatcctttgttttacactttcattcctattaaaatcctacatttttcctattcctgcattttctcaaccctgtgattcaaaggggccctgagtttgtttcatgacaatatgttgggtatatgtctatcggtgatatgggcctaggggtatcatgtttagagggaggaggccgcccccccccaactcacgtggcgtctcttgagaagggtggcgctcgggtggagtggctgccgccccctcccagcttagggtaccgagtttggaggaaggaggctgcccctagacccacatggcacttccccgaggggatggcgcccggggtggagtggcggttatcccctccgcgcttgggggtcgggcccgtcccgatcaagactagagggaggagg

SEQ ID NO: 2692 - DNA, 4567 bp, Oryza sativa
cccccgaccccctctctaggtcgccacgtgcggtgggttaggtgctgcctccaggcactcacctacccgcatttatggcgacctgagtggttgcgctacgccgcatttaatgcggcgtgcagtgcactcaaccggtctgtgatcggtcgaatgaccgatggaacggcggctgtgtacccccaccctgtcagtgtgccaggcggcatacggcgtgctctgtcccatcacatcataatgagaggctttttagcctctcatcatagcaggagtcggtttatccactctggtcaaacaggagcctagaagtcttcatcccttaaatggcgactcacaggggcaccccccgtgtcaggcggcaagatttgacgggccccatcatcaagacaacgtgcaatagacaagacatgcatttaatgcaaagattgtaatacttctccactaagttaggttgttgggcccatgtggtaaccccttatggtataaaaggaggtccaggcctacttagggagggggtgttttttggacggatagagggaggatgagccattttagactctagagcagtctcttgcccctgatgatcaacaccaccttctactccaacaagaagatcttgtaacccccaactcaatgaacatagcacatgagtagggtgttacgcttcatagcggcccgaatctgtataaaccccttttgtccaatcgtctttgaggggcctacctaaccccctcaagatcacatgtaacgctccgcttttcgtgagtcgttaaaaactaactcggcaaaatcctaattgcgaaaattttcgttctttgtgtgagagtctaagttgtgccaaggatcccaatttaatcccgttgttccctctcatcgaaatcaaaatcctccccctcatccaaattcctcttccgattcaagtctctgaaatcaaaattctgaaattcaaatccttcctttgaatcctcgccaaatacttctacgaatccagaattattcaaatcccgcctcgaatcctttccttgactccaccctatgttcccgagaacaaatacccaagtattccttttgaaacttttccatgactcctccttgagtttcccttgatacatccctaaaccctcgagttcgaatatcaaattgaattcgaatccaaaccctaaatctctccaattctatccaaatcagttttctctgtaaaagtctactttacctccctgtatttttggatggaccgattttcctcccccggcccatctcccctccccagcccatctctctcctttgccatctccctcacgtgcgctgcacgagccgtcgccgagagaaggatctctctctctctctctctcgttttctcgctccctctctgtttctctctcgcgccgacaccgcttcccgccgtcgccgcccaaaacctccaccgccttcgcccattcccgcgcgcgcctcgcgaggtggccgaccggccggtcgccgccgacgccatgcgctgccgccttgcccccgctccatgccaaaccgaccgccgccgtcatcgtcgacgtcatccatgcccccccccccccccccgccactccacgccgcacccgtccaagagtgggagaagcagctgccctccctctcctcctcctcctcactctccctctcctaattatggcaagggaccaaacccctttttccccttctttttcccttttccgaccactaccggggtcactgcctctgcgccgcttgaccgaccacgccaactcgctctccttgaccgcgccagcccgcgctcccgtggttcgatttccgccgctcgatccaccgccttcgccgcccaacgcatccacgccgtcgccgctttcgcactgcccacgaaaccgccgctgccgcccgtgaacaccagccgagctcccttgaccgccaatgtcggtttccctcctccaaaccgacctctcctcctcgcctataaagcccgcgccctcctctctcgtttcatctccgcctcgctcgaaacacccgcgcctttgttgccggccgccagctgctcgcccccgccccgccgtcgcgaccacctcgccacgactccctctgcgtcgccaacgttgctcctctctcgccggtgagctcctcgcccaaattcttgccattgcatcatcttggataagccccgagccgttcggttgctcgctcgtccccctaaacgtgccgccccgccgttgctctgcttcgccgccgccgtgcccgactgtgcgccgccatgggccccctcgccaatccctcgcgccaccaccgtccttgagctccctaggacctccccaaaccattccctagcgccgtcgccgcccggcacggcctcgccgccattgccgcccgctcccgaagaccgcctctcgtcgccagccaatctcggtgccgctccatccaatccgacgccggaaacggattccttgaaccccggagatgctcccacccctttgaatcgaaccctcgtcgtctcgtcgtgttttccccttttgctctccggtgattgccgccgccgtaatccaccgtcgtcggctcctctcgcgtcgattcctctcgccgccgcgcgtgcgtcgccggtgaccatcgggtcccgcgtccccgcgtgcgcatcgcggtcgcgtaccgtttcggctaggcccgagtccgcgcccccttgtcccttccctcacaagaccacatccccgatccgacgagcttggtcgccgccgccagccaccgtcgtacctcccctctcaaatccgtgccgttaaacggattctccctgacctcctctagctgccggcggtagccgctcgctccggttcaccgctgctcgccggaacgcctcgcgcgtcgtcggccgtccgatcccgggcgcctcctcctcctcctcctcccctttcgcccctgcccgcgtggccgaccacgtggcagccacctcagccccgggcccgcttgactgggtcaagtcgcgcccagtcagcctcctccctccgtcttccctcccgtgcgcgcggtccacggcaagccgtgcggctgcacgtgggcccgccgccatccgtccacccggcgcgccgcgcccgaaccgcgcgcacccgaaaccctagcgcccgcccccgcgtgcgccctccccaccgtgaacccaaccaccgccatgtgggtcccgcgcggtggaccgcgcccaccccgtcgggcctccctctctccccgcgcgccctaatgggccgtctccccatggccgcgctcggcccaatggccggccaagccttgtgaatctctcgagccgcgcctaagtcgcccgaggaagtctaaatccgatccctccttccttttcttttccaagggaattaataattccttttccttgtccagaaaatccatttagacctccaaaattcatatccctcgatccgtagctccgatcgcctccgttccacttccagtaattccgtaaaattgagacctatttaatggcactactaataggtctaaataggatctttcttttggtcttttgtttaggttttcgattgtttgcgtatagttgcggttatcggattttcgtcgatcgcgggttttctcgaagattcgtgaagcttcgtgaagaccttgagcaaggcaagtcaccctttgatcaattgctcctataattgaaaagtcattattattttatttgcaacttgcattattagaatcacacttaacttgcttggcctcggtttgcgtgccaaaccgacggacctacccagtagtcgcactaatttccgtaggtcgtactaccctgtttccttgtcgctccacccttgtggtacctcggtattcgtgttctctgagcgcgtataccaaatatcccacatacaccgttgtttgtcgaaaacttgggaaatgggtttgtgaagccttcaaaacccgacatgtggtgtcggtgtgtttgaaaataaaatgaattgtgaaaactcgcgatgcgggggttgtgcctatgtggcactgtcccgtattcgcatataaggaccgattcctgtaggaaactcatcgaacataatcaaagtgcaaccacaaggtggaatgggacaccctggctaagtaactagtcggttcagggaaacctcgcatgccaatagttgggaacgccggggcggggtcggacaaaccgggttcctggtaaggcaaggacgagaagcttgctcacttaccgatcaaggtggttggagttgatttgtgaatgcctaaaatggcctatacttacgtgaggatttgatccttctatgtggcatgaggtaaccctgggtcggcttgggaaaggctttgtcgcgaacctctgacaccggccagtgtctggagtaagttcgtgtcttgtgggtaaagtgtacccctctgcagaggttaactaactgttcgaacagccgtgcccacggtcatgggcggatgtgaggtggttcccgttgcgtagatttgtttgcctgtgctttgtgaaaagttgttgtggtgtgggaatcgtaaccagaatcagcctatgtggcagatggacgacctgagtggtcagaaacgaatttgtgtgattcgggatgtctgcggg

SEQ ID NO: 2693 - DNA, 10659 bp, Oryza sativa
acgcaagtctcttttcggcccaaacttagaaagaaataaatcacttagtgatttcaaaatgtcttcaaataaaagatttgcaaaacaaccttgcctctcttccaagcttgcattaaacacctaagttcccgtgacttgctgagtacgaaagtactcacccttgctctatataaatatataaatatatatagttcctccgccctgaagagaagataaagtgaagtgaagattagggtttcgtcctggttcccagccgtcgcctgtggtgttgggtattagaccgttggttccgctgctgctgttgttggtgttcgcctcgtccgtgtcgtcggttgtattctcgggctgtctgagctgcaacctaagttaaggtaaataagtcctctatttattttaaagattgctatgattcatatttgtcaccgtgggtaccagcactatgtcctgggactggtaccgagatcgcggtttcgtaggaagcggttcgcgcagttttccctacgacacgctcctgtcaggtgccgttgtacggcggtatcagattggggtgtgacatcacataacttcgctcactgggtcctcaaatctcacccgctatcctcggctgaaaaaaaaaaagaggggcctcacagttctctggtggaggagttcaccctctgacaatgtcactttcaaagcaatggataatgcacaagtagctttcccatgcatgaaccagaacatgcatgtaggataagctagctaggtttaatccatatagatatagtacaagttcatagtcaatggcgtggacgtagtaattaattagtgtgtacatgagggatgtgatcaacttggtgacttgataagcacagtgtaagtgtaaattaatattctttttgatgacgttgtttgctcggactaatataattgccactggaattggattccatagagttgtttatgaaagaatgccttgccaagatacgagacagagatacagtggaaatatgaaacttgtctaagttggatagcgttctgatcagcctgcaagcaaaactattgtacgtacagttagctgatcaagaattatctcaaacttaattatgtcttcataacatctttcattgagatttcttgccggcaaagtatatatgtgacttataatgcatatagaagttcgttcagtgcagtttcttggaacgctagagaggatatatgacgagaacatttttttttcctgattcacaaaacagtctacaaatgatagttaatttttgtttaaagataaaggagatattttttattgcagtataagatatcgtctataaattatagttaaaaccaacttatgatgaaaatgaaattacatgttaaaaaataaaaaagaaacgttaaactatgttttctccctatacaagtcatttatatcgggcaaattgagtaaatgcccatgtacacaaattgagtaagccaagaacaaaaccattactacaaaacaatacttatagtgttagtttttccccctcatcaatgttggttttgaaactagcactaattattgagcacttatgagaggatcctcatgttaccggttcctaatccgagagtgatagggtgacaatttgaaaaacaaaagagctggtacgactctattgaagccgagccgatgcatcatcatcgagcatctttatccacaaaacaaaacaatcacgaatccaactaaagtagcagtcacaaaggcatcctaaaaattggtatggttgaatcaaacactttacagaacatagatccagttttttgcataatctctaagcatatacaaacatccatatcgaacttttttcggaacaagcacaagacacgcttgttaactagaaaaaaaaatcccattgagtgtcaactcgttttttcaccgtgatggcatcagatccatcatccctcgctcctccggcatgaactgtcactagctcacacgtcgttgcaatcagtgcttatttatttgaaaaactagccatgtggaaacacattaatactggtttttttaatgaaccagcacttatgtggcatcattaatgatggttattccatgcggatgacgcgcatgggccggcgggtggacaggaaaccgctatcaatgctgagttttccttgtttggtattgatagggtgttactccctccatcccataaaaattacatttctagctaatttagaacaaaacaataggattggaaaataaccataatgaccttatttaatgaacccattgcatgcacacattccatatatacaaatgattaaaagaaagtttgagagaattaacccatataattagcatactttaattacaagctgagagaacttaaggaaacttatctagatgaatcaatttgctagggcccaaatggctagatatataatttttatgggacaaagccttagagctagaaatgcaatttttttaggacggaggtagtacgattaagcagttttgtacttcctccgggctaataatacttatcgttttaggtaagggtgaggtcaaactttagaacttttgattatgaatcatttttaaaatatttgtctttcaaatatgatgactacatgtatagattagtcttagaaagtacttaataaaatcatatatttgttaacacttttatacatattataatggacaataatggttaaagttgtttttttaagaccgtgctcttatccaaaacaataagtattatcaaccgggagggagtagcagtgaacatggcttaacatgtgtcttttagagtctggaccctctgcttcgttgtgcaaaacatggacttatttctccacatgtactatatatgattagagaaatggaagtttttatttctgatatatacaaaaatggaacgaggaacatgtttcaaagtaacaaaccacccccaacacacacatgaagaccaattcgattcaatcagaagcagttcgaccatcacacataaccgagattttaatttaaagagattttacggcctagcagaacagtaaaatcactttaattttttttatcactccttaattcaatttaatttgagggctcgttttggcgccggcgccgctcgtcggagagctgctttgcgaacttggcaagctgatctctgttcgtgccttcgccggccacatccacgtaatggccggtctccaggtctactcgtgagacgttcttgtcgagaagcatttccccaatcttcaccaggttatccatgttttccttggagcagtcgtcgatcgagcccgcactgcccgtcaactgatcatactgcatttacactccaacagatcgatcatatatcgatacaacatcttgttaagttagagaaaaattttctaattgtcttctttatcgaagaaaagtcacaaattacgactaagaacaaggtgaaactagaccttaggctccttaatttgaaaagaaaactagagttcaggctacttttgaggtcctgtttttccccaaatagactcaaacgcagtgcaatatatggacattgtttaggtcctgtttaggctactttactcagttttgacgttccactttgatcattaattttttattagaatattgtgcaagtcttataaagaaaaaaatatacttatatgatttttacgttttcaaaatattttgagatactaatggtcaaagtacggtggtactacctctttatggatagtaaaaacttctcatctagcacaaataggtattttacctgtatgcgtaagtagttcttttcgcattgaagagcgctgaagagcacaccgaggtggatgtcaaccatgtcagcactagcagaagtaaacatgtcgatgatgggagctgagctacccttgatgagccagttgaagattccccacttggcagcgtccttggccttgtatttctgatcgtgattcgacccacagccgatggagatcaccatgaacttgccatactccgtcggcttcaccgggaagaagtcgcaatcttccttgtcctcgaggatgatatacttggacacttggctcattgcacacaatgtctacacatacagttccatgtctatatattattatattccaacagatatactccctccgtctctaaatatttgacaccgttaattttttagcacatgtttgactgttcgtcgtatttaaaaaaatttatgaaatatgtaaaactatatgtacacatataagtatatttaacaataaattgaatggtaggaaaagaattaataattacttaaattttttaataaaacgaacggtcaaacgtatttaaaaaagtcaatggtgtcaaatatttagaaacagagggagtattattaggactcttttgcagaatgggattttcacaggaaatagtttgattcccttaaaagtcctaaaaaaagaaacctgaggtttgcatcggcgacacgtggtgcttaccgggttgttggcggcgaccccaccgtcgacgaggttgaactccctcgtctggccattgtcgtctttggtctcgaaatagtgcgccgggaagaaggtcggtgcggcggaggtgctgatcgaaatgtccgacaggagagcattcttcagtggcttgtacttcaactgatcatcaccaaaccatccatatattagaaattccaaacatttcattatcctttatagtttatacccatgtgtgttgactataaggtttggtcccgattacttcttaaaatgggacacttttttctttatataaaacgtcggcaacagcctgatcgttcgaaaaaaagactatacacaaaaatagtttatctttggttaatcttcattcgccaaaaattctcttgttctgattaagccacctaattaaaactgtgcacatcatcgtcttagctctatttgtggctatatattccactggaaaagtggatattgacattgatgattgatatccactactagagcaaaattggtggtagctgcttcactgatggggggtagacgaaaattatgctcgtgtgtaggtgatgagcccggtcactgaaacatcatgggaagaaagaaaacgacgctgtacctcgaatttggagaagatggttggttgcaggttagcgatgtcgaaggtgggaataaccacgttcgtcagcgccttgtccagcctcgtgtcgccgagcttctctcggagcagcgaatggaggtacttgccgtcgtactttgggccactcaccatcctcagcgtgccggcgatcttggacaagacccagttcctgcgaattcaccggctcattcaccattgattagaatatatatataaataataatcaagttgttgcaatcttcagcaagcaaacgatgcatgttgtactaagaaatgtaattttatatgacaaattggtttgctatgtgtgcatgcatatgcatgggactaggttactacttctgtgggaagatgctgggcgagtgttcgatgtagaatttggccaattcgtcggcggcgaacagtggccggttgttctcgtttggagcagtgagcatcgccgtcaggaggccaccggtgctcgtgccggcgacgacgtcgaagtagtcagcgatcctagcatccggaccatccagtttctacacaaactcagacaagtcatcactaataattaagtcacagtgtaacaagaacaattcacaactttagttcaattatattgttcatcacttacttggagctctttctcaaggaaggcgaggatggtggccgggatgatccctctgacgccgccgccgtcgatgctcaggacggtgaccatcttgaccttttcaggagagctcgaacttgcaccttccggtgagctagcacttgccatcgttttgctactttgatagctcaaaatcaggctaatattgatgcaacgacttatggaacgaaagaaagaacaatgcaagattggcggtgattagcaggaaggcaagcaagcaatttggggttcttttataaagacatgcacgtttgcaacagaaggaagcaaggaacaaagattggccaggtcagctgcagagatacataggctaaccggcagttgccaactaagactaataaaaacttcatcaagaaaaaaaaattaagcctaataaacaacatcgtttaattagctttaattaatcatcagttcctttcaacggtttggtgccttgcttgaacttttcttgaaaagaatatctattaaaatgctcttagtttgagaagaaacttaacaagtgctgcgtcaactacaacttgtcatataatttcgcaatgcttgcagatcgcgtttaattaggataacatactgagacgtgcttaattatattttctctcgagcaataatggaaatgataatagcatgcatggaaccaatgtgggagaaaagaattaatgtagataaaaaggaataaaataagacaaattaactaacagcttcggttaattaagttgcatggtttgcagtcaccaatccaggaggaagaagcgaaaaacagaaaagaaaattaggggggggggaaaggaaaaggagataaggaaaaagaagaggagggggaaaaattatggttggtgtattttactatatttacgtggtttttagtagcaataagcatccacacatctgctccgagaggttaagagatttgcagattttgaggagaaaaaaggcggatatacagtatatattacatatttgacattcaaggaaaaaagaaaagcagatatatattgcatatttgggttctggttacaacaacgttcactctgaaaagttaagagatttgcacatgttgatagagagaagaaaaaggaggatacttattgtatatttgggttctggtcacaacaatggtactggttgtttgagccatgcattaaaagccacatccaattttgttttgatttcactatgccttggtttttagttaagctataggagtatctatgttaccttaaaagagagaatcccttatataccactagaatttgaccagtttttttatatgtcacttaaaattggtttctcccttatatgccactagttcaagtttttctacccttttatgccacacccaccactatagtgttagttgactgttagttaaagattagttttttttcgtaaatgaccaatatgccctctcaactaaaaaatgtgtaaacttcaaaaaaatcataactaatttattttaaatcctttttgagtgaataaaattttgtcagaaccagtgaaaaatgctctttatattaaaaatattgttagaaaactgcatgtttcatgcttacattgaaaatttatttgtgatggtaatggctaaaattgcatgtgatgcagaaaaaatcaattttcatatgttgtatccagtagctatattagtactaaaatacttattattggttgtatactaattctcaagggcaaatgcgtctttttacaatgaagttaatggtcaactgacggtggactgacggcaatggcataaaagggaggagaaacttgaaccggtggcataaaagggagaagccaatttgaagtggcatataaaggagccagttaatttaaagtgatatataagggattctctctactttaaaagcggagttgtcctccatctgccccatgtagagcagtagaggtcgtctgctccttctcgtgtggtaaccattgaagaatcctctgctttattatccataatccatccacccagccattactcaattatatgagcttgattcgtgtttattctcaattcatccaatctccaattatatgggtctgatccattgcaaagtacgggcatattactagtaattataaaactctaaacctaaaatttgtttctgtttgcttgttcatgaggctttgactgatatccatatatattggattttctcaaatcgtataagaaatcggagccatcttttcgctttgcaaacgaaaagtaatttgtgaataaaaattttatatatgtgttcttagcaatctaaaagcaaaggttggaaaataaaattcgatgaaaaaacctcaaaatcagctcatgagaaaattcaaattttagctgataattgtaagcataagcgaaaagatgaggcccagatttacatttccaatcagacggttccgttcatatacatatgtatatatgtatgtatgtatatatatatatatatatatatatatatatatatatatatatatatatatatatatatatctctatatataaattgctatgctcccctcacacacaaactaagttgtccagttgggggtggaaaattctattattttggttgaaatatagaacggcttgtcggaaggtatatatatacaaaggatgagataattaatgtttccaagtacttgcattgacatcgtcaggaagtcttagtgctcttaagaaacaaaatatatgcattacaatgtaaacatgtttacaacgaggaacagatgtaatactaccagctaagacctaagaagatgcaaacataaatccaccaatgttgtctctcttttcttaacgttatcttctcaaagtagaacgcgtgaaacaaaaaaaatacatacagctattatgattgataaataagatgctgtgagcttgtgtgttgtgatttgtgataatgatcatactaaaaaagctgtggatccgtgttgtttattgactacttcgaaccaggtgggaattaaccaaaaaaataatcgagattgttaacctggttgttgagtggaaggtaaagaaactaagctattgataaatatttaattagttattttcttttgtgtcgcacgcaatttgtgcttggagatgaagtcggtttgattgacatcaatttcagttttgcaagtctatattgatggaaatagcgggcacacttcccttccttcacttcatgaataacttcatgtactactgctgaaacaaaccatgatgacagggctgcgcaaacaaaatagtagcccggtgaccgaacaatagtacaagtcttaatcatattctgtgataaatttatacaggctaacagcaggtccagatatgatcatacgaacgccctccaaaattatcaatctatagtaacaacagaattagaacattacagaggctttggttcactcgcaaagacaaattcagttcagtaggcacattatagtacatcatcattttatgaatacatacaaggaaaaagaattagaaaacagacagtacaacaaccacggcacaactaataatcaacctgttagacaagatacctgtgttacaagtagccagtaagtatggaagactgacagcatagatgagcaaaaatctttgagggactcatgcttttcatctggcattgaaaatagcaatctgagtttaaggtcgaaccattatcatgttgcatccagaatgcccttaaaatggttagccaaggcatatgttaggatcatcttcatctgagtcaaactccacctgccatccaccattgcattttaatagttagtggatacagatgctggtataaatttggattgcacagtggagaggagaaatgagctatcctctatgaggcccttgggtcaaaggacattacctctactgatgccacatcactgtccgccacaaaaatatgaagtgcattatgtgacttagtgtaaaaaggcttagtaattgggaatcattcattattgttgatagcaaaagcaacttaaatctcatgacagcaatacaaagaataattagcctatatgagcaaagctattgttattctttctatattgagttgactactaagaataacatacaaaagaaagagccatacaaaaaaaaaatgtgactcacattttcatccctgtaccatcttccatggccatctcgtttccatcctgaagcagtgaatttgagttcttgctcctggcgtttttggaaatctgcttgctcctctgcaagcattttggttgcagttctgtcaccagcaaagatttttcctttcacagtatctccactccatttttccattggaacactaggagtaacttgggaatcacacagtgaagaatttgatgtcctctccagatcatgagatttcttgttggcgctgtcgatgataaatctgctggactgtgcttccaaaatagcttgtcttgtctgctgaatcaatggtttttctttcatatcactagacctaacaccataatgttgcttaccagaacttgaaacggaagcttctggagaaatagcaagtctcttgttgatctcttgttgtcttgataattctttctccctcagcctcgattctgctgcaatgtgccgtgaacctttattatgcatctgttcatttgttgtcatttagagatgaagaaaataatcaaagaacacgtggtcgcaattttcaacaatacaaaatgcaaaagagacggataacgaacatatctcggtctaacatatatatactccctaggatcattcaacacaaagtttcatgtacaacatgatgcacagagcgctttagaccgaaggaccaacttggccccaagctcttttcattggataagaaactggatctagagagccatatcactcgatgtttgaagcaaaaatagctgacacacactaaagtaacatggacaaatgaaccaaccatacacacagaatgctactgatccaatatgtattcatgacaat

SEQ ID NO: 2694 - DNA, 19493 bp, Oryza sativa
tcctgcagcctctctttaatcaaaacatcaaacacaatacctcatcatacttaacttaagggaggtactactggcttaggacacctacttctctcataccaatccgaattctgaaccattcttatcaacatttgaaccaatctatcttgtgacagtttcctaatccatggttcattcagaccccaaataaaaatcgattggtcaggactagaaatttaacgagccggtcttcgtgctcacgcataggcaagaacaatgtacaccattaagcatctagaatccaagatgctagaatccaactacgtggttagggtaaaggaaggcgggggcacagaaggggatcgcttacggagagcatgaggggggagtcgaggacggggcggtgggggcagacgaggcaggcgaacttgccgttggagagcctcctgaacgaatcgggcgaggacgaggatggggacactgccgaggcggggagcatgaggtcgtcgaggcggcgcttccgctgccgcgcgtcgcgcgcccagctgtcgccgccgaacacgctcatctcggcgttcgcgtcgccgccgccgccgccgccgcagtcgccgccgggaaccaggaggaggggaactctgaccgggccggatttgcgctctacttgggctttaacaagagactctgagtacgatgggctacatcccgaagtggtctgatttggcccggcccatgacgcaacaatagtacggttaattgggctcttccttttgcacagattccattttctaatgggttagtgaagtagtactcctcgttttttaaaaaaaaaaacactttttataggagtgcactcctgccaactttgcttgccaaaattggcttgtttttttaattaaaattttttgttgttttacaccaaaattttgattgttttgcactagaaaattgcttaccaaaaattttgattatatcagtgattcagtgaaggagtaattgtttttggcacatggaagtgagcaaatttctaggtgattgtacaatgtgattacttggattatattcgacccgtgattttatttggaagttccatctatgttccctcattctccctagagagtttagcgaaaatttagaagaaactaccgttaaacataaggggaaaataacttgtacccccatcgtctcaaaagaatgttggttttaagcatttaagtttttcacaaaaaaaaagttgatttctactcctttttcttaaaatatagctacatttagctaattatccaagtacctagaaagtatctatattttttgaaacaaagagcgtaaccacttaattacccttgtcgaattattagatgagcgtatcccttcaatacatttacatccctcgcatcctgcgaccacgtcgtatcttactttttttttttggaataactcataccagacagcacaaattcatattgatagagcaggaaaaaatcataagattataaccctgggagatcgtactcagaaaaacgaagaaaaaaaaccaccacccatgcaccgacagcaccaatacacaaacccaggaaaatgctagcaccgaaccggccaccgctaagccaacaaagaaactacagctggaatcgcccaaaacccaaccctaacaaacgataccaaacttcactctatccacatctttagggttgagggagagagggtgaaagagaagaatggaaccgctctccccctagaccctctgacgtagccaacttgcataaactagggtgctggcacagaaggacatagtctagagcgagcttgcacccattgtatgggaggttttggcaaggggttgcttagacaacgactccagggagagaaacaacgaaagcaccgtcgccaccgtccatcgagttctcaaagagaaccgagactaagttttcacccggtagccccactagaggggatgagatggtacgacaacgccctcaagaggagaagcgagctcgaaaacgccaatgttgccgacctgaccaaaaccgggctaggttttcactcgccgcctatgattccacacctacacgccattgctccaccactggcggccagcctccgcgtgccgccacacgggcactctctttgcgcgctccatgctggactcctacgcactacactgccagccacgcatctaacgccatgttggcctatcgcccgcctgtcacgccaccttgccacacgcccgcccccccccccacctccacggcctgctcaccgcctcaccctcctcagaggcactgacccacgcctcctccgtgtgagcatgccacggcgtcaaatcggagcctccacgtgctccctttgcctgccgccttctctcctcctcgcgtcgccttcgcgctctcagccccgctgcccgctcatcctcctctaccctcgccgcctctccctccttaggaacgctggggctgcccacgccctatgcctcctccactcggtcgcaccgtgggctgcgccaccgtcgcagtggcctccgcctcctccgtcgtaagcgcaaacccctctggacggcgccatgatctcctctgtcggcaccgcgacctccaccgccagcatcgcgacctcctccacctgcacctcagcctcctccatgggtaccgcgaccgccaccgtcagagccatgacgtccttcgcttgtaccttggcttccttcccgatgcggcacggccagcgccgctccatctcgatctggccacgggagcgccactccatcccgatatgaatgcggggggccagatccgctgccgagggaggtggatccacctccggcatggctggatccgccacgccgaccattcggtcaccacctcccacgacccgctgctaccgagcagcccccggtgtccctgccgctgggcttcctcgtgggggagagcgccccaccgccgccatccatatggccccggctttgctgacgagccactcgggcagcggtgaggcgaaggggaggagggagggggcgatagccgctcactcgaattaaaattactaaacaatatgtttcgtgcgaaaacgttctatataaaagttgtcctaaaatatcaaatatatatatttgttaagtttgtaataattaaagcttaattaattactctctccattctaaattgatctgagtatttcataggtacaccaagaccaaaaaaagctaataactctctcatactatatttactctagcagcaaactcaatgcatgcaccatccccactattttctagccaatagcaaatcaatatattgcatatgggttataaatatatgtgtgcatggatgcatgcatcaatgtccatttactccaatgcacaaataacgaatagaactaataaatgaacacaaatatgtaggtcatttaggaataaacccaaaaaaactatatgtagatcaatttggaatggagggagtatgtgctactccctccggttctattttaattgacgttttggacaatgacacggtctacaagatatatctttgatcttacttttctattatagtatatataataaataaatgcatgtttatttttattatagtactttaaaagataaatctgtatatgttgttctagttcctttaaactaaatatttttaaaggtattgatgattaaagttataaaaatttgacctcaaacttgttcaaaacgtcaattaatatcgaaccggagggagtaatagctttctcatgtgcgtcagcttaattttcttcttcatttatggagtcgtaaatctatgtgtgtggacgtagcagttcatgttcatgctctgttccgagtcctgtgacacgaagatcgaaacaaaaacacaaatcgaggacgccaactaaaattgctgggcgcacccgcaaaccccactaccaccaccgggcccctcttcgtcctcctccgttccatctccttctcttctctttcccagcagaatcccagtcaaaatcccccgtgtcctccccccctacggcggcgaggcgaggcgacgcgacgccatggatcccgccgccgcgcggcgcaaggccgagcggtggataggcgtggcggagaagctcctgatggcgcgggacctcgaggggtgcaagcagttcgtctcccaggcgcgcgccgacgacccgaccgtccccggcgccgacgacctggccgccgccgcggacatcctgctctccgcgcagcggcggcgcctcgcgacgggggcgcccaacccgtacgccgtcctggggctcgactgcgccgaccccgcgtcccgcgaccccgacgtcgtccactccgcctaccgccgcctctccctcctcctcaaccgctcccaccccgaccgcccctgcttgcatgccttcgccgacgccgcccgcctcgtcgccgaggcgtgggcgttcctgttcgaccctgtccgcaaggcctccctcgactccagcctcgacgccgcagccgccgcggcggcacctcgcccgcctcccgctccctctccacagaagcagcagccgcagccgcagccgcggtcaccgcggccagcctcgccaccgcctgttcccgcggcaccggaggtggcctcggcggtgtcgacgccgccggcgcggccaaagcgcgggcggccgccacgcgccgctaaaccccaaccgacgccggagcggcagcaggaggcggaggtggaggcggcggcgacgttctggacggcctgcccgtcctgctgcaacctgcacgagtacacccgctcctacgaggcgcgcacgctgctctgccccagctgccgcaagccgttcttcgccgcggcaatggccacgccgccgcccatcgtgccgggcaccgacatgtactactgctcatggggcttcttcccgatgggattccccggtggccctgcgttcgctcgaccaaccagttcttcttcttcttcttcttcttcttcttcttcttcttcttcttcgccgacgaagcaagcaccggctgctctgggattctatccaatgggaccctactccctgccattgccagctcaaggcgacgctgccgagggcaatgcagcagttggttccggtgatggcacagtgacagcgccgtcgccgccgccgccgccgccggcggcagcgccattgccggtgaagcccaaacttgtaaagcttggggcaaggaagcgagggaggcccaaaagcagtaagaacaagcatgtggtgatcgagatcaattagaatgtttttttggcaaattttgctcttcgccaaactcatggttctgaatgtgcacgatagattctttgtttgctgatgagaggggcaaaaatggggtgaaaatgaagagagattggatcttctacaagaacagcaattttggtgatgaacaattttcctcttctttcagttggaaagttggttctcattagatggttagattctgtgtgttgtgccatgccacctcgagcgcaagatttgttgttgtaaattgtaagattatcagatgggttgttggtagtgccaaatgtacattactttaggatgatgcaacttaatctttatcttcaggagaaaaaaaacaccaccttagatgacaacctaatatttcatctacaatctcatatatggtctactaaatttatttttctagacatggtttgtcaaaccagttgttaataactaatattactcctaactcgattgttaaaaaaacatattaaaaattatttagtaattcccgcagcacttgggaatcaactagtttctatacagttcaaaccatatattgctcaataattataaagcttttacttccataaatataaatataagagattctaatgtttaaatttcattcacaaatatagaagatactatagtattatttctcccactcaatcactctataggctctaatcgacaacactgctcttcagctgtaaccagctatgctatagccgatgtatatattttctttaccatgcactgtagtggctgctgctgtgcagctacaatttagctacaccgaacatacccatatttattttctccctattttaccctaacaacccttccctcacccacccattaattaatgagggcgtcatagttattctctttattctcaagccctctttgattttctagcaaaaacatataaatttggagggtttcaatactacagaaaaaatttctatcaaggttttttatataaaggagtgaagcatatactctcttgctcttgaaattactatagaatgggtgatcttatagagattttataggaaaattagcaaaagctccatcctcttgaaaatttttctttgatctatatctcccatccgattattactttttatacggtctattcaaacagtcatttatatttctttttgtttcacaatactctattttggatttatattcctatcaaaatcgtgtttttttcaactgctccattttttcaattccaagtttgaaaagaactaaatctctttagtaaccctaggcatagctataagcttttgaattgaggtcctctggtgtgaagtcacatggacatgatcactgattatgtgggtcactggggatgaaaacggagcggatagtttctatccactccggagaaaaacaaatacatatacctttcggagcgaaaactctcaaatagttcatatacggatgcgaatgaatggtgctattcaaatgttcgctgaagagataaaagacataccccatttctttataactttacgacattcaatatacctttttagattttaatagttgcccatctcttaacacttgtccacactattaatattatttaaacctttaaatattttgtaaattatacaatatttcatataaaatggtctaattatatatgatgatatttgtttctattagaagttaaggtggtttccgtgttccgagaaaaaattgtttccatattcgtgtatgatcatattcgatcattttcctattcgagatatttcgtatttgtttctatatccgagctattcgcattcgttttcttaactagcaaaaaaactgaaaacaaatatggtatgagcattgtccatccgtatccactctgttttcataccacgtcggtggataaccgctattttctttttccattttctttttccctccgacatttggataaccgctagattcagcaagaaggagcccggatctagcgtcttcgttctttgtcggggcagctcctgcgtcccagagcccctgcaagcccgatatccctgaccacaacaacaacaacaaccataacaaatagtgtgtatgacgatatgggaggagaaaaagacatgtcggttactataggtgcatgtgaaggcggagaggaggaactatggtggctcatggagaaagagtagtgatggtggctcatggagaaagagtttgttgtcgatacaatcgctaaccgagtttgttattttttttaagtattgataatacatgggccaccagtcatcgtaaagaaagaaatactaatagctactctttccgtttcatattataaatcatttgaattttttcttattcaagtttgaccggtttataaaaatatatattaatattttttttaaaaacgtattattaaaatatattcaatgttagattctactccctccatactcacataggaagtcgtttaggacaacgacacggtttccaaaacataactttaacttcttgtttctaataaaatatttattaaaaagttatatatgtagagcctgtttggtacagctccaactcctaaattttgctcaacataactttaacttcttgtttctaataaaatatttattaaaaagtgatatatgtagagcctgtttggtacagctccaactcctaaattttgctcgaggagataggtctggagtggagttgtggagctgcctaaacccagctccacaactctagttcattttatgagagggctccacccagctctactgccagttttggtggagctgaaactgtttggctgagctccaactccagaaggggtggagctggagctggagctgtgccaaatagacccgtataatttgatgaaagtatttttcaagacaaatctattcatataatttttacattttcaaactcaagttcccaataacttgagagttatttatgatttatatttctaaggtttgacttaaacattatcctaaacgactttttttataagtactgaggggtatgaactagtttggcattttagatgctgttaattttttctataaatttgtataattttagatgcagcataatacgacgaaccagagggagtagttcgaaggtgtagtagtcgcgtgtcgcgaaatgtcccgtctcgttgtctcctctgctccttgcgccgccgccaaggcgagtcgcggctgagccgggagggggcggcgatctccatttggcgagcagagcaggggaggggattctggtgagcatccacatcctctttctgattcatctctctcccaccgggactactgttgtctggaatttgctttgcgttaaccctagcttctcttctagatctggaagaacctcttctcctccttaaacctctcaaaagtttgggggttcaactgaacccccccatgtccaaagttggatccgcccctgcttgtggacagtctctataacagtttttttttcttcttactctgtgctggtgcaggtctgaactgatcatcatggtgaaagaacatgcagagaaaggagatggcgttcaagaatgccaatcgtctcctgcgctttcagaagataacttgaggcacagtttccgattgggagatattacatgggttaagcacactggctcgtggtggccagcacaggtacgattgcatacatcttccgagctttaactttgaatgcacaaagtatcgttctttcataagatgatgagatattttcagtgaacggtgcattaggcaggctatattctaaatcgtaaaatattaatgttggctgggataatagattgacatttgtagatatatggaattggcatgaacttctttttgaagttcagatgatgcagaagctaagaagtggacttttgctgactgctactttgtccatgatcctagttttcccatgtgtatatttacactggttttgttttgtttttttttttcctctgaattcaaggtcgttgaaaattcatgtatcagcagcaagcctaagaagacggccaagcatcatgttccagttcgtttgtatggcacttgtgtacagtaagggatcttattaatgcgctatgccttcttttctttccatgatattctggtgacaaaagtttatttcttttactattttcagcatgtacgtagacccttggaagtctaacatggaattcaaaatggtatgcacaatatctatttataaggatactgatatattgtcattgctcccgtgccactcattgtagatttagaaagaaagtgcctctgacacagttgaccatgaattccataactcacagtcatcctccctttctcctttgatgttcccctcactttaaacctctcaagtaaaaaacttccaaattgaacaacttgactcccaactgcatttcaaactttgaaccataaaattcccaatattataaaccatggttcaaactttaaactatgaaaataaaacaaatttcaactgcaaataacaactttcaattaaacaacacaattgctttcaaatcaacactttgaatgcttcaggcatgacatcagatctaagggcagcggcagcacgtgctggatccgctagtagcagcatggcagtggagttaaaaaaatgtgccagatcaagtgtgagaatggagtgaatgggggagagaatgaagaagtgaaaggagattttcacatggtcgcaaataacttagctgcctctaaatcatagttggcctgttctaaatttctactccctctgacagatatccaaggcaaccatgatatcactaggtgctttcttggctggttgttggcttataagcaacagccagaatttgaattctagaacttaattttagagttgatttgggtttttgtaattgttttctatttttcagccttgtcttttggactgctaagaaagtaagaatagaaatataaaagtcttaccctaaaattatatttgattgcttcgtttattttcttcggcttaccaggttatcactgcagaatgataacataaaccagtttagaatggttataatacaactgcttgaaaaagctggtttgggctttcaaacttttaaaaaaatctgtgccatttatcttttctcttggaagaaaatgaatcatatcgatattcattttatatttcacatatgagctcatcgcatgcagatgctgaagcgagagaataaaagtgcaatggaagcattccatgaggccgttaagaaggtacgacagtcacctttgcataattgcatcacatatgttaagatgtaactatgtttagctgctgaaaacatcccataatgcaggagctgtcccacgttaattcaccttgcgattctactgaagaagctggcaacttgaaaggtgagtttctgtttttacctgaagatatatatcacatatacaagtttttttttactcagctttttagtggttatggataatgatttgatcattcgttcaatcccttattcgctctttattactagagaatttttgttcttctgccatccagaatttacccctcttgctactactgtcagttagactttgagtttgtaaaatgaccattccaaccctgcctcaaagctaaccgttgtagaccttctgtcagtgggagaaaatatctaggtggatgactggataactggatgacacagtgaggtttataaaactgatatatgggtcacattgtcagtaactcattgttgaggcatgttagtctttattggaatcgagaacatttgaacaagcagtagtggaaaacagaaaagagccatatggcgatactaacaatagatagagcagaatttggatgacagaagaaagaatagctattttactagtaaaaaataagaaattatatgtcaacaatgctctttttctgttaataaaatccttgcaatggtggtattaagaagtagtatggagcagcatcactttgaaggtaattgatatacatgatcttcaaagttcaaacatcacataatatcaaatattgctcaattggatatgacgaacataacatgcaaatgtactctttttctatgaaacaaaaggattttttttgcttggtgaaatgcaagcatgtataagtttaaaactgtcattaattttgatgatatcaagtgggttctacagacaacatgtcaatggcacattggtattatttcctgactcatgccatctatttagtattaatccatttgcccctaattttgcttctttactatgtacctaaatttattttcctgatggtgtgactgaattggacacagccaagacctcttccaagaaagtcagaaagcaaaagggcttaaaggaatcaccagcctctgagcatatgggagaggatacaaaagaccagcatagtgcagagcagcaccaagaacttggatatactgcaacaactggagttgccactcgtaaaggaagaagaacgcgagaaggtgcaagacaactcagtcctactgatggtgaagatcaagccagtggtaaaaaagcttctattgagggttcaagttataagacagaaaaacaagttggttctgtatatgatgaagaggcttgtaagatgacaacgacagagagatcagtgggtagaagggaaggactgagacgatctgcttgtacacccatgaaggcatatttagatccatcggaggatagaacatcacttttcagtgatacaagtgcaagtgaaggtgcaaatgaagtaaatagaacaccagagaattcaaatcagcatgaagatgattcaaccatagatggaactttggcttctcatgcagaaataagggttatggttagggatatactgttcagtgacattattgccaagcagcatgctgctgagatggcatatgtagatgaagtgatcaatggcatttgctgcgctagtgaattgaacataactggtgatcctacttctgttgcaaagggtggacgaggcatcaaacgaggtggtagtagggcagaggcggagtcaagttaacattacacagagatctagaaaagggagaatagatcaagcaagtagcaatggaaagaaaagagctaaggacacctcaaaaaccatgaatcatgacaacagtcccaactctttgagagggcctttcgatagtactgtaagtagattcccttgcccacgcccatacttctaaaccttactatctcaaatttcaacactaatttgaccaaaatccaccaaagcagggatgcagccatggaggaactggggcaagttagcgcgcgtcaaatcaggatcatgcagagtcttgctttgattgctccgtcaggatccccgtttggcaaaaatggactggttgcatcaaccagtttataattctgagttaattcgaatatccttgaaaggtattcgacagatattcgaaagctatcataactcatgaactcagcttcggttacacctaaccagttgctcgcttaggtcttttggagaaacccacaacgctacatggtcttctagaatgcaatgcgattgcctttatgtgtagtagaatcgactgaatttaattgcaatgtgagcacaacattgtatctgtaaggccacaaaatggtcccagtatactgccaactgaattcatacatgagtacactattattatgttagtactagtaccaagttaaggctcaattattctctttatcttaagatatcagaatgcgccaccgtttgaattgaggccccctattgcaatgttcgtagtgatttaaatagcaatgaaaaaactttaaaattaagttttaaaatttcaattttggcgatggttgatttcatacaaggggaactatggggcctgaaactttggtgccaataatgcattggcctactggtaaagttaaacagtgtatgtaacagcttgctacagcaaggttaccagtgttgaccattgcagaattgcaggttagagttaaacttgagcttggaggtgacgactttaaaccttggagcagtatttactcttgtctgccttggaggtgaccaacagaggactgatggatggactgaaaatcttctttctttgagaagttttaggtgccggtgaagaacgtcagagggactgtttcatcttcatgaagaacaatacgcatctgagagcctgtcggcattgacatgacgtcacgtctgcagatgattccttccctgaacgatcaagataaacaaggttccctgttggctgcatggcgattgtcagcccaggtctcctcccgagaacattccaagtgctcatcacctaacggcccgttgggttggagggagtttttaggagggattgagagtttagagggatgaggctattaactgtattgtttggttgggagacatgggaattttggtgggatagggatggggaattgaggaatgaactccctccttttcaatacctgggtagggggtgggaattgggagggaattcctcctttacttcgcctaaacaaatctcagccatccgttttcattaatgacctaatcttcaactaaactccctatcaatttccaccacctctatcaaacaagagactgggatgaaaaatcaaattcccatcttaatctcaccatcaattctctcgtgtaaactcctaatccccttccctcatgttgccaaacaagccgaagctctagaaaatgtatgcaaaattagggaaaaaaagtatggcataacccttaaagataaataaatgaacggagccatcacgatataagcgaaatgatatatttgcaaacgaaaagtaatttgtgaataaaatttttatatacgtgttcttagttatctaaaagcataggctgaaaaataaacttcaatgaaaaaacctcaaaattagctccaaatttaaggttgaaaatttaaattttggctgataaacataagcataagcgaaaatatgaggttagaaaatttgatccatattaagagaaaaaaaattatgtatagtgaagttttgatctcgtccacctttttcacaatgtgatgtgagaagagcttcatgcttaacaaaagagaatgaagaacaatgtgaatatatactagcagagctggatccagtgtgggtgccaccctacctcgctagatcaccattgatagaactagagagggaagggggaagaagagggagagaaggaagaggggaggggagggcactaaaggaggaggaaggagatgagtttctctctaattttattttggatccgtctttatacacgagcacatacatgaagatacatagtaacttctattggtagcatgttttacctatcaaggtctcgtttgaaatacatgcaactttttttttgacgtaatacctggaacctctttaatatcacacggcttaaactagctcttgtatgatccttcacaaatcagaactacaaaattaccgtgttccaaaggatgtcccaaagtatttcgaaatttgtagtaccaccacattaaattccaggaaaaaagctagattactcccaaagcacatttgttatgaatcacaaaacggggtgcgtttttatgagaaagatgtaagcctttgctgcctggacagggaagaagaaagaaagaaagggcaaaccaaaaaagtaaaaagtgagtgaaatggtctgcatacgcatcatgaagcttgacctgtcactgccttctctcctctgctttcgattgcgttttgtaaaccaaaggggtggtagtactgaagctgccgcgtcgcgaggggacacgccataaaggccacggttaacttgtcccttgtctcggtttaaccggagaggagagtgaggtcgccatggtgaaaaaaagctgcggcccatccggcatttctcctttttgtttgatattacaaggtagaatcacaggcgcacacaccactatacgcgcaacatcacactgacatcctataaatgtgtcccctaacacatgctataagatgtgaaaaccagctatatatttctgatcttactaaagttccgttgaaaaccaacatatacatgcttaatattcgtggagattttaacatagtagcagagtcatgtatcacttagtgcttccccggctccatccggcatttcactggagcgatgccggtgaaatggcaccagataaaaaggctcagctggagagagtttttttaccactgtttgggggtatgcaaagccctgtgccgcttgtcttcgacatcatgagtttccttcttactctctcagttttaaaatgtttgacaccgttgattttttaagcacatgtttgaccgtttgtcttattaaaaaaatttatgaaatatataaaaccatatgtgtacatgaaaatatatttaacaatgaatcaaatgatatgaaaagaataaataattaaaaagtcgacggtgtcaaatattttaaaacggagggattatatttgtgccagagaggcttcgaatgactacacacggccctgctgcatgaagcagtaggtatcgtcgtttgggtatcatgggcaaaaatagcggtagtgtgtgtaaaaaaaagtttgattcgtctttaattaggctgtgtttagattgatggtaaaaaattttaagtcacgtcaaatatacggacatacatttaaagtattaaacgtagtctaataacaaaataaattacagaatctatctgtaaactgcaagacgaatttattaagcctaattaatctatcattagcaaatatttattgtagcaccacattattaaattatggagcaattaggcttaaaagatttgtctcgcaatttacatgcaatctttgtaattaattttttagtctatatttaatacttcatgtaggtgttcaaacgttcgatgtaatagagtgaaaaattttagggtgggatctaaacagggccttagacttgttataaagttctgattgatggtagataaaaaataatttatgataattgtttgaatgcacgtacgaataaactaaatgatagaaagttgaaaaggttattttctaaaagttttcaaagaaatgctaatgaaatggagtattagaaagttgattaggagcttggaaagcatgccaacgataatccattatctgttactagttctaaagaataggccttaagtgggtgtagtggtctttattctttttctagtcgagtatttgacaatgcacaactgagtttatggacgatctaaaatatactgcttcagataaacttatgtatctacgttttccttcttccatcggtctacctcttcttttcttcatggccacttttgtagtctccggtaaggaacgattgtatgccgaaagcttctaaaccctggagcgatgagcatgttgcaatggcaacgtagtatagaatgggtgttctcatagcagcttggcacaatccaaccgatgtcaacatagatgagctcgcagtggttaatactacgggtccttcgaatcacaagaataaaaaaacagaaaaatagaaaaaaaatctaagaatctgacaggaatataagtgtaaagtagataattgcaaaccacagaaatctaataagagagatatattaaaatgaaaatttttcaaaatgttggagctctttctaagtttatttcaaattctataggcaatgaaccattccatacgaatttcataggatttggaaaaccccattcctttgtatctaaggagcaaaaaagaaaatttattgaatcctataaaattcaaagataccctacatggactagggacgaaaacagtcgaaaacgatatcattttcttgaaacgacattggtacggtcaggaaagtgagttgacacaaacaaattctatccaaatagcatgtctctaaatactaggtgttctaacagagggaaaatgatctaatagtataatgtggattgttttataaaattagtgacataccaatattactatactatgtagtaaaggccaaacttagacaaaaagtcatatttatattttatataacaaacattttattagataaatgaaattgtaccatacttctattgtgtgtaccatatccacatatttatttattgaaccgatgtacaggagtatactttgtgttaaaaaaatccaattttaaagattaatctagacacgtattgttagaatttgattttctttttatagagggagtaaggtttaaggggactgcctcattcatcttttttttttaacaaatgactgttgactgcccctatcgtgataaacatccatgagaaggacttaattaactacggtgcactgttgggataaaatccatggatcggccgacgcgcgcttttgaccgagggcagccgacaaataacgttcaaaggagggtccggtaaagaggagggcatccccagcaggaattctgatgaaaatccccattccccaaaggctgccatcccctgacacctccctccgatcatcccagcctccatgtccctcccctgtccccccccccccccccccttcttcctctttggttgcgtcttgcgtcgcccaacccaatccacccctaaagattaatttagagttaacataaagcttaatttagggcatgtttagatacactggtaaaattttcaccctatcacatcaaatatctggacgcatgtattgagcattaaatataaatgaaaaaaataactaattatatagtttgcgtgtaaattacgagacaaatcttttaagcctaattgcttcatgatttgacaatgtggtactacagtaaacatttactaatgatggattaattagacttaataaatttatctcgcggttttttggcggaatctgtaatttgttttgttattagactacgtttaatactttaaatgtatatccgtatatcttatgtgacaaccaaatctaaaaaattttctccaactaaacaaggcgatagcatctataatttgcttggaagcatatgtataattagttcttttatattcttatataagagctaacatttatcattttcattttttttctctcctccacctgagtatatatagttatcttatagcctacttcctctatctaaaataggattttggacggataggacatttcacatgaattctctaaaatatctcatccgtccaaaatttcttatattttaggaaggatggagtcctattaaacttaatcttacatactcttttcaacttggtaactgagtatatatgaagttgtttagatttacatcatttcaaaccataccatttttaagtacaattgccaaatatgagcatcaatttagtttattgccaaactttactaaatacataagaaatcttaccagaatttggaaagttatattttggatacaatctgaaccttctctttatttcaaaataaatatagctgtgcagttaaaatttaaactaaataactaagcccgagtttagtttcaaactttttcttcaaactttcaacttttccatcacatcaaaactttcccacacatataaatttataatttttccatcacatcgttttaatttcaacaaaatttctaattttgacgtgaactaaaaacagcctaaccttaaccttattttggttgtgtttagttcagcgcaaaatttagattttggttgaaattggagatgatgtgactgaaaaattatgtgtatatgacaggttgatgtgatggaaaaagactgaactttgtatcaaactttaaatctaaacacagcctttgaaacggaggcagcacacatcggtcgttcgatccgccaagtgaaacgcgccaaaacagccgtcgtcccgaccaaaagagtagcttcccgtgtcggcgccccccgcccccccgtatacatatacccctcccgccctctttcccgcctcctctcttttaaaccccacgacaaccacctcgcttgccattctggactgcgggtgagatcgatggtgacggacggggagtgctcggcggcggcggtgaggaagggtgggtcgccggcggtgcggagccacagcgaggcggagcggaagcggcggcagcgcatcaacgcccacctcgccacgctccgcaccctcgtcccctccgcctcccgggtacgtacgagatcgagacatccacgacgcccacgatggcgtgtgtgcgtgcgtgcgtgcgtctgacgaggttggtgtgcgtgcgtgcgtgcagatggacaaggcggcgctgctgggggaggtggtgcggcacgtgcgggagctgcggtgcagggcggacgacgccacggagggcgccgacgtcgtcgtccccggggaaggcgacgaggtcggcgtcgaggacgaggacgacgacgagggcgagcgcgacgaggggtgttatgtcgtcggcgg

SEQ ID NO: 2695 - DNA, 20247 bp, Oryza sativa
tccgccctccgcgccgccctccgcaccgtgcttctcaaccgcgaggagctcctcgccgccgccgccgccgccgccaccgacggctacaagcggccacgcttctcgccgaggtgtagcagcctaacctaagcttcgctactactcgccgtacgtacgtacgcggcaaaacgaatctaagctaagctaggggaacaatgcgatgctgatacactactaccggtttcgtgtcacaactagcttggtgtttttttgtttgtttgtattccctccatctcaatatataagagatttcgaagtaatacgatatatcctctgtttcatattataagattttctagcattatccacgttctcatatatatatatatatatatatatatatatatatatatgaatgaatgaatgtggttaatatgttagaaagtcttataacctgaaacggagggagcagtattataaatctggacaaattttctttctagattcgtaatactaatatgtatcatattcttctaaaatctcttatattatgtaacggaggggtactgcgtgtcatttttccttgctgcttgcctgcatggtactagtaggctggtaattgtacttggcaaccagtatcgtcacgtagactttgtcaggtatactgttgcacggttgcagtgttgcgaagttgcaacagtggagatgtgtggcactggtgcactttttgtccaccagtacttcagtagtttcagtattggctctactgcagatcacatgaatcccttcgtgttttgccggcagtaggggccagtgtgctgtacttctacaagtctacaacacgacagggcttgctcctgctgctccggagttaatacatgcaggaaatgaaatagtagaagcaaaggtctaaatgcagggcttagttcacattcatttcaaaccatgtcattttctagtaaaattatcgaatatgttcatccatttagtttcttaacaaactctggtaaataaataagaaattaatcttgccaaaacttgcaatattaccaaattgcaaaaattttagcattgataaggtttattttagctacaatctgaacatgcccgcaatgttgcaactgcacgtgcaaagtcgtggtatctgatagaaattgaatgttgaggaatcattacagctccccctctaagtaatttttagaagcagagagacaatttcactctatattatctaggatcctgaaagcatttggatactccatcccaatttcaagattttcgagattttcccaaaataatcatctaacaaagtatctcttggtttatttgtgctaaaagtaaatgtgtatcatggaatgtcctgcatgcacgcgtgcaaccaatcaattaatttatattggtttaatccatgcaacatttaaagtgtgaattaattttcgttgaacacaaagtgacggagcaccttgatcaatgaggattaattccttggtcttgatgtcatttgcttagaggatgatcaaattgggatggagagaatattatttaggatctaaaagtgtttggtacagcatcaattctacaggataaaaatagcgagtaaggatctcgaagaatattatttaggatctaaaagtgtttggtacagcatcaattctacaggataaaaatagcgagtaaggatctcgaaagcgtttggtacagttccaacttcacgggacaaagaatatcggggtaggagatgtatcaaaatgtcattggaatggtttaagtggaagcccagaacattgctggcaccatttctcttcgtttctctatgtatgacgtttagcttgaagtctactgttaatcttccacatagcacccagttgaaccaaaccagaagagccccttaggaaatgcatggacttgccagacttgtgatgagcattgcagagagctcgaaaagttcagaatgaagaaaggcatatataccaagaaggcgagaacttatgactatcccacacctaacgagtgaacaatgtggccaaaatgatgctgggatgtctaaactcagaagttcagaacaaacccaactaccctgccagactgccacaccatcagttcaagccagaattttcctaacccccctgacgaacaacatctcgagataattggtgccaccaattccaccaaagttcagagccttttatattggatggtgaacaaccaaaccaaggccagggacttcaatagctaaagcacacagatcaactaccaataagaccattgctctggcttacctgatcacagattgctataagtagctccagcatcaactcctagcttcacagcctcacaagcatcacctcacatcaaaagaaacacagtagccttccagaacacacaaaaacaacagtcacttaccatggcttcttctggttgtcatcttctggttctgctcctggccttctcagccttccattgcagctacgcagctcgtcatcttttggacacagcagctgcagctgcagcaccagaggcagccccagctcagccctccatgccaacagttccaaccacgctgcctccgataccttccatacctgcagtccccaagctgacagtgcccccaatgccatctgttcctatcccaaaggttaccattcccccaacagccgctggcacaattccatctcttccaattccggccattccgaccaccataccaaccattcctacagttcctgttaccctgccaccaatgccctcaatcccaaccactattccatccattcccaccacaatcccgacgacgatccctaccattcccgggttccagatgccaccaatcccattcatgtcctcacctcccaaaaccactagcccctgaagttcttcaagaggatgagactgatattcatggttactagtcagggatttggttaggcatatgttgccatcatatcagtgtgtacatttatttgtgttctgttattggagttatactggcttgcattggtgtgattgtaaatgcagctaggcagttgtactatcatgtttgtgaataaatcatttcttggtttgcataacataccgcacaggatataagcttttttattgttctttacacgatcacatacagcgacagagaagaatgtgacacctactattacaaggctttcttctatttgacagaattttagcatggttttagcaatttaacatagtacatcaggaggaagcagacagacaggtgtgcttcttggtcctgtctctgcttaaaagtggcttgatataaactgtttgcataaattttctaagcataatctactgataaggaaaaagctttactaaatgtaagcagtgatttgtctcaattaattcttcagcaactcttcaagtcacacaagataatgaagatatacacatgtatcattgcaacaagataatcttctaacgatattgtaaagaaagaggaagaaacaatgcatgaagccataaattgcaagaaaagaattacgcatcaaaataacacagctgaatcaaaagatcagccaaattaatgtcaatttggtcataaagatcatggagaagttatcataacatctctttcaacatatcaatgctacaagagtataatactaagacgttattattggtaacttacaatagatggtagacaggatgagaaactaatatatatgtatgtttggaggatcaataatctcagtagaacatgattctgccgtttacattggggaactccaatctgaagttgctgctaagaactatcgtcgagtcaaaggctgaatatttcaggggtagtagtagtgcctataagttaaataaataataagccaaatatattaaagatcagatgacaaggaaaaaaaatatcaaaacagggaaaaaggtaaagaaaaatatttgtactatatgtgatatggaatatcttagtacttacactggttaacagaggctgcagtaggcacaacctgaacattgaatctgcatggtcacacttaaccctatgattccacttataggagtagttctattttcctgctgcaggctgaatttactgcattcccaagattctcaattttttcatattccaatttgaacatgaccataacagtaccatctttcccagtgtcatagtcctgtttgatatcttcagcttggtaatgttgcaactgtttcaaggttcaacgcagtcataattaggctgcagaaagaaggataaaaaagtctctgaaagaaatgcacattcagttgtactgttttttttacagaaaatggaaccgcttaagccactaatcatcacctgatgatagactgttcccaagagatcaaatggtacctccatacccacacgagcctaaagtgaagtcagaaattaaataataattataccaagtccatgcttcatacgtagttgcaatgaccaagaaaatgcttatgcaaaagaattagatattatcacctttggttttacaagacaagtaggagcatcttttaggcattcagaagcaaccccaccataagctctcaccagcccaccagttcctaattttatgcctccaaagtatctatacaatgtatagcatcataatatgatggaaagtatcaaatagtcacaaaccatctgtctagccaaaagttgtagttaatgtacacatatatctgtcagttagtgacagtattatctctgctcaagttgaggtacttaattcagtagaacactaaatagcaacaaaagggtgggtcacaattttaaaattacatgaaatggtttgcttaacaaatcggttacctgattaccaccaccatgaccatatcaatgccagatgaaataatggcagagtatattggctttccagcggtgcttgaaggttcaccatcatcattgtaacggaattgctctcccagctaaatagacatgtataaaagaccaatctttcatcaacaaacattactacatgagcatgaattgttgtacgattcaggtatatgtacaaaccttatacgcccagcaattatgggttgcacggggatcactgacctgttacaaaagagactcataaatttaatcgataatataccacacaaaaaaaattgtaaaaccaattttcacatggatgagttttctggaagccgaaggtaaatggaccaatattatgtgtacacatacaactgcaaacttaacctcacataaacaacttgtgaaacgctaaacgaaatacctgcaaatcctagatgaagtttatatcattcgaaatagcacgcattcaacttagctaatgagcgaacccttcagctaggtatggacactaaaactaaaggatgatggattagtactttacagtgcagactacactgaaaaactatcgagttcccctatagaacaattgtctgctctcccttcaaagaaaaaattggcgattgttggctgccacatagtcggacaagagttccctgtggctcaaggttaagacttaagacttgcccgatttggggcgtcggtgagggagatgataatagcgcgcgtggagggggacgcacctcgttgaggaaggacatggcggcgcgctcgtcggggacgggggcggcgatggcgatgaacttgctcttcttgatctcgcgctcgcagctcacgcgacccacgagcgtcgtgtacggggagggggagacggaggaggaggaggacgacgacgacatggcgcgcaggcgggcaggcgccaacgcggccaagctaccgccacaggaggagcagctgcggtggacggcggcggcggtggcggcggcgtctggtccggggagcaggagcgggagagagcggaggcgtggggcaatgcgcacggccgccatggatgggtggaaaccgtgggtgcgcgcaccggttccgtgtagccacggagatgctgctggtcgctctgacaggtgggcccagattgtcagagcggactcgccctatgacaggtggggctcacgtgaacagagggcgaaatactacactcgacaaacaaaccatctacataaatacacaaattatctcggcattatagagatcaacataatctttcaacaattgatcatctttattcatgtagaacggagatgaacacaaaaacaataaaacataaacttcttaagggtcaaccctctagaaaatgaagaggtccaacacaagcaaattcagttggaactgcagcacggacgacatggtagaatcagtttgggagtttaaacaggccccatccacatggtatggaaaccaccattgttgcgatagtggattcccctatacatacactctgggacacaagacaaaattattaactcttccaagaaagggaaacaaagagttcctccactcttcagtagccccagttgtcgttacggatttcatcatcgaacttctgcttgacctcaggatgctttgcaaagtattcatctgctgtcattgtgctgatatttttctgtatacgtgaacaagtatatgttaaagcaaatggaaaaatgctcttaataatggatgcatgcacaaccaatctctgacaaatggactgcaatatacaagtttcgccagagatcatcctcaccttcatctcctgcaattcagcaagctccttctctatcctctctgactccttcagagactccttttctgcttctttcagctcaacaagctgcatatgacgtgataaaagagaaaaggataaaaggtgcatcagtatctaaagggtacagaaggataacctgttgaagcaagatgagagaaagacgggcacatataacagaatgatagttccagacaagggtgatagacttatagttcctcaccagcgcatcaaactttggcttgtactgaggagtcacggtgtcaacgtacttggggatttcaatgcctgcatttatttcatgcttagtatcttcactacaagtaggcggaacaaactatataaaccagaagaattaagcaaaagtaatacttgcatggggtcaattgcaaattcaaagtgtaaggttgatgtgatcagcattttactaatattccaacaataaatttgccttttcccatccggaaaagggcatgtgaaataacacatactaccttctattgactaaatcacagagaagaacatgcatttctgagcatattacagtgccacaaaaagcattaacatttggatttacaaaacaacttgttcctttgaaataaaaaggtacagccaattagaatcattaacatggtaggtagtatgtgctaattgcatgtcagcaacatggtacgaagatatcgtattgattgacattagaaggaactgaaaacagcatatacatattactgatatgatctgaaagattcaaaggtctatacacaagagcgacaacaagaaaaggcataacaaggtcattgaccagaaaattagcacacgctaagagacaaccaagagaatcaacccacataatcatcaaacaacaatatcaactagaaagaacatatttgccacttcccacgccttatgaaatattgaaatatgttgatgtgattatagaatcatattccaataatagattagaaaaaaaaaatcaatattgtcaaacactatttctgagcattaagtttgtaacatcactgtagaacaatggtacaaagacacactaacgtttgtgcaaagaaaagcacactcaaatttaaccctacttccttgaaagacgggatatgtttgaagagtaaggccgtgtttagttccacgccaaaattggaagtttgaagaaattggaacgatgtgacgaaaaagttggaagtttgtgtgtgtaggaaagttcgatgtgacggaaaaattggaagtttgaagaaaaaagttggaatctaaacagggcctaaaatgcttactttcataagcttccttgtacatatctacaactttagacccaattccttttctgtagtactcccagtcaatcggttggggctcctgcagtgtcaaaagagagaaacttttagaaacataatacgggacctcagaaattaacagcattgagaaaacgcatgctgcaaatcaagagaaaatgcatgcatccaagagttctagattcttccaggcatttttcaaggtaaaagtaccaaaggaacatgacggcatcaatttgacaagacaaaggatcattttaattcaaaccatattaatcttattagccacaaagacaatacagatccttggtgatcgaacgtagtctgtagactataataaaaatccaaacgcgcaaacgcggtgaacggaataaagatgtccataattaacaacgttcttatgctgatgatcgtaagcaccaacgatgtgagaatgttggcataacgacgactacatttgtatgggttaacctatctccgatgtatattggtaaagtccaaatctaactgaatatcaacatgccaacaaaattattacaacgcacacgaatacagaatatacccaactaaatggatcgattccactaacatctcaccatgggatcttcgcattcaatacaagatcagaaggatcggatacgggaggatgccccccagatccggaaaccctaggtccgatccggcggcggcgggtgtggggtgggggggggggtggtgaaaacctgagagaacttggtctggagctggtggttgacgtcctcgaaggtgcggcggagggtgttgaactccttgcgcgcctcgtcggagacgagcatcttggccatcccctcccagtcgatcgccttcccggccttcgcggccacctccgccaccttcttcacgccgttcccgctcatcttcctccgccctcctctccctttcctctctacctcgacctctctctctcccccctcgttcgccgccgccgccgccgctgcagtgagctccgaccacacgggagagagaaatagggagatcgagccacgggatggggatttgcctggcctctctgccgctcgcgtggggtatactagttggcgactcctagtgggcctcgcaacgaattcccttgggccgtcggcccatttctacccactacgggccttcgtgggctgtaacacagaccacgtagggactatttgtcaacaaattttcttagacaattttgctatatatttatcgacaaatctccccccccccaaattttgacagatgtaattatagtacaatcataatgtaattactgtaacttacatataattacactgtaactataatgtaacttgtatgtaactttcaaaaacctctccataacatgttatttcagtaaaatagaggtcgtggaaacaaattctttcacatatgtgtgtgctgtgatttgttttcttcctcaccaaaataaatcttgtaatagatcttacatacaagttacactgtagttacatgcaagttacagtgtaattacactacgattatactgtaattacatctgtcaaatttttagcagaaaatttgtcgacaaatgtataggtggtcgtatgtaattatgatacaatttgtatataactttcaaaatcatatgataacacgctattttcatgaagcggagatcgcgacatcactcacgtacgtacgcttgatctttttttctttccaacttgcatgaatcttgtactccctccgtcccagaatataacaagttttaaggttagacacggttattaataaagtatgtagaagtgcggttattaataaagtatgtagaagtgagtggtggagggttgtgattggatgagtagtggaggtaggtagtaaaagtaaatggcggaggttgtgattggttaggaagagaatgttgttggagaagttgttataatttaggacaaatcgtgaatgttaaaagttgttatattttgagacggagggagtagtaaatctattgatttagaattatgtgaaagttttatatagtagccacaaatactttagttatatttgataatttcttagaaaaaatttatcgataaacataaagcaaaatcagcccgcataccgctgaacccgttctgaacatcacaattcacatgtggtagttttctcgaggagaaaccagtaaaaaaaaatcatcacatactcacagcgtgatgctgaagagatcactcgggattatcaactcttttccaccacggatcagagacaggtaaaaatgagtacatcggtgcatggagctgtgggctgtgggcggtcatactactccagcatggaagagataaagaagtgaagaagtactacgagataataaagagagatggatgtaactgacgagctaactgatgaactggtgtcgcggtacgcttggaaagcagagaaagcgagcggtgcatcggcttgagaaaagcagagaaagcgcggtagggagaggcgagaccaccgcaggttgctgtcctctcctctccaagtacaggcgaactggaactacgtgcagaaatcggagatgcagtcgccgtcgcagcaacgaaaccgccggtatacacgtacgtaccgatggtgatctgcgtcgtcgtcggagactagcgcttttgcccaggaatctgatcaacaaatttttttttaactatatcttacttattttcactatgtgcacacctctcaatataaaattagacactcatatcagcttaaactcgatgtaaagtagactaaattaagcaagtacatctctctatatttcgttatagctccacacctgctggtcctccaactccaaccaccatggcggcagaggagatggacgcggagcagcagcgttgtagcggcatgcaggtgagtggggacgagggtatcttggtggtgtactcacaggcgttggccggcctgcagagttggttgtgtacttgcgctggtgaatggtgatcaccggctaatggatgggaagaaagtctattcgtcccatgaaagagatgtactttagttctaaagaaaaaaagaatgcgtaattcatagaaagtctattcgtcccatgaaagagatgtactttttttcaatgtcatctaaatctttaaaatataagttcaaacttaattaatacaagtaaaaacaaatataacaaatctgacaaaaagaattcgtaattcatagacatttttttaaaaaaaaatttatataggtactagaattctccaaatctcgtgaaatgacattataaattaatctatcttaccttttttataagaaaaaaagatgattttttagactataagtaaaataaaacgagaagacattctctctagcgacaaaaatccataccatggatgaaaagcaactcagctagtactctgtgagctggagtgaataaagtgaaggccttcggtccctaagtttgttagtactaatcagttgtctgagatttgaagaattctactataggctttttgacctcaatatccaacagttgcatgaggagatggtcgaattaggtcatcatggtaaagggtaggattgacagggtgtgaggtgaggtggggtggatagtgtaggggtgtgtcgggagagttcgttgtgcaaatggcagagagctagtatatactttctccattccaaaatatatgggattttatacggatgtgatactttctaatataataaaaccgtccaaaatccattatattttgggacaaagaaagtacatagcaagcacctcggccaccaaggaaattagaaagacagtgaacggcgataacaaggctgagataacggcggtgtcgtctggatcatatgaaaggaaggagagcgatgagcagcagagaaatgagattgcatatatgatcataattataataaagaatataaatagctagcgagacttacgtcgtgttttaggcatattttcaaaattttctcgtcttcagtgagtactatttctaaactgataaatagtatgctccatgaaaaaaaattccatatcaaaatttcttttaaaaatcaaaaacaaacttattgccaccaaacatcacgtcctaacagcttacttctattttggattagttagcagtgttgctaaatgaatgtccgatggtaaaacactcataaaatctggttagcaaggttaaattatccacaccttggaataaaatctggttggtcgttggttatagagtttccattggtactttcgcggcctaataagtgttacactatgtttagttagccaacagtataaaagcccctaataaatgtaggattttatattgggttgcacagagcaatggcaattaaatcaatccacattactccctccatctacttttgatagtcatatttctaaatctgaaaattttatttgataggcatatttcaatccaacaacctatcatcttattgattttcttgaatttaatacgtgactctccattcttccacacatgattggctacatgggctttgagaaatataaatattaatgaatcgcttgtttatgaggaataactagtagcatatttaaatggatgataagtagaattacttatccttggtctatgtgtcaagatgaaatatgactatcaaaagtagatggagggagtactatatactactccctccatttcaaaatataagacataaccagccctaacccaaataccaagagaataattattatcatcttatagattagatcatcctaataaatacaatacatgcatccaatagaatattagagaacatgagagtggaggatttaaaaaagtaataatttagttagtggaaaaaaatttggtggaggaggggtgcagcgggcctgctgtgcagccctgatctggatgaacgacacgtggcccagctaccgatccaacgagagcgcgcgtagggcctccagcacaagtctcggctggctcccttcggctgagaatcgatcggctcccgtcccggctccctccgcgctcatgcttccctcgatgcgccagctcggctaaagtatatccctcccttatttctcgaagtctcgatgcgcctgctcatctaccgccgctgcccgcgtgttcccctctgcttctctcatagcagcgagcgccggcggcggcggcgagcggccgtgccgtgccgcgtatgtgtcgtctggacaacaagtctgattctgataggtacgtcatctctctagaaatcagaaccaccaccagcgtctgcagatccagattatttgctctcacctgaaactacagctgcaatctctgtttcgtttctgacaataattcagcagcagagcaatgttcaatacttatgtatatttattttccaatggtatctcccgggtgctttcctcccgctgaagaagcacaagacagcaaacaactgaacatatatataactcttgctgtaaactaatgtacgcatacatttcgaaatcacttccctaaaaatggaagaacatagttttgaaattgtttcctaaaccttggactagcggattaaattgctcattttcttgcaggttcttctcctggattggactgatggattagaatcagtaagatgcatattgtggattgagctcaaacctcatttttttatcatggtggttctgtattttctgtgcaaaatataaaggaggaaaatgctcagcctgaaaggactttaattgccacaagaggatggttttcaaaggactgtagtttaatatgcaggctttgtaatatgtactatgtaatctgcgaaatgttaacagtttgtaaggattgtagttgaaatcatacaagctgcaatgtaattgcaaggaaattcatccgtttgtaatctgtacaatttttgtaaatctgaaatacacatggcagttgataactaaagttatataattatattagcacaatataagaaatattatgattgtcatgatcatggtcatcctctacatataggtgaacatcatccatcatcaaacaatgctgattgaaaaacatgataattaaagaactagacgatattacctgcattatccgctcgccgccggctccaacatccccggtgatttcgacgtccatgggcgcaggtgattgaaatccatgtccttccatgccatgtgctagggcaggtgaaaacaacacgagatgagatgtcccggcagctgcagggtcctcctcctgcccttctcctgccatggaagctgatgcagctgcgttgcccgtggagacttgtcctgccatggctgctgcagtgctgcggttgccggcgatttttgccgtgatcttgaggcgcaggatgagacgtctcactccacgtccgcgtgatccaggggcacgcgataggagctttccaatttccacacccacgagccgatcgagcgcgtgcggtgatggcagacgaacaggcgcatcgagagaagcgtgaccgcggggaacaggatcctctgacgtagatctacgtcagagggacgtccgacgccgctacaccccttgatcggcatcggatggaggtgaataagcacggtagattaactggcttcttttctgctcacgctgacaaaatcgaacagtttactcgctcgcagggacgtcggccggcgcggagaacgacggcgtcatggcgacgttcagcgcctcgtcgtcgcgcgtgcaggtgcgtgtggccaggaacatcagtgcgtacgccgccctggagcgcatcgccaccgcctgcgccagccggagtgcgtgcctcgggggatggcgaaataaatcccggccggttgtggcccgccggagacgtagtcaacgtggccatgcagcacccatcccggcagcaaggccctccgtacgatcaccatgtcgttcaacttgcaggggctcatcgcaaatgccattcactagcacgctggcatgtatccaagctcaaagcacaaccatgatgtcgattctggcaagaagagtaagattcagcagtgctccgtctgagcgtgagctcgaggaggcagctagccatggcccatgcaaggttcggccagaagcgctgaccccagcgacaggaggtcggcgcaggcgaaccacacactcaacacggacggctccgccgcaggatgctgcgtgctgcgggcctgcggcaccgtcgacgaagaactcggcggcatatgacgagagaagcggccgccggccaggagcgagcctttccgttttcgtgggttgatttgtcagcgtgggccgaaaagaagctagttggtgtgctgtgcttgtttacctccgttcgataccgatccagcggcgtagcggcatcggacgtccctctgacgtagattgctctacgtcagaggatcctgttccgagaacggagggagccgggacaggagccgattgattctcagccgaagggagccagccgagacttgtgctagaggccctacgcgcgctctcgttggatcggtagctgggccacgtgtcgctcatccagattggggttgcacagcaggcccgctgcacccctcctccaaatttttttccttagttaatggcctatatgcatgcatgccttatattatggaacatcttaaaaaagtggttgtgccttatattatggaatggagggagtactactagaaccagaataggataataattctaaatttatatccatgtaattttggcccttttgtcaatcagaatcatggtcagaacaagcttgttttttctgtggattataattcaaaacgattttaaaattaaaagtttggtgttcaacaataactttggatgaattttatatgtcctcataaccatcataaaaatgagttgggaaatgaagtgaccataataccccgaaattaatctaattaaaatataaaaattgaaaatacttttgccgatactttgttacgtcgtatgtatttgagtcgatttttaaattcgttcgcatttgaaaatatataaggagtcgtataaaatatccttttaaaaaaatcacatactaaattgggacgagagtcggactcctaattgcttcagaatttttttcaagccataagaaagcaacatatagaatatgaccatcatccgaataagagttccgaattagataacaatactatcaaaataaaattctcatatatacttttcaaaaaaaaaatctaacaataatacgattaaaatagtcttcaccctttgcaacgcacgagcaatttttttagtctaaaattcaaaatcagttccaaattagttttcagctgtccaagcaacaaatagtagaaaatataaacacattccaaattttcgatctcaccagacattgagtcgtcaacccttcgtgaggtaaacagcaaagttaaaaaccctaatgacttttactagtgagccaacatcaattaactagatatattttgatactctatgcaactttgcaagaagatcaaagggattgccttggccttgcatgtcatcacgcaagcactgcatcactagcttcgatttagctattggtacggcggccgtggccgtggtgcgctcgccgccgccgccgccgccggcggcggccatacctcttcatgctggcacgctgacgcgtacacaggttgagtcgtcgtcgtcgtcgtcgccgtcgccagagctatgccgcgcggatgcagcggtgtcaagtgatggtgctccggtggctccgttcggcgccgcccgcggtgttcgtcagcgtcggcgccgctgccggagacgggcgccggcgcgtcgtcgtattccgcggggaggcggtggaacgtggggctggcgaacgcggcggcgcaactacgacggtggtggcggcgacgagcgggcccgccacggcgcctccgaagatctggccgtgtggccccgcgagagatatcgagaggccgccgagcgcggcgcgtggcgccgccgcggccatggcgggcgggaggaacgtcgccgatatggagaggatctcgtaccggccgtggaacacgaccacggcggcggcggcgccgccgccgatctccgccgcggcgccggaaggcaacgggtggcggagcgagacgttggcgacggcgcccgtcccggcgagcacgcagatcccgaggccacggcggcgcgcgtaccccgcgagcgcgccggcgacgtccccgccgcccgggatctccagcacgtgcgaccgcatcgccgccgccgccgccggctcggccgccgccgcctcacgcgtgacgaccaccggcggcttcggcttgttcttggaccccggcggccgccccctcctcctcttacccaccaccaccaccgcagcaacaccctcgccgccgccgcccgccgtcgtctcctccgccgcgccaccaccaccatcacggctgtccacctcgtcagagaagcactccagctgctgcttcttctcgcccatggcgccgccgccgacgacgagcttgccatcgccttctcctcctcccagctgactcctcctctccatacctccctcacaagcagcagctagctactccagcttggagtgtgagtgcaacaatagctaagctaggaggagggtccctggctgctttaccctaccgggagagatttcttgccgggagagggagcacggtgaggtgtaagtgtaagtgaagcaaagctggagagaggagagacaggaggacaggattagccactggatccggagagaaaaggacatggagctcattacctagctaataatgccatactccggagcctcaggtagctgcagtttatttccaatctctcctgctgctgaaatagtatagattttcattgacattttaaaaatctgtagctgtaaaatttagaaaataaattgactagaaacccaaagttgataacctagttttttcatattcttactagaattctagagctcctccaacaaagatggataataagattaagtgggtacgcaaaacaagaaagttattagcatataatcaattaaatttttattattataaacttgaaaactggatttatttgatattttagagtaacttctatatagaaaacttttatacaaaatataccgtttagcatttttaaaagcatgttaatagaatcacatcttacctgtgatgccataagtagggcccttccattttcctttgatctcctttcatctttacccctttcaccgtctcctcctcctcctccaactgacatgatgcatggccggtgtgtgtacgctatccagcatccacccaccggccggccgccgcaccctttgacggcacggcagcgacacacacgcacagccgcgaatccgccgccacctctcacgctagctttttcatgtgccgacgccgcgacgcgagcgagagatctgaacatatgcatgctagtacaactgcgcgttttgaatgttgtagtagctagaactgtcaattatgtggaggatattttggagggcactctaaaaccgatcgagctatattggttgataagattgacagggacgtttgcaatttggacgaccaatatataatcaagcacgtgatataaacactttggctggctaacgtgataggcccaagcgatggacctgatatgatccatccacctgtagctggcttatccaatcttggtcctactccatctcttatttgtgggtttatgcgttcaacatttgactgttcatcttatttaaaaaattataaacaaaatcacacataaaatattattcatatttatcatctaatgataaaaaaatattgatcataaaaaaatttaaataaaatgggcgactaaatattaaacatagaaaccgacaaataaatttatcttgagacagacggtgtacttggcccgtggaataggatggagttaatgttgttcgctttttaagggaaagaatccaaagctagccgcactctgctatcaatcggtctctatccgttatcgacccgtacgtatctctggaacgcgacgtacaacatgtcaagggtgtagtagtacttgcagtcttgaataattcattcacatgttcgtacctagcacgccgacacatcaagtaaaaacagaatttgaggaagtgctggttcctgatgcctacttcctccgttgtaaagttcatatttaatccttgaagtacaaattaagatagagcaaaaacgaccaaaatactcttcattgatggagaaaatagtattgatgattgagtatgtaagggtattgaagtaatattttttttatttgtggataaccttattttggaacaaacagtataatctaaaaatgaacttatttatgaacgaagagagtacttctataggcaaaacaaaatcaatatgtgaatagaagcgttaaaataaattccctctagttatataattcttatcattttgaacattaaggttgactatcagtaatgtccaaaaatatagtttaaaggcactagaacaacgtatacatattagtcttcgaaagcactttaataaaattgattatttatttatttattatatttatattataaaattatattcaaagggtgtgttctaaagtgagttttcagacggatgattagtcgcacgtaaacaagaaacatgattagtatatgattaattgagtaaaaacttaaaaaatagatttatttgttttctgaaagcaatttctagataaaaagttttcacacgtaacatgccatttaatagattgaaaaacatgctaatgaagatcgagaaactaagtttagggtgcccaaatggagtttagaacgcacccaaaagatatgttttgcataatgtacgtgtcattgtttagaatgatataaactatagaaccggagggagtaatcaacttatggatgaactgatatgtgtgcatgtatgctctcaatataatgcttcagcttagtagtcagaccacatgcaattatatgtgcgtggctttgaaattaagtagggtggaattagctgcaaagtggttgctcctccagtacgtcctcctgttgtcttggttagaattcgtggtggctttggtggatcagatagagacgctacaatctacatcgacagctctggttttgacctggcaggcaaggcacagcacgtatggacggagacggaatatggtatggtatcatccatgcgcatccccttcggagaagaaattggttgctgagccctatttcttttccaacaaacggaatgatagctgaatacttcgtgtttcttttttttaaaaaaaacattcttatatataacacttttaaaaaaactattttaattttattttttaactataatatttaatttattcggttgtacccttaaataattatcgtaagtcgctcagctatttagctacctagccaaacaccctaaactttacacaagaatctggatttccatgtcatagcaatatagcatacacagcatc

SEQ ID NO: 2696 - DNA, 2081 bp, Oryza sativa
attcctgcagccttatacctctacaacccaaaccctccacatgtcaataaaatgtttgggccgtcctttccctagccgatctcctcaataaaacactattggcttctccaggatcatgctcagtcccatctaacctcctcctatattgttctgttaacttactactaaattgatgtttactttggttagtatacaaggaagaactttcatcgccctgattccaaccctccctggcaccctgaagcctgtgctcgtcaggcctatactgatccacctcttgacccgatgaactggtacccaagctagactttgatcgggaataagtcatacggccgttttccccatgtccgaacatagagccatcaaagtatgaaacttgatcaccaaatatgaggcgttccatatcctcactggtagagtttctagtgctttcactgctgtcggtgctatgtgaccctgtgtcggaactggtgaaaattgatgaactctcacttggactaggagattctgctggcgaatatggtccatgtccaaactcgtcatatgtatggggcaaatcatctgtcatgtgatctgcgtacatctgaccaccttggtgtatgggacctcctccatgccaccgtcctgaatttacccttgccttgtccttctttacacgtgctggatcttgagccatcagcgctggccttacagagcttggagctcttggtgaacacctgaaatggttgacaaaggatttatatatgtcctgataaagatccaggcaagcacagacaagtaattgccagtgtctgctattcatgagaacttctcttttttccgctccttgaaacaagtggcaaaaagaaaaataacaaaaaggatcttctctctaatgaaacaagagaatctaccttgcatagagcagcatgtatgcgcacttcgacatgacattttccagagatacaggtttgacctgaacaaagcaatttaccctccagttagaacaaaacaatggtgcagtgccttttgaagtcgcgtattctgttcagtatgctttcactaacacatagattatcctcagtaagtagtactctcatagctaaagattattcattacttaaaataggaaaacaaggctccggaagatccaggaatgaacataatcggctttactaaatagtgttttaccagtgataaaacattgggcaggtataggcaaaaacatggtgaaagagcttgtttacctgactgtcatctgttttgtaccacttcccatgcgtgtccttcacatagcatacataatgaccagaaaaggcggcattcataatatcatgatggacaaccactgcatacaggctgtaaacaggggaagtgtcatcagcttttgggctcatatagcgctgcaagttcaaggtctctggaaatctgatggctttgttgatctttccaaactttccagactgtatagatacagaagaaaagtattagtcaaacactaaatacaatttcaatgcttgttggacttattcaaaactaggataaatgaaacaatgaactcttgaataagtaaacaagttccttcagtgttgctattataagaaaagcaaaaaaaaaggtcttattgtagatgatacctgatatcttttcagcgcaatagtcaggacatttggtgcttccgatattgtcagcttctttttagcgcgctcatgcgatttgcatctgacattacatagtagagttaggagtatcagcattagggactaggcacaaaagcagtcaagttacacagaagtgattaaatatgtagttattacagctctaacacgatacatttattatagaactagattaacaggacacgtcttatgacatccaccttcctattatttcacagaagcaaagcaattttaacaagcaacagagcgttccaccaattctttttcaaaagtccctcgagaagatatctcgttttcaagactaaaatatatgcaacttttgcatggatatacatgacaatttctgggaaatcaattttccatctcaacaatttgccagatctgaaggcactactcatgttgttgtagaaagcttggatacgg

SEQ ID NO: 2697 - DNA, 15628 bp, Oryza sativa
  unsure (1)..(15628): unsure at all n locations
ctaaggattacacattcccctcttaaatcctgattagtgacatgggaaaaaaatcgatccctaaatcccagaaagtgaatacgaacttaggctacaggtctgaggtgcctataattcgttttgaaattacaacaacactataatagaggtccttaacttactacggtctcagtgacaagcattttgaggattttggaaagtggcaaaaaagatgtgcactgtatgaacgcatatgagcacaaaaggaacagcaagagctggcagagaaagatagaggtcaactaagtaataaacctgctgcatttatatttattatctccatccaagacttctgtagatgtaaatcgctcaagtgctccttccagtgaactgatgtcgccatctatttcaacagtaagatccaaaatacgctcatgttgctcggaagtagcatcacatcttgtgcatcttatctagaagaaggaaaaaagcagtcaataggagtggggcttcattacacagctgatctcaggtaattgagtacaaacaacagaaatttaaacttgttctgtgaactgtgaagaaaaccttagatcgcagatagcccccaaatattaattgcataagtgttgtttcttcgtgtaaccgatgagtgccgcttttcctggcttccttcatgcatacagattgcatagcatcaatggcgtacctacaacagatcaggtagtgcggttccatcagacactattgttgaaaagaactggttgagcacaattaactaagctaattcaaaacaaggacattggcaatgccaattcatacccaaaataatatgtttaggttgtttctaccaggattacaacattatactgatgcaaaccaccaccaaaactccgaatccagatgatagggaaaaaggttgtcattgctcattagattcttcatgcagaccacagaccacagaacctaataagcactccggctaccactcaaatattcaagtaggcctattaactttaattttctgcatgaatatgtgatatgatacccccgctcttatcccccagtgcattcctcgttgaggcacataaatgttcctaacttctgctaaactaattcttaacttcttaaactggaaactgtcaattaaaaaaaataacttacctaaggaattcatgagcatcttcttgtttaccaggaccaaagctacttccaatgtcaggcaaatgagagagtatcccagttggtgacaaagcaatcttgccttgtctgccctccccaacgagtttttcaaattcacacatgaagcaccattcctttttggaacctagagagtatgatatattaaataattactcaaagaaatgctttatgggaaacaatgatgtaataaacacagtaatagaacattacaattttttgaatgaagccctcccaaaagatatgatgtaagtggtcgggtaaacattaagcactgaagaacagcatttgcatagcaactgcaagagagaggaaaaaacaaggtgaaacagggtgaacacagaacactgtactaagctaattcctgcataaacaccacaaattatcataaaattcgatgcaagctgtgatatgtagcctgatagccacaaaaggatggggagagctaagttataaatcttagagaaatgctaaaataatgagataagcaaaaaagaaacacatatatgtgttccaactatccagaaataatccaaaacttacctattgccaaggttatgaagaccaaacggttgcaattcaaccttttcatagagcttaatgaaaagctcatatggaaaatgtgtctgaaaaaaataaaactattagcagatagaaaactcctactaactataaacacagcagttcagttttgcttactggctctgatggataatgcctcacaacttttggtgctgtttgctgcctgacaatttttttcagagatgttgccaggctatttgctgttgaaattgatttctctgatggtttagaattcctttcagcaatattatcagccctttttgatgaattaggtgtaacagaacgtccaccgggaacaggagaaactttatcaacagtcaaaacagatggcaccatttttgacacaccaatgttgtctgagccagcagcttttgtcttggagtgtccaacttccacatgaagagcagtcctggaagttttaggttctactgcaacaggtagagcagcttgagcattgttgttatctgcatattttttgctgttactagtttgagagcaatcctggtgcttcttggaatcaattaaggactctttgttgataagacttccagagccactaatctttggtggagaaggttgaaatctacacaccaacgcctcatctaagtcctttgtgtaagaaccattttcaacaggagttgtaggtttcatatttgattctgtctttctactgccaagagaagctacttgtgaagaactttgagggagtttgaccgcactgacagaatggtcatcatcaggaacctccaccgaagcaagtacttctgagggcatatcttttgttttatcatttaaattcttcacggtggctgccgtgttggtttcagctatgttttcttcagaagcacttgtctgctcaattttcctttcctttgcaacagaaagttcagccacatcatcatgattagcatcagtgcttggtgggcggcattcatttttatgaccctgtctccagtgggctatctggcatttgaaggaactgcaaaaaaaatgaaggtatcattgaagttgaacaagtagcacattctaatgccatgcacaacattacactatagctcagaattttcaatgtatacaatgtaacaaagataataacttaagagtttgaaaaggtatcaatgttgatatcatatccagtaaattaagcctcaatgttaagtattatgagtttagaatcaaaggataaaactcagaataaaaatagttgttgtaatccaataatgatctttgttaggatgattaactaaactaatccataaaaaatctactgataaactcaagtaatcaacggttccataagtagtttgctaaattcttattacgactatcaacctcgaaaacttcagattcgtttaatccataatcatgggttaacacataaatatactcatgaatgtgtagcaggtgatgaaatttgtcaatgaaaattatggaatttaattttctgaaattatggaatttaattttctgaatacccttcagattagcatgattgatgtgtgtacatcttaaaaatatatagttttgtgataaaattggggttaaatcttatatttttgcaacaaaatggcttcaatctgtagtatcgggatatattctatgctaaatctacagtttattatggcgtaaatatgttgttttgtgataattttgtccaaacatttgcaatttagtgaaatttaaaggatatgattagagataagcttatgcgcatgaaacaaatattgtgaagaatcaccactgttaagcagtatgaatcttttccctccccgcaaaaaaaaaaggtatgaatcttttcccgcaaaaaataactatgaatttcagagtctcaactatttattgaacatggtttgataaatcatctatgtttgttgcctcgatgtagagcatctgagcataggaagcatcatgtatgaaaacgataccagtaaattccatcacaacaaataatattgctttgtgaaaatgatacttttctcatctagagaacattttagacattgagatcctaacatcttaaacccggtcatgtgcctaagttcattcataaataaaagacaataatatatgtgccccgagccaatggacggacaactttaagtcaggctaaaaaaagtaaagtttccaagaagatcatcatcaacaaaagtaatagaaagaattgagccattaggatcctagttgggaatatgacagatgagcgattcacaggctaatgtctttcaaaactgtgtttctgttagcaatgccatatgtccacattagattcttcaaatgcaacaaatgggcacaaagaaaagactaaatagagggttatccataccaaactcacttgccaatcagttattcaagatggtcatgttatgcgcaaaccaaaactagacgcaaattccaggctttctggaaccactagccctcctcaaggttgaacaccgaaattactacgaaatacagaaatccgcactaccaatcgcagaactctctttccgattcccctttcacccggtgaaatttcacgaaatgcaaagggggactcagaagagggtttcagaattcagacaactcaccagtacttgacagccttgcactgcttgcacctgaacgtcgtcggccggaagcacaccgcgcagacccccttggcacccaccggcggctgcggctgcggctgggcccgggcctccatctccgcctctgcctccgcctgagccggaaccacggccggcggcgccccccacgccgcctcatccaccatctccgtcgcgtgcacgacgctcgggaacagctccgagtagtaggcgcgcgcgcactccacctccgccatctccgactcctcctgcgccagccgcgtgagccgcagcacctcctccctccgcgccgcggcgcgcctcaccttccgccgcaccacaacccacaccaccaccaccaccgcaatcaccacagccaccaccaccgccgacgccgacgacgacgacgacgaacccgccgcctccgccatccaccacctcctcctcccctctcaccccgctcccctcctcctcctcctcccctcccctccccaccgcatagatctcgccgcccaacctcctccacccaccggatccgcccgccgatcccgaccccgacccctcccccgcacctcgccgtagccaacccgccaaaatctagggcttccaattttttcccctccccttctctctctatctctctcctctactcgagttttgtttggtctttggaagtgacggagaggcaggcgacggagagagagaagccggcggactcgagaggagggaaaggaataataaaagaataataatccggcttgtggaggggggaaactgcaaaaagtggttccgcgagacggagagggaagacggagcacgtaacggtaacggccaccgcgacgacaagaaaggaatgggttcccacacgcgggaggggggtgtgggcccgagtgtgtctgggccgtcggatcgattccccccgggtggatttcgtacctaacttttggaatcgcgggaaaatgttattagcaagtttgttcttcttcccttttcttttttgttatgtgttcccgccaattaggtgtggggtcccataaagtgactggtgggtcccacgcggttgacgttgagggatttttcacatgaaagggattttttaatatatatatatatatatatatatatatatatatatatatatatatctgcggttggtaattggaattggaaactattctaaggtaattggtgatttttattcgttttagaaattagaagaagttcggatttgtcacagttgcctaaacttcatgaagcttttatttaggcaaatatatttccatcaatatcacttgttctcaatattgcctacccgaaatattcgatgccataaaataaaatactgtagtaataaactaataataatcattttagtagctcaagaccttttgcaaaatagcccaattaaatcagtttttttttttctgtcgacgtcactttttttctgtcaatggcgacgagggaagaaaaaaacagagaaatcaaacaaatgcagcagctgagacgaaccggcaaatacgtgccaaacaagcgacgcttttctccctttttcctcctcctgattcgcagcgtccgaagtaggcatggtttgcctcacctggctttcccccacgtacctttcccctgcgcacgcgacacgtcacgccacgccacggcgcgcgcgcgggcggcggcgtcggcgcgtcgcccacgtacacacacgcttgtcgcgccaccgccatcctcgcgcgccggcgccgacgcttcgcggcgccgcgggcggacgcggcggcgcgggcgatggcgacgcgccgatgtgatatgcggctggtcggcggacggcggggggtttggttcgccgaggcgacgccacgtcggcgccggagtatccctgaaggaaagcgcggccaccaaattccagacaaccgactcgccgactgcatctcgatcacaaaaacaaattaatcatgctgcatggtgacatggtgtgatctggactctaaatagcatcagatcaaagagaccaattggtggtaatcatcaagcatcagagctagatttttaattaattaggcagcgggtgagttctgggaagaatccatcgatttccatcaacagaagcactcgagcatgtcgtcgcgagatgagtggacgacgggaacaagaggcgaatttcaccacttctcctcacgctcgctcgctcgaaatatcagtgtgttgttacagtcaactgattgctattggtctgaagtttcaacttacaccggccttcttcttctaaccagtagtttagtttgcgacacgatcacacgatctgttccacgagctgtagggtgtgtttcgttcgctaaaattaaaataatgtaacaaaaaagttggaagtttgtgtgtagaaaagtttttatgtgatgaaaaaattaaaagtttgaaaaaaaagttgggaactgaaccaagccgtagtatcgctgtttgtataacaactgtctatcagcatgatgcgacgtcgaaacaactaaaaattttcataccacccaattaacgaacaacacaccagctaatactctgctcaggaatctgctagcctagtaacagacgagattattcaggtaaaagtggtaattgaaattatgccaacatggcaacattgaattatgttaacatggaagtccaagagcatgccaagacgtggtgtatacgattcagctctgctaatcaagctcgtaccctgaagaaatttcctcccgaaaaccaatagcttgtggggtggtttagcttccaacgaattcaacatgtacatgtgctgaagaatactgcagcaaaagcatgcgttgttttctagtacatgcactgacctttttttttcctcagtgggagtccaaaagcctgacgaatcaaaccattcattgatttcgcaactaatccggttgctttccacggttgtggtcagtcgattagatgcaacgaccagcagggcgatttgtttccgcaattagcgaaatttcaccgagctgaatcttctcatcaaacttatttggcgggattaggtgcgtaacaaatgagaatatgagattttttttttcaggttacgtttgcagaagcaacctcctcgtttcgataattgcagcctttgcaatataagcatttctccaaactgtttttagattgaaaatttgtaccgcagtataaccattcctctacttattttattcatctcagctaattacaactatctcttatctaatttcttcaactattttattattattgtcttaacaagtcatgactatttcttaccaatttctgctagaacttttagaaagactgtattttagcttgtatttttcgtataagagtattttaacttgtatttgcagcacgttatctctacagattaaaccaaagtctctatcagactataacctacagtgcataaagttctgtaaagctcaccggatgcattttgcccctttttgttgccaagttccttcagtttttttgttctcttgccattctgggacagataaacacttttctttgatatgctaatgcttatgtggtccatcagctaagtgcgagagagcattggttgggggctaatcgcctgaagttttttattacttgcgtacagaattctggctcaggaagaaaaggtttcagataattccatatttccatcgctaacctgcgaccgtcagatgatggcgacacacgttttctcctccatgcttgattgtattttaagttagctgattccttctgttttgttctttgttgcatggagaagataacgaaagaatttgttgcggctgggtttgaaactgtgtgccaaactaaatatacctagctggctagttcatacattatgccgtccatggagttggcaccattcgtgagtcaaataatatattatcatgacctgaagattagtatatcgcattgttatgtcttgataattcacgaataggtgaaacttgcatcataggggaaaaagacattaagagtgatgacatgatgtcaaccctattcaaattcattcttttatgagaaaaaaaattattcaaatttcttcgttcttttccacttacatatcatagattatatcatgtttatattcgctaagtttgtaggattcatgatttcttaaaaacggggctgctattcaacggaatcccgttaggacagaatgataccaattagttatcaggtcctgatacctctgaggtatcatgtcctgatacctaaccagtatcaggcgatatttgcgagatatcatgtgatacctagaaggtatcaggcgattcctaccacgtatcaggtgatacttgcaaagtatcaggttatacctgtcaagtatcaagcgattcttaccacgtattaggtgatacttgcgaggtatcaggagccgggcaccaaggcattgtcgccggtggtcccatcgtccacgtctcacgccggagctcgtcgccggcggctgcatcctccaccgtccacgccacgtcggagctcagtggcggcggtcgtgtcctctccgtcatccaggccccacgccgaagctcgtcactgatggccgcatcctccaccgtccatgccatgtcggagctcatcgccagcggctgtgtcctccttgctccgcgtctatccacttcgacgatagctctatccccgatcgtcgtgacaacccacatccatcagctccgatgtcgagctcgcgctgctcctcaacacggcacctctcttcgattcagcaacggcggccaagccccacgcgccatcgccgtcctcagttggcgtgagtagctgagcagcacgacggcgacgcccacaacctacggcgacagacgccatgccgcaacctcgcgtgaaatagactgtctctactgcaatggctgccgtggaacctggttgtctccacaccattcttatctgtagctgtgtgaggctgggagaagatcccgtcctgaacgctagcaaacggtatcccggtatttagcatttccataaaaaaatacatacattcttgggatagtatttaaaataacttttaactccgttaccctctaaatattaatgtagaataagataatctatcatatatcctttaattgaatgttcattcattatttttttgtccgattagtagacttcatcgtaaacaagagggtaaatttgatcatgccactgaaacattgtattagaaaaatgtcactaacaaaattgaaagtatatttgtgtcacttcactattctaaaataagaaacgtgcaatagctgtcaaagcatgtaacttcttcctcttgaggtggccagcgacagatggacgggaagggatccaacaatggcgaccagagtagacatgataaagacgagatttgacagcgacaggtggaagaggtgtgacaggaggagatccaggagttgttggaggaggcaagggatccgacaatggcaagaggacgacgaggcagaacgggatgcactgacgtcctagcaaccacaatcgcctctactcactgtcatcgagctccccttaacctctccaagttgtattgccatcgctattaggagctcgctccagcaaccactatcactattgtccttcagtgtgaccgagctttgtctgcctctcaaagccgcatcgatgtcgcccttgggagcttaagtccgtacatcgttgcctcgccaggtgagctcgagcccccacatcgctgcgatgcgcttgcgccactctgcttctccacggccatccatgccatcagccgctatgacaatcattttgtactatgcgcgccggagatagagaagaaataatcgggagcaagatattgacagaaaccttaacgataatagatcaattcaaatttataaaagtaccagtgtcacctatccgatttcgtcttaacaatattcttttatagtacaatttgataaccggataggtgaattcaaatttgccttaatttgcagactgtaggataataatattattcaatttgccttaatttacactacaattggataataatattcaattgtcttaattcaaatttgccctaaacacaattcattatctgctccgccttcccgccactaccgtctaccagtcgtccaccaacaccacgccaccacggctgattctccgatccggccgccgacatcgccgccggcagcgtcggcggccacaaacaaggtgatcgtttcaccccctacccgccattctctccaccgcttgctgttcctatcgggactagtcgccctaaccaacccaggcgactagttttggactccgccgcatcacattttgcacgcacgatctcttcctctcctctcctttaatttccccaagtcaaacagttgtttattggatcgatcgatcgatcggtcaactcctaccagggctacccaacccatcctaccaccgacctcgatcccaattgtttaaatgtttattaatctccggatcatccaccaactttactagagaagccagagagattcggtcgcggtcccttttcgcgcgcacgcgggccaggcgcgaggaccaccgatgcatcaaatgtgcttaaaccagcagcgatggcggttgttcggggatgcgggggcggggcgatttactcggctgcccgcgcgccgcatgtgcggataggtgggtggagttgtggcgggcggggcgcacgctaggtgttcgatgtaatgcggcagtagggtcaagcgcgttcgcgtcctggagatggggggagttggggccttggggggtttatgaattgggtcatcgtgctgtaggtgtaaggtgttgtttaggtgggatatgcctctcacagctccgacgcctgatgggaagaattgaatattgatggtgggtggtgtatcagtttgaggcatgaggtcgtcattcctttctttgggatggattctaggcatgttagagttcttcttttgattaaaagttacctcaatccagactggcattgatagaaaaagaacgtcggctattaaaacctcattcctggtttagttattctgagcaatgtgaaggacggttgttctttcttagtggtcctagtctgttcaatgaagacatgccattctaaagtcacattacattgtgaattcagctttgacctagaatcctactagataactagtagtctaggactctttttggaagtcaccagagcttctttattatttatcaaaaaggtagagctttgacagagaagttgataggttaactataatcagtttgcacttgagcagaaaaacccacagatccttttggcagtaccccggccttttgatttaggaaatagcttttccacatggttgtcaatttgattgttttcttcattatgttattgtgcacttcagcgtgtgcacatggatacacttgatggtacccctttgaataccgctgcaagcatttcttgtagcctggaggatgtgaaacgtttatgtttttgctaattatataaaacgttttttttttctgaaaacacacactgtttgcgccaggtttgaaacttggtttgcgccaagattgaagcttccattattctttacaagtaccaaatacaccagctgctttcttgtcaggtgctaccaacataaggttgttgcacaataatgcacttcttttcttatgctgacgtacctattttgaatttgctcttgaatatcatcctccaatattaatctgctataattgcaggttgcagccacctttttttttgtttgaaactttgcagccaccttcaatatggctaattttttaatctctagtacatgcgaatatgaatgccaatagaatagaagtctgaaatattcttgaccagtttaatactaccataaactggtacagtactattcaacttatgtaccataatggccttctaggtagtaatgttgagaagctatgcttatggccagtacagaactcaccagtcaccagtatgtctttggcataatcaaaccatggtgcccacattgctgtaaccattctgaaattgcagaattagcataagggagtcttctaaggttaagtagagtgccttgaattattgaaagtaacagatggcattacgaataaaatttgtatcactgagtaatttgctatttgatgtgcatggcttttgtttgtttgcatacccatagcacagttgcacacaaattaccacgtgtgctctggcttttaggtgaaaagttgaaataagattaacctttttctctctacttctgacctatttaaggggtttgtttgactttatggtattaacatgtgagaactcttcgaataagtgtcagcttgcctacctaggaaagttgtagctgataaaaaaatattgcaacatgtcttagaaatgttgaatagttgttaagtaacaggttggtgtaagacaggaaaagattacgatcttttgtctggatgtctgggttcctggcaactgaaaaaacattttaatgggccaagtccaatagggtaacaagttgtggaggccaatttttagcccaaatagtgtgatccttcaagtgtctgcagaagtgcaagatgcaaacttcagaattctggtatagttgtaccaactaataggaagctttatgttctcatgattgcagaacctgcacctataatctggtaaatttctcacacatgttcctgctgaaggtaaaacttgacgcctcttttatgcaaagttaaatttgacttgtattgtgtaatttatccttctcatttcagtatgcttctttggagccccttcctgtgttgagatgagaagcacctgtttcaaagttgtattgtagaaactagaatcctagagtatcattccctttctggtatttccgcaaatgtacagatttttaaccttactaatgcttcatgcatgttccatcttcttaccagtctgggttcctggcaactgaaaaaacattttaatgggccaagtccaatcgggtaacaagttgtggaggccaattttagcccaaatagtgtgatccttcaagtgtctgcaaaagtgcaagatgcaaacttcagaattctgttatagttgtaccaactaataggaagctttatgttctcatgattgcagaacctgcacctataatctggtagatttctcacatatgttcctgctgaaggtaaaacttgacgcttcttttattcaaagttaaatttgacttgtattgcgtaatttatccttctcatttcagtatgcttctttgaagcccctacctgtgttgagatgagaagcacctgtttcaaagttgtattgtagaaactagaatcctagagtatcagtccctttctggtatttccgcaaatgcacagatttttaaccttactgatgcatcatgcatgttccatcttcaacatcatgttatcatgatcgtggagtggaatgatagaaccagtcaaggatcatgattggctctcaagtacaaagaaattcagttggagttggcagggaaaccattcagtaattatttaggtacacatctctatccttcatcaaaatggtaggcaatggacctgtggtgtgaactctgtttttactggttcgcacatagaatgcctacttatgtggataagagtaaatacattatgtagccaattttctaacagttgcaaagatttattgaggcatattggagttatgttgtgacatgacactttaatttggccaaaatttattagcatcaaattggcaataatgaaacaatttcctttttaggcaatttagtggaaatatatcacagttaaatatttgtgaagcccactccaattatgctgtagactagagacttgtggccctccatttttcagatatttgcgtatacctaatttcttgagcaatcagcatccacttaacaccagaatagttgtagaattttcagataaatcaaattgatacaggaccagttgtaggttcgtggtcaccatcatttgatttctgaatcactgttttattggttttacatgatctacatcaatcatattcttgtccaaatgagactagagagagttcatgcctaaatatcaatctcatgctcctattaaacaatatatatatatataatcttttgctaacaagcttacatttaccatttgtatgaaattgctactggccagtgccaccttctagcttgaactgattagagcttgataaatggatatttgtagtacagcctggccataacttatatgacgtaatatgtcatgaaatactgtcatatgcaggataatatgccacttaccgaagcaagctgtttatcaagctgacactgttatatatgttgagtttgacatattttctgatgttgagtgatgggcatgattgctctagtgggactgtgggaggtaatattgtgcttccagaatcttcttttattgaaacgataaagagtaaaagaaaaactggcttggataatgtgaatattgtcattcaattaaaaatgagatggtcatccaagttgatcctaggacttgaacctattagggcaagaggttaaagttaacctccttgataatatgcctctcagttcacatgcatcaaagaatgacgatcattttcttgttctttaagtaagcaagacaatgtaattttcagggctcaggtgccgggatgtattgcaggtggggttgcaaaactgcacttgcggcaggtctctactgagtttaatggcctccaaccacactgacgtgaaaatgggttgttaataaggcatgtcagtgagatcctaaatattcttgatgactccgaaaagctgttgatctaaatttactgtaagagttccaaaaaggtatggccgatcaaaacactgctgctaatgtcctgcaaatgcatctggaaaatcagtccatcatgtctcaaactgctttcgttgtgcatattcttatggtaccggtcaatttggtatgatgtcatcagttgccgcttgtttcttttgcttttttttttaattcccacaattggctaatgcaagttgacagacaattttctgttgcttgttacatgtccaagaagtagtcctttgcatctaaatcgacgctatgtgtttcctgttcagcatgattcagaacaagtttgcatgcaaggttgggaagccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2698 - DNA, 19270 bp, Oryza sativa
  unsure (1)..(19270): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttaaaaaaatgttgtatgagactaaaacaggaaagattcagcttagaattcacactctttcgtaggaattgataatttgcatttgaccaggtggaaacagttttttccagtgatagtctaagccactattaattgtgactaggactttggaacacggcaatgctgtaaggcatcctggaaatttcaatgtgattgtaatgtttaaatgggagcaaaaccaaacaacatacgctgaaaatagttaacctgtaattcagagagtacatctggacggtgagtttgtgaacatgatacaactaagttgaaagcaatgaaaaaactgtgaaaaaacagaaataaaattagctataagtaaaagggactttactaaaatctaacttaatacccactcaattttcacttaacaatttcactaaagaatacatgtaagatgtaacttaaccagaacacaggaagtatctatatatgacaaagtccggacaatgacatactagcatatatctaaaaataacaaatgcggataattgacatttttcatgacctcgtcagtacgcatcaccaaaaccaccatagaaagttcaggcaaatatgttatccacgtttggtgtcctcaatgacctcatctgtcagcatcctttgttgagctacaaccacaaatgtgatttattttcttccattgtactttcctcttcgccgtcggtttccacctcgcccttgacctctagctcgtaaccagttcgtcctactcgttgatgcacccgttggtcggtcattatactgacctttcatgagcaacagcttgtgagcttcagcctctcttaatgtccatagcaggtcatagtacttctcatatcttgcagccctgtattgccgatgtagatgaaggttaattggatgaaatgtagataatgtcttctcaattaactcctcctgcgtgatttctctaccacaaattttgaatcgagagattatgagatggagagctgagtcatattcagacacaagcttgtagtcatggaaacgcaagttcaaccagtcattctgagcttgatataggaccctggccttctgctcttcttcaaatcgatccttcagggattgccataagacaaatggatctctttcagcgcgataatcagtccgaaatcctttgtttaaatggcgccaaagaaaagccaatgcctccctcttttgggtctcggtacactctgaattagagataagtgccgtacagagacctttcatgcctaaatggatttgagcctcaatagcccgttccaagtaattgcttccatcaagagcaagctcatcaaagtcttcgctgttgaaatcgaacatgttttcctacagttaaaagtatttagtctacagatagtcatgaataaaataaagattaaacaaaccatatatatgcgtcagggcttgcaatgatgtcaatgctaatatgcagtacatcctgtccaaactacaatctctgttctataaatgaggctttaaggagaacttatcatattaccaatatttttatgaattttatatgaaacctaactgcatcatccttaatactccctcttgtcataaatatttaacgtgtaggaaaatatttggtccatattgaaaatatactttaaccatagataatttttcaaatgcttagttttaagtaaaaataataatgtgcatagatttatctcgaaaagtactaatcacaatatcataaacacattttaatataaaactgatggccaaagtttcacaattttgacctctaaacatcaagtatttattaccagcatcagtatttaacggctaagcatacagcttagacagatcgtttgtcctgacgccaaatatagtattgtgaaagtgtaatttataaacctgatcaaataccatatctaaaacaattaactaggcttaggtctactcccagtgtcccaaaataaaataattcctcatcccaagaagattttagtaaggagggaaaatgactaagttcctcattaatcggagatggttggtggatagacaagaggtattgaagagtttaggaatacaactttccaaacaaattttgaactctgtgaatcaacttattttgagatggagggagtatattattttttgtgttattgtcttggttgtacttgggtgagttactataagacacgaaatgttcatgtctgtattagggttattatttttcttttctaggcatccctggttgatgtagaggttacgtgtaattcatttttaatgaattttttctcgttatcttaaaaaatgtatatgttatttgtgctactgatcaacaaattaattgttacttatgaactgattcaattgactagccataataaatactagacgaaagtatctggctatgaacaatgaagaacaaagaatctaaaagggacaaggtagccgaatattatcacacagcaacaaacaaggaattaatagtccataacacaatatctcgtcggagaggatgcccctctcgtacggcacggcggaggaaacgggagcaaaatctgggtagaactagagttaatctacatgtatgatgtatctcagcaatttatctttgtagggcaacgtctagagttgaaaatggtcaaaggggaaaatgcggaaatcaaatttcatatattggcgccggggaaggcagggaagaaatcgagaaaatcagtgagatcaaatgttgtgatcttgttgatgagattaataaaggagattttcaattgtgagatcgtggcttccgaacttgaaattggaacagaaaaaaaaaacctttcagtttcacaacactcaccatgatagtgccggacgcgctggccgctgtccgaaactgaccctaggctaaccgcgggcgccgggcggcggcggccgcggcggacggcggtgcagcgcgaccggaacggcgtggttattggattggaaccgacggcgactagcctgagagcgactgttccaatccaacagcggagtagaggcggagagatccatatataggggaggcgaaaaagaaactgacagcccagagaggaacgagtaaacgggccatccgtggacagcccacatggctctagccatccggcccatctagcccacgtcgcgtgtaagttgaaggttcgccgcgccacgcatcaaaccatatctgcatcgacgtgcggcgcacaccgccgcgactaccatttcgactgatagatcacccaccggatcgcacgcactctccatcaacgtgccactccggattcaactaacctcactgcgatgaaacaagccatatgatattatgattgatcaagcgcaatgtgggcagaaaacgcaacaaatcacaccgtcttcggttcggcttcgtgctctggtcttggctccaatggcggcgtttctggtatggattctcctcttgttaccgtacgttgccatttcgtccacggcgagccatggcgttcgtcttgagctcacgcacgccgacgaccgcggcggctatgtgggggctgagcgcgtccgccgcgccgccgaccggagccaccgccgcgtgaacggcttcctcggcgccatcgaggggccgtcgtcaacggcgaggctggggagcgacggtgccggtgctggtggcgcagaggcctccgtgcacgccagcacggcgacgtacctcgtcgacatcgccatcgggacgccgccgctcccgctcaccgcggtgctcgacacgggcagcgacctcatctggacgcagtgcgacgcgccgtgccggaggtgctttccgcagccggcgccgctgtacgcgccggccaggtccgcgacgtacgccaacgtgtcgtgccgctcgccgatgtgccaggcgctccagagcccgtggtcccgctgctcgccgcccgacacgggctgcgcgtactacttctcctacggcgacggcacctccaccgacggcgtcctcgccaccgagacgttcacgctcggctcggacaccgccgtgcgcggcgtcgccttcgggtgcgggacggagaacctcggcagcacggacaactcctccggcctggtcggcatggggagaggcccactgtcgctggtgtctcagctcggcgtcaccaggttctcctactgcttcacgcccttcaacgccaccgcggcgagcccgctcttcctcggctcgtcggcgcgcctctcgtccgccgccaagaccacgccgttcgtgccgagcccgagcggcggcgcgcggaggcggagctcctactactacctctccctggaagggatcaccgtcggcgacaccctcctcccgatcgacccagccgtgttccggctcacgccgatgggcgacggcggggtcatcatcgactccggcacgacgttcaccgcgctggaggagcgcgcgttcgtggcgctggcgcgcgcgctcgcgtcgcgcgtgcggctgcccctggcgagcggcgcgcacctcggcctcagcctctgcttcgccgcggcgtccccggaggccgtggaggtgccgcggctggtgctccacttcgacggcgccgacatggagctgcggcgggagagctacgtggtggaggaccggagcgccggcgtggcgtgcctcgggatggtgagcgcgcgggggatgtcggtgctcggcagcatgcagcagcagaacacgcacatcctgtacgacctcgagcgaggcatcctatccttcgaacctgccaaatgcggcgagctttaggattcgcatgatcaaagagatacatgaccatatgtacataacttgaattttctatcagttgcttttgcaattattctatggaggtgttttcgttcccaaggcgacattccctctgtttattgcatgtcgagaaacacacttttcccttgttctcttgcatatgcttggttgattatgcgtgtgcttggtggtgtgttctgtgttcatgttcttcaaagaagtctgatgttcatctgacttctaaaatgctaaataatttcagctgaatgcagctcaatcactgcagctaaatctgaaatccaaacttaacatacttttatttacaagtgcgtgtatattacacggactgtacattattctccacatccatatctacaagaatacgcgctgacatatgaaaaggtgatcaaagccgaacaacaaatgtatgtaactcgaaattctagccagccaagagaagtacgatcaaataattaaacaacataatatgtacatatgcaaatacgcaatagagatcactcccatcgatcgatcagtacgtgcgtctcggtctcgatcagatcttgccgcaatccgcgggctgcacggacagcacggagttcttgagctcgtacagcacgtggaagtccatctgcaagtagttcccgatgcgcgagccggtgctcgacttgccgatcatcaggcacagcacgtcgccgccgccgccgccgctctgcttaccggtgtaggcgaagtagttaccgaacagcagctccatgtccatgccgtcgaagtgcatcgtcatcgtgggcacggtgacgacgttcttgctcgcgtcgtcgacgaggaagcacaggaggccgctcccgttgacggcctcgtacgtccgagacatccgcgccctgaacgcctccacgacggcggtgtaggccggctcgaccagcagggtcgccggcgcgccgatctggaaggcgacgccgcgcgtcttggccggtgtttgggttgaacgcgaacgtgtcgttgggaatagcgaggcgtgtcccgtcgacggagatgccgagcaggttgacgtagtaattggcgtcgtcgggtaggagaggggtggatgaaacgccattcccgtccatgctggccgtggacccgaacagcacagggctggcaacgttagggttcgacgcgaggcagtaggagaagcggtccaagcccagctggcccaccagcgacagtttgcttctacccagcccaactacacctgtgttcctgtttaatttgatatgaaaaaaagaagagcccacttataccacttaattaatccatcgcccatatatattcttaatttcttattactgtttgtgaagcttgagagggaaatctattcgtgagtacgtttacgtacccgtcaaacaaatcattgcggtagaccgtgttggtgcacccgaaagtgaagctctgcacggtagctgcatcgttgctgccgaacttgatggtctcggtgcccagtatccctttgacgtagttgcggtcggtgtcggtggcgccgtacacgtaccggtacccgcactcggtgtcgctgcacgtcgtgcggacctgctcgatccggcagaaccttgcaggcctggctcgcgcacgccagcggcgagaagctgctcgaattcgcccggtcgtacagccgcgcccccgccggcggcgcggcgttgttgttgcagccgctgcatggggtgcactccacccagcacagatcgctgatgccgaaaagggcctggacggtcaccggcggcgtgccgacggcgagctccatcacgtagtagagaccagcgataacctttgattcaaaagaaattcataggaattttaaaggatttcatttctataggaattttttctatatagccctttgaatctaagaaatgaatcctatgtaatcccataaaattcctatgaaatacctcttctcatgcaagttttgaaggaaatttagcatgaggttctacctcatgttaagaatcttttgagtctttatctctctcaaattcctatgtttttcttgcggctcaatcaaatagtcattactatacttttcctgtgttttacaattctctgttttacacttatattcctatcagaatcctatgttttttctattcctccgttttttcattcctgtgattcaaaggtcctttaatttcatgcatacctccccacttggcaattaggaaaacaataataattgtgtggtgatctttactgatgcaagctagataacattttcatgcacaaagtcagaactatagcggttctcagaatgcgtacatgcgaaggtgtgtgcatgatatgtgctctgcaatttgttactctcctccgtttcaaattactctcaatgatttatcctaagtgaagcatctaaatttagaatccatatagtctaattacacgtggattatatatttatatatgaaaatatttcctaaccttctcgtaaaaaaagacatttaatatgttttgatatatcaaacttttagaaccacaaccagggtaaatttccaaaatttcggaaatttcggtgacacccgatacgatattaattcggccgaaatttgtgaatttttgaatttttttcatgaatttggataatatttgtttaaattcaactaaattttgtttaaaattttggaaatttcagaccgaaatttccgaaatttcgggatttcggtgacacccaatagaaaaccttgaaccgatatagtgaaccctgaccacaaccatcgataatttctcttgtttgttaggccaaaattttaatgcgggtggtccaggtcttggtcatttctaagtccgctcctgcggctgcctaattgtgctaccgagttttatctaccacttgacaagattaagaacatacactagtggagaaatggtttttattcccggttcgtaacctatatagtcctggttttccaaccggtactacgaatccgggactaaagatcgttatttttagtcccgggtgaaataaccgggagtaaaaatctatttttaaatatatagcctctttagtaaagatagagtcagcctaaatccggttgctcctttattcttttcttttcttcattgtttttaatatattgatttcactccatcccgcccccaaaatcccaaatcaatcatccccgaattgtaaaatctcaaattgattattacctccaaatcctcaaatcgatcatctccaaatacatcacaaaatcttaaaaaaaaattacatcacaacttctacaaaattcatcacaaatacatcacatattcacatcacacacaaatcaaatacatctcaatccgaatcacaaatcttaaaaaaaaagagaaaaaaaacctaaatccggcgcctactcccgctgccgcaccgcctgccgcgtaggccgccgcctcggcgtgccgcctgccgccgcgcccccgcgaggccgcctggccctccgcgaggcagcccggtgcgccgccgcacgccgccgctgcagatggggaggaggggggagggagaggaggagaggaagataggagttaaaggagaggagagggagaggagaaggagaggaagagatagtgtgtgaggagaggaggagaggagttaaaaggagaggaggaggagatatgtcgatctgatccgcgcgcacacctctccgtgtatgtcgatctttttttccggttggtgttaccaaccgggactacaaatagatcttttagtcaaccgggagtaaagcgtatgttagatcttttttccctgttgatattaccaaccgggactatagatatatctgtagtcccggttggtgttcaaaaagtacccctgagcttttaaatcgggactaaatatgtttctagtcctgatttttaatccaaccgggacaactgtgaaatctgatcgaccgataaagatggatttctccagtagtgataccgagtgttaccaaaaaggaagtccaaaaaaaattaccatgtgccaagctaataaacttttttttttgggggtggggcaagccaataaacttggttaaccttgggaccaatcgtttctaccatgatttctattggcgcgggcggatggcatatgctctgcatgcagtccccactctcgtcggctcgtcgcctcaattttcccctctccaggcggccactgagcgcgaccgtgtgcctctggcttctttccaccacacgtcccagatgacgtccattgaacgcggcagcatgtcctcggtatcctctcgtctctgattgtgttaaagactaaaactgtaccgagaaagaatccataaaaaaaattaaaaatcacttatgtagaatctatatatttttaatcaaaacaatatgatttctatttaaccatacaaggacgactaaagcaaagaagaggcaccaattcgttttttatatccatgtcgattccccatcaatcaatacctaatatgtggtttgcttgtgtagtggtgcacatatgtgtcctctgtataatagaaaaaaatactagtgcaaattaatacttgaagaagaagctacagtaataaaagtcaagaaacaagaatagatgtcattccaaagaaaagatacacgagacagatacaaaacacacttgaacagtactagatagagttttgcaaattgcaattaaaatcgtacgtgcaaaaataagaggacagtattattttagcaaaacggattgtatatataaacatgtacatctatctcagttgaatgaagtacccatcaatcaattcttaatgtggtttgcttctgtatgaacatatgtgtttctccatataattgaaaatataatacttcgaattaatactttaagaaaaaaagtacaaaaatactcactctatttcatgttacaaattgttttgactttttttctagtcaaacttttctatgtatggctaagtttatagacaaatatagtacattttaaacataaaataaacatattatcaaaatatattcaatgatagatttaataaaactaatttggtgtttaaaatgttgctaattttttataaacttagttaaacttaacaaagtaaaaaagtcgaagcgacttatagtataaaacagaggaagtaaaagttaagaaaagagaacatagttgcagacaaaaacgatttttttatctataataattaattatcccaaaaattaaatatttagtaaatcaggtgcggacgctagagccaacggcgtccagatgtggacgctgtagcgaacggcgtccagcgcaagtccaacccaacatgatcaggctggagcatctagcccaaggtcaggactccacgagtttaggttaactcccccacagatcgaagcaccgaaactagagttcacaagctcgagatcgaggaggaggtccccctttccctccacagtgagcagcgccgacagcgagccggcgagcctcgccgcaacaatcgaggcagcgcatgacggagattgaggagagaaatgagggtggcagctgttggtgcattagtctaatcgagtaaacctagacagttagatttgggttggagcttgggccgcaccactgcgatggacaccgttggctgcagcgtccagagccggacgcgttttgtccgagtgtccacacctggacgctcttgctagcagcgtcctttccatttttctaaataccactactgatttactggttatttaatttcagaaaaaataattattacaataaaaaatggggatacaaacgatagaatttgcaatcaaacaataaaaaaaagagatcgaaatcctgcaaaaatatgacaacactatttagaaaaactgattgtatatatatatataccctctacacctatcttagttttttttttagggagggggggggggaacggagatatattactcattgaatgtgatgtgaaataaaattacaactgtcatccggccagaacacggttaaagattcgcttctgcctttattcgctaaaaaatggctaaatctcgatgaacttttgtgagtatagtctcctttagttgaattgatctatatctagatgaacccgtcaaagaagaaaaaacagaaagaaggaaaactatgcatggaacgagtctgtctttttttgttagaacattaaagcgattcttaatagcaatttgcgaagtttaaatatgcaactaggccggatcatctatgagttgttgaaatggtgtttataagatcaacgaacgctcatcgaatcaacactgcaagattaaacgaaaaaggagatcgagatatatacactcgaaacatggcgtccacagctgctatactagccctcatcctcctcctcctcccgccaatagctctcgccgccggcgacctaaatggcttccgcgcgacccttactcgcatccaccagctctcgccggggaaacattccgaagcggtgcgccgcgacggccaccgcctcgcattcctctcctacgccgccaccgccgcagccggcaaggctaccaccaccggcaccaactcgtcgtcggtgaacgtccaggcgcagctcgagaacggcgcgggagcgtacaacatgaacatctccctcggcacgccgccgctcgacttcccggtcatcgtcgacaccggcagcaacctcatctgggcgcagtgcgctccgtgcaccagatgcttccctcgacccacgccggcgccggttctgcagccggcgaggtcgtccaccttctccaggctcccgtgcaacggctccttctgccagtacctgccgacctcctcccggccgcggacgtgcaacgccacggccgcctgcgcctacaactacacctacggcagcggctacaccgccggctacctcgccaccgagacgctcacagttggggacggcacgttccccaaggtcgcgttcgggtgcagcacggagaacggcgtggacaactcgtcgggcatcgtcggcctcggccgcggcccgctgtccctcgtgtcgcagctcgccgtcggccgcttctcgtactgcctccgctccgacatggccgacggcggcgcgagcccgatactgttcggctcccttgccaagctgaccgaagggagcgtcgtccagtccacgccgctcctcaagaacccttacctgcaacgctccacgcactactacgtcaacctcaccggcatcgccgtcgactcgacggagctcccggtgacgggcagcacgttcgggttcacgcagaccggcctcggcggcggcacgatcgtggactccggcacgacgctcacctacctcgccaaggacggctacgcgatggtgaagcaggccttccagtcgcagatggctaacctcaaccagacgacgccggcgagcggcgcgccctacgacctggacctgtgctacaagcccagcgccggcggcggcggcaaggccgtgcgcgtgccgaggctggcgctgcggttcgccggaggagctaagtacaacgtgccggtgcagaactacttcgccggagttgaggcggactcgcagggccgcgtgaccgtggcgtgcctcctggtgctcccggcgacggacgacctgccgatctccatcataggcaacctgatgcagatggacatgcacctgctctacgatatcgacggtgggatgttctccttcgcgcccgcggattgcgccaaactgtgataataataagctgcatatataattgcgcacgtgtgcggatgtgccgtttgatcttgctgtgtgcatcgaggaggacaaggctctttctcctgttacatcatcctctggaatattatttttcaataatgaaaatggtttgtatatttccgttcatcaccggtctctgcgttggtacagagaaaaaggtcttaaagctagaaaaacaaaaaagaatacggtgatgaggcaaacacccaatttcgctaataagagattaactgatataactttttcaaagtcacataaattatactccctctgttcaggttataagacgttttgactttggtcaaattcaattgactaagcttataaataaatatagtaatatttataataccaaattaggtacattaaatcaataatggaatatattttcataataaatttgtgttgagttgaaaaatattattattattttctaaaaatatggtcaaacttgaagcagtttgactttgactaaagtcaaaacgtattataacctgaaacggaggaagtagcacataattttataggtactgcaccattcaaactagaacaaaagatacatgttccctaccaattgtaatgtgtagtaccattacgtacaatattttgctattactttgatagcatcatgcataaggagtggagccaattaaaacacatagatatagcatgcatcatgttagataactttttgttgttaaaatctacgtcaaattgaccaacataaataatagcccaaaataaaatcatttgcattacgtacaggatcctcataaaacactccttatagccaattaccaaagataacttttctattatagggaagagggatattaaaacagacaacatgataggcaaagaaaaagaaaaagaaaaagaaaaagatgttcaatggtcttttatgcattataaaaacattactatcccccccccccaaaaaaaagcacaatttctctttgccaagtcatcttttgttaggatttcttttttcaaggaatcgtataagacttttattttttagtggtagtaccttttaactccaaaaaaaaaaaatcctcttacaaattcttacattgaagttcatgctcgcattgtacatggatttgataaaaaatattttttttatatagaaactagaaaaacggtctttttatctgtcagggtatgttaactagtcggtaaatcaaatcattccactcaattagcttatgtcctacatttgatcgcccaaaagttatattcatcgctgttgtactcatgcataatctcttccacgtaagaatgttccttttgagtcacatcataaagagaaggtatcgatactgtgtttcaacggtaaagaagaatgtttcaacggtgttgtactcatccactctagaatccagtttgatattctgtcctgatcgatgacgttctaattgccgtgtcccttgattgagattgactatgctctcgattgactttcagctctaagttctaattgaacaagttgtatgaaaagaattaatggaaggagtaagtatcggtctttttcattggcctagctaggaaagaatgagtacacgttcccatctcagggacatatatagcacagaaaatgcatgtcagtttacaacaatcctcttatgacttctccactacatggctacccgtgctggcaaattagttacgccatgcggtgatatatatggcctacatttttatatgaaaatatttcctaaccttctcttaaaaaaagacatttaatacaagttttgatatatcaaacttttagaaccacaaccatcgataatttctcttttttgttaggccaaaattttagtgcaggtggtccaggtcttgaactcttgatccatttctagctaggtccgctcctacgtctgcctaaatgtgctaccgagttttatccaccacttcgcaagattaagaacgtactgagtgttaccaagaaaggaagtccaaaaaattaccatgtgccaagccaataaacttggtaacattgggcccaatcgtttctaccgtgatttttgttggtgcgggcgcggatggcatatgctctgcaatccccactctcaccgcctcacttttcccctctccaggcggccactgagcgcgaccgtgtgtctctggcttcatcccaattcagcacacatcctaggtgacgttcgacgagcgcggctgcaatgtcctcggtttcctcaggactggtctctgattgcgttaaagtgttaaagactaaaactgtacctcgaaagaattcataaaaatcacaacctatgtagaatctatatttttttaatcaaaacaatatacggtgactaaagcaaagaaggggcatccgttacaatttgttttgatatatccatgtcgattccctatcaaccgatacctaatgtgtggtttgcttgtgtagtggtgcacatgtgtcctctatataactaaaaaatactagtgcaaattaatacttaaagaagaagctacagaaataaaagtcaagaaagaagagcagaggtcattccaaagaaaagatacacgagacagatatatacaaacacacttgaacactagatagagtttgcaaattgcaattaaaaaattaaaaaaagatattgaaattgtacgtgcaaaaataagacgtcactattttagcaaaactgatagtatatataaacatctacatctatctcagttgaatggattattacccatcaatcaattctaatgtggttttcttctgtacggtgcatgcacatatttgtttctccatataatcgaaaatatactacttcaaattaatagtttaagaaaaatagtatagaaatactcccttcatttcatattataaatcattttgacttttttctattcaaacctttctgcgtttgactaagtatatagaaaaatatagtagcatttttaatataaaacaaatatattatcaaaatatattcaatgctagatttaatgaaactaatttggtgtttaaaatattgctaatttttttaataaacttagtcaaacttaacaaagtaaaaaagttgaagcgacttataatataaaacaggggagtaaaagtcaagaaaagagaacagagttacagacaaacccgaatttttatctataataattaattatcataaaattaaatatttagtaatcaggtgcggatgctagagcgaacatcgtccagatgtggacgctgcactgaacggcgtccagtgcaagtctggcccaacgtgatcaagctggagcatccagccctagtctggactccatgagtttaggttaacccctccacagatcgaagcactgaaactagagttcacaagctcgggatcgaggaggaggtccccctcccccccccccccgccacacagtgagcagcgccgggagtgagccggccagtctcgccgcaacgatcgaggcagcgtatgatagagattgaggagagaaatgagggtggcggctgctgatgaattagtctgatcgagtaaacctaaacagttagacttggtgggagcttgggccgcaccagtgcgatggatgccgttgtctgtagcgtctatagcccaacgcgtttcgtccgagcgtccacacttggacgctctagctagcagcgtccttcctatttttgtaaataccgctactgatttaatggttatttaatttcagaataattaattatctattatatactaaaagtccattaaactttctataaacgctcccaaaccgtcatgcagcactctacaaacgtcctacgccgccacgtggcgatctaataaatagagaaaatcatataaattctaagaaaaaaaagcaaaacatccaattatcgatttttatttaaaatggtggacccgttaataaaggttttatatttgaaagaaggttttaaatcaaaaccaaatcaagaaactcctaaagatagattgtaaatgaaaatcacaaaagaaattaaacataagagagttttatgggagttaatttttaggggggtccctctaattataatttcctaggtttacgagggttaataagaatataagaaccggcatgatgcaagattagaaaatggttaattttcaggatgttacagagtatctaaattatttaataaggggaagagagcatagtaaggtaaatgttggacagataatccatttatatcgtggttggtagcagtgtacagtctttaatcttgttcagttcggacttgatcaaaattcctgctaagtcctgtcgaaatgtattcatatccctctgcataatgtaaagggagtgcattttaaatggttttcataatgggaagcattggtgcaaaatgttttcatatccctttatttggttgttttgtttcctcttcttttcaccccgtaattcgtctatgtctggcatgataacttctttattcgtttgtgcttgaaaaggaggaaagttagtaccattcacatgagcatatgtcacgatgaattagcatagtacctattgttttttttgttggtgtttgggttctgattatgtcctttttaccccttatttcgtagatgaagtcagtccgatttgttggtttatatgttcttcctgtaggacctgtaagcctcttgttgctttgattgcactggttactgctgtcctgttaggtaataatgttcacgttagtattatgataagttgttgtaacgttagagagagaattaaaattcactttacgttcgtttcacaagtcatgtttacatttgggtttatataggtctctttgtgatgatttgatcatataggctcataggatcaatttgttcttgttcaacatcttgcaatagcgtcaatctttttttagcgatgttacataagtaatattgatttacagtctactttatgatatttacctcaaacacatgcatagtatcttttcaatttgggcattttgaatcattttcatgcaatctagtatcaatgatcgcatacgtggccaaaaatccattgtgaaaccgttgaaattattctctaaagtttggatcctttcttgtagccttccttgtaaagtgatattggctgattgttcagtggatgttatagagtgtacctgaatagcacaagtgagaaaaggatgtcaaacatattttgttaaatacagaagtgcattgaaaatcttgattgctatgtgtatctgagtctttgtcctgctctttttcattgaggatttcattgcaatctatagttcccctaatgttgtcgacaacctatgttttagtcaaaaatgtttattagagattttacagacaattgatataattaatacatagtattgaaaatgagatagttaccttcccttcaccaaaagggtaagaaattcggtcttttttattttttttggtcccagtactgaattagtggcttgacggccagaataatatattgtcgcggccaatttatctaatcgcactttttcccaataccaaatctgcaagcatttgtacatgataatcaataccgtaataaaaaaataacggagttatatgtgcatgccatttttttaaacaaacacaatttgttctatgttttgtaacaaacctataagaggcatacgttcccctcaatgtttgttgtcttctctctaaaacttaatatgcctttgttgtcttctctctaaaacttaatatgcctttcattaactgattgaggattagacttgacccgtttagttcactcattttgtccatgtcgtcaacgagattgagatattctgagcgcacatatctttgagttgtacgacatatgaatgatccaattgagaaaagaataaatcttcgtatgaagtggtcatcatagctagaagagttgaatattgcttcctgtaatgcttgtaaagtaattgttgtttgtccttcctttttgtacaggttgaacaatttaggtttgttgatttttggtgcctcaaatatcttctctccttttgatgtcagtccaagcaaacaatagacatcatcgagtgtcattgttatgaaggtaccatttatattaaaggcttccttctccttgtcgtagcttcttgcaatctcattgcacaagtttcggtcaatatgaattttgttaatctttagcaagttgcctgaatcctcgatagcttgcttttgacgtggacatagttggagtcctagctcatacatggcgtatggggagcatactagagttccctgattaacagagaagaaaataagagtttaggccaatcttcgtacataaccttcacaagaatacccaatcaaatcatatcagtgcatatcaatgcatcatggagttcctttagattcaggctagtattatgctcaacatgttcttatgaaacagtagttgtataattgttttagtgttctagttgtgaaaaattagtaatatgaactgatgtatggttccaaactttcagatccagaactatgattattggattgctagatagatgcagcagcggcacagctttggaaaccaacagtgtggcagactagcagtgaaatgcttgaaggttttagcatggcatgcggtcttgaacattttcatttcaaaagatgggtatgattttgtgtttttgcttcgacacttagctaaccagacattcccacagagcagaacagatttgaacagcagcacagcagagcagaacatagatcaagttttgcatgttttgaggctatata

SEQ ID NO: 2699 - DNA, 1532 bp, Oryza sativa
tgcagttgtaaaaggatctgtaaaagacgtacccgttttttcttccgttggcttgtgcctgtcatcgctttacagtgatttcgtttgctcgtcttcaaaggctcgtaatttggtctcatgttgtattttcgtattttgatgcccacaatctgaagaaaacgaaaataatgattgcgcctggaataatgaatgcgattatctcggcctagctcggtacagaaaaataggggatcgatacgggaaaatagaaaatagattaaaaaatctaccgagatcagtagtattacaaaaaatagaaaccttgtctccaagtacgtgatcacaggggattagaacggaataatatgggatatattatcttcaagtacgtctttttaaaaattgacccgtcctatataatctaggaacgatcgaccaaaaaccatggtttttaaaaatcgacacggtccagactgtcgtggacttaattttttatttgtccaaaataatccgttccgccatattctatgagcgatcgaccagaaaaccacggttttttaaaatcgacccgattcggccggtcatgcatggacttaattttttatttatccaaaataaaccgttccgctatattctatgagtgatcgaccggaagacaactgttttttaaaatcgacttggtccggacggtcgtggacttaattttttatttgtccaaaataaaccattccgctatattctaggagcgatcgaccggaaaccatggtttttaaaatcgacccgatccggactatcctggattccatatatggatttttttttcctgaaattaacataaaaaagagaaaaatgcatcgctcctagtcgggttgcggctgataggacatgtttctgattcactaaaaagaacatatgttttctttaagatcatatattattttttctctgcgctgtaatattcatgcattgtcaatcacttatctaggctcccaggttcctgtgaaccccctatatcaactaggctccaccactgttaagtacaattgcctttcttcaaaccaagagaagttcagaaagcagtttatactttccaatgcatgtatcgcctattgatttcagtgactgataattggcacaagcagacaactcaccatgtggtttatatgatgatcaagtcacatagggcaacaaagtcgtttttacacacaatattttgtgtgctgcctattaatttcagtttgcatcttgcttcaactagcttgatgatttatcatgtgccaataaaaacatgccagccatgtttaatatgctgaagtagaaaaaaatctgcaaggcttgaaaacctagtgttggatagaaattcatttccccagacggtacataacatatatactttgtcattactagtttatgctggaagggtagaaataactgcgaatgatgggagccatcatattgtaagtgtctcattatttgttctctatttctgttgctgcaaatctgtgtactctatagcttaacttgggcaattatatttgttggtatagacccaa

SEQ ID NO: 2700 - DNA, 7981 bp, Oryza sativa
  unsure (1)..(7981): unsure at all n locations
tccatttcctcacaggcagtggtggccgccacctccacatccagcatgacttggattggtggtgtattgctggcattggtgccatgtgtggtcagctaaggactatccatcagctcttcggcgtccacgaccacgtctttcatcatctacccacaaatgtgacacaagattaaaacatattgcattgtaatatggacaaccagttgctcttgatacaaatcaaacaggagaatattaacaatattaaaaaactacagcaaccaaaatctgatagatgaaggtcagaaatgttatgaatgactacaaacctgcaagtccttgaaatccaacctgaatacaaactagctgtattttacatttccacatgcggtgtcttccgccgcaggtgcattacttggtctataccaacaaatataataacatcgaagttaagctatagagtacacagatttgcagcagcagaaatagagaacaagtaatgaggcagttacatgcaatatggcggcccccatcgttcacagttatttctacccgtcagcataaacaaggaatggcaaagtatatatgttctgtactgtttgggaaaatgaatttctatccaacactaggttttcaagccttacagattttttcatctttagcacattaaacatggcttagatgttttcatcagcacatgataaatcatcaagctgcacttcaagaagaaaaaaaaatcaagggcttcaagggcttagttgaagcaagatgcaaactgaaatcagtaggcagtacacaaaatattgtgtgtaaaaatgacttcgttgccctcgccagtgtcgaatctaggacaaaaattgaggataggctggactgatagtctaagtctaaattgataatgctaaaataaggcacataccattatcaagtcaaatgtaacacttacatgattaaataaaaaagcatacttataaaagacgtaccttgactttcgactaaccagtaaaatgctcattttcaccggatatgtcctcaattagtaatgcataaatggtagaagtaaacaaatgttaactaaaataagtaacataccacaaaatgcagcatccttttccacactatgttccaagcaatcaaatcgaaccaattctgttgaaaggatctccaaatcttaccatctaatgtcctaggaaaaacatgtccaggtgctctatttggaccattcaacaaatatgcccttctcacttcatctctaactagtaatttgcatgtgctaacgctacggctatatttaacaatacagatcaaatatatgattcagacaatcaaaagaatggaatcatatattgctaattatataaccatgtacaactacatgtttcccacagtatatattgcttcaagctaacattttgcatactctatatatacgcaaggcaaaccatttgcaagtacagaagaataaataatcaagcttcattgaaattgtatttcaaaccggaatagaaacaaaagtaaacacttcagcatcgctcatcttgctggtgttgatgcttccaacagctgcatcacatcactgaactctgaacaaagctgaatctaaagcagcaaagatggcaattacccaaggccaccttttgtctaggttcttcctgagatcatccagcatgctcgtcctgttgatgcttccgacatctacaacacattaagacaatgtcaggtgcaaactaatgtgcaaagttacagatggatctgtcatcttcagctagctttgtcagatggtcagatgcagtgtttttcagaattcaaacacagaggtaagaacctacctcttgacttcagctcaatagctttttatcagaacaattaatcacaggcattttgcaatgccatctaccttaaaaccttggtttagcaaacatttaaagactataaattagttgaaatttgattttaattttaattcagttgtacatatcaaagacaaattaggagatagatagtattagatatagggataatacctactaaaactgtctcaactcattgaagcaatggagatattttcaccctacagctatcaatatcaaatatctatggtgcaacaagcaatgccaacatcgaattgttgccctcagaaacgattatatgctactgaagcagaacatggaagcagctcatttacctagcgaccctagaaataaggggatcaggtgacctggtcggagagcttgcggccgtggacgaagaggaagaacatggcgacaaatcatacatggtgccccatcatcagtcatttataataaaaagattatacaagcgctgttgcttttgacagattgcattatcaccaggaaacaaaatcagtccactgacaaaaaaattggaggcataaaagcagaacaaaatgaagcccagaggcattatagcatcttgcatctggaaaaatgagtaggctaacaatatagggtagattacaatcttgttggttcctgttgttaatcatctggcctattatacaacaaaaggccttcaatcctcaccaatctagttggctgagacgcagtagtactcgtggccaccccaacggagataccctctatgaatcaaggttattcatctgaacagggcaaaaatatattaacaatctcatttgtaaaagggagtaatctggattgcatgtagctaatccaattttcatcggtatgaaattaaaattgaataaataccccagatacattagacaagatagtgagtactgataaatcactctatccatttaaaaaatattgattaaataataagtgtataactttatcaccggttgtgatacaatgagaaatacttgacatgcattaatatcagacactccctccatcataaaaagaaacataggaggggatgtgacctctctatggacaatgtatccgaaattagtttttttattcgtatccgaaattagtttttttcattcgtatccagaaaccccttccaatatcccgtcaaacatccgatgtgacacccaaaaaatttcttttcacgaactaaacacaccctaaacaagaaaaaatgcaacgctgtcatccttgtgtcattagcagaaaaatgttaatagcaccaatcaacagtggtcaccgaggaaaatggttaagcaatcaaagtgatgaaaaaacttgatagtgaagccattacttcccttttgtgtagttttagtgctattgagcatgttagacaggtaccatgacatggttcagttagatgctcataagaatttactgtttgatacgcattttaatcaaaacactgaagggctcaaaaaaattgaatcggtgagtttaacaccatatcgtgctatcagcattttcagataaggtgctgtattattcaccaattgttccaccaaacataaaaaacatatggaaaacacaacagaaaaaagcctcatatcaaacataaaactgagacgatacactgaaaaagtgagtagctagcaccctgaaacctggcctgcgtggagttgatgcgagcaggcgccgagaaatcgggggagcgacgacttgacagcgtggcgacagtacggtcattgtcattttgtagttaaatccaaacgaaactgaaatggagggcaacactacaagagaagttattgactccccccaaataacacttctaattaatccatttaaacatgagcgtatgaatatgatgcatgcatgtgatactaataatctagctaaatggtggtgattcacgatttgatcagttaattaaattgttcatatcaaagaacaaaaagagtaccttgcaactgattgttagcgacggcgccagtgcccagtagatatagcacttgcagcaaaatcagtcaggctagcggtgatagccacgctcgcaacggtgacggcggcgtccggcggcgacggcgaggacggaataggaggcagaacgccagcagcggaggaggcaacgtccacgtgcacggccagcgtgatgatgccaaagccatgctgtagcagaccgagcttcgtggcatcgacgtcgtgcgcctcctccggcctagacatggcgctgctcttgccgtggccgagctgatcggcggagcggcgagagcaggtccatggccgccgtcacggacatcgcctgcgtcaacgtagccctcgcgggcttgctggacccggacgagcggtcggaggacgatgacgacaacgaggtgggcgccgccaccggcgagacaagctgctgctgcggctgcaccggctggggcgggaggatcggtggcggcgtgaacgacggtgccacggcctcccggtgcgccgtcgccgccgccggcggctctgaggcccggttgccgccgagcccgagccccgcgcggcctgtcccgccggagcgcagcttgttcttggagcgggacttgcggttctggaaccagtagaagacgttggcgtcgccgacctggccgtactcctgcagctgcatgcggatgcgcgggatctcgtcgcgcggcgggttgaccatgccggagttgaagatggcctccaggatccggatctgctccggccgcgggttccgccgcggcttcgggtccggaaccctctcctcgcccactgcaacaaccacaaaaatcccaaatcaattccctcctaccgatcgatctcgatcccctctaacctcgcaaaacgaaaccctacctaccaagcgcaaacagtagcatgcacggatgatgcgggacctacctgacgagaagggcgaggacttgagggagaagccgccgccgccggtccggtggccgtgacttcgaggcagcattgggtagggaggatcgcgggtgatggtgagggtctgagggatacttaagggcgaggtggaggggatccggtgggtggcggcgtttagggctgggagacgcattctttttggcagaatatatagcgagtgcatgatttttttttcttttctgaaatcgccgcgagtgcgtgattttaggagagatccgcggcatgcgtgcagcggtgcaggtgggtgggagaggcatgcacgcgcaggtgggaggaatcagttggcggagatatgcgtggggaggtgggataaatctgagacgttggatcttagcgagataatctggaccgttccatgagaaataaaataatgagtaataagtaaaaccatttgttaaactgtagggtagataattttacaataatcatatattggtattcgtttttgctggatcggcaaaaattttattaggatcaaattccactaggtgcctctttggtctgtttgtgctctcatcagttataggtgtatcacttaaatggcttgtatagtaattaagcaatgtcgttttcttctccattacaaatctaccaacaaatcaaaatactaggaaatgtaaatggtaacaagtaacaaataacaatgaagaagtaaaaaaacagtatagctcactgcctcactcacactgtcacttaagactcacttagagactccggcagccagggccctgtggccgacccctccacgcctgccacccccgtggacaatgatggcagggcactgctccttgagccaccgccgccgccgccgaacacgatcaccgccaaaagtgtcatcgtcgcgtagcgggccggacacgtaggcgcgcgagggaggcggtggcacgcctaaggccatcatcgtggtcgcctctgccgccgccgtcgcggtcctcgtgctgcttgctctgccacgacagctccagtgggctgaccgcgccgctgctgagctactccacctagtcgttgttgttggactgcaacgccgtccatgtctggtcggtcgaatcgacggaattgggctcccacgagggcgtccacgcgtttgccggcaaagctgttgctcccaccggattcctgcggctccgcctcgccatggatgtcacgcacgaagacgtacttgtgcaggctcgactccatcagctcatccttcacaacaacctgtcaacctcctacacaacgatgtgtgtgccaccgccggcgaccttgccgtcgccgtacctcccgtttgacaagcacttgccattggccgaccggtccaacttgaagctcttgttttccgacgacaaggagttgaggtccgcgaccattgttgtcgtcgagctccgccatggggttgcaacggtatggctagtgctcggccttccgcgacgagctccggctcagagatggcctcgtgcgccggctgcagccccttctccctggctgcagccacttcctggacgcagttggcatgcgccgcttctccctggtcaggaccgacaccgtcttcccagctgctgctgcggccgcccccgcgcaccgctgtgcacacctgcgcacgcgagagagagatatattaggaagaggtgaagagagagaaagaccggtgggtcccacccttttttttaaaaaaaaaaatgctgactagattgccacgcgtacaccacgtaagacgaaactgctcgggattgagtcgaggggggtaattcgtccggtattgaaagttcagggtgagtttcgttaaaaaaaaaaagttcagagtaagcaatgtttggtttttgggttaaagggggtaattcggtcgaccacgatagttcgggccgaggtggggggagggggtaattcgtactttttcctattcttttatacattggtacaatagcaagtcagattattaacacttcggttgtgtggaattatataatcatatactccatccattctataatataaaggagatttggggtggatgtgccgtctgtccagattctttgtgttagnatgtgtcncatccccccaaaatcccttatatatattatgggacggatagagtatatatatatgtaataatacctatgatatgcttcatatgacatggttttttgtaagttaaaccacaatacccaaattcatatgaaattatattgaatttgaataataccggtacttctattcgtggagaatatatatataaattaaacattctgaaatttatatgggaaacagttgtacggctcactgtcactggtgcgggtgcctgagaaagaccgcaggcatcggcatgggagatcactattggcatagatcatcaatggttggaaaatcaaccattaggatacaaatagtcattatataagtacaattgatcatgattgacaatgattttaatcgtatatagtccgtggtgcttggaagttgtcgacgtttgatgtcgcaattctgatatttgcatagtatggggatcgtcggtgctaggatatacgtgatactgaggtaaaacagatggagacagggatttttatacaggtttgggcccttgaattgtcaggtaataaccctacatcttgttggccgaagccggtattgctcttattcatgataatcacaccagtacaatattttgggtagcctatctaactgttgtcgacatggcagtcgtacgatctgactcgtagtcgacaacaggatagcctttctccttaaatccgtgcccggcgagatcaaagatagcactttcatctctcctgacagtatccggagacaccgtagggtactagccgtgcttatccctaaagtcaatattcggcgacgtgtcttggtgtatgtaggcttttatgttgtggcttctatatcgattgtgttggatgttgatcccccatggtgggtgtgtggattctcttgtgtatgttgattctgtcccctctcctcctatggggccttatatttatactcatagatgtctccttgtccaagtagaaatagggaaaccaatatggatacaatccgagtagtacttgttgtttccatgtagaattttggttgtcttttcttatctggaactcctcctatattcacaggttgtttccgtataagacatgatatgtgatgggtcctgccgagatttagtcaactactattaggtatgtggtatccataatcctgacagaagttgattggaccgaatagacggctgctcatcaaagaaa

SEQ ID NO: 2701 - DNA, 3092 bp, Oryza sativa
gcaacgcccccggctgcgtctactactacccctacggcatgggcttcaccgacgggtaccttgccaccgaaaaggttcacgttggcggagcctcgttccccggcgtcggggtcgggtgcagcacggagaacggggtcggcaactcgtcgtcgggcatcgtgggggtcggccgcagcccgctgtccctcgtttcgcaggtcggggtcggccggttttcgtactgcccccgctccgacgccgacgccggggacagcccgatactggtcgggtccctcgccaaggtcaccggcgggaacgtccagtccacgccactcctcgagaaccccgagatgccaagctcctcgtactactacgtcaacctcaccggcatcaccgtcggcgcgacggacctcccggtgacgagcaccacgttcggcttcacgcgcggcgccggcgccggcctcgtcggcggcacgatcgtggactccggcacgacgctcacgtacctcgtcaaggagggctacgcgatggtgaagcgggcgttcctgtcgcagatggcgacggccaacctgacgacgacggtgaacggcacgcgcttcggcttcgacctgtgcttcgacgccaccgccgccggcggcggcagcggcgtgcccgtgccgacgctggtgctgcggttcgcgggtggagctgagtacgccgtgcggcggcggagctacgtcggcgtggtggcggtggactcgcagggccgcgcggcggtggagtgcttgctcgtgctcccggcgagcgagaaactgtcgatctccatcattggcaacgtcatgcagatggacttgcacgtgctctacgacctcgacggcgggatgttctctttcgcgccggcggattgcgccaatgtgtgatggagtaattactaccgttcgttaagtacagtataaacccaataactacggagtagaagtactatattgtacgcatgtggggatcatatacagtttttgtctagcttgctgttcatcataggacaaataaggcttaatttctcttgtgccgtcattctctgtttgagattgtgtcctaactgacaacgttctattttgccgtgtctggtacgtattctggtgtcacctgattgactatgctctgatgattttcagcactaattaaacaagtttgaatataatggaaggagtaggttttggtttttgactctttcgtttggcctacggaagaatcaattaatgaatactctctcacacacattatacttcagtaggattattaaaaaaaacaactgttgtacgttttcaagtgaaaaactttcgaagctaatagtaactatactataactaaaatatattatttgtatataatttcaccataactatactatagctaatataaattcaccgtaactatactataactaaaatatacttgtatataaatattaaaaaaataggaaggaaacccgcacaatctatctatctatctatctatctatctatctatctatctatctatctattatattattaaaacagctttgaaagaaggcaccacgttcactgtaggggctagaaattcccacattaatcggagaaaaagagaaaaaaagaaaaggagagtccaagtagaaatacaatttaaaaatagctgcaattcagaataaaaaataagcaatattgaaagaagttttcatgtaagaacccaatacgagattaatcaaaattcaaaataaaaataaaataaaatccaaaattagaaaagaaaaggagagtccaagtagaaatacaatttaaaaatagctgaaaatcagaattaaaaataagcaatattgaaagaagtttccatatgagaacccaatacgagattaatcaaaattcgaaataaaaataaaataaaatccaaaattagaaaaggaaaggagagtccaagtagaaatacaatttaaaaatagctgaaattcggaattaaaataatcaatattgaaagaagtttctatataagaacccaatacgagattaatcaaaattcaaaataaaaataaatctactactacttagaaaataagaggtgcttccatcgtctgtcaaaaaaaccgggcgaacaaaaaccgggcgaaaaaaccaggtctgtccgtaaaaaaaaccgagcaaaaaaaaagtgcgaaaaaaaggaaagaaaaaccaaaactgtccgatccgaaaaaaaaccgaacgaaaaaaaccaaagttgtccgatccaaaaaaaccgagcgaacaaaaacaaaccgggcgaaaaaaaaagtgcgaaaaaaagaaaaaccaaaaaaaagatgtccgattcctatggcaaggcagaaaaaaaaacacagtagatccgattcccttaaaagttggaaaaaaatcatattcctatattatcctatttcccgtacggttgtttgtttttcttctttttttcgtttctttttcgttttttcttttctctttttttctttttttatttcttaatactatgtatgtatataaactttatatacacgtatacaaactttatatattatatattttttcttttttatacgtatgtatataagctttgtatacttctctatctccactattaaaaaattcaaaatatttccttcgtccgtccctacttaaaaaattcacactaaaaaagatctgtccgattcctaagaaagtggcaaaaaaaaaggttcataaaaaataaaaaagcaaaggagaaaaaaagtacaaagggagaaaaaaagcacggcaaaaaaacgtccgatttctattcgttttttagttcctatatatctcttctctatatctaatataatctaatctaactatttaaaaagagaagttttcatagtacaacttaaaaagaaaaaatgcgcgagaaaataaaaacggttaaaaaacgtggagatagagaaaaaaaagcaaaaaacgcgtgagaaaaaagtcagaacaaaaaagctaaaaaaggtttccgtcttccgtaaaaaataaaaaaacacacgaggaaaaaactgttagaaaaagcacgccatttctaaaaaaatggttcgaaaaacctcacataaaaatcaccgtttataaaaaaacaagggctgcaggaat

SEQ ID NO: 2702 - DNA, 2348 bp, Oryza sativa
aaccggataagtcgcgcgtaacttatccggactccacgccgtttgcacgcaccggatctttcggaacgtttccaaaacaaaaacgaatccgaatttgcaacaaaacaaaactgcaaaaggaggctgcatctgcgcaagggtgaggagccaatttttcggaccattcgacgcgtacgtcgtgcacgcgcgccgcctgcccggcccggcccggcccggcgaggcgagcaagcgcgcgcgtgtgtttcccctcttctctccaccacacatgcttcaagcgactaggagggcatcctctcttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggcactagaccgtctgtagactacccctcgggtggagcgtataagtcatactcctaggtctttagtaagcttcctagaagattcacccaaaatcttcatagactgcgaccaacagtcaagctcacaaagttgagttctttcaagaatgctctgcaggacaacatctttgctaattaaagccaacagaactcattaaggcatagccaacctgccttgcagctcacgagagtatatgcatcttcacttggagagggtatatatattggtactctcctctagtttattaatggtttgttcttcccaggatctaattcacgggatctccgatcacataggctgggttaccaccatagtataactcacatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcacttggacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaatggtctgtttgcaagacctccatgaaacagcaccaccacccagtgtgaaaacatatccactagtggctttgatctcatccacatcagagatccaattagaatcactataaccctccagtaccgcaggatacccagtatagtgaagccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattctagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatctttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattatggtcaatctagcaacaggtgagtaagtgtcaaagaaatcttcgccttctttctgagtatagcccttagcaacaagccgagccttgtacttttca

SEQ ID NO: 2703 - DNA, 24638 bp, Oryza sativa
agggttggttcgaaccactatgtgtatccttcattgggaaaaagctctcaaaaaaggtaccatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccatttatttcacaaagatctgaatgtaggagttctagtggtgccaagtttctctcctcggcagccttgtgaggcttgcgagattgctttgattgcacacaactatggcacttaaaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaattagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattagaacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgctgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggagctagttttgcaataatgcacccggccacaaatttgtcgggtaagacacacttaaggagttcgagttccttagccatggtttgtatctcatgagcctgttcgactacagaacggttgttagccattttgtagtcatgaaactgctccatgatatacagatcattgctagcatcagtagcaccgaatttagtattcagtgcatcccacaactccttagcgtcggtcatatgcatatacacctggaccagacgatcgccaagaacgctaagaatgcatcccacaaagagagtagtggcttcctcgaattgcttctgctgttcagcagtaagaactccttcaggtttgccagtactcacccagaagcatttcatagctatcagccacagagtgaccctgatctgccatctcttaaaatgcacaccggtgaatttatccggcctcagtgcatcggcaaaaccagccatagtaaaatcacagtgcctataataaggtttttggattgttgagattatagacatataatgatttaatctattccataaataaatcatgatattacagatgaaaactagcatgaacgcatcattagatctacacatgtaaactacacagtataacatgaacagatcaaatatgcgcaacatattgaacacgtaccgaggtgacggaaagaccggctgcttggtcgaaacttttcgcaagtgtctacgaaggcacgaaacacgcgagcgaagaggaaggcgagccgtcgcgaacgaacagggagcagtcgcgcgaaacgcttcccaaaaaccttattgccgccttctcccggtgcagaacgtcgaaggcagaggttccggagacctactctcccgatcgccggtgcacgccggcgagcgggatggagtagtctatgagcgacggtgcagtacagagtaggaggcaaaccctagattgattttttgtatgttgcgtgaagacggcaggtcggtttatatagagaagggtcgcttgatcagggcgcccgcacgatctctactgcgcgtaaccgaaccggataagtcgcgcgtaacttatccggactccacgccgtttgcacgcaccggatctttcggaacgtttccaaaacaaaaacgaatccgaatttgcaacaaaacaaaactgcaaaaggaggctgcatctgcgcaagggtgaggagccaatttttcggaccattcgacgcgtacgtcgtgcacgcgcgccgcctgccctgcccggcccggcccggccaggcgaggtgagcgagcgcgcgcgtatgtttcccctcttctctccaccacacatgcttcaagcgactaggagggcatcctcccttttaaggaggtccccctctcctagaataagcaaggcggtactaaactccacatgcatgccatcccatgaggtgggcttttgtgattttccaaagaattaatcttcgagtgggctaaggcccattcattaattccaacataaaatgttggattactctgtaaattaaaaaaaatgtgtggattgaagcgaaaaattttaagagttgacatgaaaaatggaattcacccctagagtcacttcgcatcatgggataaatagattagagaaatatgatcttgtcctatgtgtcactctgataccctcttcgagttcccttagaccattcctagtggagttttattttgtggttttcaagggtgccatataatctaaattttcgtggtttcatattctactaactaggaaggtggcccgcgcgtatgcgcgggcacttatattattgaaaggtaagactattgtttgttcagaaattttgtctcatagattaagggcaaactaaagtttagataatgttattttataataatttaagggttctatttttcttaacgtatcttaaaaaactattcacaaacttttgagaaggagatggattaagtacttacgatttttgaatcatgtttcttttttctcgagtaaagaaaaaactattgctagttaattatcatatagtccatctatatgcgtaccgtgtagtatgaccgcaaatgaaaaatgcgagtgcaagatactcaaaattctttgattaaattgtctcatgaaggtgcatgatatagtaataaagagagggaagcatatgcatgggaaaaaaaaagaagaaggagaaaaaatgaaaaaagggaggggaaacatacgtacccatgcaggtaggtgcgtacctatgtcgtgggaggagaggtgggacctcgtagtatttagtttgttctaagatcaatttaatctaacggtttataatattggacctagcgatttaagtgaaaaatcaagaaatagatactttgtttttttcttagaatttctaatatttgccctaatttattagagcaccacgtcgcagcttgagagcattttaaggaattttaaatgacttaacacatgtaattagaatattaactgtgcaatatatatgtatgggacatatggtaatatttgttctagcttcgtccatgtttatatacatatagagtgaaattaattttgtggcttgcaagccattagatgtctaattaatagcaattatgacacctatttacaattgttcagagtaactcttacatattcatgttgcgactttaataatttatcaccatgactcgcatgaaaaaaaatgtagtacttaaggtttaggatagctgaaattgatgaattatataatttatgtgatattattttgagggtataaacgaatgaattgacttctaaaaagttagaatgttgttaatttaaagaatacactatttagaaacttggaaagcgtgcaaacaaaaatccaaaatataaaatcgggaaaaaaaagagagggccttaaactccttttatcacccttatcgtagtaagagttctattaatattcgtcaatattgcgctcacatttataacataataattcctttcacctatacgaacaaatagtacaaaatccaaatacgacataacatagatacattataattattatgtaatcaactctcggtttcaacttaaacagagctaattagtgttgagaaaaacacaatccattgtgcttaattattctctcgtgcatcacacatttaattttctttttatgttattaacaaaattaatcatctctatatatgatttgatttgtggcaaagtggtagctctacagcggttgtgatcaccttatatgtctcagacactacactttgtcacacgtgcgaaaggcaaaggtgcagacgtgtattatgcagcgggcaaaaagaaaatttcggacgctttatttattagcaaacaatagatccgatgattataataataagtccaccagttctagtgtaagttaaattagttaatatagattttaaattgttaatttaatgggtacgcaatataatggtgtagatcttattttgaaacagtgcattacttgagaataatataccaatgtaataaaaagtagatccgatgatttatataatggggccatcagtttaaacgcatgtataaattagttaatatagatattgtttatttaataggtacatatcaatataattgtgtaaaatttattttaaaatagtgcattatttgaaagaaagattctttgttatatgatggtagattctttgttttgtaaaattatgattatttaaaaaatatatccattatatatatataaatggaaaaaggaaaaaaaggaaaaaaaaggaaaagaaaggaagaatacatacatgtacgtacgtatatactccacctgccaacgcgcgggaggaggataggtgggacccatggtatttagtttattttaagatcaattttatctaacggtgtataatattggacttacaaatttaagtgaaaattaaggggtagatgatttgttttatcttagaatttcgaggattttctctattttattagagcaccacttggcggcttgagagcgtttaatagggtcagaatataaatgtgtaaaatttatttttaaatagtgcattattagaaaggaagtttctttgttatatgatggtagattctttgttttgtaaaattatgattatttaaaagaaatatatccattatatatatatatgcgtatatatatgcgtatgtgtgtgtgtgtatatatatatgtatatatatatgtgtgtgtgtgtgtatatatgtatatatgtatatgtatgtatgtatgtgtgtgtgtatatatatatatatgtatatatatatatatatatgtatatatatatatatgtatatatatacatatatatatatatacatatatatatatatatgtatgtatgtatgtatgtatgtatgtatgtatgtatgtatgtatgtatgtatgtatgtatatatatatacacacatatatacatatacatacacacatacatatatatatatatatacatacatacatacatatatatatatatatacatatatttatatatatacatacacacatatatatatatatatatatatttatgcaaatgaacaatttaccttaattctacccctagtagctagagatcactgcaacagttgtcaaaatcaatgtttccattggccaatgcaagttgagcttgcaacttatgcagcgccccatgttatgaattgatcgtaaaaacaacctagtacatccatctgacgacatctactctttctgttccaaaatataagaatgtaggactgggtgggacgtttcatatagtataacgtatctggacagccctccgttccaaaatataagaacctagaaccggatgaaatgtttcttagtataacgcatctggacagacggacatatacattgtactgtgaacaattccatccggttctaagttcttatattttagggcggagggagtacatctgtttttaaatatcaaaatcatcaataattttcatcaaaaaaaccataaatcattagtagacgaaataaattatgatttaataaataaaaatagtgttagtatattttttgtgaaaacacttttatattgctatacttttatattttttttataaatatatataagttaaaaatgtaatgatcagatatttacattccacgttatgtcaatgtctaaaacgacatgtaaaaataaaaactaatgtagtagtactatttttacatctcattgtcatgctttgagatgcatgcttactaagctgaagtccttagtctctatatattaggggtttcaacgtcatttactccgtcatggataagatggaaaagtagccatattatatcgatcttagctaaaaaggccaatacctactcccattcttttcaagaatttgttgaatctggactaatcgctgaaagagtgaaagtcacccgaaagcacagttaattcaaaggcacggaacatagaattcattcatcaccacatattaaggaaccagcagacggactgactcaggacgatatgtgcaaaacaagaagaaagacttgaccaacagcaacatcaaatggtgatatggtaggtaggcactcgtagacttattactctcgccggttaatacagtaaccaaacggacggtacaaatcacactttggcgcaatccgccggagcgaaggagaaaatcccgccgtcgagatcgtagagcaggtgcatgtccatctgcatcacgttgcctatgacagacatcggctggtcacccttcgccggcagcatcatcaagcacgctacggtcacactgccctgcgagtccgtctcaactccggcgaagtaagttggcacggcgtactcagctccgccatcgaagcgcagcaccagactcggcacggttatgccgccgccgccgccgccggtactcttgaagcacaggtccaagccgcgcgtgccgttcaccgtggtcacgtcagccgtctgggacaggaaggcctgcttcaccatctcgtagccgtctttggcgaggtacgtgagcgtggtgccggagtccacgatcgtgccgccgccgaggccgttctgcgtgaagccgaacgtgctggtcgtcaccgggaggtccgtctcaccgacggtgatgccggtgaggttgacgtagtagtacgaggggtgtaccgcggggttgttgacgaacggcgtcgactggacatttccgtccgtaagattggccagggagccgaacagtatcgggctggcgccggcggcagagccggagcggaggcagtacgagaaccggccgacgccgagctgcggtatgagggacagcgcgccgcggccaagacccgcgatgcccgacgtcgagttgcccacgccgttctccgtgctgcacccgaacgcgacgctggggaaagaggcgtccccgactttgagcgtctcggtggcgaggtagcccgcggtgtagccgctgccgtacttgtagttgtagacgcagccggtggcgttgcacgtgcggatggagttgggtaggaactggcagaaggagctggtgcacgggagcttggagaaggtggaggagctcgccggctggaatggcggcgcaggctgctggaagcatttggtgcacggcgcgcactgcgtccagatgaggtcactgccggtgtcggccacgaccgagaaggtgagtagcggcgtgccgacggagatgttcatgttgtaccctcccacgccgttctcaagcagtgcctggaaactgaccgacgagttggtggtggtggccttgccggctgcggtggcgtcggagagaaaagcgatgcggtggctgtcgcggcgtaccgcttccgagtatttgccgggggagagctcgtggatgcgagtaagagtggcgcggaagccatgaagatcgccggcgagagttatcggcgggaggaggatgatgacgagggctagtatggcagcagtgctggatgacatgtttcctgtgtccctccttgtcgtctttttcgtggtgttggtttgatgaaggttactcgatcttatatacactattcaacaactcatagttgatccaagttgcatttgaaatttcccttaaactgctattagaaaccgcgtgctaataattcaaccaaccgttagtttgtgtcaaatctaataacttattaaaggaataaaaaaaagcatccacgttcgctctcacggcctagaaattctcatattaatcggagaaaaagaaaaataaagtccatatagaaatacaatttagaaatagttaaaattcagaattaaaaaataagtaatattagaagaggagactagagtccatatattaatataatttagaaataactaaaattcgaaattaaaaattaaataacattagaagcagagtatagagtccttatagaaatacaattaagaaattaagaaattatagaaattcggaattaaaaataaggaatattagaagtagagtatagagtatatataggaatttaaaactaacgaaaattcggaataaatataataaaattaaaagtagagtttagagtccgtataaaaatacaatttacaaataactaaaattagaaattaaaaaaaacatgggaagaagagtctaaagacaatataggaattcaatttagaagtaactgaaattcaaaattaaaattaaagaatattgaaagatgagtttaaagtccattagaaataataaaaattcagaattaaaaataaataatattaaaagaagagcctagagtctacagataacgaaaattagaaattaaaaaataagaaacattcaaagacgagtccagagtccatattggaatataatttagaaataactaaaatttgatattaaaaataattaataactaacacatgtataaaatacaatatgaatattacacacttgtagtttgtaaagttggttcaaaatttaaaattatgctgtcattttaatatattttaataataaattgagaaaacatatatgttattatatgagaaaaaaatataatgatgctagccgcgaaatctacgcgggccaccaagctagtatatgtaaaaataaaagtaaaacttaaagttatactaatacgtattacaactgaaaataaaagaaaagttggtgaagtgctagagatgtgtcatgactctacgtctccatccactattttttctttcgaaaccacttatgttcaaataaatcttgatggatatggttttcatctcttgaggagatgccccattgtcatttgcattgtcatctaaatagttataacaaaactgaaaaaaattaacaatatagattaatataaaatatatcactccacaaacatgcaagccaaattcaacttctataagttgtaacaaaaagaacaaaataaactgaaaatagttattgtacattcgtagctatatttattattttttgttacaacttgtaaaagttaaattttaacttgcatgcctgtggagtgatatatttcatattatttttgcgacaacttgtaacatttgaattttaacttgcatgtttgtggagtgatatatttcatattatttttgcgacaacttgtaacatttgaattttaacttgcatgtttgtggagtgatatatttcatattaatctatcttaccaatttttttcaaagttttcagtgactatttaggtggcaagcacaaaatgaggggatatttcatcgagggatgaaatcactttcccaatctttgatacattagagtaaagtacacagccggtccttaaagttggagcgtgctgtcacttaggtccatgatcttggaaaatcgatattagggtccgtgatcttgtttaagtgaatcattgtggtccaaatacgtctaactgggttaactaccttacgtggcggtccagcgtggcaacatatttgcagtttggcccctgcattattttgcttccccctcgtctgatccagcctctacttagcatggcgcgcaacgatgtggccgatggcaccgacgaacgcgcggcgcggagcgtgcggtcaatcttggattaattcaaggaccgcgttgcgccggatgccaacgacatgaggtgagtgctctaccgggtaagggtcggtggctggttggattgctccgaggagattgcgttcttggagagcgaactgtgtgcacagctggacggcgtgacgagaacagcaatgacgttctcgtcatgaacagcttaatagtgtttttgtgtactgccgcgtcacgttgttcgatgacattcaccgactgagatgacgacgacgcggccaagtgggcaaagaggcccggctgcgagaggatggccacggcgctcgatggctgctcggctatcctcgccagcagcgcgatgctttctccggccaggtcgtcgcggtcggtggagagcaaggtggcgagggctgacacagtgcccgcggcgatggccctgccctggttggctgctctctggagcagctcgtacaggctgaccatggtgttcttctggtcgcggtacacgccgtctaggatgagctggaccagtgttgggatcacctccgggatgcatccgggttgttcgacgagaggtagaagaggatggccgctacgttatgctgcgccacggccttggcaacgacgttgatcacgtcgacaacgaggccgacgcctccgacctccatgatggtcatctgcccggcggggtgcttcaagaggttgagcagcgacgccacggcattatcctgtatggcggcggtggtggaggagaggaagcatagcagccaaggcacggccttgtcgtccacgaggcacgcccaacagaacacgttgtgcttcgacaacttccgtgcctccgatgtcaccttcctccactcctccgtcgaccccctggagagctgcgcgacgttgtactcgacggcgagcgtgcggcggccgtgccgaacgacacggtcgtgatcgcaacggcgccttggcagtagccaccgtgggtagagaagaagatttggggaagaagggggtaggatacgcgaggaaagtaaaatgcggggggccaaaatgcaaatatgttgccaagttggaccgccacgcaaggcaatcaacccggtcagatgtgttttggaccgtaatgatacactacaacaaaacatgtgtttagagatatcttatttatagtctagagacattttgaaccgtctttaggcatacatagagtcacttctgcaaagcgtcccagaagcgtctccgttaggaccgtctcaaaattataaagacgctccatatagcatctctacaagatctgagacatgaaatagcgtccctacgttagttgagacgcttttgtaaatgagatccaataacgtgtctcatggtgcgtccttatgagtaactgagacgtgtacatacgattcattgtaggatgccatgcttggcatatttacagcattcacatctgagcagtatatatcgccatcaacatatataccaaaatgacagtaaacagtaaaacactccaatagatgaaaggtaattatattaaggacaattgtgattcacaagtcagctaaacagccatacagaaaaaagagatttgcgtcatctcttagaaaaataaatttataactcttcctaagataattcttgttttatctcctcccttcttcacagcatgataaaatatatctataactgttcttaagataattcttgctttatctcctcctccttcacagcatgatgtagcaatcctttacaatcttcagtatcttctaaaatgaattgtgtaaaccaaatcagtgtacatgataagatttctaaaaaatgtaagaaagctagctaagtttactaggccataaacagagaattagacaatctatacatgtattgattcatagaagatacacccatcacatatttcataattgtcaggagcttattcctagcattgtttactagcttcagtaaagatttattgaaatcgacccttaataaagtaaaacaaaataaagcacttcaatttgtatatttctgaacaaagagactatagccatactacagtattaacatgagaatattctcctacagatatccaacaatttaccttaatagctacttgttctatactttttatgtggctagaatttctcatcatcactataagtaacaggtaaaaacttatgatggccatacctttgacactttagcagttgctctccctcctgcatgtaaatactttggaaacttcagcatatagaaagcaaatctcccattttggaccagcatctctattcctttactcatatgccaccgaaggacagtatgaagaaccatcgcatcattcagaactagtgtccgagatccaagttaaacaagcattaataccaatatttatttcaaagtgaatcgattagaagattgagttgagtcaaagcaatgcctctctgtgttttaatgtgattttgttgctaaaactacttaattaatgctgaactaaagcaggggaaagaacacagcgttatgcaatccaatactccaaataaattttttgcaagcgataccaaattaccaagtgattatccttctgaacaaagtatacaacaatcccaaagtatcatcatcagaattttttcctaaaaatctgcaaaaaaaaaaaagttaccttcaacaatactcatctgtatttttgtgccttcttgaagctaaaattccaaatgtagtcatcaaatggaatggaatcagtagcaaaaaagaatttataatgagcccttaatgatcgacatattggtattgattgatccacagaggttcacaaatcatcaaattgattatcagatctgcatcatgcaagtattggtattagcatttcgtcaaacaactagtacgatggttcatccctgaagcagaaagaacgaaaggtacagatcaatatttactcttttatacttctgcaggattacgaaataatccgatggggtagaactcaacataaagtctggacaaattgaatcacacaaacaaatcaaagcacctttgtagttccttaagccttacagattaggggatgagagagcatacctaccaagctaccaccgtggagttgtcgctgggctggtgaaggcaactgagggagggacgcgttggcgacggggagtcgctgataaggcggcaaactgccagcggtggctcctatggcgaggatcagagcaggcagtggtgggcggcggcctgaggaggaggaggcagatgtggcattgactcgccgaggatgaggcgccgctggcccccggtcgaggacgagccggcggcaggcatcgagatggcgaccggtggaagataggcggcggcaccaagcaggcagttcaatctagatgggagtttgttgcagcacgcagagaggatgaggacgtgggtggtttccaggagaaaaaaaaattcaatgtaaatcttaatttttgagaaatcaatgtaaaactagggcgttatttaaaacgtctcataaaccgtctttattggcggggtagcctagaaaatagagacgatttaagtctcgtctccagccaaatgtctttatttgttgttttgttgcagtggattcacttaaataagatcacggaccctaatatcgattttctaagatcattaacctaagtgacaccgcgctctaactttaaggaccggccgtgtactttactccttataaatactatagtttaagacaatggcgatgggacgtctgctgggattgtcagcaatactactgatgcagtagtagacactgacgtgtggacccgcacccacatgttagccgctgctactgcatcagcaatactagagaggatgtgcatccattggacgctagtgacgagagggctccaatggtccacagtgacggaggagaagagaagggaggcaggaaccgacgagctcatagtcctacggctgtggcttgtcgtcacaggcggcttgctctttttttattagagaaggaaattttttttagcctttatgtccaaccggatgtataaagccttcttaaactagtaacttaacccttaaataatctaatcttaaattaacttagcccttaacctttaggctacatgcagtttgacaagcggcttgctcttgtaagactcggagctgtcgaggagctccgacgccgcggcaggggagaaagctcggaccgtgtcccaacaagcccagagccagccacgtggaggccgagcggaagcgctggaagaagctgaaccgccagttatacgacctccgcgttcccgcatggcaagcctcctttctcgctgatgccgccgcgcacttcggcgacctccacgcccgcgtggccggctcgaggtcgacgcaagcctgaattgaaaaaaaggcttatttggctgatcagcctaagagcaagttctactaattttaaatcatctatagccaatgaaatagccaattcatacaatagttgattactatactattaatacatagtctcacatgtcatatacacattatgtcttggagtccgtgctgcagctgctggttgctcttctctctcttccttttatctctttaaaatatatttatagctggcttatagcctgctattgtatctactctaagaatactagatgaataccccgtcgcgttgctgcggtctgctctaagaatactagatgaataccccgccgcgttgctgcggaaaattaagttacataatatgtacaaataaaatataatttgattatcaaaactaaaacaatttgatacaattttaagcctaaaaaattgagattttatgttttatgagagaagaaagaaaagaccatttagactatagatctatcattcaaaagctaaaaataattgagatgatgtggcttaatgagagaaaagagaaataacattaactaaacttagtggggatgaactatataagtactgcaccatccgtcccaaaaaaagtgcagttttgcactattaacgttcaacgtttgaccattcattttatttaaaaaatttttatatctagtatttttattactattagatgataaaacatgaacagtagtttatgtgtgactaaatacttttaatttttttacaaattttttaaataaaacggacggttaaacgttgggtacggatatctacggctgcacttattttgggacggaggtagtatataggatacttaccgatgaggacccccagctccgacagcagtgcgtatactatcacccacaatgtactccctccgtactcgtaaaggaagtcgtttgggacaatgtttaagtcaaaccttgggaatataaatcatgaataactctcaagttgttgagtttgaaaatgtaaaaattatatgaatagatttgccttgaaaaatattttcataaaagtatacatatatcacttttcaataaatatttttatataaacaagaagtcaaaattatgttttggagaccgtgtcgctgtttaaaacgacttcctttacgagttgagggagtacttggcaaggggagagaaggggggatgctaatgcgtgcgcgcagccgcgcacgcccctccccctgcgacgccccctagtccactgttcactattgttccgttatacaaggacatggcccatcattatagttgggccgtccagctaggtgcggcctgttgggcccaaacgaatttgcgagtgacgtgtggcctgtaacaggccacctgttacacttgacaggatcgatggtcttctcttccgctgccaatcacttgtcggcgtacggggagccctggctaactgagaatttggggatcacttcggcacgtcatgcagtcatgctatagctctggcaacggatctggtatggtgtgttgtactgctgtttcgatcgatttcagtagcaaacaatagcaacacaaaatgcatcgaaagcttgatagaatggcaggcaaatacgtcaaaactcattcaacacatacgctataataatatactccaactagtactaacgacttccgatcctcaaattcttgccgactcagcagttgggctttgcaatatttagcacgatggcgacgaccaaggtgaccgcgataagcaccgggaggaatgtccgcaagagagttttggccaagaagcttgtcacgaaacaccacaagaactcttccaaactggacggacaccggtgaagattcgtgagccctcgccatccggcgcgcctccagatcaccttcccgaggcagaacggcgcccagatgcccgggaagcagagcagcaccgatgccgagcacagcgcgtggacgaacaccaccagccaccggctgtccgcgccgccgccgagcgcgacctggagcccgaacgcgaacgcggcgaccatgaactgcgccccggccgtcacgagcgcccacgccgacccctggtaggcgcggagacggcccctgctcggccggacctccctcgcctcgccgacgacgaggaggcaggtgcccacgatggagcagaggaacgccatggtgtccgacaccgcgaacgccctgaaggcgaaccgcccggccgacgccgccgtcccggcgttcgggtggtcgtcggcgacgtagccccccggaacggtgagagccgccgcgaacgtcaccgtggcgatcagcacggacgcgactgttccggtggatgtcacgccaccactgtccttgggagcatcggcatcctccatggccgatgggatgccagtcctagcatgatccccttctagggtaaccggtgctctggtgcagtagaagagattctttaccacggctcgaggattctgtacacaaaaattatcacaagaaagaagacagattaattggccaagtaaacaggacagcacatgaaacgattctctgcagctgcgtgataaccaattgtgatgaactaatgaactgaaccgtgttccattaccagaaaatagtgcaaaccaggttgcagatggcgataagcaaggtcagcagcagttagaccatccctgttggtaatggctacatcgacgctcatcgtctccaagagtaaactgaccatccttgggtgcccatactcggcggccaaatggaggggagtatttccttcattgtccattgcattcatcaggataccaaacctgtcatctcggcaaatgtagcgaactatgctttccttgttatgttcaacagcacaatgcagaaaatttcttcctcgatcatcgaccaaatcgttgtagttgttggggcatttctgtatgagctcaacgacgatcctaacactgcccatcacagcagcaacatgcaaaggaaatgatccttggatatcacaaaccagagctagggagggctctgcatctaggaacagctgaaacacgtcaaaccgctcaatttgtgatgatatagcaaagtggagaggtgttctgcccgacgaatcagctttggttagcagtgttcgaccctctggcttccagtccagtatttctcgcgcgatttctgattaaagacataaattgactttgaattttcatgtgtcattcacaaattgctcgcgtgtttgtgatcatacctttgctagtagttgccgcagaatgcaaagctgtccgtccgtccggaccagcggccgaggccggcgagggcgttccatcaggcaacgggtggagcagcgcccggacaatgtccacggagccaaccgtcgccgccaggtacagcggcgagacgccaccgtcgttggccacggaggccagctcgggagcctccgccatgaggagagccaccaccccggcgtggccgttccgcacggcctcgtgcaaggcggtggcgcccaggcagttcgtcgcccgccgcagcggcagcgccgctgacgccgcgccgccggctcgcagcatctctgacaggaggcaggccgccacgtcgcggtgcccggacttggccgcgcagtgcagaggcgtgtcgaggaacctgttgcgcgtggcggccagcgcgggcgccgtcgcgcagaccagcgccgcgagcgcggcgtgcccgcgggtggcggccacgtgcagcgccgtgttgccgttgcccgtcgtcacgccaaggaggcggctcgctcccgccggcgcgcggccgtcgtcgtcgtcgtcgacgcgtatcgccacctgggacagggagtggccatggccacggcgttctctgcccagcaggtccgccatgcggacctcgtcgccggaggtcagcacgtgtagcagttcggtgtcgagcgtctcgttgcaaggtccgaaatccatggacgcaccgtgaccgtgagtttcggctatggctttggctggtctagacgagaaggtgaaaggtaattgatctaaacccggttgaaaaatccatttcgcgctattccattccatcacttgatttcgctgaaacggagactagtagtcaacaaaaaaaaaatccccatatagctaccggcaaaagcaacacaggtgagttggcatgcgaggattgggggtctcacgagtggcagtggcggcaaaaagccgtattctctctcctcccctcgcgctgcaagtcccaactgcagaactgctcagcttttaaaattgaaacagataaaccgaaaatatgtggtgcaaacctaaaagttatcattagataaaaatagatgcatggaatttgttaattttatcaagggtaaaagttttacttgtaaatttaattatgagtaaaagttttactgggagtaaattttttttactcttgagtcttaatgacgtagacaaatttttaaaagtctatttttggattcaacagtaattttcactatatatttttcttaaatataaacggttcctcttttttccttcgtttcttggacaacgttgatgatggtctcccagtaagatcagaaggcatgcaatggttcagaaaccatctcagagacaccatacagcaccaaaaagtaaactgataaaaacatccactaaattataatttaatcaaaaggaaatgccctccaggggcaaaacgttatgcaaattaagcatcatgagaagctaaatcagttctctacaatacacaccaaacctcagctagaaacagagcgcaactgacgatcacctgaaaaatcactcaggggtgtttagatccagaggtgtaatccgtcattagcaaatgtttactgtagcactacattgtcaaatcatagagcaattaggcttaaaagatttgtcttgcaaattagtcgcaatatgtgcaattagttatttttttaccctatatttaatacttcatgcaggtgctcaaacgttcaatataataggatgaaaaattttacggtggggtcttaacagagcctaattcaatttgtaggatcgaaacacaagaactaagccaaccaaaggggggagaatggttggcttacccaaaaaccaaaacttttagcggaattaaaagttaccctcaaattcgacagattgcggtctgaccgaagtgtatatgccgatctgactgcctgaagaacgtcggtctgaccgaagttggaacttcggtcgaaccgctgagatcgcctgccagctcctgtcgccgccgccggtttgatgagcaccgctcctccgccggtctgaccgacgcgatgccaccggtctgactgccggtgtctcgccggttggaccgccgcacccaagaaaacacaaatagaagaactctcaaagtagatgacaactttattgcttttctctgtgtttacaaagtacaccaacagcactccttacaaaaatttcgactaaactcaaaaccctaactaaactagaaactcaatttctcttagaagcgataccgggaagtctcacgctccctctctatttatatatgaggtaggcagcctaaagccacgaaccaaactcatactagaagttctaatcaccctaggaaaccttctcgtacaagaaataaactttacataaccaatcataccaaatttgtactccttccaaattcgactccacaacccatacgtacacaatacctccatcatatgccatatagaatcatcaccaaccacgtgcattgaactctagccaaagtatctcgcatgatatctaacagtcacggacatcgccttaccaccaagtcgactctcgatccatcaccgcaaatactctcccgaggcatcaagtcacctacacatgaatcaaacaaagaaaccatattcccagaccaagctatccccaacttgacttattagtagcaaacaacagtattacatatgtatagtatccatctagaagccataaatatgaaacaatcaataaacaacccgaaaccgaaaccgacacagcgtcgaccagtcagaccgcgagctggccgatctgaccgcttgatcaccgccggtctgatcggcatacacagcctggtctgaccgaacccaaaccgcagcagttcctgtagatcacctgaaaattccaatcatctccaaaaccatttcgcaaataaattccaaatatcaaaaccaataaactccaattccaattgttcatcacagaataataatcaaaaacacctttgattttacacaattctacaaaaccatcatgctccagtcaattatagagacaacgagacaaatatccgcaaacaacaagaaacttcccctctttctaccctaggccgagttgtaaagagaagttcaggagagctacttcacgattttctgtgagcaccattctcagactacttcccccgtcctaaaatatagtctttttaagattgacacgggtattaagaaagtatgtgagaatgattgtaggaagtgtgtgatttgttgaaaagagaaagtaagtaaagaagaatggttgtgattggttgagaggaggaggtaggtgaagaaatagcttcatcttgtgacaagacattgtgctaaaatagctacattttaggacagaggtaatacttaaacattatattttttctaggagtttcttttaaaaaaattaaataaatctatttttaagttttcaatagcttttacttaattagtcatatcctaatgacttattttgttttccgtgctaaaaaaaagctcaccccaacctaaatttcaaaccaagccttatccatttcccatgcatttttgcgaatgcctatcgcatagacgcatagtatgtcatagcgcttgtaatcttgtatactccatccatccaaagaccaatcctagcattccaatgtaaatttaatgggagaaaacttgaaaccgaagtttcagtaaatttgcaattcaaggaagagactttgaagcgtgcaaactaatgtcatctcggctgttctaggtatatgtctgttgagtgcaaatcaatatgaacaaatgaatgttcatgcaccagctctgctcggtggacggtctaatcttcaaatcaatctgaaaatcaatatgagcctagtgataagcagtttggtcatgtaccacctctgctcgttagacgttcgcgcaacaggaacatcgccgctgccagtaagagcaaggccaagaaattcctgaagagggacgttgtcattcacgggcagctcatatgttgggtttagtcctacatcagtaatttattatggaggaacatgacttaaaaggtagggacggacctcaccgatcagattagtcttttgggttgtataggcctagaacctaaagttgtagctccggttgggcctgtgatggagcagatccaatgtgacctgggtggcccacggttggtgggccaagtggtatcaaagcccaggattggaacccggaacaataggtaacagggccaagtggtatcaaagcccaggattggaacccgaaataataggtaacaagtcttttgggtcatggtgaacaataggtaacaagttttcggggtcatggtatgggttgatgtgatgtgattgataatgggtagcacgacttacgtcaaagattgttgggtttagtctgacatcgagaattgatatcgggggtcacatcggtaattgtaattgatgatcggtaattgatgatggggagcgtgacttaaaggtgggggcagtcctcacctatcatactattttttgggttgtgcagacccaagacctaaagttgtggctccggttgggcttgtggtggagcaggcctaatgtgtcctgggtggcccacggttggtgggcctaacaagtggtatcagagcccaagtttgaaaatggttttgtcccacatcgggaattgatatcggggtcacatgggttgatgtgacgggggagattgttgggtttagtcccacatcggtaattgatgatcggtaggggagcgtgacttaaaaggtgggggcagtcctcacctaaaagattgggttgtgcagacccaggacctaaagttgtggctccggttgggcatgtggtggagcaggcccaatgtgacctaggtggcccatggtcggtgggcctaacaagtggtatcagagcccaggtttgaaaaccggaacaattgttatgttcattcccacatcggtaattgaacaattgttagatttagttccacatcggtaattgatgagagggaagcacgacttaaaaggtggtgcagtcctcacctatgagactagtcttttgggttgtgtagtcctatgacctaaagttgtggctccggttgagcatgtggtggagcaggcccaatgtgacctgggtggcccacgtaccctagaacctaaagttgtggctccggttaggcctctggtgaagtaggaccaatgcgacctgggtggcccacggttggtggggctaacaagttgtatcagagcccaagtttggaaaccggaacaattgttatgtttagtcccataacggtaactgatgatgggggagcacgacttaaaaggtgggggcaatcctcacctatcaaactagtatttttggttgtgtagacctatgacctaaagttgtgactccggttggacctgtagtggagcagacctaatgtgacctgggtggcccatggttgctcctgttgggcctgtggtggagcaggcccaatgtgacatgggtggcccatggttggtaggcctaacaagtggtattagagcccaggtttggaaaccggaacaattgttaggtttagtcccatatcggtaattgatgatgggggtgcacgacttaaaagctgggggcaatcatcacttatcagactaatcttttgggttttgtaggcccatgacgtaaagttgtggctccggttgggcatgtggtggagcaggcccaatgtgacttgggtgacccatggttggtaggcctaacaagtagtcccgcattggtaattgatgatggaggagcacaacttaaaaggtggaggcaaacatcacctattagactagtcttttgggttgtgtaggcccatgacctaaagttgtggttctggttggatctgaggtggagcgggcccaatgtgacatgggtagcccatggttggtaggcctaacaagtgggatcagagcccagagtcttttgggttgtgtagacccatcataaagttgtggttccggctgagcctgtggtggagcaggcccaatgtgacctgggtggcctatagttggttagtaggcctaacaagtggtatcagagcccagagtctggcccaatgtgacttgggtggcctatggttggtaggcctaacaagtggtgtcagaggcagagtcttttgtattgtgtaggcccatgatctaaagttgtggttccggttgagcctgtggtggagcaggtccaggactagttttttttgggttgtgcaggtctaagacttaaagttgtggctctggttgaacttgtggtggaacaagcccaatgtgacatgggtggcctacgattggtggacctaacatcatcatcagggagggcggcagcatgtcagcgactgcaaatgtggcagtgtggatttttcaccgtgccaaaaaaataaaaatgagatgggtttgggtcgagagccttactgagagataggggagggatttgcacaaatttt

SEQ ID NO: 2704 - DNA, 2362 bp, Oryza sativa
taaagtcagcgtgccaacgtacattcagcaccatgctatttggcgctgaggtgtctaagttcagcgccacatgatttggtgttgagcaaaagggtcagatttaaaataagttttggaagcggttcatttgtaaaaatagtttttgcaaagggtcaaattgtcaaaatttgtgagggatttgggtgcctttctattttggaggtttaatagaggccctgtttagattctaattaactttttttcttcaaactttcaacttttccgtcacatcaaacttttctacacacaaactttcaacttttctatcacatcattttaatttcttcaaacttttaattttagagtggaactaaacgcagccagagttttgtaccttgatttttcttcctttacctcaaaatctatttgggagcttagtttagatgttccgttggagataatctaactagaagcaaatctaataaatggaaatggacgcaaaccaatggtttgaatttgcttagtttcataacgacaacaaaatcatgcagctctttatagtcaatatacttctgcggttaaattggtagggctgcagtactaattaactagctcatggcaaaaatagaacaattaatgttctatacacaaaacaacattatgaaatttcatttgtaccttggctgatagctgccgcaacatgcaaagccgtacgtccctccggctccgggccagcgaacgatgccggcgacggcatcccgtcacgtgacggacgtagcagcgccgcaaccaaacacaccgaaccactaccagtcgtcgccgccaagtacaacggcgagacgccatcgccggatgctactgcggccagctcgggagcttccgccatgaatagatccaccacctcagcacggccgtgccggacggcttcgtgcagcgcggtggcgcccagctggttcatcgcccgcagaggcgccgtcccctcggcggcgcgcatcatcggcaagagacagtctgctacatcccggtgcccagccttcgccgcgcagtgcaacggcgtgtcgaggcacttgttcctcgtggcgaccagcgacggcgccgtctcgctgatgagcttcgcgagctcgacgtggccgcggctggcgacgagatgcaatgccgtgttcccgttgctcgtcaccccaaggagggagctcgtacctgtcgcggcgccgctgcacgcagggccgcggcgccgacgttgattgagacctgcagggcgtctgttcgacggtagccaccgtcgtcgctgccgcagccttctctccccatcaacagctcctccatgcggaccgcgtcgccgtcggtgagcacctgtaccaaatccgcatcgagcgtcatcttttggcgtggcccgaattccgcggctgcggcgacagcatccgccatggttgactgaatttgaagctttatctgcggcgcttgctttgcttaaattgctttgtgtgacgcacacctcactgcgccgatccctcttttttttttagatgctgaaacactgctttggtgaggtaattactcctaattaggtaaaggacatttgtgagcactgctcgaggtcaatataatactcctttttttccccctcatgtggcggcttggcctcctttggatcttgaagcaagcccatcgcaatatcgcatcttattgccctgattccttgattccttctgcctccagaccgtgagtcggagcagctgcctgttaatggcggcggcagtgaacaaccctcattttattccgtagcgatcgagcaccatggcttctgcttggccgtttgcgtttcgttgtgttcgcggacgcgcgcggcagtgccggcgggcggtgactccagctgccgtactactgctgcgaggttctctctcggtgaaccatgaacacgagactgtttagtggcctgaaaagttatgtgaggtccgtgcggcccgttacagttgggccagaaagggattcaaagggacatgctaattatggctcgattttgctatatatttgtcgacaaattttctcccaaaaatttgacagatgtaattacagtacaatcgtagtgtaattacactgtaacttgcatgtaattacattgtatctatagtgtaacttgtatgtaactttcaaaaatctctctgtaatatgttatttcggtaaaatggaggttgtgggaacaaatccttacacatatgtgtgtgctgtgatttttttcttcctcactgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtc

SEQ ID NO: 2705 - DNA, 14822 bp, Oryza sativa
aggggctcagcgtgtgttttctgagctctcatactcttccgtgtgcgccaagtttcccttgttcagcctaatggccgagcaagcaaaggcgcacgacctctctccgagtgtgagcggcgacgacgggagccaaacccgcgccatcgagctcgtactcccccacctcctccgcgccaaagtcctaagcggggggaggcgctcgagagggttgaaaaacccatagcatcaccagtcgcaggtgatgcaggagagcggcgagacggggagcgtcgcctcctcgtctacggtgacggcagcacgccccagggagtgcttcaggctgctggcgcgctcctacgtcacccgcccgtcgtccctgacccggagtctccagcccagcgatggctggacgacgtggccaacttggtcatgacggcacagcagcgcctgggtgctggtggacggtccgccaccaccaggacctccggcgccgccaccaccggctctgtgtcatcaaggcggagggcgcggcgagcggcggctgctgcacgccatttggctaccactccctcgtcggcgcctccgactcgggaggatcagcatgaagagccggatgcccgcctcgacatcgagcgccgacgtagtgatcggcgtgctccccgcgcaacggagggtgcctcttcgtccagggtgtcacctcgacatggacgtaaggaccagccctccgtgcccccggttggtggtgttggctgtagagcctttgtggcgagtcttcggaatgttcgttggcccccaaggttccggcccaccatcaccgagaagtatgatgggagcgtcaaccccaccgagtttctccaggtctatacgaccgggatcgaggccgctgggggagacgacagggtcatggcgaatttctttcccatggccctgaagggacaggcgcggggttggctaatgaacctgccacccgcgtcggtccactcctgggaggatctgtgccagcagttcaccatgaactttcaaggcacctatccacgcccaggtgaagaagcggacttgcacgcagtacagcgaggggatgatgaatcccttcgctcgtacattcagcgtttctgccaagtccgcaatactataccttgcatccctgcacacgcggtgatctacgcgttcagggggggtgtgcggcacaaccgcatgctcgaaaagattgcctccaaagagccccagactaccgcagaactttttcagctcgcggaccgagtggctcgtaaggaggaggcctggacctggaacccctccggttccggtgtggcagcttcggccgcccccggatccgccgctcagacagggcggcgtgacaggaggaggaagaaaaggtcggtccattccggcgacgagggtcacgtcctcgccgtcgagggcgctccgcgggccacccgaaaggggaggcctgcgagcgacaaaaagaaagaggctggtactcccagcagggagcgcccagccagcaagtggtgctccgtccacaacacctccctccacgatctcgcggactgtcgcgcagtcaaaaacttggctgagcgaacgaggaagtgggaggaggacaggaggcaggaacgccgtgagggcaagtccgcggcagttccctccggtaaacggcgaagtgaggccaaacagaaggcccccgccgttgacatcgatgacggtgatgatgacctaggtttccaagaacctggggccaccattgccactgtcgacgggggagcgtgtgctcacgtttctcgccggagtttcaaggccatgaggcgagagcttctcgccgcggcccctactcatgaggcgacgcgtcgggcgcggtggtcggaggtggccctcacttttgaccagaccgaccacccaccgtgcgttgcccggggagggcagattgcgatggtggtttcccccaccatctgcaatgtgaagttgggacgtgtcctcatagatggaggagcggctctcaacattctttcccccgcggcctttgatgctatcaaggccccggggatggtgctccggccgtcccaaccgattatcggtgtgacaccggggcacacatggccattaggtcacatcgacctaccggtcacctttggtggatcagccaacttccgcacggagcgggtgaacttcgatgtggcggacctcagtctgccctacaacgcggtcctagggagacccgcgttggtgaagttcatggcggcggtccactacgcctacctccagatgaagatgccgggccccggtggccccatctctgtccgtggcgaccttaaagtcgcgctcgcttgcatggagcagcgcgcggaccacctcgctgctgcgaccaagcccgagggtggtgacgagaggcttggcacctccgcccccaccgccccgaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactcaggttaccatcagattcgcatggctagggaggatgaggagaaaactgcgttcattacccccataggaacctattgttatacatcaatgcccttcgggttaaagaatgcaggtcctacttttcaacgtactactcgaatttctttgggtagccaaataggacgtaatgttgaggcttatgtcgatgacttggttgtaaaaacgcgcaaccaagaaactttactttcagatctagcggaaacttttgagaacctccgctccgcccgcataaagctgaaccccgataagtgtgtgtttggtgtacctgcgggcaagcttctcgggttcttggtctctgcccgaggcattgaggccaaccccgagaagattcgagctatcgagcggatgcgcccccccagcaaacttagggatgtgcaatgcgtcaccggttgcatggccgccctaagtcgtttcatatcaaggctgggagagaaggcgctacccttgtttaagctcctcaagcgctcggggccgtttacttggacggaggaagctgaacatgccctcactcagttaaaggcatatctcagctctcccccggttctagtcgccccggagccaaatgagcccctgctactttacttagcggcgaccccctaagtagttagtgcagcgttggttgtggagcgcgatgaagacaatcctcatttcgtgcacccccattctgtgctaacttggcccgggagcgagcggggaggagaggcccccgagtcggacggtggcctacggcccctgacgaccggagtcggccctctgcccgcttgtcagacggtgctagatgcccccgaccctcaggagggccccaaggccactgcgggaaggccgcacttaacgccctttgaccccgaggctaaccctgtgctgactcgacccgggaaagagcagggagaagaggcccccgagccgaacggaggccagaggcccctgacgaccggagttggccctttgcccgcttgtccgacgatgcaggagcccccgacccccaggacggccccgaggccactgagggaaggccgcccctttcatcctccgaccccgaggtcatcggcacagaagacaagtgcgccccgaaaggccacttgaacgaagaacgccccggggatacggcccctagcagagaggatcggccccaccgaagggtgcagcggcctgtctactttgttagtgaggccctccgggacgctaagacccgataccctcaggcccagaagatgctttacgctattctgatggcctcgaggaaactgcgccattattttcaggcacatagggtcactgtggttacgtcttaccccctcggtcaaatcttgcataatcgagagggtacaggacgggtggtaaaatgggcaatcgagctttctgagttcgatctgcactttgaaccacgccacgctatcaagagccaggccctcgccgattttgtggcagagtggaccccggctccagagaccgtctcaatccccgaggccagcacgaacccctcgcagctgcctcacaccacccactgggtgatgcagttcgatggttctctgtccctccagggtgccggtgcgggggtcacgttgacctccccgaccggagacgtccttagatatctggtccgcctcgactttcgagcgaccaataatatggcagagtacgagggactccttgccggactcagggtggcagccggactggggatccgccgtctcctggtgttaggcgattcccagctggtcgttaaccaggtctgtaaggagtaccggtgctctgacccgcaaatggacgcctatgtacgccaagtgcggcgtatggagcgccattttgacgggatagagcttcggcatgtgcccagacgggataacatgatagccgacgaactctcacggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcggacccgaagggagcgctccaagctcccttagattgattgcttggatctctgagatccaaacatacctcacagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgctgacatccatgagggcgagtgcggagcccattccgcctcgcgcaccctggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcaaaccgaaccacaccaagccgagagaccggggaaacgcctttcttcctcgtctacggcgcagaagcggttctcccatccgagctcaccctgaggtctcctcgggccaccatgtactgcgaggctgatcaagatcagcttcgtagagatgacctcgactacttggaagagcgaaggcggcgcgcggccctccgagccgcgcgctcccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgtacggctggccacgggcgacggcactgagctgccaaacccgtggaacatcgaacaccttcgtcgcttctacccctgagggggggggtcgggtgtcaggtttcgggctcaggctaaccccgcacccccctcgggtgtgcagggttagccgggggctaccacacatgcacagccttacttttcttatttcagcatttcaataaaagcagtttcaatttcctaaaggttgtgtctgtgccgtttttccttctgaagaatcttaacttgaaataaggtcactcgtgctcaaccttgccctcgggggctcggttcggtcagctaaaatcgccaagcggggcccagaaccgagccgtgccctggggcgtggtgaactccgggggggaatcggcaaaaacccacaatcgggtcacccataaccctcggtcaccatgttcccggcctggccagtctcgacatgtggatctccccaggcactagccccgacccgagccatttgaggatcgggacttgagcacgagcccttaaatcaagctaaaatgcaaaaggaccacggcacaaatcatcctcaactcatatgcatagcaaaataaagttaacatagaaatttttcatcatttttgattgcagattaagttgatctatacaaaaagaagaaagaaaaagaaaaaattggagattggcgggggcctgggggctcattccaatgcgcccgggtcgccggcctcgtcgccaccgtcgtcctcactgctggcgtcgccctcctcgtcggagctgggggcgaacgcgagccgaggggccgacccctcgaagctttggacgatgtggttggcggcatcccggacccgcgcgcgcgcatcgtcctcggtcccgggagggaactcttccagcgccatccatggggagaagccggggtccctggcctggtaactcgctaacacgagttccaccgctccttggtcgaggtccctcgaggatgacttgatggtcttctcgagctcctcggggagttgttggacagcccaggccatcctcctaaggtgcggggcgaggccttccagattggaggagcgcgaaattgtctggcctttccagaggcccgcttcccgaccggcgcgatccagccgggagactgcatcccaaagcatgccgggccctatctcacccaacaagcggagagcctcggcttccccggtggatgagtccagggcgcgctgcatgtccgcgacggtgtgttcggcagctgcgaggcgggcgactaagtcgctttcgcccgtagccgccccgccgctgcgctccctcgcgtccagctccttttctcgcgcctcgaggttagcagcccgctgctccagcgcggctctctcggcgcggacgcattccagattgcggcgcgcctgctcctcctgcgctgcctcgcggagggacaggctgtccgccagccgttgtgtcgcggcctcggactcctcaagagctcgctcccgctcagcaagcgcgtcctcgcggagccggagcgcggactcctcttcggcgcaggcggcctcgtgcgccgccagcgtcgcctcccggatagcggcggcggcctcgcggtccgccaagctggtctccacggcgccggcatgatcttccagtgccatggcacgggcctcaagggcctcttcgcgccgccgggacgccgcttcagcctccgttgctcgctgctctcgggcagcggcggcgtcaaggaccccctgggcggcgtcgagctttttctttagctccgcctcccagctctcgtgttgaaggcggagggagtcctgcgcctcaatcatcgcggtggtggcgatgagggcggcctctcgctcctcctccacctctcgggcgatctccgccagcgccgccttgcgggcttcaagctccgagatgtggcggcggtgagccttacggcccacctccaccatggcgtccaccgagcgccgcccctcctcgacgcgcgcccatgcggcctcgagctccgctcgttccgctcgcaaggcctccacctgggcgctgaatccatctagcaccgcggtgtttgcggcggccaaggcttgcagaaggggctcggcactcagcggggcggcagaagacgaggagaagagccgccttggagaaaatgcgacgcggctcggcccgcctgaagacgcactgagctcggggatgtcccccggacccgtttggtcctgagcgtcgcccgagggagcgggcccaggcgatgcgcccgcggccttgtcgcgagccgccccggaggttgtcgcctgagcgtcacccgagggagtgggcccgagcgacgcgccggcggtcttgtcgtgaaccgcctcggaagacgccatcgcctcagcctggcgagcccgggcggtttcctcccgagtggcttcttcagcctgacgagcccgggcggcctcctcccgagcagcttcttcggcttggcgagcccgggcggcctcctcccgagcggtatcctccgcctgccgaacccgagcggcctcccgggcggcctcttcagcttcccgaaggcgatctgcggcctctcgccggtcagattcccgcctccgtgcctctgcggccgccggatcttcggcctcggactggccggacttgggatggtgggaggaacgcgatgggatatcactgaagcagaaagaaaaaccagaaggcaaacaagatgggtaagagaaaacctgcttttgggataaaagaaagacggtcgcaaagagagcgggacgaacctgcgagggggtcggttaaatgaccaccttggaggggaaattaggtttccccgggatggttctgtctcccccatcttgcgcagccgcttcttcttgcgctccccctcgggctgcgatgtcggcgcggccccctccgggcgcctgctgctggcacgcaccgccccgccccctcggggaggagatgggggaggtgttcctcccagtttcctcttcccccgggcgtcggtagggcggttgctccccgagcccccgacgcggggcccagaagcacgaccccctccgggggtagattgatccccccggcggctcccacctgcgccgtcatggcccttaggagcctgctcctctgaggccccgaccgccgtcataatggtcaagatggaggcgcgatctgggtcgctgcagagggggaggataccgtgggggatgagggacgcctccacggagttgagatttagcacccgttggatcagtatcttgaagtcctcgggggcccaatcccatctgactccctggtgggtcctcatatagtcttcgggcccggtgtactcccaggcggcccgagcgcgccgctggagcggcgcaatccgacgacggaggtagtcgccgtacaccatggccccggtgagcccctgggatcgcaggcccgcgaggcggtcgaggacggcgtcatagccatcccccagatctaccgacgcccgccagctggaggcctgcaccgggggctggctcggaagtcggaggcgcgcttcgttggcaaggggggtgtagaaccagtcgcttttccaatcgtcccacttcttgcggagggcgcaggggatgtagcggttcaacaccggcccccgcggctggaagtagcaaccaccgaccaccgacggcggcgataccgactgcacggtgaagaaccaccggaacagccgaagagatgggcgcaccccaatgaacatctcgcacaggtgcgcgaagatggccaaagtcatcactgcgttgggggtgaggtgcgccatctggagatcgtagaactccagaacatccataaagaaagaagaaaaaggaggaaccaacccggccattgcaaaggggaggaagaagatggaccgccccgggtaatctggtgctgggcgcgcctcgcccagcatcactatctcccggccagtggcggattccggcatgaagcggcgcggcagcccagcctgcctctcgctcacaatgcgggaaggcggtagtacgctaccgtcgagcagagcggagccccgtgccatgtcgtcggagaaagagagggttgagaacgagtgtgtgtggcgaaggtgaggcgcagcaaagagagagtttagggcgcaaacggcgaaggaaaggggaatagtggcgaaaggaagggagcaagtcctttcctcgatagctttatacccttgccatcgctgagcccggctcctcgtttctcgtgcccactatctcgctccctcgttactcgctatctcgctccctcgtttctcgcgcccacgcttccactaattccattcgcccgcttgcggcgcatgaggtggatatgcggttgtggcagtcgagatagatcgtatcgtgtgtgcgttaattacgctcgccgaccgaagcgacgttaccatatctccagacgaaacgaatctgcacgcccagattcgagcgctgctcaagtgatgtggcagtcttgaagagaccgcccatgactgacggccaagacaccgttaccgatatgcgtggtttgagaccgttgggtttttgcccaatcacggagaccggtcccacctgtcaccgggctttatgagtggcgtcatgcccgaccgcttcccttgagaaggatgatcgccctgacataacgccgggggctactgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtcgggttgctcctgccccggccccgagggccgaggtgccccgaccccctgtggggtttgcactatgtacataggttgggtgaacacggtagggctcacctaaccgcatttattgcggtctggtcaagcgtgtcacgctgcatgcagcgcaatgcagcgcgctcttttatccggtctgtgaccagtcacagaccggtcggatcaacggttaggtggcgactggcggtctgacgcacgcctcgccccgtcccgtcaagacgagagcctctaggcacacgtctccagccggagctagcgtgttacctcttagagatgacacgttagccctggttagatgaataccaggcttcatcccaaccattacaggcaagatgctacaaaaagaagggtgatcatgcagatcgctgaactgacgcatagaggacaagaatgaccgatctgtgaccggtctgacactggtcgcgtcagcaacagacagccacgatcccacgttgcgcctgtctccgccgggagtggaggtaggtgtgggctgtcccatcgaagtgtcattcggacggcaaccataccaatctccgtccataaagagaagaaaagtccagtttggaaagggaagggtacatgtggtatccccttaagatataaaaggaggaccatgcccacaaagagaggggactggattctcccgggagaggagagggctggttgatattttgtaacttgctcttacacagatccaccaaaaacacaggagtagggtattacgcttcccagcggcccgaacctgtaaacatcgtccgtgtctcgcgtttcttcctggcacgcgatctttccacatacagagagagcttgagatctcaccctaagcccccggccgaactggcaaaggggggcctgcgcggtctcccggtgaggagccacgagctccgtcactcaccaaaacaaatcttgtaatagatttaatgattcaaaattacgtgaaacttatatacaagttacactatagttacatgcaagttacagtgtaattacatataagttacagtgtaattacactacgattgtactataattacatctgtcaaattttcagaagaaaatttatcgacaaatgtataggtggtcccattatggcttagtgggccgaattttttttatttatacatttttttattaaaatatttaaaaaacaattttttgtttcaaaaacttgcaaatcttgtcgcttctcgtcctctaggagggcgatttttaaaaatcgccctaccagagagcgataagggacctaaatacaaatttttcagcataggttgtagctctatgattttacaatttaaaattatattatataaagtcagatgaaataaaactttatatcaaaattgtagatctcgaggagctctacaactttgtagttaacaactttttcatttaagatcttttagatataaaatattcgttacaaaatataaaacctattttaaaaaatctcagatctacatttgaaatgacatcggatggagataaactttatacaaaagttgtagatctttccatttaaaatcatttagagtattgaataagcattattcgtttttaaggaattaaagctggtgagaagggtttgaacacaaataaaaaatttgcatttaggtcccctatcgccctctggaagagcgatttttaaaaatctcccttccaaagggcgagaggcgactagatttgtaaattttcaaaacaaaaaaatattttttgtaaatattttaataaaaaaatgtaaaaataaaaaaattcggccttaaagcacatactttatccgtcccataaaaaataaatctataattggatatgatatattttaatactataaatctaaatatatgtatatccagattcgtactattagacagggagtaagtccatcctgctttcatcctatcggctagctgacggagaattatttcgctaaaaaagaaaaaaagcggatggagaactggtgacctttgctgacgacgtcgtggcgacaagcaatggcacacgcacgggccggacgtacgcgtttgttacagcaaacggccaatagacggttcttcaatctgctaccttctgtccggtagaagcagaggaatgaagaagtagaatgctatctcggctgtggtgattcgcgtgtaccgtgtatcacagcagccctgcagcgacattgataatgacgggtgtataccgtgtatagaagtgatccctatgtagtttgtacagaagttatccatggaatggcttttatttcaaaagagaattgttctgaatatcgatacaacgcatcacactttccattaaaaaaagatacaacgcatcactcttaaattcttaattatattcaaaagcaaaacacggagggtttgtggtagagatatactccctccgtttcaaaatatttgacaccgttgactttttagtacgtgtttgaccattcgtcttattcaaaaaaatttaactaattatttattcttttcatatcatttgattcattgttaaatatactttcatttacacatatagttttacatatttcacaattttttttaataagacgaacggtcaaatatgtgctaaaaagttaacggtgtcaaacgaagggagtatatcttagctcactgtcttggcataacaatgtcgagtgcgattgcgacgacgaaggtgacggagatgagtacagggaacaatgtcctcctaatatccatcaaaggtcccgtgaatagagactccaagaattctagtaagctcgacggtcgatcgtgtatgttgatgagtcctctccaccctgctcgtcgccatatcgttttccaaagcccaagacagaatggaccccagatgcccgggaaacagaagaggactgcagctgaagacaccatatagacgaagatgacaagtccacggttggccgagccgagcacaaggtgaaacccgagcgcgaacgtgccgatcaggaactgagctccccacggcaccaacccagatgccagtaagctgtaccaccaacgatggccgcgtggaatctcctttgcgctaccgtatataaggaagctggttgccacgatggagcagaggaaggccatggtgtctgtcacgacaaatgctcggaatgcaaaccggctcgccagtattgctgtcccggcatgcgggcggtcgtcggcgatgaagcccccagggacagtgaaagctgccgcgaatgccactgtggcgatcagaaccgacccaatcgttccgtttcttgtcatgtaatcttcttcgtcgtctaaagcgggtgcaggttcgtcgacaataatgtgagcagcgcgatgatttagagaaagtggtgctctcacccagcacagacagttatgcactaatacgcgcggatcctgtgaaaaaaaagggtaatataggagcattgtcaaataaattggtactcactccgttttaagttataagacgttttaactttaatcaatatcaaactgctttaaatttgaccaagtttatagaaaaaactaacatttttaacccaagacaaatttattatgaatatatattcaattattgatttgatgaaactaatttattattataaatattactatatttgtctataaacttaagtcaaagtcaaaacgtcttataacctaaaacagaggactaatatataaaaagcaccaaatataagcccaaaggaaacaaatgacggaggtcgggtaacctatgaccagcaccagaaattggaaaccaattaaccagctagccgccttcaatacttgataccccacgctttgccgtggaatatatgaaagaatgcatattatatattatagaaatgatatatgtccatgtttaaataatataaaaatgatatatgaagataatgatttgacattaactgcatattgagttctaaaaaatacaat

SEQ ID NO: 2706 - DNA, 14826 bp, Oryza sativa
tccgtctactctagagaaaaacgaatacgggatacctttgggatgggattattcttgattggtcggattccggttccaattacagatatttttctcccggatacgaatacgaatatggtatcggggtttccgtcggatacggataataattcggatatccacataagccttgtgacatatcccatttctttataattctataaccttcaatatacctttttagattttaatagtagtccatctcttaacactagtccatactattaatattatttaaatttttaaaaatatttataaactatactatattttatataaaatgagctaattatatatgttgatatttgtttctattaggagttgagttggttttcgtatttgagatactccgtatttgtttccgtatccggcgaaaaatatgaaaatgaatatggtatgtgcatccgtccgtatccgcaccattttcatccctaatttgtatgatatttaagatactctagacaataattgctagtgtgtgatgattgtcgaggagtgatactcgtagaccggataaattgggtattggggtacattggtacgaggatctacatgatacgatatcaagcaaacggaagacaagaattatactggttcagaccccttgtcaggtaatagccctagcccagtttatatgggattaatatggaaaagccacaaaatacaatgggagtagatgaatctgatgataccaacgagatcctagtcgatggactcgacgaaatctcccggcaacttggctccgtatgcttcggcttcataaactgtggtggatgtattggcgatgagattcgatgccctttacccctccaagggggtcccttttataccgtggatcaccttggtctccaagtaagacccggagatatcggaccctatacggtacaacagaaactctatcctctccgagtatgaccgtgttaatcactcgacccgtagagatattttctataattcgtgacggattcctacaacgcatacggaaacaacccgtgtatgtgaaggtataccatactcgtatattccatactcactccttcccaaattgatcatcatataagtttatgcaccaagaccaatgttaatttaaatcatatcaataaagacaccatacacacattctcccacagtgcatgcatcgattaaaacctaatgacaattacaccctatcatgcacacattcatccatactgcattaattgtattccgatgaaatccgtatccatacagttatataatgatcaatttgagaaattttggattctattacatgatgatcaatttgggaggataggaggtatgccttatccgtaaccatgataatgatgtacacactttgtatttgatttaaaataccctagatagtaattgctagtggatgatgatataacatccttgcatgttgaattttagaagttagtgagcatcaactttatattaagatagaatacgtgtagaccaaattaagcaattacctagagatcatttttttaaagaaatggtcaataaccattaaccaatacgatccttgaagtttcgctctagagacgcggtttagttcctaaggctacaaataatccaaacaagttctcaaaattaattatttaacttaatattgtctttggtcccaaaaaatgataagacatgccccacgtcatcctcgcatgtaagggcagtaaggttttgaaataatcattgttatatatcatataaaaatatactattattatcctatcagtttgatttatccaactaaacgtcgatacgcgaacggcggccgcatcatcgcagccttgcacatacgatgattgctccagttcacatgtgacgccgtggcacggagaaataccaacgtaccatttcattgaacttcgccaatttctctcgtggttgttttcttttctctttttttatggtatgtgagggtagaatggttatttcatccctatcattgcatgtggcacacctatgaggtatttttatgggtctaatgactatgttaagccaaacgattaattttgggaacctttttcaacgatttgaaacctcggggactgaattgatccaggaatgaaacttcatggactgtattggccattcacccttaaagaaatacttcctccgtttcataatgtaagtcattctagtattttccatattcatattattattaatgaatctagataaatatatatgtctagatttactaacatcaatatgaatattggaaatgctagaatgacttgcattgtgaaacggaggtagtagcaaaaatacccttctgttgctaggaatagtaaaatgtccggtcgttactgtggactcaaacaacatgattattttaagtaagggtcaaatacccaatacccggactcaatttagttcctaacatttcctattatccaaaatagtcctacaaatttagcatacgagtagttggatccaccggtgcatgcgatgtcatctcaacatgtaaggtcaatatttaaatgtccaaagcaaccctacatttatcattagaaagaaacaatcaaaaaggaaaaagaaaaaaagggaaaaaaaagggccggcccggccagcgttgtttcgtccttattagtttcattaatttgttttgtttttctctttatttttccttagatctattttttttagtttttgagactaccaaaaaaattgttgcaagtttttcaagggaaaaactttcaaatctaaatataatttcactatagctataatataacttatatataagtattaaaataatatatacaactttatatctaacttatatagagattacaatgtagctacgtacagtgcagttacattatagattacagtgtaactatagtgtaattataaattataattacacaacaactatattagctatagtttcatttgaaagttttttttttgccaaaaacttgtgacattttttttagcaattctttttttatcttaaatggcatatataaggataggatagacatttagcgcttaccttgcatgcgggatgaggattacatggcatacgaagtggtgctcccgatgagtccaaggaatatattgtgccgcataaaaaaatatagcattactttgcacaatatgaaacaacaagaatatttatgggacgcgctaagtaccatgaaaaatgactatatatgaaatatatagatagtagatttaattagatccatgcctttgcaaagtctatggttaatttgaaaatctactgacactattgattcatttgtaactatatatgccattacaatatatttaaaactagatccatgccactttgtacatctcgactatgatttgaattgtttttttgtcaccgtattttcatgtggatcgaagtgcccatgcccccgatactgtgggactcacatatatgcgcgtggcatggtgcagcggcgtgcggcagcaagggtgaggctcccgtcatgtgcgagcatgaccgacgtgacaaccccacctgctgttgatggaagatatggtgcaggaaggacgatcggggagtattcacagtgttaggccggttgtcgatctccagggcatgtacaaccaaagccatccttagagtgccatcactaactgagcgtactctctgaaaaacatattcatcccttaatggaggataccctaggttggaggataccctaggtgggttcttcaaaatctaaggccatttgatgaagataagtcagcacaatgggtgtcctggcccatggtagccccagagtaaaaataccatcgatacccctccgccaacccatccccttctctctctgcccgctcctccccagtcctcttctttttctgcccgctcgtctctccatctcatcacctccgcccgctcctctctctgtctccgaccgtggcgaagaaggcgattgtggtcacgtcgagcgcaaggggtaccgccggcggtcccgccgccgccgctccctccttgccctccccgagtagctgccgccgccttcctcctcgccctcccagccaccgccgcctccctcctcgcatctccggcgacgccgccctcgtcggtgcacggatctggcatgccggcagctggatccagtgggccggcaccatctctatgtcaccaccacctgtctctcttgccacatcctctctctctccggtgctctctctctccttgccacccgtcatcgctgcctctctctcccgtcgtcgccgatggagaggggcacgcggggcacggtggccggggttggggccgccgtcagcgactcaacctcctcgccgcctcaggctcctcactactgccgtcggcctcctcccagtgacgaggtcgagggtagaaggggaaatcgtaggtgcggtagccgtgtccacgggcgccccaagctcccaacgcgtcgcctggttgcgactccccacgaaaagctagcgaggcgcggagagagccacgtcccccagcagagggacgcattccatcatgaggggacgtcatggacgaaaaagcaaatggccatcgatggagggcactagggatactctccacaggcacacattgaacatgccctcagaacctgcctcctggccgcagatctaggccaatgagtctaggatgcacgctcccatctttttagcggatcctgcccactatgactcctcctggccctccccaaccataaatggaggcggtgatctactcgctcactatatatggatctacaccgtctttattccacgatagtggacagtgggaggagtgtgttagtatgcttaatttgtataaggtatgtgacgcatgtttatctcttgtcgttctcccgatatttctccggattatgcttctataagtgtgtataggatgtgtgtgcatatttatattggtaagtatgtgcatgtgttacgtgcgttatattgtgttttggaacaagaaaattcaagccaactcagttaatatgctaaatttaaacttatatacgtatgatatatagaactgataaaaataaacttactttttggagattatgttaatgatctctaaatggagggattaatgatcttatatacgtatgagagagagaatagaacaaggggcagtacaagataattagataaacttaccagaaaatagcgcaatcggccgtgctctaacgttgaggcacagcaagaaatatctctagcagtatggccatccttgttcataatgcacatatcaacacctcttgtccccagtagcagaccgaaaatccgtggatatccttgtttcacagcaaggtggagaggggtatttccatcataatccgtcgcattcagcagcatcgcgaacatatcatttccgcaaatgtggcgaaccaccatttcctgctcgctctcaactgcaatatgcagaagatttctccctttatcgtcaaccagttcatagtagttgggacatttcttcacgagctcatcaataatcttggttcttccgaacatagcagcagcatgcacgggatatgaaccatcgctgtcagaaatgctagtcagccttggagaagcagcatcaccacctaggaatagcttaactgtgtcaagccttccatagattacggcaaaatgaagaggtgtcctccctgacgaatcggctctggttagcaaagatggaccttctggccagttcagtatctcctgagctatttctggtttacagttgaaatttactgagttcaatgatcggaacttcaatgaaaaagattaaaatacagcttgaatttagtttctaccccacctgaatattataaacttggagcacaatatacgtgaatgaatgctgttttacgtcaaaaaaaaatacgtgaatgaattacggatctagaggagatatcaggagagtttctagtgttgatttatgtaaattacttttattatatatataaattacatttatttttttaaaattacttctaagacactcaaaatgttgtgtttattgttgttttcaagttagttctataatttattgattaaatttaatttctaaataaaatcatgtttttaccgcacaacgtttacttttaatgtcgtgataactcattttcattttgtgttaagttacttttttattatgtaaattatttttggtcttcattcaatttacttttataaaagtgtctaaaaattaatttgatcaaatctgaaaagtaatttacatgtatgataaaagtaatatacatcatatatttttttcatcgaaatataattatatgagatcttactataactattttgtttcaataaatacaatggtgtaatcggattgtaaagcatataattattttaagagaaaatgttataagaagaaaaaaaaattggcatgcatttctctccgacatgactaccaatcaagcggataccaatcaagcggaccatgttgtctcgtctaataagactaaacaataggatatcctctcgtttcgtgcatgttatctaaatagttattaacaaatttttttaaaaaatacaagatagattaatatgaaatatatcactccactaacatgcaagttaaaatttaaattttacaaattgtaacaaaaataataaatatagttgcgaatgtatgataactatttttaatttaatttgttctttttttgcaacctgtagaagtttagtttggttttacatgtttatggagtgatatatttcatattaatctatattattaattttttaataactatttagataacatgcaaataacgatgggacattctctcaagggatgaaaatccatatcctaaacaatgggcatgcactacgtgactgatacatactgctactctctataactctcgtgaacatgcacacataataattatgaaggcaaatccttaattaaaaattctataaatacccaattaaagatgcgcagaagaaggattcttgagagttatttatgattctatcataccattcgtccttttaatagccgccacatgcaaagctgtacatccctccggaccggcggctgacgccggcgacggccctccgtcttgcgacggacgtagcagtgcctggaccatctgtaccgagtggctcaccgccatgtacagtggcgaaacaccgccgttggttgtcaccgaggccagccagggatccgtcgtcatcagcagatcaaccacctcaacatggccgtgccgaacagcctcgtgcagcgcggtggcgcccgtcaggttcctcgaccgcggtgtcgcctgatccatcacccgcaggaggcaggccgccacgtcgcggtgcccggccttcgacgcgcagtgcagcggcgtgccgagggacctgttgcgcgtggcggccagcgagggcgccctctcgcagatgagcgccgcgagctcggcgtggccgtggctggcgacgacatgcagcgccgtgctcccgttgctcgtcacgccgagaaggcggcttgttccgcgccgcgccgccggctcactcgtgccatggaagcttatcgcgacctggccgtttgtgcgaggcgggtgtgtaccgccctctcctctcagaagctcctccaagaggaccttgttgccggcggcaagcacttgcaacagctccttgtcgagccacagtatttgaggcccgaattccacggttgctgctgaagctgccgccatgattgattataaagtccactctgcactctgaactttgcagtgctatttatactggtctgggtgaatctttgggccgctcgctagttgtcgatatacgtacctactacgtactatatgcattcggcagagtcgttcgaaatcacgtagaactaaatatagaataatagagtgcatgttccgttttgccagattcactcttactactttcttttattcatcttcaaacttcaactttttcgtttttcattaacacgcttttcaaattattaaatgatatgttttctacaaaattttctatatagaagtcatttaaaaaattcaaataaatctatttttaattttataattattaatacttaattaatcatatgctaatgagttttctcgtttgcgtgtgctaaaaacctctttcaaaaaggagattcaacgcaagctaattactcctttcgggttgataataagcacgaggtttaacttcaaaatctttaattataaataatttcttaaattatttgtctagaaaaaagaagattatatgtataaattagtcataaaaaagtttaaataaaatcatatatttattgacatttctatttatactataatagaaaataattgtcaattgtatagaaattggagtagtcttttgaatagaaatttttttgaaaaaaaaaccacaccgtctagaaatttaaaacggtatattttttaaaaaaaattctatacaaaagttgttttaaaaaaattatattaatttattttaaaaaattagttaacacataataatacgtattttgttttctgtgctggggaggagaacgcagcccaggacagctcttgtcgcatgctttggagtttttttttaacatgcgtaggagatagcaattatactttcacgcttatgtataatactccttctgtttcacaatgtaagatattttggcttgtctaaatcagtttttttcaaatttaattaaatttataaaacaatgataatatttttaataccataaaatatattcaatgatggatatgataaaattaatttgatgttgtggatattactatatttttctataaattttaatcaaacttatttaattttgatttagtaaaaaaatcaaaacatttatattctgaaatggattgagtacaccggtatcgcgacagacagcacaccagctccttctccctgtcgcgccttttccactcccacagggcttcgtctcttcaaaccatggaacatgttcccttcctacgacctgccgtctctcagttatttatgtccgtcaaaaacttaagacatgtgattcaagtaatagaaaataattttaagctaagagtcataatgcaagtacatatacgcgactgcgtgcacagtaaacaacagtcgggaaaaaaaacactacattagttataaaatttaaaatgctcaaacaagtcgaccctaaccgtgggcatcgatcacttcaaatctaacccgggtagtcctatggctgcgttcgccttgtgtgcttccctattggggatttttgtcttttctgtatgtctaggtccacagtgaggtgaaagagcggataaaattattcacaacaggcaatgagcactattctagcttccccttcctgctattttagccagtttcatatgttgtttattacttcagtcttagcgttcaactcgatcagatccctcgccagtgtagaattatagatagttgggtttggcttgagaatctgctgtgcacacagcttcatgtcttagtacatgtcttcatatgatcgatgcaaaacgccaaaaccgtgtgctgcaatacttgtctttatctacctgtcccagcttcattaagagaacttctctatagcttccccatagccaaaccgtcagcggctttgccactatactcctctaaggctctaaggctcacctgctgcctcccctgtcattaagattttataatcgaacatgattatcattggagtttattttatttactttttagaaatcccgaaccttatttttataatgtttagatgtcccgtcaaacgctgccactgtacgtctttactatccgtccactatctcacctcttttttacactgattttaaaaatcaaacaaaattatcatttggatttttttttttactttctagaagtcccaccaaaccactgtactccactacagctagcccgctatctcccctctttactgtcgttgaaattctaaaatcaaacatgattatattctagaagttccgccaaccatcgtgacagtgttgtttaatgccctgtctatcgtgctccttttaatcgtcaagtggattatatttggggttttcttaatagttttaaaatgtcccataaaccgtcaccactctacttccttataggcctgttgcttctcccatctttattgtcatttgttatctatgttccaaatgattttttttgaaaattccatatttttcattccgatatgttttatttataaattatattcctacatgaacccttacaattatttttctatttcggaatttattttatttgttattcagaattttaattaatctcgtcatgtgttctaaatggtctcttctttcaatagttttttttttattttattacgaattttagttatttataaattatattcctagttaaactcttattttctttttctaatttcagaatttattttattttttatttcaaatttaaattaatctcgtattgtattctatatggactattctttccaataatatttattttaatgtattctagcaagttaggcggcgaagcggagaggcacatgacgcggcgggcgccgctgtgggcattctcgtcattttgaaatatttctcccctctttcaacctggaaattataaaataatgcttctggcatcctacagctaattacacaacttttgttgtgtccatcggcagtgtcacgtttttacgatgtcctttggtcaattacacgatttttgagtgtcctgtagcaaattctgcctttactttattttaaattttaattaatctcgtattggattcttatatgtactcttctttcaatattgtttatttttaattcctaattattttagttatttctaaattttattactacatggactctctttttctttttcttcaattaatgtagaaacctctagtcttcacagcgaacgtggtgtctcctttcaaaactgtttttaataatataatagatgttatgtatcggtgataataaaaatcgggctatacacccggtcctagagctagaatgttgcaaatgacaatgagatatataaaagttcaggtaatatcctagtaatgttttggtggattgctttttgcctgtgaattgtggggagttgtatgttgcctaatctaggaacccatattcatcttatataggctgaggggtaaggtaacctagccacgtacggcttgcgctgctgcattgaaagggattcttcttgcaagttaaggatgagggcatcttcactcattttcaaaatatcaagcattggaaagttctctagattgtaagattttcagtcattttatcatttcctatcttaacatgtgttcatcaccattgccattttgatatgtggcacaattagtacatctatatgttaaacaatttagacttgcgatcaattctatcaatatatgaagttatactcaatttcaatttgtgttctgtatgctatatattatacaatcattagtatgtaactaataagatagcccgcgcattcgcgtaggcatataaagtagattatgcttgagtaacatgtaaggtggaatatcaatcggacgatacctaccaagcttgaaaagtactactccctttgtcccaaattataagacatattttttacacggtttttaataacatattttgactggtactttatttcattctataatcccatcaaatatgaaattagcatcacatgaaagtactttaaaacataaatctagtgatataacatgcataatacttagatatagttagtatgattattagtcaaaagctactaagttattagtataatttaggacagagggagtatttctttaaaaattttcttcatcgccattgcttagatattttttacaagacatttgtaaggtttgaactatatactgtaatatttaattcattactataagcaattatcaatgatcttctttattttcttgaaagaatgagtcaataaatacataggagatatatatattgtacgcgtcgtttccctattatatatgtgatttatggtgttcctttttaaaaaaatgccagtcaatgtgagtcctaaatttaaagttgatagtagaaaatatatataactttttaaccaactaaatactgctacatccggctaccttagtatgtcttatatatgcaataacatatgagaaactcataataccacgatagatggatggttatggcaatagaatatacaatggttgttccaattttctattttttagaaatttattactagattctctctaattgatttgattcaatccctattgacattttttatacttttctattttattttatacaagtcttattttagattaaaaatataggcattatggatcaggaattgttggtttaattatttaacagagcaacaattacattagaaatttgatgtatatcttaagaatacagtctttttagtttggtttgatagataaaaagtaggaggtgggggggggggatggagagcggagagcgtgagccaaggttgaaggggatcggcagtgttttgtgcatgtgctagggaggacaaggttttggggactttatttttccattttttttctaaataatttaagtaaaccgatgatcatatgttttttcttataatttgtaagatttttttgtaattttgatgaccgttaaaatcatataatcatatacgaatgtccccttaaatgggtgaagctgaccgtgtccgtcgaggctttatttctccgctgcctttaaacataggtcctgagtcgacatagtcatgacccgcaataccagcatgaagcataattttaatgtttagttcactatcagcactctcatagataattgcatcattaagtacaaagttatccactattgacaatagtggcctctgacggggtagcatagcatagcatgcttggtgccctttatgggaaaaaaaaaggcaatgtaggtgatgaaaatattttcctgatgaatttttttaaagttttgtgtagacaaaattgtgtatggtattaatcggtaatgcttaattttttattgtgtagataaaatattctcttttgaaatgagcaaagttaataaaaaaaactaaacagacatatgtccgtgacatctaggagtactatatcgttctttatattttgactaagatatatagtttagctccggtttgttttcattcatgtattgttcataattacatgcaatatttttactaattctaagaatatattttccaaaattagttaaaataactaatttgttggagtgcatttatagttacttcagtggggtgtatgacatacatcatcaattatgtctgatatattagaatttctaaactataaaaaatatatgatgaatagtttgatgcacatgattgttcatttgttatcaaaccaatttcgcaaagaaaaaccatatatgaccataattctcgtgatggattaaggggtcgtattatagcaaggacattgcctggaaattccaatctaatagttctattttttaaaaaaaagagaaacttaatctcacataaactaaaattaaatcaaatctaactgtaaaccacaatgttgttttactttttctgcatgtagatttgaattagtgttatatatttgtcaagtgaatttgataccaagttgatcctttttgtcaggtaaaattatttttaaaatgatcatgacattagtttattatatgttagctaaattatttaaaaataattatgacattacgtattatatgtcggcaccatgtgttgtaatgaatttagcagttccatataactattgtactacctccatccacaaaagttagacatatttcacatttgagtttttccaaataagttgttcctatttgtagtctttatacattcaagacttaaagaaggagataaattaaatgtttgattagaatcgaatgtgtcatctaaatactcattggttttgcattcactcattgattttataacatccaagataatttaatttttcctttggtcttggtgacaaaagtaataggtgtaacttttgtggatggaggtagtaagtgattagtattttatttaattaaagaaagacaaaggattataagttagatagatattcgaaataatttaaacgatgaagatttaaagacagttgatttggtactttatattaatctagtttaaccgtgcatatttgtggagtaataaattttattttataatataggaaatcctattttaaagaccgtggatagatagataagtcataagtatgtacttgctgttctttgttaaataaaaaacagagaaaggcatacacaatacgtattcgaaagaccgtattgtttctttttttttatcttcgtacgtacctacgtctgtttggtttttttttaagggaacaatacgtaggtttatattcggtatgtacgttaattttctggtaagtaatttcgatgaagctgggacttttctaaatagatataatctaatggtctaaaatagcgggtccatcaatttaagtaaaaatcaacggttagattaaaagtgctatgtggcggtttaagagcgtttgtaggagtgccacgtggcagtttatgagcgtttgtaggaagtttcatggacttttagtatataataactagaaaggtatcccgcgcacatgcgcgggcaccttcttatataatgtaagtgaaattttattacgaatattttttgtgcgggtgaatttttattaaaatatcttgtattatattctaaattaaattaaacttaatgataccaatagatcggtgcttagttctaatacccaactaggactggttacagggaactcggcatcaatctttataactagccagcactaat

SEQ ID NO: 2707 - DNA, 548 bp, Oryza sativa
tgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaagaaaatcaaacgggcgaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagcaggggcacaaaaagttggataccactctggagttcttgcaatggaaggcaaaaaatggggttagtgacaaggcatttggcgatttattgaaactcgtcaagaacattcttccggggggaaacaaattgcccgagacaacgtacgaggctaagaagataatctgcccgttaggactggaagttca

SEQ ID NO: 2708 - DNA, 651 bp, Oryza sativa
  unsure (1)..(651): unsure at all n locations
ctccgacccaagaagatgtgcgtgaggggccggatgcccgcctcaatatcgagcgccggcgcaatgatcgccgtgctgccacgcatcggagggcgcttcctcgtccggagcgccacttcggtccgggcacggaggccagccccccgtgtccccggttggcggtgccggctgtcgagactttgtggcgagccttcagaacgtccgttggcccccaaggttccggcccaccatcaccgaaaaatacgacggaagcgtcaaccccgccgagtttctccagatctacacgactgggatcgaggccgccgggggtgacgacagggtcatggcgaatttcttccccatggccctgagaggacaggcgcggggttggctaatgaacttgccacccgcgtcggtccactcttgggaggatttgtgccagcagttcaccatgaacttccagggcacatatccgcgcccaggtgaagaagcggacttgcacgcggtacagcgaggggacgatgagtctcttcgctcgtatattcagcggttttgtcaagtccgcaacaccataccatgtatccctgcacacgcggtgatctacgcgttcagggggggcgtgcggcacaaccgcatgctcgagaagatcggctncaaggagccccagaccac

SEQ ID NO: 2709 - DNA, 716 bp, Oryza sativa
acgtcaagccttcatccgcgaggaggtggcgcgacttctggaggccggattcatccgagaggttatccatccggagtggttggcgaacccggtcgtcgttcccaaggcgaatggcaaggttcgaatgtgcatcgactacaccgaccttaacaaggcatgtcctaaggacccttaccccctaccacgcatagatcagattgtcgactccaccgcggggtgcgaccttttgtgttttctagatgcatactctggttatcatcagatttgcatggctagggaggatgaggaaaaaactgcattcattacccccataggaacttattgttatacgacaatgcctttcgggttaaagaatgcaggtcctacttttcaacgtactactcgaatttctttgggtagccaaataggacgtaatgttgaggcctatgttgatgacttggttgtgaaaacacgcaaccaagagaccttactctcggatctagcggaaactttcgaaagtctccgcaccgcccgcataaagctgaaccccgacaagtgcgtgttcggtgtgcctgcgggcaagcttctcgggttcttggtctctgcccgaggcattgagccaaccccgagaaggtacgagctatagagcggatgcgcccccccagcaagcttagggatgtgcaatgtgtcactggctgtatggccgccctaagtcgattcatatcgggctgcaggaa

SEQ ID NO: 2710 - DNA, 13793 bp, Oryza sativa
  unsure (1)..(13793): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggttgattgcagagccatgagtcacactagaaggacgtgcggaatccatcccccacctggacgcttgaaaggtcttgaaccgtcgggatgagagattggagggagcgccagaggggtccaaggttcaagtcatccgccaacgatttgtcctcagcttcctactagagccacatagaccacgacgaatttgagctatgcggatggaacaacatcttgattagcagtgtgtcgttttgcaacctgggagcttagaggaaaacatagcaaagactgggatattgttcaggactaagttgataaggactatgtgctcggcatatgagagcaggcttgcctcccatccagctaggtacttgtacactttagcaattgttggattgaggtcctgagctcgcagcttatggggagagacagaggtagtcctagctaggtacgacaaagggaagctttccttcttgcagttgagaatttcattgatctggcacctgtgacccaagcattgcatatgattaaagtgtcgtctgcgtattgtattgtcacacaggggctgtctgggcacatcgggtgtgagattctcattgtgaaggaggagtctttggagaacatcagctacaagaatgaacaggtgtggcgatagaggatctccttggcgaagaccatgcttgcagttaatccagcgtcccgagactccgttgagaaggattactaacttaaaggttgaaagaatattctgaatccatgtattccaagtggtgttgaagcccctggcggtgaggatctggaggcggctatcccagctgatggaatcgaatgccttggcaaaatccagcttgaggattagggttgggcattttctgacgaagcaggtttgcatcagttcagtcgcaaatatgaaattcttagtgatacttcttcctttgagaaaacctctctgatcaaaatggattagctcttgcagaatacgatgaagtctgtttgccaacacttttgtaatgattttcatcgagcagttttgtagagagatcggcctgaaaccatctggtgtattctcttttccaggtttcagaatcagaacaatgtatggccgatttatcctttcaagatagacatgttgtagcgagaatctttcaaggagattcatcacttctgtgctgaggagatgccacgttgcttggtaaaaacttggcccgaagccataaggtccaggggcgttgtttctgtccatctgcctgattgcaaagagtgtttcttccttggagaagccgcccatcagactgctcaaggctgaaggctgaactgtgtcgtagagcattccaagctgaaaagacactactacagaaaagcccttaagtgccggttgtgaaacttccaaaggtgccggatttcccaatcgacaccccggaggcggcactgatatggtgaatcaaaggtgccggtttaggaaccggcacctttgaggttccacgattgaaaaaaaaaaggtcggctcgactgcagttgagccgataactgattccatcaagaacacacattccatcaagaacacatatgaacataaaaacacaacatgaacatatgcctcttctgccgtcgccactgcacgtcccctcccgccggatctggcggaggggggggggggaggcgccgaccctcccacccccgccgggccgcagccgtctccacgacgtccttccctccgctagatccggcggcaggggacggatggcgtggaggcggcagaggttgccgggcgacggcggccgggacggtggaagaagcatatgttcaagttgtgttcttatgttcatatgtgttcttgatgtttgttcatgtgtgttcttgatggaatgtttgttcatgtgtgttcttgatggaatgtgtgttcatgtgtgccttttttaaaaaaacgggcacatgtaatatgttatagataccgattttttaataaaccggcacctataatatattataggtgccggattttttttaaaaaaactggcacctatattattattattgatgttggtttttctctaaaatcgatacctatcttcgtttaaaggtatagtgccgacttatacgtttttttttttaagtagtgagaccattgcagggattcagcagatcctaggatgagcgagtaatagttgaacatgacttgtgccttgctgttgtggtcagaaacttcggtgcctgccgccttgatcgatttgatggaggttcgtccgaagttgttgtaggcatgcgctttgaagaaagcagtgctatctaacccgagcttgagctttttaactttcccgcgctgtttctagtaggccagtttgtcgttgatagaagtggctagtttgtgctgtactaaggctatgttcgttgctgtgtgttggaaacatatttctggcgcgagccgaggctgggatttttcgatgaagtcgaacagatcaataacaaacttgtagtcattaattttcccctgactcttttgagcttcagttgtttcatccaagtattattcgttttggatacgtccgccattttgtaacatcagctaggcgaggcgaatcaatttattttgttgaagttgcagcacgaattggagcctgcctgcatgcatgcacttggaggatccaaagtctcgtatggcagtgggcagtggcacatgcacatgtatgatcatatatgcactggcaatacgtgtattcgtatacacggatctcgtacatgcatagccgcatgggataagtagtactcaaatatgtcatcagcgatgactaaacgaaatttataagatgcgtgtaaactgatccgtacgaggcattccagaagagtctacacactgcacttttttactctgccgtgacatgtcattatcttgggctaaaaataaaaaaaataaaatagcgtcaaatagaaggcacacactgctgtgcaagagtgcgtgcacgtggcaaccacgcgctcggggtcaactgtgcaagtattaggaccggactggcattccatatgcatgcacttcgagctggcctccatgttcgtaacagatgagtccaaaaggtaaaccataaagacaacaaagtcaggacagcgaaagaaagtgcaagttgatacatataggctgcaaaatacagcaatattgctgcttctttgtaaagcttaatttgaaaatggagccaatggagtcgatcctagctttgtcgtacactggtacgaaaatactcactctctcttccaaaatataataatataatatcacatgagacattttagcacaaataaaaagcttgttcatattcgtaatattatgatatgtcttatccgatcataggttcttatatttttggattgagatagtatgggctgtttggttcaatgcttcagacatcttagcacaaatagaaagcttgttcatattcgtaatattatgatatgtcttatccgatcataggttcttatatttttggatagagatagtatgggctgtttggttcaatgctttaacttgccacatcacactttaggatgccacacctccttagccttatgtttgattcattgccatagttatggcaagccacactttcttatcatcttaccccacatgtcatagactcaatcatttgtctaactttgctacaagtgtggcttacaatttgtaggccacaaaaaaatgtggcaaagccacacttgtctaacattgcctaaagtgagttatggcaatgttagttaagaaccaaacgacccaaatattttgcatgtggtccgtaattcattacatgggtgtttttcaatcggcctataactaatggcatgtaaaaatcacatgatttttatggacgcattccacaaccacccgtgaaaattgattttcactggcaactctcttaaggaatcacatgtaaaaatgaatatcatgcttttgattttttttaactgtaaaaaagaaccccccaaaaaaaatattttagatttttgtaggcatctatagacgcaaaattttactggctttcccttatgtgaaccgaccataaaaaatattttaagggcgactctttaaaatgtctgcctgtaaaaatcattttagggtgtttcgttaagaagtctgctgacaaaacccttttttctttattctttgataatgactaaactttacttttttagaaaattcattttatgtccgattaaggtgaacagaagttctcaaccttacaacattctgggtcgatgtttccttaaaatacttcttttgatatgattgttcacttatgtcctgtagtctctatatgttgatatattgcataatgaatgggcatactaaaagaaatattaagtagctcatatcaaagaaaataataaataaagataacaatctataaaacttttggtttacctcgattgggccaaatatgaattttctagaaattttcaaactttgaactttctgaacaattccccgtaataatagatatatcaaagcctgtaatgaatattagccacctgaacgatctcatttataatagcttttaataacaaagttgtagatctggccgagctcgataatttcaatatagaacatttctccatccagcgttgtttggaaaactaaaaagtagttacgagaatagtaacaaaaaatttgccacactaaacaacctaaaatgaaacaactttaaactgcaaagttataggtttcatcaagacctacaattttcatattaagtttgtcatcatccgacttcacatgaaaaagttataatttttttcgtattttagtggggcttctagttttaacgtcttgtacagaatgcatggtccacgaaaatagattttataggtggatttctttgggatctgcccaaaaagtatacatatttttaaaggggaatttcagaccaacccgtaaaaatagtttttttaacaggcggttatgaccctaagacaacctcaaccatttccacaagtattttttcttttggatcgtctatgtgaagataaaagcctaatgtccgaaaaaagactttttaagtagcatcactaattaaggtgtagggttaattcttaaaattatttgattttgtcttcatgatcgactaataattctattttgcatataaaagtctaactaattgatataatgcggtatttggttgtttgttcacagctagaaatccccgaatatatggaccgaatcccgtacggggatcagagaagataaccatcaaatgctatgaagccaaattgctttgaaatgtttttgttggcttcttgctaaagaaggtccaacactgtatagtttttgcattgttattatgcatgtgcatgttactatttctgttataggatgttgtaacatcccggcctagggcttaataggattaatagaatactcatatcaacaagttgcaacttcttttccggaagccagtctggcctggagcaatttgggatgggtgaccgaccgggaaattcttcccgggtgcacacgagtgatcagagccgactctcgcggtttcacgggcgcgtgtgtcgcagttgcgcaggcatggtgcgcatggctggtgtagaccgggagtggttacacagcatggcacatgcgctggcactggacacatggacgtggccaagagaggacgttcttggcctagggttgatcgacgggggcgtcgatctctcttaagggggtcacatggacgtggccaagagaggacgttcctggcctagggttgatcgacgggggcgtcgatctctcttaagggggtgagggtgtaacatcccggcctagggcttaataggattaatagaatactcatatcaacaagttgcaacttctttttcggaagccagtctccaaagaactccagggttaagcgtgcttggcctggagcaatttgggatgttggtctgtgagggcagtctatgacctatgaaagctatcagatgtaagtgggcccagacatgtgttggtctgtgagggcagtctatgacctatgaaaactatcagatgtaagtgggcccggcctgggggaggcgggacgttacagatgtaaactacatctttgtaaagctttgaaaatggagccaatggtgcactacttccatcacactagggtttcatgtggccataggatgtgttggtaaattttgaaagtttgattgtcattgaatgtgacaacaaggaataaatatatttcacatctaaaaataataataggcacttgagttatagaatagaatcagttgttaaccatcacatacttacagcaccagatcacgctacctataacgtggtttttgatgcatatggcttgctaaagcatgtccaacaatttgaggattatttttttttattattaggcacatgcacatgcatgtcattgatttttcctgtgctatctgcataagacatggtggatgaagaaaagaagagagagaatgtatagacatgataataattttgattcagctggcatctttgagttaaagtaggtagatttaggaagggtaaattctatttttgccctgaactttgttcgaactaaaaagtctatcatttacttttaactacaaaactagttattttttcaatctcaattttcaaaacaagacaaaaataacaccataaaccatatttcaaggtggctttgataagaaatattggtgtgtgtacatgtgttttttttttttgcaaacatgaaattcaaataggtaaattttatggttgtcgacctaattgatatctacacgggtaaaatatgtataataagaatataaactaagaaatccaccttcatttcatccaaagccacaaaaaatgatataaggtgttacaaacggttccattgtttagggtaaaaattaaacctcgaggagttcaggaacaaaaaatggactttacccatttagcaaaaatctgatatacaagatatttatatagtcagacagtcagcctccgtttatcctttatccttgtaatctaagacgactatttagacgatatgcaataacaagaaagcattcccttgagagattaaaatccatttcccggtcgatcgaagtgcttgcactatgggatatataataattcagtaggttttggaacggggcgctgtcaaatgtgattctcaatttgccaatttgcttaagttgtttggtgaaatttccgaacaatggaaacaagaacaattaaggattactgatgggactgctcatttataccatatttttctccttaattgcatgaatcgtacatgattgtaatacacgaccctatccatgactccatgtgcctgtggttgccttgctggaatcaggtagctaaaaacttggtgaaggaggcaaaaaaaaaaagaaactctacagtgaaagtcaaagcctcgtccaattgcatccagcttcgagcaggcacttggacaaaacttataaatagctctgccaagcatgacagagcatattcatcgagagatcgaattcggttctcgtctcgatcatcagtttggcctgtcgatctctgtccatctctgacgacgccgacggccatgcagcagctgctcgcgatgaagctgatcctgacgacgctcgtcgtcgccgtgctggcgctgtccgccggcacggccacggccacctgcgacacgctcacggtcgggcactaccggcagtcgtgccgcgccgccgagaccatcgtgcgcgacaccgtcaagctctacttctcaaaggaccagaccgtcaccgcgccgctgctccgcctccacttccacgactgcttcgtcagggtaaaaattactagcatatactctctccgtaaaaaaaaaactcaacttatttgaattttatctcacaaaaactaacttctaccatcttatttatcctccgtatgtaaaacgagaagttttatttcttcaataccctttacccacccatcactcttactatttttatcaatgattaagagtattttagtcattctctatctctactacttctattattagatttattttgtaacggagggagtatatcaattatcaagaacaagttaagctatcagcttgtaattgacagctgcaaatgtggatggagaacttacccaagtttaaaattattattggcagggatgtgacggatcggtgttgctgaacgcgacggcggcgagcgggccggcggagaaggacgcgatgccgaaccagagcctggacgggttctacgtcatcgacgccgccaaggcggcgctggagaaggagtgccccggcgtcgtctcctgcgccgacatcctggcgctggcggccagagacgctgtctccatggtttgagactcgctccactgatgaattctcctgttactgtagagacgatgagcaatgcaaaagctgatgctgatctgatcatccgattcttgctgtgctctgtcttttcaggctgccgggaacatcaatggcgcgagcctttggcaagtcccgacggggcggctcgacggccgcgtgtcgtcggcggcggaggccgtggccaacctaccgtcttctttcgcggatttcgctaagctcaaggagcagttcggttccaagggcctaaatgtgcaagacctcgcgatcctatcaggtatagtagtgctaaccatggacgattctaaagctacgtgcgatttgctgtactgttcttgctgtatgccgtgtcagagtcaggcacaatcttggtcttcaggtcgggtcaaaatgacagaatgaactgaacctcaataatgacatttctgactttttttctgtatggagttgctttcttgctttcttattaaacatttgcgtgttcagaaatcatagaaatgttgaacatcttttaaccttttttttcaaagcgtcaagtcacattccgattaagatatcattatccctggcaatttctcgaaccgtaagatgacactgacaacaagggagacagtaattaacacagtaaattatattaattcctttacatcactgtttcaggtgctcacgccataggcaattcacactgcgtctccttcgccaagcggctctacaacttcaccggcaagggcgacgccgacccgacgctcgaccgggcgtacgccgcggcggtcctccgcgccgcctgcccgccgcggttcgacaacgcgaccaccgtcgagatggtgccggggagctcgacgacgttcgacaccgactactacaggctggtggcgagccggaggggcctcttccactccgaccaggcgttgctccaggacagggaggcggcggcgacggtgcgcgtcatggcgaggtcgagcaggcaggcgttcttccggcgattcggggtgtccatggtgaggatgggcaatgtcggggtcctgacgggagccgcaggagagatcaggaagaactgtgctctgattaattgatgggcagagatttgatctttgatataagttattactaagtcatgtactaatgatgttctattgtttggtgtctaattaagttattactactactacaaggtaaatttcatgagggaataacttgctcggcattgtttgatttgttttatgttaatcatcgacttgttaatgtactcttgcactgatcttctccatgtatgaaatggcagagccgctgccacccttctccagaaaaaaagatgttggccatgttgacatttcttctttatttttttgtcaacattatgagcttgagaggatgagctatatacttggatgattctatacctttgctgtctgcctgtcagcattcaagcccatgttggatacatgttcagttttcagcccacccaagggacgattttgggcccaatattcacaaggctttgacacatgcagacacaaaagtccacagcatagaaaggggaaaactgcttccgaaaacactttacccgactgacttttactgaccactttaactccccaactaccaaaatatcactttacacttcactccacagactttgggtagtacaatattttatattacctcagtcgtaaaatatagctatttttagtacaatactttatctaaactgaaactatttcttcacttatcttcttctcttaaccaattacaaccattcttttttatctactttctcttctcaaccaatcacatacttcctctaatcatttttatatttttttaacccatattaacctaaaaaaatacttacatttgaagtatatgctagtctcctcggagacgtcttataatcttatctttttactttagggcagtgttcttgtttattttactttatccagcgtcgctagaagaacaaccattgtataggaagtaggaaccagtgcagtttaaggttcccatggtttctaacgaatcatggttttgcagcatccgcctttgcgtttacccacgggcgaagtttcgccaattgttctcatccggatatcagcaagaaccttaagcaaggaacccaagaataaaatacagaaatatactcctagagagctagctagcctcgctcatcactcatcagagtaccaatcccctttatacctgaacctttacaacatacacgttcaccgagccatccatcagccagaagagaatttgatccctatttgagtttccgtttcactttccagcacaagtccaacggccagggctcgatcaactagccaggaatcacgcagtgctctgctctggatatcgaatgttggcatctcgatcgcttttgggcagcaaggcaagaatattacttgccttccacacccttaatcacatgcacggcccccatacagacgcagctataaaacatcacgaacgccatgagaagatgtccattgtccaaagccaagagcagcagcagagggtagctagctcgaacagcacactactgaagctgatcagaaggaagcagcaaggcaagcaggtttagtttaagcagcagctcgccgccggcaataatgccgccgtaccggctgccgatgtaccgggagaggccggcggtgaggtgcatcaacttcctctgcgccgtgctgctcaccatggtgctcgtcgccggcatcatcatgttcgtgctgtggctcagcctccggccgcaccggcccaggttcttcctcgacgacttcaccatccccaacctcaaccggcagtccggcgccgtgaacctgccggtgaggttcaccgtcgacgagcgcaaccccaaccagaagatcggcatccactacggcaccatcttcgggtcggtgtactacaacgacctgctcgtcgcgtcggggccggtggtccagccattctaccagcagcccaagggcgacacgccgctggccggcgagctcacggcgtccgggccgacgcccggcgacccggcgtggcagcggttcgccggcgacgcggcggccggcagcgtcgcgctccggctgctgctcaactcgacggtgaggttccaggtgcagatgtgggacaccagggagcaccacatgaaggtggactgcgagttcggcctgcgtggcgacggcacgctccagcagggggacaagaacaagcagtgtacgctctacttctagggtggatggaccgtatcttaatttttcctcgatttttctttgtgagtggttttatatttttcatcgtttggattttcgagtgatattgattattactttttaccccttgttgacaaatgtaatttgtttgtaactgtacattaattttattaaactgtctgaattattaatgttgtagcgcgagtgtatgtgccaggttctttgtctaattatatggtactataaacgatagactacttgatattgagagaatattttgagggtacaaacggattaatgaactattataaagtaaaaaaaaagctgttttgaagtactactcttaagaaacttgtgtatataaaacttttataaaaatcataccgtttataagtttggaagagcgtgatgatgacaatgaataatatgtaaagaggaaaataagggggaacagagaaacgattgatcgaaaatagctgattgtttttcaaggtttcactgggatcggagaagggtttaatgtccagtgtaacggttgaaggtatgacaactagacaatctaccatttttgctcatagttttctgcaagcagtcaattgtacaaaatagtgatgttttaccccccaactttatggggagatgtacttctttgttctaccgatggctcagtatagttaaggaatcattattaacatggactcaggaaagattattcacaatgtatacccatgagatgatgagaatgatcagggcatcaggcagagggtaagtattaatacatcatttgggaaggtataatatttatgtgttaaccctaaccaatcataaaatcttggctaatacaggctattaaatgttgattctgtcaagctgcaaacaatttacaacaaaactgcagtggtaatttccacatactccagagacccagatacacactaggacattagtaacctggactcaccaatgagcaccagagttgattgatatctgtttagctttcctccagtctccgcaacacagagtcagcaaagatgcgctgcctgaaaattgaaaaccttattagaaattcaactgcttttagtgagagagagagagagagagagagagagagagagagagagagaaagagagaaggaagaatcacgcacttctcttcagtgtgtttgggactagggcggttgtgtttcagatacccgtcccacggaaccttcttaagaccagctctagcagctatcatgtctcttactctgtggaaagcattccattaagtatgaaaaaggcagtatgtttctcataaaaaaaactagaatccaattttatgctacctttcagcaaattcaattgctgtttctccatccctcagatactgaggctccaagtaccatacatcacacacaactgcccatgatgtcataagcctaaccaagtgcattgtaaacgattgcctgacaaaaattacgagaagatattaagtgaaatacagaagaagataaatgtgaacaaagtaaatttgtgcagttgattgtattcctcacttcttactattccagaaggcatcaacaaatattttattgtatttgatagctattgggcatacagcacagccaagctcaaaagcaccctggaaaaacataatgagaatgaagacaaatcatcattagtctgatcgtggtcaattccagcaaatgttaaaacataacaagaatgaagacaactcatcatttgatagctatttagaagatgacaactttctagcatttgctatcttttaaacatgtcaggcatatgattggcaatgagtatgttcgtaccactactagaaatactcaactactcttatctatctgccaaaatatttgtgctatctgcagtacctctttctttttgcattctctgtccatatgtacagctgtgagttaattttaagtgaactcatgcatttttaaatataaggacaattaattc

SEQ ID NO: 2711 - DNA, 6207 bp, Oryza sativa
  unsure (1)..(6207): unsure at all n locations
aaactgaactatatatagtaagtaatgcattggaaatgaaaaattatacttttttgcaaccacttcacgatccttgagatcattgcgattaaaccagatgcaaccaacactttccaagatagtcttctgaataaatcctgtacaagggaggaaagcaaattttatcaacaatctagcaatgcaaaaggtagagatcaacaatccatcctgaagaatgagaactgaccaacccatccaggatgcttttgcataatgacagcaaatgctgtcatctgctccagaataatgaaatctatcatcgatgtatggtttgcaacaaatacctgtggtaattagaatttagaagagagttgcaaaggatatccgtcattcattaatggatgaacatgaaattaattaagtaaaacataatgaaggaatgacaatgtgtacctaaagaatggtttctgcaaatgtttgcatttaattggaattatagaccttgtgaaacatgaggagattttgtgatagaaaggataacttttcctgaattatccaggtgagatttccggggaacaaggctaagttaataactatgatgtttggcaacagtgttgcgcaccacatgttcctataagtgcataaactacttaacatgggttctaagagaaagaaagtttgtaacctgatgaggccgtgtgcttgggcgaggcccatgatacttgatcactccagtccaagaagcaacaaaaacactgcacatcatttcaaccagctttctctgcaaaaaagattacagtgtttttgaataaacaaagaacctaagttgcaaaatattatgacatattatggctgcatatgaacatacacacatctacaccagaaattgacatagatgggagataagataagtcacctctattttacttctcatcttttgacctttcaataagaaatgtacaggaaaaaaggcagcaaagaatgctaaccatccaactagaagagttaggcccctgaaacataacatggttacagttatcagatgagagtgactcaatattcgacaaaagaaaagaatataagctagatccagagacagaaaataacttttagtagtaatacatacacaaagataccgaaaaaaaaattctctccaacatttcacacaaaattcaaatgagtttcctgaacaaagttggtcttgaaatattctgatttctgacgttatgtggaaagtgattgtaactgaccaaaaaaactcatagcacatggttaaaaacatctacttcattgccagtttggacaaaggttttacagatcaaatgggctaggatacccttgtactacaaaatatcaagtcaacaaagaaggatacattgcaaacacttacaaaacaagtaaactaattagcaaaactgccgccctaaatatagtgttcagattataaggatccagtacctcagcgggaatagtattccgtatcttatcactactcccaagcaccacaatgggaataaataaatgttccaattccatggctctggagaatttgacttaaagcaacgtgtgaatgaatcctgtatcagtgtaaacacaagcaatgagaaagctagacaacatcgatcacaacaagaagaattgccataagaacgactgctatttatcccacaccgcatcacaactgaagttacgtatgcacagtagtaaaatgatatgaaacaaagatgcatgagatgtcaagtcattatcttggcatactctcactaacaggctatggaagtacccatatacttgtctaatacgaacaacattataaagaaaatgttatcatgttcctgttttaaaccttaactaagggagatttactgctcctttaacttgaagttttgaaaatagtgtcaaagacagacatccttttcttgttccaccgatatatacccagggcttagatgacaactttgtaaagaacatcgaacttagggttaattaacattacaacattaattatattttgattcttatacaaaattgattactgaccacaagcaaaatactcttttcctcagtaataaacgagagtgttcaaagcgcgaaacaatccagaaattgtcctcaagggaggccataaaataggaaatttaaggtaaatctaactatatgcaatattgacgaaattgtacatattttcggagattttgacgcaagaacagagtatgagagtaatcatatgaaaaccgtacaaattcaaaaatttgagcgaagcaagcctagccttgtttccacaaaaggattgctctactcctttcgctaaacctcacagatcaaagcctataaacgtcctatctgctcttgccatctcatagaacatcaccatctaataacctgagaacgcacgaaacggggggggggggggggggcgattttaagacccgggtaagccactcacatcgacgatggcgcccgccgcttcagtgagcaccggcgagatgtccagcagatcgcgcctgcacgatggcagaagagagtaaagaatcgcctaaaaaatatctcgccaaaatcccccacataatcccaagctagggttaacgagcgaagaaaacaaagacggggaacagagagggggctagggcgcgattacagatggagattcctggggaactcctgcggcagcgagtcggatgggaggtagtcctccaggttcggccggtccagctcgatgtcccccgccaccgacgaggtcgccatccccccctccgtcgatcccctccgccgccgccgaggaaatcttcgcgatgaggaacgagagcgagagagatgggcgcaatgtggcgtacgtccagcgaatcgatgcgtgggtggatcggtggaccaacagacagcgaaggggaagagagaggctcgtcaccgggtgggccccgcacaccgacaggtgggcccactgcagcgcctacatgggccggctcgggtgaattagttggccaaaactgtcggcccatgtaaggtccataaaaccgaggtttacccttgcgcgtcgccgccactcgcaagcaagcagccgccgccatggcgccgccgggcaactccgacgagctcgcgagctccaagaaggtgaagaaatctaactccaaggaggagaggaagcacaagaagggcaagcatgagcgccccgccgcctccgacgaagcgccgactccccgcagcgacgcgaaggggagcaagggcaagaagcggaagcacaaggacggggagggggagaaggagcacgggaagaggtccaaggagaggaagggggagggcgaggcggcggaggcgaggcgcggggacgacaaggtgaggcgggcgatggaggacgagaggttcgcggcggcgcggaccgacccgaggttccgggcgatgcggcggaaggaggcgaaggtggagctcgactcgaggttcaccagcatgctgacggacccgaggttctcgtcgtcgtcggcgccggtggacaagcacggcaggaggcgccgcaagaagggtggcagggagaacccgatgctgcagtactatctcaaccaggaggaagaggaggaaaaggagaaggccaagttggttgaagaagaggaagaagagggggacgcagaagagcagcaaggggaagaagagagctccagtagcgacgacgacgacgacgatgaggacgaagaagaggacgatgacgacgaggtggtactttgcttacaattttttgatggtttggtttatatttcgttcaattctctcgcttgtagcatggaagtactttatttactttatacgtctcgtccattctacatattatatggtagatgatagtgattagctcctccaagaactcaattgcatatatcttgtttgagcatgatttgtaggggactacttttgagtctgagtttagttttaagagcattaagtacttcttgtttttctatcaatatatggtcttggtcatttgtaaccacggtatgttcaatctgatgttacaagtgttatgaactgttaaacttttttttttgggccgaatgtgtaggttatagagctatgtggttgtaccaagatatgcgtctttgtagctacgcatttttaatagtcgactaaccaaaaaaaacaaagggcatgtgtttgtgttgtggtatttgacacaatcccttcgaattgcttgggactcaagtgcactttgtttgtccaaatgtccaattgaagggattggacataaacccacatgtcaaagaccctactttactcatgtactcagctgacaatgacatgccactgttagtatttttatccaccatcctgccgcttaaatctattttttgagttagccttgtaatttttgtattttgtaagcattgattaatgattgcaatatttatgtagttttcgcccttcaagaaaaaaaaacaatgttttgcaacattattcttgcattatatctaatacatggtccttttttttcacagtactctgtcggcagtgacattgcgcattatttgatgggcaggcatgatgatacacctatgattgacaaggaaacccataggcttgctgttgttaatatggactgggatcatattaaggtgtgtgatgattgaaaataattatttttttgtcaagcaaacctattagcataaacaatttacagaaatattaaaaaaggctttgttactggatgcttaagaattaccttgaaaccaataattttactgaaaaaacttgtttattatgtgattacatttttttaatgcttttgcttttatgagcgcattggtagcttctatcgaacacttttgtgccattggggtgatgtttggaaaaaaattgtctgctaggtggcagcagcatttacagagtatgttttatggctgaaagatgtttatgtttatttcttatgttctgtttaaatcaggtgaaatttctatgtgtactactctcttttcttttagttgaggacctaatagtccaccatataaattcacttattttatcaaacatagttattgaggatgctagttcttgtaaacaaatgtagttgcatctaagttcttgtaaaaaaatgttgttgacagagcagtgcacactgaggcacttggcgaacacatatccaaactctaaaaatgcttggactttggaaagtttagagggcaaatccaacttagcaaaatcctggttgttaaaatgaagatctgagttgttacattgttattttgtctccttgcaactttcaattgattagttttgttcatccttcattgtacaataatactatattttgtttgcgtccttccaataggcagttgacctgtatatggtgatgacatcttgcctcccaaaaggtgggcgagtcttatcagtgtcagtctatccatcagaatttggacttgagcgcatgaaaattgagtcaactaagggcccagctgcccttgttgatgtcaatggtagtgatggtgaatatagtggtggtgatgatgatgacgncgatgaaaagaagaagatagtagtgacactgaacatgattctgaggctgaaaacaacaagctacgtacttatgagctaaacagactgaggttagtaacaaaatggagaggatttttttttatctgtttttctgggacttgtagacagtctttaacatgttcaaatcctatgtgtaaatatatgtttttctgcttgatgtatttatcactgtctgtgtatgaggagacattctcatctattcaattttttatacaacaatgtaataccaatcttatgcgtacgcttatcttgttgtaggtattactatgcagttgtggtgtgtgattccagtgcaactgcaaatcacctgtacatgaatcttgatggtacagaattattgaaaacatcaaatgtgttcgacttgcagtttattcctgactctatggaatttaaacatcctgctcgtgatgttgctacagaggtatcttactttactacattgtatcatcagcaattttggtatataataaggttgaaacatgaaacattgaaataaaactgatccttttccttcttcaaaagtgacttgccatgttatttttccattgttcaagttaacatcttttaagtttagtataacttgcttttcaattgtgctaaaagaattacttttagtttgtcagtgatttgtttgatattatgcaggcacctccaagttacaaggagcctaattttgaaactcgtgctttgcaacat

SEQ ID NO: 2712 - DNA, 1428 bp, Oryza sativa
ttgttcatgtttttgctgcagttagatgatcttgatatgtacttagcaagtgatgacagtgcatcagacgatgaaggtgcagataatcatggtgacgagtctctacaaagtggagccaaaagaaagttaacaagggaggagaggttggctcttctactacaaggtgacaaatccgaggaggaacaaactgatggcgaggacatggagataacattcaacacagagcttgaggaccttagcaagcgtatacttgacagaaaggtcaacaatgagaagactgtctgggagaagcaccaagagaaaatgaaagagaaacgtaaatctaggaagagaaggtcaaaggatgatgatgatgatggctatagcagcgaagatggcctggatgaacatgacgatttctttgatgatgaaatgtctgatgaagaaattaagccaaacaagaagcagaaggcaaaggccaaagataaaggaaaggggaaaggaaaggacaaactcccagaacaacatttggaggatgaagcaaccagagaagagttggagcttttggttgcggtgacaaggatgcaggcaacggtgcaaagggttataacttgaagcgcaaaaagggtacgaagggcaagaagggtaaagagcaatctgttgaggacgaacttcccgacatagatcttagcaaagatgagaggttctcagccatgttcaattctcattggtttgcggtggatcctactgatccccagtacaaaaggtatactatgcgcattcgcccatcagactacttcagaattcatactactagtgtagcctacatgatctgcaattctgcatcttcttggttcagttttacacatgttaaattgctaactgttgctgatggttacttacaggagtgcggcctttatgcgcaagcaagctgggataaagggagcacatgaaccatctctgggaggtagaggtagtggtagaggtacattgccacctgatgatgtgcctaccgatactcatgaccagaaacctgatggcacatccacggagaagctggaaacaatgtctgcagtcaagtcactaaaacggaagcttactgcattaaaaaacacaagcaagagtgaccgatagagaaaagctttgctttaccctgatgaccaatgaacaagcttttttttttatttgtctatgacgagagttattttggctttagaatagtttttaggtatgttatttatgtttgctacctacctatgaaaatgtgtcaaaatttgggttttgacaatgatcaagtaggacaattttgttatccttaatattttcgaatatagttctattattttcaggctataaaattaaattatgatggtggctttgtaccaacattagtggaatattagaagccaccttctgtttttttggccttctaaatataattttagaaat

SEQ ID NO: 2713 - DNA, 14414 bp, Oryza sativa
tacaatgttgccatcaacactgaatacactgaatacataaaagtaggaagaacatgaaggccttatttcatcatcttttcatctttattcatagtagaagaaactgtaatagaaataccatcttttcatctttattcatagtagaagcaactgtaccatcttttcatctttattcatagtagaagcaactgtaccatcttttcatctttattcatagtagaagcaactgtaatagaaatacctcccaagttcctttcatctttattcatagtagaagcactgtaatagaaatacctcccaagcaggaggagcagcatcaacaatccttatccttgacgatcgaaggtaatttgagcgtgaaagtaataccaccattgttgtgttcactgactttgattctcaggtagtttgagcgtgaaagtaataccattgctgtgttcactgacttttcttttcagtttttccagattctgcgggttgcacgttccccccttgagttcgaggtgtgtgagactctgcagcttacggacccctgaaagcttctccatgtgagtgaaggaccaaactatcttttcaagcttatcagggtttcggtaaccaaaggtgacgctgataataatatcatcttcaatgataaggtccatgagattcccaaaactccagaaccggagagcgccttctgcaaatgaatggtagcaaagcctgagatagcgtatgccatcgagcctgctaagtacatcgagggcgccctgattcaaaaaggtgtcacgtagagttatcttggcaaggtgatggagctccttgatcctgggaggcaacctgcttctgatgctacagatgtgtaggctctccagaagctttggaggtctcagtaaaatagcatcaatagcatcccagttacccggtggatccattcggattgacaaggacagaagacctctatggagtttgtcaacctgaaggaataaatctatcaagctagctttcgtgccagatagaaccacacccagcttcttcaggtgctcgagtttgtcaccaatgttgttcagttctgtagcactgttggaaactttgacatgggacaatatctccatcttttccatagttgcaacagcacgaggcacgcagacagtggagaagaattccttggacttgacaatgtctttgcctgggcagacaataatgcacccagcaagcaggtgctttagcattggcagcgctgtgtggaacacctgtacccttgttcctcggatgtcaagtgtctctaagagcctcagctgacctatttgcttgggcagttgggcaacatctgtgttccggagacttagatacttgagtttgtgaatcttgcatacggtatggaggtcgtttgccttgaggcccttacgaccttccaaatcgagtacagtcagcagcaaccttgaagtgctggaaagtgagttcaagaaccttgtgatattagagttagccggatggagttgcatgccgttccggattgagtagaggagatccaagtcaagtggcaactggttgttgagcaataggtcctcaactgtcgaagactccctgtctatcaaatcggcaaccacaggatgcacagtgcagctctttaccttacgtgcaccgctgagtccagaaggaacaataagcttctgtctgagcatggcttcgaaacagtgcccagcttcaatctctgcactcgactgatccacttgggtaatcaagccttgggcaacccatcgtcttagtaaacttgctcttcggacgccatcgggcatgctgattccacgggtgaaaacggttgaataccataagcagttcttgtaattatttggcagtgcttggtagcagaaggccattattctgtcctgcctcccatgatctgtatattctttaccaaggcttgtattcaggacctgcaactggtgttccgtcgtttcaggattgtagtagagggcatggaggaacatcttcatgcagaagacatcagggcagcattgggtgaggatattgcacaaaattcctttcaagtgtctgtcatcgtatctgtggggaagcagggcgagcgctttgttgaggtaaatatcaacgagagagtagattaccggaggcccacatttggcagagtcacagcaatattttgccatcttactatcatttgtgcagagtattactgcactgtcagagcaacccgtcgagctcaacaattccaggacctgatgccataacactgggtaattcaaaccggaaagaacaagcagcacattttcattgctcaatttcttggcaagcctctgcctgtcttctgcctcattgtctgtctccctttctttcgggtgtctcagcttgtcaaccatggcctttgtaatctccgagagaatcggaggtcgttggagagcaacgtggagctcctcatcagtccatggattacgccagtgactcttgtaacgcttgagcatggtctctccaacagcagcttcatccatgccatcttgcacactgattatgacgaccctgatatgctgctgcttgttgccaccgtccgactggggcagcagcggctgctggtcatcaccatccgactggggcagttgctgctgctgcttgatgccgcctcccgactgcagaggcggcggctgctccttgtcaccaccctccgactgcagaggtggcggctgctccttgtcgccaccctccgactgcagaggcagcggctgctccttgtcaccaccctccgactgcagaggcagcggctgctccttgtcaccaccctccgactgcagaggcggcggctgctccttgttgccgccatctgactgcagtggcagtggctggaccttgtcatcctgcttgtcgctgccgtcagactggagtggtggctgcagcttgacacagcctcccgattgcacaggcggcggtggctgctccttgtcatcatgcttgttgccgccatccaacagaggctgcggctgctgcttgtcgtcgctgttcaactcctccggtggcttcacctcaacgtaaagatattctgtgaacggcttgagccgcgagagagcctcatccacgctgccgtagtcgccataccagccatcctcgagtatggcacgccgggaaggattgttccagctgccagcattggtgcgcctctggttgcgcggcctcacactagcatccctgggctccattgtggtggtcacctcgacgggaagctggtgatgagaaacggcaatgccgtacctcgcctgcctctcactaatttcgcgtgcctggatcttgagctcgcggatccgggtgacgacccggtggcgagctaccatttcccagggcagccaaccgcaacgcgcgctaccagactgcgtgtagagctcaacgcaatttctggaatcgaatgcaagctccatgacctgcttcatccacgggcggagctggtagtcaccggcagtggtactccccttgttggccacgatgtggcggagcacgttgttcatgctctccatctcttgcatgatgaactgcaggtcctcacggaccctgccaagcagccgggcctcgtcctggatgaggcccagcaccaagttgacagcgccaaatgctatgtcggccatctcttcttcttagctctagctagcttatcaatgatccgcctatcttccgatcgatcaacagtggcagctggtagctgctaccatccggccatggcatgcaatgcaataggaggtaggagcaggaagcaattcccacgtatggttgataaccctctcctctcgtctcacggcagaacaaaacaggactgcttttgtttctttgtcagcaggatacaattcgtgttccaacattattccagcctacgggccatttggagtccagccatctctcttgtcgtaagctccttgtgctattgcctgcatcttctctgccccttctacaatcattttatgctttgcttgtgatctgcaaaagagcaattcggatggtatctaacagccgcctgcccctgaagcaaaagcagctgcatttcttgctttccaaagataccagcttacagctgaacacccaacagatagctagtccggcccatttggatatcttcaattagaggcagaatcttgaaatttgattaatgctgggatcagtgtattctttcttccagcattaggctgtgtttagttctgcactaaaattggaagtttgactgaaattggaagtttaaagaaaaaagttggaagttggtgtgagtagaaaagttttgatgtgatggaaaagttgtaagtttgaagaaaaaattgggaactaaacaaggccttaatcaagttcatttgtattagtgtatcccagcatcaatcaaaattcatctgtatctattgacagctcactctctccttctatgtctcaagctcctctcgtatttattttccaaggaaaagatgttttgcaaagtgagattgggtgtcaaaatcagggaaaggctcatactaattctcatgctagcactcttttactcttttagctgtaccttccgtgagggaagagggcatcttcgctcttctctattttgatcttctccacgaggtcgccactgaaatgtccacacaaggaggagatgcatttccctatttgcgcctccttgtgattccaagccttgcatctaggtaaagaacaagcatctcaataaaaggagcattccacgctgagtcgctgactgacatcccaaccgctgcctcttacgtgctgattaccgaacagcttagtactcatgttaataacaccaaggtgagttggctcctccaattttcatagcttgcacatttgacaatttggtaccacgccgtgaggatttctcatccgttgaaggacctaagaactgaaatcacaaattcattgtgtgcaacaaatcaataaacagctcgagtcaccgatcccaaatcttcccaaatcaattggagtagaagagagtctaatctactatgtatagaactatagattgttgaataccgaccttcctcttagatcctccatctccatgccccctcggtccgcgccatggccatgggacagtaggaaggccgatgacgggagatgggagggccggtcacccctcgtcgctgggccggcgcccggcggaggcccaccggaggtgtggaggcgtggagaaggacagcagagcgagcgacggcgagggcggcggcggcgaccggcgaaggcctgcacgcctggatgcatggatggaatgcaacgctaggggctgaaggctagcggcgtcgccggaagtcgtcgggatggcggaacggccgagccgccgcgccgccgaggagcggcgcggccgcattgcgtgtcggcggtaccagttggcgagcaggtcgagagagacgagaagttcgcgagctgatagactatgggccgtgggctggattgataattttaaagtctatattaggttcctcgactatggctgataggctgagcttgaattttctcacccaaccataataaaattttaaaattcagatatgccacataagtcacatccgacgtggtgccatgtaagtgcgtcctaggtggcatgatattgggtagatccacgtcttttcatatgaaaaagagaggagatatagagagagagggagtgctcacaagacatgacgttcgacagtgtgtgaagtaagcagaggtccatgtctgccaacaatcgtgttctttggatctgaagtagtgacggaggactagatccgatgacgcttcacgggctcaagaggtgtgaagaccgagacccgcatttcatgagctcaggtagcactgccaccgagacccgcactaaactgccaagatatgtataccgccggaccctcatcactgcctttacccaatgcacattgtcatccgacaagctatcgtcatccttgtcaaattaattctatgtatctcgtcctgcgtgatgcatatctcaggcctggactttttgtcaatcgttcacccattttttatgaacggttaattagttgttgcaagggttcacccattttttttaagaaaaaaaataccaatggcatgagctttgacgaatatattaagaagaatagagtttacaactacaaagtctaaattgctatgaaacgaatgaaacatatcagataagctcaaaaagctaagagaaaagaatcatagcagtctgaaagcatgtattttggtctatttcttccataattaatcttacctctctctgcctccatggattttgcgtaaaaaacccttttgtttctctctagccaagtgttccaacgggaggttagaagagttccaacgatttccttttgcttggagtgaggattcgtgcttgctagatcattctactaggattatattgaggtttccgggcctggcagcaagattctttgcccacatatgtacacattctcaatcaatctattgccgcatgagctttctctacaccatggtatcatacgcttttgatctaattttcttccactaaccctcttgttgccggcctctgctcgacatgcccatccccaccctactcctcgccgccgccttctctatctagcatgctcacaacgccgatcttcctcttcaatgtcattgccgtgcagcctctggcaataatgattttgggtttagaatagtttttaagacctatatgttagttgtgatcgttgtctacctataatgcgtctaaattttggattttgatatctcaagaatcagataggacaatcctattgttcttcaattcgtgattttttatatggttttcatttacatgttgaccgtggcaaactaatcttcgaaccatttttaggcgtcagcatcaaaggagcagacaagtattacggcacacagtttttgcatcttgtgtgggatgttgaaatgtgtgttcctatgatcaattgcatgtgtgcccagcggattctcaagacaatccagcgagagaacaactgtctagtgttttgagttgaatcctaagaacgtgacgagcaagcctattaattgtcaactctcaacacaacagtaatatgagagactaaaatatcatgagtaggaaactagatcatggcactcttggcattattttggtagcagcgtgtcctttttctaaaataactgagctcttcctttatgacaatgaaataatattctgggctcagctgcatgggatcgttttcactaaattttttttgatacggagttctggcctctgaataggtaaagagaagttctcgacggcaaggaagggaacactgaactttctatgattttcaactagtttaacctatttaaaatcagacgatcgagacggaacatgcatttcatatttccatgtgaactccaacaactcgaccaaaacgcatacagattacagaatacagcagtggatttcagagcactactgcagccaacgatcgacccagagattcacatgagcagtataaataacattattgcagactggaattcctaatcaaacttaacccacagccatggcagaaactcctgctgcagcagcagccgtggaattcgggcctcatcctcatgacatgttgacgctcgacggggaacttttgcgagtgctcatcaccggcgacagggtccgcttggaggagattttgagagaagcgggtagctatggtggcgacggtgaacaccctggggatggtggcaatggaggatcaccacctcatgaagttcctccattggtggacgggcaccgcgaccctcgaagggatggcccggagctgatcgcgattaacttacccgatcatgcggcaccagccgtggtggtggaggcagggttgtcgttgagcccaaggagatcttacggctatctgaagaggtgcattgctgcctgcagctggagctccatggcacgctggtgtcaagcccgagatgctcccgctccccacccagcccggggccgcggggtacatccgcggcagccgatcgcagtggcgcctgcagcgcgacacggagcgggctgccttctcggagtgacgagcaacgggaacacggcctgcacctcgtcgccagccgcggccacgccgagctcgcggcgctcatccgcgtgagggcgccctcgctcgtcgccacgcgcaaccggtgcctcgacacgccgctccactgtgcggcgaaggccgggcaccgcgaggtggtggcccgcctcctagatacgcgcaccggcgtggccgaggctgaggtggagttggcggcggcggtggcggaggcggctctgcgggtgaggaactgcctgggcgccaccgtcctgcacgaagccgtccggcatggccataccgaggtggtgcatctcctcatgtcaagggcgggcgcggctgagctggcctccgtagcatccgacgacggcgtctcgccgttgtacttggcggcgacgaccggctcggtgcgcatggtccaggagctgctgcttcgtccggcggatgacgggagacgacgatcatcggcgtcgttcactggccgggagggacgtacggctttgcatgttgcagcaactaaaagcgcaggtaatacgtcatccacaacgacaactctgctgcttctccaacttctggtagctttatattctccttaaaacggaagatgcgtctgatgattgaatactgatgtccaatacattgggcattttgcactggcacgtatagaagagatttttttttctctgttgtttcacttgcgacagaattttaggtttttatctttcgatttttcgttcataggatgttgcatcaagattcatatttctatagatactcagttacatagtacttttactcagttacagtgccctcaaattcagctacaatgcattcacattcagttacaatgcgttaaaattatattttacgactatttttatctatagatatacgattttaacgtgtttatcccttttctttttgttatttcattcaaaacgggttgtatccattggttgaaaattttgcaagatttaaagctctaaatctgtagaaagattaataggtagtctttttttctattggaaatgtttgatggtttattcttatgcactaattgtctcatgatctatggaaaatcctgtacatggattactgttgtttcaacatgcagattttttttctaattcctttttttcacttgttccttatgtcaaattcgttgggttacttttttttaagacatgtactacctcccaaaaatgtaaaggattttggctatgcatttgcgtagccgaaatcctttatatcttaggaggatggatgtagtatgttgtttgtgcttttctcactgagagagtttctccagagctagcctccatctcctcccacttcggtatcgcgacgctatagcctcctgaccctaagtggtgatggtacttcttcttggcggcattttctttgtttctttccatcatcgcctgcccttgttcacctgtcttatatgcaatgaactcgtcccagtgatcccttagctttgggaatgtgtcgaagttcggtgtctgccccttcaggatatatttcttgtacagctctcccttgaagctctgaaactgttctgccattttctttagagtccaccttttcactttgtcctctgtacccgcgggaagggtgaatgtctcgagcattgtggtccacagcatctctttctccgaatctaggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactagctgcttccctccgcgattgtatcgtacaatatctgtttctcatcacggtcagccatctgttgatacaagaaacatctgctaagtcatgagacatttatgttttaacaatctaagtcatgtatgctaagtgtaaatgtcgtacattagaaccctacacaaccttacgttctaagtctaattacaaatcgtgatataaactaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctaggagtcgcaccaattccgtagtcaataattacatactaattctaattacaaataaagtaatattatattaaaactcaaataatattacatgctaagactgaaagagtcatgtatgctaagtgtaactgtcgtatatgctaagtctaattaagactaaaattgtcaattgctaggagtcgcaccaatttcgtagtcaataattaaatactaagtctaattacaaataaaataatcttatattaaaactcaaataatattacatgctaagactaaaatagtcatgtatgctaagtgtttcgtgcgtatatactaagtctaattaagactacaatagtcaattgctaggagtcgcaccaattccgtagtcaataattacatactaagtataatttgcaataaaataatcttatattaaaactcaaataatattagaacactacacaatcttatatgctaagtctaattacaagtctaatattcttaattgcattacaaatataacaatcatttatattattacgtcacttgcctgcacgaattccttctagggctagctcttccactccggcttgagggacgactccgacaacatgtcttttctgcaagatacaaaaaatatgtattaggataaatgcgaagtaacatatatatatatatattgcatttcacgttcacgttcgttcgctcgttctcattcacgttcgttctcgttcacgttaattcgttcgatcgttctcgttctcgctctcgttcgttcgatcgttctcgttctcgttcacgttctcgtggcaacgtacgttgatgtgttcgttctcgttcatgtgttcgttaacggcggtgtggcggcatcgggccagcgcttggcgcggcggcgtggcgacggcggcggcggcgtggcgttgcatgcggcggcggtgttgcgcggcggcgaaggcggtggtgtggcgtggcggcggtggcgttgcgcgcgtggcggcgaaggtggcggcgtggcgtgccggcggcggcgtggtgcggcgtcgtcgtggcgcggcgtctcgtggcgggcggtgcgacggagagagagatcgagattggagatcgatgaagggagaggcggcggcggctctcaccccagagatgcggcggcggtggaggaggcggaggcggcggcgaggacgatgagctcgagacgacggcgagatacggcggcgtcggcgcggggatttgccctaggcagtggcggtgaaggagagaggccgagagagatcgatcggccgaaaacgctaagtgttgggggagaagacgagggcgtgcatcgggaatatatatagccctcgatcttcagtcacggttcatgagcacaaccgggactaaagaaatcgatctttactcccggttgttctcaacagccgggactaaagatatctttagtcccggttgttctcatctagtcccggttgttgagaacaaccgggcttctagtcccggttgttgagaacaaccgggagtaaagatcttttcccgctatttcctaattctttttaaacccggttagggttaagaaccgggactaaagattatagcactgcatattattttcgcttacatatatgtttctaaaatataagttaatgcattaacattatttaaagtacaaagattaatgacaattacttcgaaaaattatttttgtctgtaataaattaagtggataaatcgtaataagcaaatatatgacttaaaatgaataaaaattccaataatcatatatacttagcatatgaatgatattattaaattggtaaaaactctaattaagatatgtatgtacatactgcatgatttaaaattaataaaaattgtaatcatcatatatacttagcataggaattatattaaattaaatgttaaaaactctaattaacatatgtaaatgccacatgcatgatttaaaccttttaaaaattcgaatagtcatatataagtagcatatgaaagatagtaaattaaattgtgaaaaactctaattaacatctgtaaatgccacatgaatgatttaaaacttttaaaaattctcttgtcaattataattagcatatgaatgatattcaattaaatgtagcatatgaatgatagtaaattatgccatacaacaattgatttatatggagaatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccaacgatttttcttttgcctgggagaaccacttgacgcttagtctcgtcaggccctctgcccttatttcctttgctagacatgtccttcacgaaaaagacttgcgttatatcattggcaaggacaaaaggttcgtccgagtatccaaccttgttaaggtcaacagttgtcataccactgtcatcaatcattacgcctccaccagtcaacctaacccattggcaccggaatagaggaaccttgagaggaccatagtcaagttcccatatatcctcgatggcaccgtaatacgtggcagttgttccatcgtgtcccatggcatcgacacgaacagcgctgttttggttcgtgctcttcatgtcttgggctctcgtgtagaatgcgtacccattaatctcatatccctggaatgtcgcgatcgacccagacggtcccctcgccaggaaggcaagttgttggttgatcgactcgttacccatgagatgttgtcgtagccacgtggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcattattgctttccttccgagagttccctttccccatagtctcccttcatggcgtgattcaggtaccccgattgggcgaaggtcttcgataaattctacgcaaaattcgatgacctcctctgttccataacccttggcgatgcttgcctctggatgagcacggttacgaacatacttcttcagaacgcccatgtagctctcgaaaggaaacatgttgtgtaggtacacaggcccgagaatacggatctctttcacaaggtgacaaagcagatgcgtcattatattgaaaaatgaaggtggaaatatcaactcaaaactgacgagacattgcaccacttcattctgaagggcttctaatatatccggattgatgaccttctgcgaaattgcgttcatgaatgcacatagctttgttattgttgcctggacattgtctggaaggataccccttattacaactggtagcagttgtgtcatcaacacgtgacagtcatgagactttaggtttgtgaacttcttcttcttcgtgcttattattcgcttgatattcgtggagtatccagacggtacctttatgctctccaagcattcaaacatactttccttctctgtcttgctaagagtgtagctggctggactcaagtaatggcttcctttctcctttggttccaggtgaaggtcgccgcattgttccatatgcttcagatcattacgtgcttccagtgtatctttcgactttccgtatacacctaggaagccaagaaggtttacgcaaaggttcttagtgagttgcatcacgtcgattgcgtggcgtacgtccaagaattcccaatatggtaactcccaaaatatagagttctttttccacatcgccgcgtgaccatcttcgctctctataggctggcttctaggcccctttccgaacactactttaagatctttaacc

SEQ ID NO: 2714 - DNA, 912 bp, Oryza sativa
gttgggcgtttatgtttcaccgacggccgcttttgcccccgccgactggtgtttccgcctgcccggctggcctttatgcccgccgttgttgggcgtctacgtcttcaccgaccggcttgccttcgccgctgccgactggtgtttccgcctgcacggctggcctttatgccgccgttgttgggcgtctacgtcttcaccgaccggccgcctcgtccgccgccgactggtgcttccgcctgcacggctggcctttatgccaccgttgttgggcgtctacgtcttcaccgaccggccgccttcgccgccgccgactggtgtttccgcctgcacggctggcctttataccgccgttgttgggcgtctacgtcttcaccgaccggcttgccttcgccgctgccgactggtgtttccgcctgcacggctggcctttatgccgccgttgttgggcgtctacgtcttcaccgaccggcttgccttcgccgctgccgactggtgtttccgcctgcacggctggcctttatgccgccgttgttgggcgtctacgtcttcaccgaccggccgccttcgccgccgccgactggtgtttccgcctgcacggctggcctattatgccgccgttgttgggcgtctacgtcttcaccgaccggcttgccttcgccgctgccgactggtgtttccgcctgcacggctggcctttatgccgccgttgttgggtgtctatgtcttcaccgaccgacttgcctcggccgccgccgactggtgcttccgcctgcacggctggcctattatgccgccgttgttgggcgtctatgtcttcaccgaccggcttgccttcgccgctgcctactagtgtttccgcctgcacggctggcctttatgctgccgttgttgggcgtctacgtcttcaccgac

SEQ ID NO: 2715 - DNA, 4580 bp, Oryza sativa
  unsure (1)..(4580): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgttgtgaataaagaaatttccaaagtattgggcatacgccatgcgcacactgctttaacagatgtgcttaagtccctaaaagacacatggttccaccacacctgaaaatatatggcatatgtggtataaaatccgtgtaaataaactcataaaggatttaccaaccgcctgaaaaatgaccacaatatataatcagcctaagccataatattggtcaataaaaatgcacacttacgtggcaaaaagcaacgatattgtatccaatcaattgcttaaaaacccaaacagcaccatgactatattaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatctggaacaagtccaaattggagatataatcctcacgcttgagttgatgagcccctgagcatatagcttgtccttttgtcatagtcaaaattgtccattgatggtagctgacgcagttggcataaagacaagacgaccaacatagagataatattgcccaccagaggtggcaaaaatattggtggtagtgaagataatgataccaatcaaaagtgatgaagttgcacagccgtggaggcgaagaaaccagtcggcagtagtcaggtcagccatcaatgaagatgaaagcgcccagcgataaagttgtgtagccatggcagcgaaataatcagtcggtgacagacgaggcaaatcaaaggcgatgacaaaatccaccaatcatggagatgaagaaaatagttggcgacgacaaatgcaactgacatgatgaagatgacgatgtcggtgatccagtcaatagcagtgtcgcaaccaatgataatgacgaagacgctcatcagcatttgcatagtaggtcaaccgtcaaggtgaaataataagtcggcgaaaacataatcatccattagcaacagcggagatgtcagggccgatgaagcagaggtgctggtgatgatgtcagtgacaataatccatcaaattaatgttatggctattgtagatgcttcacttggaggagagttgatgttgttgtctaactcgtccaaaccgaaatatttgaagttgttgaagtagaatgtctgctccgaagcaaagatgaagataatgactcctggagttgactcgtgggttgatgaattgatttcttcagcttgacataaaatttgtcaaattttgagccttgtatttgtgtagcccccgactctttgattagttgggaaacaactaaacatagagtcgagaactgtagcttcttgtcatcgaatagtcattgcttgattgaagatatgtgttgaagatgtccaagtagaaatccggtggtgaagacgcgcagttgtgaagataaaagcaccagtcggcggcggcataaccagtcggcgacggaagacgatgatgtccatcagtagtggtagctgtataaccagacgtagaggtaagcgcactagtcagcagcagacgagacgaccggcgatgaagatgtaggtgcccaacaacagcggcataataggccagccgtgtaggcggtgacaccagtcggcggcggatgaggcggccggtcggtgaagacgcagacgcccatcaacggtggcataataggccagccgtgcaggcggaagcaccagtcggcggcggacgaggcggccggtcggtgaagacgtagacgcccaacaacggcgacataaaggccagccgtgcaggcggaaacaccagtcggcagcggcgaaggcaagccggtcggtgaagacgtagacgcccaacaacggcggcataataggccagccgtgcaggcggaaacaccagtcggcagcggcgaaggcaagccggtcggtgaagacgtagacgcccaacaacggcggcataataggccagccgtgcaggcggaaacaccagtcggcggcggcgaaggcggccggtcggtgaagacgtagacgcccaacaacggtggcataaaggccagccgtgcaggcggaagcaccagtcggcagcggcgaaggcaggccggtcggtgaagacgtagacgcccaacaacggcggcataaaggccagccgtgcaggtggaaacaccagtcggcagcggcgaaggcaagccggtcggtgaagacgtagacgcccaacaacggcggcataaaggccagccgtgcaggcggaaacaccagtcggcggcggcgaaggcggccggtcggtgaagacatagacgcccaacaacggcggcataaaggccagccgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggttggtgaagacgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgattcattacgtttaaacgctctgtccgactagtcatagcccccaagcaccgggagtcggcctaggcacttcccagacatgcatatgagtgacatgagttcgccattaatggaacaaagtttcacgaatcagaatttactactcgggtacttttgcaattattaagagcagaaaataaattatcttatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattgtgtcgcaagcaatcaagataaatattatgaaaattgtttaaaaaatacgatataacatctatagcccccgactcactagtcaacggcgaaccagttgatgtagtgaggcaaaggaaaagacaaaatatcatataaagaataaaataaatgatgacttagctttgtcgtattccctcgatgacagcagaagtagccgatgtgggaataaagcagtccatcaatggtgacaaaaaacaccagtcggcgccagtggaaccaagccagtggtgtagatgatgaagcccattaacagcggcggagtccgccaaccgtataggcaaaaacaccagtcagtggcggcagaggccagccggtcggcgaagacgtggacgcccatgaacggtggtgtgaccaaccaaccgtataggcgaggacaccagtcggcggcgacggaggcaggccggcgatgaagtcgtagacgcccaacagcggcggcataataggccagccgtgtaggcggaggcaccactcggcggcaacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccagtcggcggcaacggaggcaggccggcggtgaagtcgtaaacgcccaacagcggcggcataataggccagccgtgtaggcggaggcaccaatcggcggcgac

SEQ ID NO: 2716 - DNA, 28072 bp, Oryza sativa
ccgtgtaggcggaggcaccagtcggcggcgacggaggcaccggcggtgaagtcgtagacgcccaacagcggcggcataaaaggccagccgtgtaggcggaggcaccagtcggcggcaacggaggcaggccggcggtgaagtcgtagacgcccaacagcggcggcataataggccagccgtgtaggcggaggcaccagtcggcggcaacggaggcaggccggcggtgaagtcgtagacgcccaacagcggcggcataataggccagccgtgtaggcggaggcaccagtcggcggcgacggaggcaggccggcggtgaagtcgtagacgcccaacagcggcggcataataggccagccgtgtaggcggaggcaccagtcggcggcgacggaggcaggccggcggtgaagtcgtagacgcccaacagcggcggcataataggccagccgtgtaggcggaggcaccactcggcggcgacggaggcaagccggcggtgaagtcgtagacgcccaacagcggcggtaggggttcgccgagtttcctgtcaacaagtgtgatggaatcaatttcatgattcgtcggcttcgtcttcgattcgtgagttttcacttcctcgctgccgacgacttcaacaatctctctttctccgacttgggttttaaccagtcgagagaacggcgatcaaagatctgtgtcatcaagttggaagcttcaaaccgtcatcgtcaccgataccacggctggctagttgcataagacagctgattggatcaatctcggactcggctgactcaacatggaaaatcaaaaacacggagcagtacatacaagcagcaattttcacttggtcagctcgagtattttttaatgaagacgtatggctgcgggcacacgcgagctatatcaatgctcaaacttatccagcaattactggtcatcgcatgcgtttgtacgtgcctggaacaactatgtacctgtatgcataaacacataccaacagaagatctgcacatgcatatgatttttgctacgagagtctgggccatatatgtcgccgacgactttgtcaagtttctcttcaactcggactggaacacgacagacaacctttaatctaggatacaaaacgggctggactaccctgtcaatattggtggccatcatcatcaccggcttaccttcaccgccgccgactggtgtctctgcctacacagctggcctattatgccaccgttgttggacgtctacgacttcaccctgagcctgcctccgtcaccgccgactggtgccctcgcctatacggttggttggtcacaccaccgttcatgggagcctgcctccgtcaccgccgactggtgtctctgcctacacagctggcctattatgccaccgttgttggacgtctacgacttcaccctgaacctgcctccgtcaccgccgactggtgccctcgcctatacggttggttggtcacaccaccgttcatgggcgtccacgtcttcattgatcggccggacttcaccaccgccgactgctgtccacgcctaagcggttggttggtcacaccaccgttcatgggcgtccacgtcttcaccgaccggcttgactccgccgctgcctactggtgtttccgcctgcacggccggcctattatgccgccgttgtcgggcgtccacgacttcaccgccggcctgcctccgtcgccgccgactggtgtcctcgccgatacggttggttggtcacaccaccgttcatgggagcctgcctccgtcaccgccgactggtgtttccgcctgcacggctggcctttatgccgccgttgttgggcgtctacgtcttcaccgaccggcttgccttcgccgccgccgactggtgtttccgcctgcacggctggcgtttatgccgccgttgttgggcgtctacatcttcaccgaccggcttgccttcgccgctgccgactggtgtttccgcctgcacggctggcctttatgccgccattgttgggcgtctacgtcttcaccgaccggcttgccttcaccgctgccgactggtgtttccgcctgcacggctggcctttatgccgccgttgttgggcgtctacgtcttcaccgaccggcttgccttcgccgctgccgactggtgtttccgcctgcacggctggcctttatgccgctgttgttgggcgtctacgtcttcaccgaccggccgcctcgtctgccgccgactggtgcttccgcctgcacggctggcctttatgccgccgttgttgggcgtctacgtcttcaccgaccggccgcctcgaccgccgccgactggtgtttccgcctgcacggctggcctattatgctgccgttgttgggcgtctacgtcttcaccgaccggccgccgcatccgccgctgactggtgtcaccgcctgcacggctggcctgttataacgccaactgatgctatcttcttcacggctggctacatcgctgtcactactaataggcattagtatcttcaacacaagctgcctacgtttgtcatggctgccgactggtttcttcacttccatggctgcatgattctgccagtgttgattggccttaccatcttcatcgctggtcgtctcgtctgctgctgactagtgccctcacctctacgtctggtttatacagctaccactactgatggacatcatcgtcttccgttgccgactggttatgccgccgccaactagtgcttttatcttcacaactgcgcgtcttcgctaccagtttgcttctgttgccgccgactcgtgttcacttcatcacggcaacacaactttgtcaacatggtggagcgacttcatctttattatcttcggtaccagcaaactctattgctgctacttcacaagttttgttacatcaccaaccatgacgttgttgtgaatctcgacatctcggcatgcgatgccgtgttattttactacaacaagtggctctccaacattcatgatttctacttggacatcttcaacacatatcttcaatcaagcaataactattcgacgacaagatgctacagttctcgactctatgttcagttgtttcccaactaatcaaagagtcgggggctacacaaatacaaggctcaaaatttgacaaattttatgtcaagctgaagaaatcaattcatcaacccacgagtcaactccagaagtcattatcttcatctttgcttcggagcagacattctacttcaacaacttcaaatatttcggtttagacgagttgggcaacaacatcaactctcctccaagtgaagcatctacaacagttataacattaatttgatggattattgtcactgacatcatcaccagcacctctgcttcatcgaccctgacatctctgctgttgctaatggatgattatgtttttgccgacttattatttcaccttcacggttgacctactatgcaaatgctgatgagcgtctttgtcattatcattggttgctacactgctgttggctggatcaccgacatcgtcatcttcatcatgtcggttgcgtttgtcgtcgtcaagtattttcttcatcttcatgattggtggatttcgtcatcgcctttgatttgcctcgtctgtcaccgactgattatttcgctgccatagctacacaactttattgctgagcgccttcatattcattgctggctgactgctgccgactggtttcttcgcctccacggctgtgcaacttcatcacttttgattggtatcactatcttcactaccaccaatatttttgccacctctgctgggcaatattatctctgtattggtcgtcttgtctctatgccagttgcgtcagctaccatcaatgaacaattgtgactacgtgctcaggggcttactagttcaaacacaagtatcataccttcaatttggacttgctctggatacatgcaatatgaattcatgatcatgggtctattttctatgtttaaagactggactatttattattccccataagggttacaaccgaatacttgcgccagtcgggattcaattattatatttattttggagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcacttttcgcttaggccaaagtgcgcgtgatcaagtgcccaataccttaaaatccttttataccgcagttactcgactttttaggagttggtatagcgatagggttttgagttatcggctatatgtccaatgtagagtctaacactcgatgtaaataatgatataaaggcactgatcgatataaaggcaatgatatgatagaataagcactgatccgaaggttaaagcatacatcggctggaggtccgatgtcataaaatccacaattttagataaacagtgaaacctttgttgcgatcggctaagtccaacttatatgtatatgcaatccttacaagccaatgcaacgtccatataacttatcggctagcaccccgataaaacattagcatgaacctatcggcttaacaagacatatatattatcaacaacaatctagtagatcgaacctaaccgatgcagcatgacatcggatcccataagatataatagaaactctatcccctccaagtaagactttagaaatcactcgactcataggaatattttccataatttgtaacggattcctccaacgcatacggaaatcccgagctaattctttttctcttgaaatcacttgactcgatctccttttctttttctcttttggaatcccgagctaattcatttggaaatcgtcggattcgatgccgatttggtttgcttctctttccaaaaccctagagctttcctaatccaccggtgcctccatgggcttagctggcgccctccgccgctataaaaagcacccccctagttgtcctctacccatcccctcaagtcccgtccgccgacgagacccgtagcaccctagccgcgctagctcgtgcgccgccgtcgtcgaagggagtacggtcgtgccgtgccgccgctatagtctccaccatcgctcgaggttgccttcgtcgggttcgcaaggttgccgccgtccccatcccgcccttcgtttccgccgcagacagctagagtgccgccaccaccgtcgacccgaagaccaccgccgtctcgacctcgccgccattgtcgatcgtcaccgtccgtcgtcgttcgagccatcggtgagttggccacgtcacgctctacacgttgatgccctccgtttgcgccaccgcgccgtcgttcgccggctagcatgaggtgccgagccgacgccggtgatgacgtcatcgtaatgtcatttgtagaccgtggtagaccggaacgatctcggccgtccgatttggtcaagtttaggtcaattagatctcggccgtcggtttcgtggaccgcttctgtgaacccggtttagcatggaccgtccttgatgacgcagtaaatctcttttccttttcaaaagtaattctttattgtgtcataattcaattaaaatctttataaatgctttaactcgatttaaacttcaaaaattcgtaactaattcattgtaactcggtttaatgtggttcaagttgcaaaagttgtataaaatgaagatctatatattaaaattatccattatttgtgttaaattcatttaatcctttttaaataggcttcaattatattaaatcttgtaaaattcataactaattcgtacgaagtcggaatgaggccgttcaagtctcataatttatctaaaattatgatctacatgtttgtttactttactagcaaaagtgtccgtgcattgcactgggtgattatggagtgtgtatatcaaccaaaagtgttgtttggtttagcaaaagtgcccgtgcgtagcaatgggaagtgtacagatcagaaaaatatgcaattaattaaaatacaaattctctgaatatttgatatttttaagtaggtatgtatataattaaataaatttacaagtaaagcaattgtgagaaataaaatgacatggttaaatttaattttattaaattcttcatgattagttttgctctttgaaattttattggaattttcagagcttaattgctaactttaataatacaaacatcatttaacaattatttaattggaaatctaatttaagttcttgttgggccggccgacctacgtgcggccaatgaggcgtgcgcggcccagcattgatgcggcccgatgatggagaccggcccgacgcgggagtgatcaaagccgttcgttttgatggacggctcatatcggctcctaatctatcaaaaccctcaacccaaataaaccctaaccctaatttcattcttccccttcctcccctccacgcaggtcgcctttctccccgccgccggccgcgccacacccccaccggcgcacctctccgcgcccctccccaaccggcgacgcctctcaacgcccctcccccaccgccgacacctcttgcccccctccccaccggcggtggctttacctaccgagcagcggcgacggcacccttctcccccacaagcggacagcggcggcgcccttcctcccgcgagcggcgacgatggcggcagcggcgccctgccctcccacgagcggcagcggcggcacactccctcgcggcaggcggctgcggcgacgcggcgatggtgacgccgctccctccccccaccgccggctccttctctcctcgtcgggtggtggccgctgcaccactctctcggtagatccgccggtggtgtcgacggcggcggtagccgcgggtggaaccggatgtggtggtggcggtcgcgggccggcggcagctccctcctcccctctcgcctccctcttgcccctgatccggcggcgatggcggtgttggcggcgtcggcgggtgggtccgtggccgacggcgaggtggcgaggagcagtgcgctgcagcctccggtccggctcgcccctccctctcctcgtcatctcgtgttaatatgatgttttctaatgattccgatttagatttggactgggattttgtgtttgatttggatttggattgtgatgatttgagatttggagagaaggtgtgctcaatgtgggattctatttgtgtgatgatggaattccgactgggatttttgagggaggggagggacgaaaaatcaccgtacggatgtggtgacgaaaggaaaaatccgaatatttatattagttatagatatgtacttttcatttggtttttattagtcttttttctcgttttgcgtgttagcttgtcctttccgtcttttcggaggttcgcgagtgtgtcggaagtattccagaaaactaattgaagaccgattattgcaaggaaagtcacacagatcccaaacacaattcatttgagcatgttgatcctatatttaaattctctatttaattaaatcgtgcatttattttcgaatgtcaccgggtggtgtgaacctattcctttgttatggccaatttgcaatgattaccctatttcttgattacctcgggttataatttgactagtcggatttatatatcggttcaactagatgtattagatataattggttagccatgcttagaaacattagcacacaattgggataactaatgtttcactattacttaatgatggatatttaatgatagctcacgatggttaattgtgattggttaattaattaattcgctaactaaaacttgataatggtgggttgtgagcacgtggttttgatggtcgtgctcatgacaattaaggaccggttcacgagtttcggttgtgaaacattaaccgtgccaaccacaagccagcatgggtaacggctttaccttttgtatagcatggttcattgcggggcaccagactgagaagtggcggagataagcccacgggggtcgctggggagtccatgccttgttttataagggggtgattatgatccaggaacggtgcactgtgggggattgtgttatgcgaggggtactgtcacagctcctttccgaggtaccgtggtggtattaaggcgcatggtgacatgtcgtggggctatgtcttgtgggtacagtggtacatctttggccatagtaaaactattcgaatagccgtgcccgcggttatgggtgggtctaacaatgtatttcgtgattagtatcacacttctcaccataataaatgatgctataactggtaataatttgattagctcttggtttggaatggtacattcctagtttggagatagatctgtacagccgggtatggttgttcaggtttggttgggcctgtgcagcatgggtatgctgttcagtgttgattaatatcgatgattaattactttattgctttacaattctcaaatgtttgctaaatgctccttctgcaaatgagccctatattatgccattctttggtatccttgtgcacttgtgtacatgttgtgtggcttgcggagtattccatgtactcaccttggaataatcaatcaaacctcagttgaagacaagttacaaaggagaaaacatttgacttataccccagttgagctgtctgtgggagtggagctgaaacttcgctagattttatttttctgctacagttttcttcgtggtgaggactaggtacctcttatgtaagtatttattgctttagttcttatgatgaatttgtatattaaattgtcagtttgtatacctcggctgatttctggacaatgattttattcacaaattagttcggaaattactagtgattttctggtcgtgacagaccgccaccgcgccgcaagccgccgcgagccacggtcggtcgcgccccgtacggtgccgctgcacgctgccgcgggccgattgtgcccccgcacggcgccgtcgcaccgctcgccggccgcgcccccgcacggcgtcatcgcacgccgctcatgcgtgccgcgcccgcatagccgccgcgcagcgccgagccgtcccctgccgcgccatcaccgcacacgcacgcctggccgccacaccgcagctgcgctgcccgcacggccgcagcgtgccgccgcgtctcgccggcgtccgcgcctcgccccgcatgtccaccgcatgccgccggccgagccgtgctcgcgcaccgcccgtgccccgcatggacaccgctgccacgcatggctgccgaccgggcgcaccattcacgggaagaagaatagaaagagaagaaagatggaaagagattggcgattttgcaaaagggcccctgaattgtctgaaaattatgcgcatatctctcggcatggaaattccttgcgcgtagactctggaatttcagaaatttccattttcatccctccaccgcatggaaacttagtaaagggccccctgtacttgcatatttcgcctgcatttcttatttaagcattttgtttatgtcatataaatttttaatttgaatttcacgaggcattaattaatgttaattggtattttgaattttcattttcagtatttatatgaatacatgcaacttttgccccccttttatgaatatttgtatgaatttgtatgaactctagtatttctttattgaaaattgcatttactttgaattacctgcgtttctttgtataattagcatttcctttgcataagaaatattggaaaaatcatgaaatatttgtattcatatttgcaaccatgataatagcaagtaacacttgaatgctttgtcgtctttgtaacagaatgttagtaatcacgaacaaggagttcgctgaactggccccgtatgaccagaactacctgacctgggcatccaatgtccagattgtccttggggccaaaaagctcctcaagacatttgggatgggcacagtacaagaacctatgccgacacctgatgagaacgatcaggcgatgtacttcctgcgacaccacctttgtgccacactcaagaatgaacacatggcaacgaagggtctgctcactctttggaccacactaaaggagtggttcgagaagcggaaaaacaccaccttgccccaagcagagcaagagtgggcacacttgaggtttgccaactatataaaagcgttaccgaatacaactccgccttgcatcagatatgtatcaacctctccctgagtggcaaagtagtcacggacaaggagaagattgagaaaacgctctccaccttccacctcagcgctatgcatagcactcgtaaccacaggcggatgacatgcaagaagtatgatgagataatcaacatcacgcagatgtttgagtcccatgacaaggttctttgcaagaacttcatttcccatccatccaacaaaagtattgaccttaaggtcgatactagcagttacaagaatcacaagcccatctaaaagaagaggggcaagcaaggtgggaagaaagcacctaagaatatgcatgaaggaactccagatgcccaggtagcccaaaaagcacatgaaagcaagggcaaatcgaaggccaaggcatccacaaaggcacatttggttccaatcaacaacaccccagtagtagatgccatggcaaccctttccatcaccactccacttgacatccccgctcctgccatagtcgtagcgagcaaagaaaatgtcatataggagaagagtttgcaaagatggaggcttccccagactccgtcttagtccttgatacaataatgtcatataggagaagagtttgcaaagatggaggcttcgccagactccgtcttagtccttatacaattatcttatcttggttgcattatgaacttctttgaataatggatatttaacctctatgagagcataacatttattttgtgattcgccatgcatggctagactttatttccaatattatgttgcattttgctatatgataaagttttacttcttgccttgaagtagtgatgttttactttattcacatagacaatatgcatagcccaaggtgaagaggagcattgtggaacaaaagcaccacaaagtgtaatcttgagagacatgtgacaagttcagtctatgcaaagacgtgaactaccttcacaaccgcacgtaatgattgtaaaggttattgtttttcccgtagaaaagtgattacacctcaaatatcttgggaatggcaaactctcgcaccaaaggtcccttgtaggaattagaagatgagagaagcatactcatcacctaagcacgcgagatcaatgtcctcactaagaaatgtaggctaaagtagactatttcatagtcagtttttcttagaatttagtatcttgcaaatgaacatagcacaaacaatctcacatcatctgtcgtatcgcaacaatgagatatttgtcgcacgcactgccttagcgcctcgcgccagacttgcgccaggcactggcatgcatcatacagcatcatgacgcccactaaggcagctactagcaaccccgctgtactgggggactggacgaatcatgccgcgttagcacgcgccatgcaactcctaccatgcaccatagttgcaccggctgcatatctcgtggtcactctggtcgcgcatgccattgaacatcgaatgcgtgtcaaacgccaaccaccacatgaattccgacgtaccttaaaaggtatatcggaacaaattcgtgcataccacatgaattcgcatgcatatttagtcctttaatggatcatccaatgcatactgcgcttatgaaaaagctgtaattgtgtctaattgacactacgctcttgccaaatcgatcctgcaagatcacgcatgttggcatcagcacattaagaaaagcactaagtaccggacgtccacaagaataggactaaaaatgtccactgcaccattattgaaattcccgccacttcaatggactcttagctccaaaggcaatgaattatcaatatccagactattcaaaatgtgttgtccacttaaaagaatactagtgttgactcgacacatgtgcatatcccacaaccataaggtctccctccgaaaaaaattgaaagtttttaacagaggtatgaacgtagcttaaattccttgacaataagaaggattatttccagtcatttagggggacagaaataacccttaaatgataaatgtcaggaaaaatggtcaaagaaaggatggatgcacatttaatcaagcactagcaaatgcaaagtatgaaaagcacactttgtaattggataactgcctatcagttttgtgatttgcagagcatgactaagttgcattacctgaatataatgcaccggaggagggtgaaataccgaggaatgcaaaggtatacctcatattgtccagaggcctagagaagaataatgggacaagaactccggctccttaaatccctagagtaacaggagacgtctggtgaaaacggaacaaaaaggaactctcaagctcatagtcactaaaaataaccccagaatttgaagggagcgagttcaaagctggcaaatggtatggaaccccagaacaagcataccacatcttcctatcaaggaagaaaaccagcagttggagtgcacaccaacgtcggtaaaatgaaagagtcatgcccatatcaaagaatagaagcataagagaattgcatatccccatatatccatggatactcacataagtgtcacatacaaccaataagaattggtaatgagacctgctatgggcaatattctcttcatacagcaaatcattggcagttaacctggagttgaaaatcaactaaaagatcaaaccgcaaagctgacctatagttgacaatgaatggctagagaaattttggattgggcacccgcatacaagcattaaaaatccgaaaccaagttgatgatccgaatatcatcacataaagaaagaaagctcactctttccgaacgagtttgagataaaatagatagaaacctatgttgcttaggctcgtaaacatacaacacatgaagaagtgaaccatagtatatcagaatgtgaaaatacataggttccatgcatatagttcaccatttctagcaagtaacatggttcgaactttatccaaaccccaaatccattatcaagaagataatgatatgtgcgtcgcacaacactaatagactatacgaactatataagtcatggaaaatcatgcaagatttgaccattggagcatcactcgaactatcttttgaaaaggatacaagcaatgagttttgacggttcacacttaaaagagatgcaaaattcaaggggagaattttgccagtctattaacaaaagcttgaaactaaagaatttagtacccaaaaatcgattaagaaaatcgataaaagaatttgggtagattgtactctttttttttccttggataaattttcctgcagtttcttatcaaggtttttaatgaggcaatctgtgcgacatagatacgtatgccatgtactctttctccaatttttcccactgggtttttatggagttttgacgaggcatggacattacgcggtgagtgctcaagggggagtgttgagaaacttttgggcttggcccatgaaggcctagcctaaatacacttattggccccatcaccgaacctttcatatattagattgcactatataaagagaggagggggctactcattgtacaattgattggaggattgaatagtaaagagagtctcacccctaaaatttgtgtttccactttttgtagaattactggaccctcttgtactgctttgtgtagcatgagagttgcgtaataggacaaagtttatttccgattggttacttgcaagtctgtgaggaaatatagaaaccatcgcaaaatctcatgttctcaacatagttatgtagtgagtttttacttggaattgaagtttgacgatacgactcgaggaactaccgtggcatctcgacaagggtagagggatttgatagctttcgtgggagaaaagaacacaggaagaagaaaacggagttggcaagaggattcggttttctcttatcgcataaactcccaacaaccacagcttctcttataccatgcacacgcacactgatgccactgccagtccagcatggcacatcaaacacacactctcacggcccaaagacatggcccgactaaacatttaacaaggcccaatgtcatggcccagctgaacccataaactcacatataagtcaagtacttcatacaccaaaccgatacaggagtcatgacaattctcccccacttaagaatcggcttgtcttcaagccagtgcatctggaaaacgcttttgaagttgtcgcagatctttccaggtcgccaactacgctgacattcctctctagtgtaccagcccttgatggatcagcgacttgcctctcttgatcaaccgtcgttggagcacctcttcaggaagcacttctgttgttgcatcaatacaggggttaggaagtttaggactcaccactatacctgctttgaccgccttttcagaagtgatacatggaccattgcatgaatctggctattcgggggtaattcgaatttataagccattgctccaatcctgtctatcaccttataaggcccaaaaatacctgaaacttagcttatgacaagtgcgtcgagccacagacatctgcacatagggttgcaatttcaaataaaccatgtctcccacttcaaatttcatgttagttctgtgtttatttgcttgatgagtcattctttgctgtgcacgaagcaactggtgatgcagcatttcattgtacaaagttctgtcttgcaaccaagactgcacatctagtgcaatactctatcctaggtccaaggtccacttcaccaaaatgtgttggcttccttgcaaacaacacttcatagggagatttgcccaaagcagtatggaaagccgtgttataccaatgttgtgcctgggtaaccattgtgaccactttgttgggaaagcatgtactgcatatttaaggaaagcctctacacattgattcagcctctcagtttgtccatctgttaagagggtggtaagaagagctcatattcagctctcttccatttccccaaagtgaccctttcgtgggagagaagaagaacagaggaagaagaagacaaagttggcaggaggattcagttttctcttatcgcataaactcccaaccatgggttctcctcttataccacacacacgcacacggataccaccgctagtctagcacgacacatcaaacacatactctcacagcccaaagacatggcccaactaaacatttaacaaggcccaaagtaatggcccagctgaccccataaacccaaaccgaatttgctatatatttgtcgacaaattttcctccaaaaatttgacagatgtaattacagtataatcgtagtgtaattacactgtaacttgtatgtaattatactgtaactcgcatgtaacttgtatgtaactttcaaaaatctctccgtaacatgttatttcggtaaaatggaggtcgtgggaataaatcctttcacatgtgtgtgctgtgatttttttttcttcctcaccggaacaaatcttgtaatagatctaacgattcaaaattacatgaaacttacatacaagttacactgtagttacatgcaagttatagtgtaattacatacaagttacagtgtaattacaatacggttgtactacattctgtcaaatttttaggagaaaatttgtcgacaaatgtacaggtagtcccaacttatcagacaccacacccgtacaggagtcatgacatttgataagtagatggaacaagatagctagatttcagcacacatgctacagaaacacggaataagtaatttatcctacaagaataccgctaagataattttcagggatcgccaacggtctgcattctgaagatcagcagattagttgataatctactgaatcaactggtttctattcacagactcacagtgctagttgctgtggttgccacattttgttccttcttattctccagaaggacctgtgcttgtttcacttgagaaccgagaatgcttactggattcattgcgctctggtcgctgctagagaacatcatgaacgcttccagttcaaacatctctttggaagccttggacagagattccatcaagctctccagctctgctttggggtagtttccttcgagatttatcagtgatatgatcatcctactggcaatcttcagtattctcaggcaattggctgttggttcactgttttcttctaccaacttcttgagcttcccggcaaagctagatgcagaatctcctgttgcaattgcattagcaagttgagccaaatctgtatcattactgatcaatttttcaaatattgccgcactaagtgacagtaaagctgcatgtagtttcctgtccacgattttcttgttgtcgtccttttgctcattgacgttgccactatctttcgtagcaacggcaccttcgcctatttcaggatcttgtgtcacaaacttggttgcgtctgttcctttttctgtatgcttttctccttgcttcaatggaggagagggaagtatttctttgagcatctgcagtggtagaaattatgcttattaattagtaggtgatgataaagacccaaggtgcgcgtggttagttaaataagtatgaaacaaatgaaatgccttcatttgtttgaaattttatcacacaccgtacctttggcagcacatctttcatggcttccgtcagtttcttgagattgtcatcctcctttgtgtaacaaatgtatagatgcttgaggatttccgccgcacttattctgtatccgctcttggtgcgaacgtcgaggagcgttgtcttgagatcatcgacaacggtgtcactcgccttgaagatgatggcggcgttgctttcgctttggtcgacggaaagcattgccagtgcttcacctgccaattgtctcgtggaggcgtccttgttttctttagtgaagaagatgtcgaccagcagcttggtgattttctccttgctatcggctgtcgaagtcgaaggtgcttccatgggaagctgcgtgaggatcttgatggccaggacgtgtagcttctcgttgcattcgtcgcacccgaggatcttctcgacggtgttgatggcgcgcttgttggaacgcagcttgtcgccggccttcccagggagggcgacaaggcggaacaggagctgcagcgacgcggctacgatgtcggaccacgcgtcgtggccgatgttgtggaggaggtcggcggtgacgggcaccatggccttggagacgaggccctggttgctgccgatggcgctgcagttgtgctcgtcggcggcggcgagcttgtggaggatgtctcggcccagcaccatgagctccttgtagtgacccgacggggcactgtcgccgtcttgctgcttggtggtggtggtggtggtggtggtgtcgagcagcgacgagatgcaccggagcccttgcgggaagctggcgaggctgatctcgccggcgagttgcgccacgatcctggcggcgagcacccggacgtcccggtcgagcgggcttgtggagcgaagcgactgcagaagcctctccaagacctggctagccgacgcggagccgaccagcttcctgatcagcgcgtgctgcccctgcagctcctcctgcgcgaggatcttgtccaggatcctcgcaccggagacgtagtcggcggacgacgactcggacttcatcagctccacggcaaacgtcaccaggttcctctccttgacgaatgatggatccttctcgcaaccgatcttggtcttgcgcatgtaatccctcaccgactcgcgcccctcttcgtcttccttgtcgaacccgtagtcgtcggcgactactcgggccagccgtttcccggcgaagtaggaggctgactggtagcagaagagcacgccctggaagagcgccagtgagtagagcacattgagcgccggggtcaggttagcgccgccgtcctcgccgccgtagtcccgctctatgaggcgccacatggagaggccggtgctgacgagaaggccgaacaggtagagcaacgccagtgggagcagtatgatggcgatcaccagcgcctggaggagcaacacaagaatccccaccagtgcacgccagtactggtccgagtcgtcgtcgtcgtcctctttcctgaacaccatggctacagtaaccaagaggccatcgaacgatttccaagcgtaccgcagcttttcgttcaggaaaacatcgaacaccctgtaaatttagttagatagaggcgccgttagacctggacaagggagatacgacgaaatgggtcggagtgtactggaaatgtttctactttttaggaacttgaaacccataggaaaatgctcgatccgtcctaaaatatggctagattagatatgtagattcatagttgaagcaatagttatattcagtctagattcatagctgaagatagctatattttaagatagaggagtgtttgcaatttcggaacaagtagatacggtcaaaattttcaggataaaaaaatagctataagttaagggactgtctatataggatttgatggattttttccgataagttaagccccccaaaaaagaaccaaacactaatcccactacctcaattccgtctgtggcgcccaaaacactccttgcgacctgaactttccaagcaatggtgatgctacccttactagcggcgacgatgggtcaactactcctggagttggcggcgacggtgccaaaaaccctttctatggcttggactccctaggaggcggcgctcctcctgctagcagtatagttggctaaaagacccgttgcccgatggaccgggccacagcatggagatttagcccagcccaaccattgacgatgcctggtcctctttctcggcacaatgagttggcccggcccggcaagacccaataataagcaggcccaaagagatgagggaggtaaatagacatattccaaggacgagtacagtggactggtcgtgccttctggccgacatggcacggcacggcccaagtgttattgggttgtgcctgcattgaaggtgcagcccatagatgcgcacggcacgatatggctagttggtcctactctcgagccgtgccttggtcgtgcccaggctggaccgtaccgaatggcccatttagccatttataactggcggcgacaacagctcagctgctcctggagtcggtgactcagcgtcaggttcttgaggcagcagcagtcatgatttgctccttcatcctccatccttcctttttcactatcttgatatgtctctccgcctctatgggatttgtccctcagcacttcttctgttcttatagtagtgcgcacactgatttggggtcatggaagaagaagatcctgcatatgttggcagggggagacgcatggggtcatggtggtcctggatcgtcagccgcctgcacagctattgtaactgatttgggcaacaatgatggtagcggggtgggaggaaggggatcagcagcaacaactgttggaagaagaacggagagtgccagtcctaaatggatatgagatgtgtgcaatttatcaatttagcgtgatgtaactgctaaataattcagctgcaataagctcatttttttttctggaaatcatgcattatccgataagaaattaagatttgcgtggactaattattttatcccagaaatttccagaactttgaaattttgattgcattttgttttttgtaacaaaatttcatatttgaattcaaaatattcatacgaataatatccaaatttttgggttttttccgaccccccacgacaacaaaaaaacatttcaaaattgcataccctgcaagggagtacaaaagacgaccttaaaattgaaaactttagccaaagtatagttcagtgaattatacaaattgaatacatattatttattacggtacataataaacatcaaatattaatgctaaaagagtaaatgtcgtactcaagcaatcaattgacctcaaatctatctatctattatattatattattaaaataagaaggcatcatgttcgctgtgtaggctagaaattcctgaattaattgaaaaaaaaagaaaaaggatagtctatatagaaatacaattgagaaatcactgaaattcggaataaaaataagcaatattgcaaaagagttcatataagaacccaatacaaaattaatcgaaattcgaaataaaaaaataaaataaattctgaaattaggaaaagaacaggaagagttcaactagaaatacaatttagaaataattaaaattcggaatacaaaataaggaatattaaattaatagtttagctataacacagcacgagattaaataaattcagagtataaaataaaataaaatacgaaattaaaaaataataagagtctaggtaggaatacaattttgacgtaactgaaatttggaaataagaataaacaatattagaagaatagtacaaataagaatccactacgagattaattaaaattcgaaataaaaaataaaataaaataaattccaaaattaaagaataaaaaggagagttcaaataggaatgcaatttaagaaaaactaaaattggaaataaaaaaaggaatatttttttttgacgtgataaaaaggaatatagaacacaatatgagattaaaataaaataaatttataaattagaaaagtaaaaataactaagattcgtaataacaaataaagaagatatcatagaacacacgatgagattaattaaaataaaaaataaaataaattctaaaaatagagagttcgaataaatgagtagagtggtggtggttgataggacactaaaagatataaacaaaacccaaatagaatgtcactgatgattaagtggagggacgatgggtagaccattaagcatcacggtcacgatggcgggacttatagaaagtaaaaaatataccctaacgataatcatattttatttttaaaatctcatgataaaaaagaggggaggcagcgggtggtccatagaggagtacggtggcaaagccgctgacagtttgataggacttctagaaagtaaaaaatgacctaaatgataattatgtttgtcttttaaaatatcaatcgcaataaagagataagtcggtgggctggtcataaaggagtaaagtggtggcatttgacgagacttctaaaaattataaaacaaaacccaactagacaatgaactctaaaaactacaatgtctaatttttaaacgttccaagaagaatgaatataagcagtcatagatcgcatgcaaataaaggagtgataaaggagtaaggggtagcgactggtgtgacttttaaaaaataaaaaaaattagaaacacgtgaactatttaacaaaatttaagaaaaaatcatatgtaaaaagtagataattttgtatgggtgctagccacgcaattgcgcgggtcacccagtagttctattgaaaagcatcatccttttagtattgggttgaaatgaaatcttcctattggggcaagatgggctttgctttactctagaacttagtggattagaaattatggccccgtgtagtcaggcacctcgcaaatgctacaatattgctagcaaattcctttgcactctatctttccttccaaatgaacatgaacagtactagaaattcctgaagaatgatcttatgaaaatctttgttccgaaagtgtgttttgttagccccttttcagagaaagaaaaattatcattgggagcaataaatggtcagaaaagaaaagaaaaaagtgacgaataggaaatacaacaaatgtatagtagaattaagaagtctaacccagctgtctggacaagggtgataatggtgagactccaaaaatccttcttctcaagcatggagacgaagccaccaaggaggacgacggtggtccataaacctactaggaagcccatccccttgacggccattgacaggtaccccataaacagagcataactgttgataccgtcaacttccttccactcggactgatcaggttcattagccattgtcagttcttcctcaagaaagttgggatcatcgtttgcaaagcagcaagccaatatatatacaagctcctcgagcatatgggatgattaactatcaatacgtagaccaatagccgattaatgaaaaatgttcagatcttgactttacctgcacgaagcgatcgaggtcattgtaaagtatatattgttcatccagcctgttcagttttggaccaagcaattagctaggtctttattatatttatgtattagtagatcaatataaaagacctacaaataaattaaagctagtggcctcacaagttacaatacaatattatgcttctcactgtttgtgtacccacactctagctagattactaatgctgggattattattgtttcttgaatgccgggaaccagacgtaattgatgcacatatgtaacacatggtggactggtcgaggagcgttacatatgtaacaggagctgacaacgatccgctaaactcgcaagagtaaactctagaaaacatcatgaagccttccagttaaaactgtttacaactaaatttgacacctagattcgaattatgaacattgccaaaatttgaaaggcgccgagtttccttcacggggccggtccgaccaccgcctatgggagtccaaaccgattttcatcgggtctcgggtttccttacttggaaaggtatttttcgagtttccattggtttccaccccaaattaaacgtggagaagaacatgtagaagacaagaccaactcctttataatagccaaggtcggttcgacctccctcccccccaaatctcaatccatacataatcgaatcgtttttttacttctacttttagccattttttctactttaccttagttttgtccatctttgtcggtttgcgccgtaaaccgtccgccttcactacgagagtgcgattatctctttgtagatttgtcttataaccttccgttcgcccacgagacgggtggttatcttcaaatcaatctaaatcggccccgaggctaatttgatctctaaatcgcctccactagccggtttaatcttcaaagcccatcttgatttagaattctctagatcgaggtggttggtgactccattaacaccacaaatctttaaatgagtcatggttgggaccgaaaagggtgccaacatgaattggcgactctgctggggaacgtcaagaattttggccataccacggccagaaacaatctactatatttgttgcttacgcatataaattgatcgctcagttgattggatcagatcggcgacatcattctcttaccgccgcgccggtctgaaccagtctaaccgacgttgtaggcccggtctgaccggtgaggtgaccggtctaaccggcagaaagcaccaagataagcagcagcaacattgtttccttttattgctgcacactgttactgagaagaaataggaacagagcggccgattttatttaacatcggttaatttttggtatatttgctacagtaccaaataccctgttacgatcaatcaacaaggctaagtttgataaaattggtccaaatacagtagcataccaagaaaactatagaccgtatattaatctatttggtcaaaatatttcagctataattaatatgatcgaaattcatccacaaacatcttcatcaaccatgacgagtgggaaggagatcgacaagctcaccaaggaggactggaccaaggaggagtggcgagactttgaaaaccaaatggcggcgtgtgagaagacgatgctcgcaagcttcctcaagaccgaccaaggcgtcttcaaaagagacgtgacgtcccgctaccttgttaggagctctattgggccgcatgcagtatggaccatgcattctccagagcaagcccaggctagcccaagcgactgggaacaaaaggatggctgctgctcctacaacaaacattgaacagatcaaacaggcatcggcggcttcagccacggcggcaacggcgtcaaggttctaggctagaacctcgacgatctatcttctctaccgatctcttcctacctccagcttccactgctagttctagaagcttccaaaacttgtattccatagtttcttcttctcttttccccctaaaacaattgttgcttgtatggtggatccttgctattgaattggaagaagtgggttcctaacaatctagtatcagagccgctcggttcgtgggatttctcgtcatgcaggtgttgggaaggcagcagtgcaaggtggaggaagatttgggcaagtgaggtgctcatgaatctagcgcacacaacctgttcgatagaataccaaaccaacataaggtgtttaaggacgatgaaaggatatcagagcccgtttccatcaaatccaccatgaacaaggagggaatatccatggacgaatctttagatcagaatcttgggaagcttgagttgatggaggccaagtgcatgcaagaggagaagttcaatcaaatactacagaagttggaggagatagaggcttgtaggagcaaggctaccgaggtgacgattgctgccatcaggacaaccaccgccatcctcaaggcttcatcatctccaacacccatggcaccacctcctccaacaccgaccaagtgtttgacaaaatgccccaacaacaacttcacttgggtgatggcgaattcaagtcacattggtgaggtgcttgctccaacggctgcctgggagctaggagacaacaaggacaagggccacgccccctgcatcgtcaccaacgactcacccaaggtcacgcccgccaagtgctcgaattgttctagccctgacatcatgctagacctcaccgtggctgtgggggtttcatgtgccactacttctatggcctccatggagttgttggttggcgaggatgaaaccagtgtcatctacattgacaaccctcattgttccatagcgacgcatgccaagtgttcgactttgggcctcgatgtcaatggtagcgccaaccaacctgtggtcgtgttccctaccattacagctatgaatgggcatagcatcattccaactctgcctctgaccattatgaatacgtcagtcatccttgttgtcaaatcaagttgtgctagcgacaattctatcagacttatgactctatgttagccactaatggagtatgctgagaggaatccatggccacctcctccttcgaacaagctaacgggtagcatatgtgagctatggccagaaccatggtcatcgtttgcgtgtaatcgatgcaaagtgtggtacttgttccgattggagagcacactattactgtacgtgaatggagttgagcagtttctaaaggaattgccatgctggccaccgcctcaagaagatgtgattaaatctgagttttatcatggagggaatcaattttggttgaggaattcagcttgtgttatttttttttagataatggattcagttgtgttattgcagagacaaaaatgatatacgtagctactgttgtgaggttcagtttgtgctatatgcagatgggtgctatgaaaccttcaagtgttatacaatggttaaatttcccctactgcacatatgacggattcaagcggaagcttcgaggcttgttcacaaatggagccttgtgcatacattcaagtcagtatgatcctccagatgggctttgtgaataatccggttgctatttagtagaactagaaagaaagcccgcgcaaatgcgcgggcatcttattgattgttttataaaaataatgcttaaagaagttacatctcactatttctatttaaatgttataaaataataagaatatatctcagattaaaaatacactttgatcgagtgacatataaattctcctattgtcaccattacttactatgctttaaaacctaataagtaattaatacactaaattatcctctatttaggtttcatatctcattttttttctaaatccatttataaatattataaaaataccaccacttctattcattaatggagtagcaccattaaagttaaacacgaatactactctagtgggtgaagtcgattgtagccaccaagactttctttctctattgccttgaaacatgagtcccgcatcgatgtagccatgctcctgaagaccagcttggagcataattttaatgtatgattcattatcacatgctcatggagtattatattggtaagtagaaagttgagtactattagcgatggtggcctccactggaactgtaacttagtcatatattccattttatacttacgacaccataataaactttgttgtctaagtttagtgtcctttagggaagaacaaagagaagatggaggtgaccaaagtagttttttaaaaatgttttgagtagatttgtggtgcagtgtaaacacaatttctttatggtgttgatcattactactcattttttttatgaaaagatagaatactctcttttgaaaatggccgagtttaataattcgatgatgttttttaaaaaatatagctaatgagacatatcaccacgatagtatccagatcatcatgttattatctatgttttgacaaatatgtatagtcaaatagttctaaaaatataaaaatactttcagaatcttaatctcaaacaaattgtaatttaatcagacctactcgaaaaacacaactaaattgtgttgcttttattttttacatatgcagatttaaattaatgttgtatatttgtgaagtgaaatttccctccgtaaaatatgatgtgatttttttgaaaaattatcatacatatgtcagcctcatgtgccgtggtgtatttaggaccataatataacttttataatttaattaaagaaatataacatgatcacaaattggatatataatttcaaaataatttagaagatggtttaaaaaacatttattgagtattctatgtttttattatagatcttagtttaactatatatatttatattatatttgtgaagtaatatatttcatgtttatattgtggaaaataaccgtccatttttatatatctactagcaaaatgcccgtgcttcgctacgggtaaaggaacggttaaattatatgaagtacatcgttaacatgtatataataatgttccaatataggtaaattgttcattgcgctaatgataatcaagatggataaaaatattcatgtttagctcacatcgcgaaagaaaaaattaaattaaaaaatattaaattctaatttaatgaaatataatttttttgcaatattaattacactctttgaaattatagcaaaagtgctcgtgcattgcaaccggaagtgtatagaccagaaaattgaggaaaagttaagaaaaatctacactatgtaattaattaaaatacaaatttgctgaaatatttaatattttaagtaggtaggtgtaaaactaaattaatttacaagtaaagtaagtgtgagaaataaaatgacatggttaaatttaattttattaaattctccatgattagttatgctctttggaattttatttaaattttcagagcttaattgctaattttaataatacaaacatcatttaacaattatttaattggaaaaagaataaaaatcctcccttttaggtttgggcataatatgaaaaagtttatattacctccctttgcctatcatatgtatctggactattctttctccgttgaagttcattttacgtcctcatgcaatcacgcagtccgttcggcggccca

SEQ ID NO: 2717 - DNA, 15055 bp, Oryza sativa
gaggggtgcaccacccttcccccgcgagcggcggcgtcagcggcggtggccactatccccgcgagcggcggcggcgcggtgccctcccctcgcgaacggcggcgtcggcggcagtggcgccctccccccgcgagcagcggcgtcggcgacggctcccccaccgagcatcggcggcgcggcgccctctccccagcgagcggcggcggcgccctcccacccccctcactctctccacttctcctcctttctctctgtgtggcggcggcgggagggccggcgacgccctcccctccgctagatcgagggggaggagaggtgcggcggcgggtcggacggcgtggaggcggccggccggacctcgcctccgccacatccggcggcgctgcggctaggacggcgtggaggcggcgggccgggcctcgcctcctccagatccggtggcatggaggcggctgcggcccggcggggcgtgaggggcggcggcccggacagcgtggaggcgggcgatggtggcgccgatttttttttttttgcatttttttccatcactattgctaacctaatcggattgcgtatggacgaaaactcggacgaaattagatgtgacgaacggaaaaatacgaatatttatattagttatagatgtgtaccaaaaaattgacgtataaaaaatatacatgtatataaactttatatacgcgtatgcaaactttacatacgcgtatgcaaagttccatttattatatgcggtgcatgcatatataatggcattgacattactttatacagaaatactaatgaggacacctggctcagttcgtttctttgagttcccaactcacactccccgttttttgcttttcaaactactatattcatctcaaaataagtgcagtcgtgggtatccgtgtttaacgttcgaccttttgttttatttaaaaaatttatgaaaaaaattaaaatattagtcacatataaaatactattcatgttttattatcgaataacaataaaaatactaataaaaaaaaaggcgatcgttggacatgaacagtgtaaaactgcacttattttgggacggaggtagtactaaacagtgtgttttatgaaaaaaattctatacgaaaattgcattttaaaaaaaatcatattatccatttttctaaaaattagttaatatttaattaatcatgcgttaatgaactgctcagtacggagaaacacaactaaggccccctttgattcaaaggaattttataggaattttaaaggatttcattcctataggaattttttctatatagccctttgaatcaaaggaatgaatcctatgtaatcccatgaaattcctatggaatgccacttcccatgcaagttttggaggaaatttagcatgaagttctacctcatgttaagaatcttttgttcttgcggctcaatcaaacggtcattcctatatttttcctgtgttttacaatcctttgttttacacttatattcctgtctaaatcctatgtttctcctatttctccattttttcatttctttatttctgtgattcaaaggagtcttaaatgtgtagatttatttaaaaccattgtttaaatagcattttcaaactgccatagtacgtatcttttttattaaaataagcagttatatttgcttttctttaactgccgatcagaggctcagagcggagagagcggcgtccctgcgcctcgataattccgcccgtcattatctcctcgttctcgccgagctcattcctctcggtgtttctctcctctgccgctcgcccttatctcctctcctccgttgcgctctctttcctttcactccttttctccttctctactcacagctagcgacgccctccatctccgcccttccccctctgccccactgcagcgttactccccgtacccctcagccacggcaccctccctccagccggcggcgcccttcctccggcgacgacgccctacccttggcggttggtgccccagccgcggcgccctccccctggccggcgacgtccttcacccggtgggcggctgctcagccccccccccccccggtcgacggcgctcttcccccggcgggtggtgccctacccttggcggtcagcgcctcagccgcgacgccctccccctggctggcagcgccctctcctcggcgacagtaccctcgcggcgcacggcggtgcccccgccaagccaccaaggcctcgggcagcggcgtcctcagcctctaatgagcagtggcgccgagggcggatccggcggtggtggcatcggcgacgtccgcgggtggatcccgcggcggtggcggcagccgagggcggatccggtcgcctttttttttctttttttttttgctcgagtttattttttatttttttggaatcggacattgggattcatgagctcttagattaaaattggcttttttgtgctgtttttggttgtctcattgttcgatttatttggggatcaagctgggggatttttatttttgaaggacgccgtggcggagggcgaggacggcgacgcggtggccggcgaggaggaggaggaggagcggcggcggctaagcgaggaggagcagcggcggcggccgtgaccggccggtggagggcgccgaggccagtgcccggggcgaatggcaggaggtggggccctgtcggccaggctggcggcgcgccgtggtggaggggcgtggcggaggggcgaggacggtgacgcggtggcaggcgagggaggtccctagggtcgtcgggcggcggggaggaccaaattcatgagctctagattaaatttggtattttcgtgctgttttttgttgtgtcgattgattgatttgggtatttttgaagactaccaaaatgcccgcttcgccacggtgtattgaactaaaaatatttgtttttaagtgaagttattttcacactgctttggtatttttgctcgttagaaaaagtctcaaataatagagagaaatatagtagcttaatagtgtgttgcaacggaaaaaattaatgttattaactttttaaagtaataaaaaaggagcattcacattagctcttatagtttagaaattttcatattaatattatttaattttagtctaaatttatatcatgacaaataaataattatatttttagtcgaaaaataaatccatatcatgagaaaaatctagcaaatttttagttaattcaatttagttggaattaaattattaagcagtaataaataattaaaatggtactaatgctatttctgaatatagaaagatgcttaaaattattgagaattattgagagagaaaacactaattttatcctagcccaaacttgcggaccaatttggaggcccaatagtgccgcggcccaatgcgagagaagccaaagccgtctgattgaatggacggttcagattaatcccaacctatagaaatatatgcaaccaaaaccctaaccttaaatttcatttcctccctgccaccgatccctcctctctgtctcgatcgaatagcgacagcggcggcgcccttccccctcacaagcgactgcggcggtgcccttcccccacttcccacgagcggcggaggcggcgtcctctccccaacgagtggctgcggccgcgccctccgccccgtctcacctccctcattggtggccgctctctccgccccatctcgcctccctctccctctcatctccctctccctctcgcagtggcggcgggttggcggcggacgcaggcggatccgaggatggtggcgacgtcgacggcagttgcgggcggatccggcggtagcggctccctccgccccctctcgcctttctcgcgcggtagatccggcggcggtggcagcatcggcggctggatccgtcggtggtgacgacaaccgtgaacggatccagctactatatttctctctatcatttgagactttttctagcgagcaaaagtaccaaagcagtgtaaaaataaacttcggttaaaaaatatttttagttttaatacatcgtagtgaagcatgggcattttgctagtataagatataaattactattagtaaaagaataatatattgtcaaataataatactgcatatttctaatttacaatcataaagggcgtatctaaacatacggtgaaaaatgggtatacatatataatcatgatctaagtagggtataatttcaactattaaaagaaagtttatttgctcagttggcgacagcatgatgtgcccagaacgaaggtcccagggtcgattcttgtctcgtgcgtagcttttttttattttttatattccatgaacacgaatctcaaagtctatctaatagactaaaaatcgaacatttttttttttagcgtttgcggtggcagcagtgatacgtgcccgcaagaggcgaatctatcccagaaaaatcaacggaaaaaaaaaaccggagccggcccacagtgtttaatccctatccatccccacaccgcaccaacccagccgcgactcaactcctctctctctcgttctctccgcctctccgcctccggcgactctttctctccgcctcctctctccttctccctctacctgcgaccccgcacctcctcctcctctccagccgccgtcttcagcccggagctctccttccgcgggtggcaacgggcggcagcgcctctccgcccctcgcctcctctccctcgccatggggccgcgggagggctcacggtggcaggcggcggcggctcggtatcccagatccggcgtcctggatggctggatccagcgcgagcggaaggggaggggaggtggtggtggcctggtttcccagtcgcggcggcacccttttttacggtttttcgtctttttgtttttctcctttcttgtggatttaatctgtgatgaattggcagcgaatccgtgggtgggattgagaatccgttgatgtgaatctgtgatgaattggatttctttttcttttttttttggaatttttccatcgctaacataatcggattgggattgggattgagattgagattgagataggacggacgaaaatacggacgaaaagagatgtgacgaccggaaaaatccgaatatttatattagttatagacgtactcggactcaaaagacgaatgacggacgaagcggaataagtttttaattaggtatgtcttttctatctatgtttgtatggttttttccttccgtgaacagtagaaatttaaattgcatgtactactcgtatgtcgtacgtacgggagaccggtagcagctttttatctaaacaggaggaagttattattttacaataatagatctaatctaatggtgtagaataatgggtctaccaatttaagtgaaaatcaaaggtgagattagatagtgctatatgatggtttaagagtgtttataggagtgccacgtggcggcttaagagcgtttgtaaaaagtttaatggacttttagtatataatagatagattttctcatatcatcacgaacggaagtgggcaaaatgtgtttgtggcattgtcaaaggtgagatcagtgcaactgttttcaaatggagatagaagggagcaccatgtcagtaatagcaaattctggtccaatctcccaataactatccaccaattcttccatacatttgcaattgttgctttagtggtggctctgcaaacacatcagttcagagaatggaatggaggataccttgttctgatcttacgatgtggtttagaaaatgcaatggagatctggtcacatatggacatgagactaatcatgatgtactagtacagtatactgagtcactatctcaccaaataaaggcaattgtgcacttactgatcaggaacaaggtaaacacatggatatctgaaacaatggggagaactaatcattttggtgctaagttcacaattgcttgtcagttctcaagatcacttgaatttgttcctatcgagagtatacataaacagtggggttctaaacagcacctgtgcattctgctgcctattccagttagtacaaggttacggataatttcagcaaacaagcattattgttttcaaggaaaaatatcaaaattgctggtggcattctttgttgttcttaccacagaggggttaactatggttataatggaaaagaaattgtgtgagctgagccattgctatggtttcctgaattatacaaatgcaatggagggtaggcaagcaattccttttggtggagccactaaaccagatacatgaccaattggtagtgttgacaagattcaccttctcaaaattttgctgaatgactggcttcaacaacactacttccattcgagggttgaccagtggagcactgagtttgttatcaaggttggcattccggaagagtccacttggtgtatcagtttgaggcatttgctaccaagaaaagatgtccatggaaattgcattgtcagatatcttttgtcaatttcctattgttaaccggactgaccataggagctatgaggacaacttatctggtaacatcaggatgtgctccattgcaagctaatcatgggggcttgaatggcgaaggaggttgactaaatgtggctgcaagttcttacaccaagacagataagaaacaactacctaatatgtacctctccagtcaacaattcaaatatttagagcagccatgggatccaggaggattacttcatcggcttgaggacaagccgaaacttaagaggggattgttagaagctctattgggtcgcatgcagtatgggctgttgacggtcgttattgatcagtttcgaccgtcaatactactaaaataggagagaactagtgatgcttacaatgcataaaaatgttagagtaataatattccacaagtattaggttactaaccttttgcagagaatgacaataaagtgaaggagaatcgacgtcaacataaacgataaatcaatcggacgatgtcgacaatcagacttatgtatgaatgggccaagaactcagaattgacacgatgaattgggccaaaattcacaagtctgcggagtggagcaatagaggaggccaccagccgaaattgggctggattgggccaaccccaggttcggccgaaccaatcctggcgccgttggatccaggttttggcgtggacgtctaggattgcatcccaatgacggttggagggcactttggacaattccccttccacaaccgtcataactacctctatataaggacttcaccttgtcacttcactcacacacctcaagcaatagctctctcatttctctcaagcttaatttagtagtatctagctggtggaataggaatagagtagaaattaggagtctggaagccttcggaagagttcggatatggctctagcagcttttcttttctcttttataagctttgtacttttattagaatactcttctaaatacatttatggtattgaaatattttccgagtatatgagtacctactttacattatgttcttgttatactgaatatacggctagcttatctgggagatgctttggtgcgggtataatgtttgcttatgcaattactctatgtcatgacgatgatattagagtagtatctggtagtttagacgtggtgtctagattacgagatatcattatttggggttatatattacggatgagaggtgggccgctgatggtgacagctcagtacgatatataatcctaagttaattccctgaggagggtattcctccgtatttagccccggttgtatagtcatgatggactgtcgtaagaaactcgacagtcaggggtggcttctcgaagtaccaggagggtatcagaaagagggtattagctagtatatcagttaactaggatgtatatatactatgtatattagaagtataggaatagattatcttcctcttttctttccacttagcttagataatatattatgagaatgagcagtttatgcttgtgtgtcactatatccttggattatcttaacccctgtttagaatatgattatcacaagcaatatataaattattagtcatgttctctctacatgatcttcccacgggataagataaatacgatatccttggaatactctcggatgaaatgttacaatggtatatccgtgcgcttgcggatggactctgtaaccataatataccagaagtatttctgcgtcattgctaagaattatatttctagtaatgtcgttaagaaataccaacatgggccatgtaatccattctccaaagcaagcctaggctagcccaagcgacagggaacaaaaggatggtactgctcctgcagcaaacatcgaacagatcaagcaggcatcaacggcttcggccacggcggcggcgacaacctgcttctgggatgaacctcagcgaactctcttctctacctctcttcctacctccagcttcctctcctagttctacaagcctcgtccgcgagcgaccgccgccactcgattgccactcctcccaaatccggaagccacctcgcctccgcgacccaccgccgcctctcctccactcacaccaacgggctccgccacccccacactcaccgcttgttgtgcccccaccgctaggagccaaacagcactaacggtcagtgcaaatccgtccatcccatcccacctcaatcccttctaccaaataaaaactataactatcctataccataaaccaaataaataactgaaaccatcccatcccatcccaaaaataggataggtctaacctatcccattttgtccccaaaccaaacacacgctatgaggtaaaatggccgataattatattatcgccctaagattgcatgctatatgctttttggttctcaagttcaccaaaaaggcaggggacatttgagggtgttagcttaatgcaagagttagcttaacgcgtgctccaagacaaataaatcaaatgtttaagtgagagaaagagaggggagaagaaaaattgaagtcagccttatagcctccatattttaatgtatgacaccgttgactttttgtccaacgtttgaccattcgtcttattcaaaaaatttatgtaattatcatttattttattataacttgattcgtcatcaaatgttttttaagcatgacataaatattttcatatttgcacaaaaattttgaataaaacgaatggtcaaacgttggtcgaaaagtcaacggcgtcatatattaaaatacggagggagtatatgtgttagctttaagatggactaatagtagaaagtgagctctacctaaccagctgcgcaggcgcaatgccaacgatcgattgtgccttcctcttctccacgacttctcctgcttctttcacgagggcagcgaaggccgtgttggcagtcgtgttggcagttatacttgaatccaagcagacgtcggctgcgatcttgtcgaaccgatcagccagaactggatccgtggagatcagcttgtcgcataccgtcacgcagagggacgccaacgcctcctgcacttctatttcctctggagtatattgcttgccattctgctgattggaacaagatgaggcgttgttgcctccattgctaactcgtgaaggatcaccgtctggtagggcttctatgtctgcatctggtggcgagaaattcccagaattgttcgcctgtgtagctactgtttgtctctctggtcgtctccagtcacagccaagtaattctctgaggacctgaaacattaaccccaaggtatttcagcataaaactttttcgttttgtacgtgttaatttgacaggtatcgatcattacctttggtattgcaatggtcatggagttcttcagtttgtcccaatgttcatcgtccgtagtgtggttgatacaaagatgtttcaagatatctgccgcacttgtcctgaatgtgttgtcctcgacatctacaaccatctcagaaaggcgatcgacaacaatactatcatttagcttcaacttcaggatgatcgaggcgttgctttcgctctcgagagacagcttcaccagctcttcgcctgcacatttcctgacggagctgcgtttgctgtcatgaacaaagatgtctgtgaggatcctgatgagaccctgtatgttttcactgctcataccaccagaagacttgtcgagagagagaactgtgagcagctgtgcagctagcctccgaagctctgcatcacaaccgtcgcacctgaggatgctctccatggtgctgattgcaggcttgcagctcgtgatttggcggcgtagcttcacgcgggagtcttggaaaggaacagagacaagctgaccaataagtgttatcgacccctttgccatgactgagagttcatatctatggtcgtcgtcgtggtcgtcctccatggtcggagccggagctgataggtgccatgatcgtggagacaaggcctcgggtgtcgctcatgatcctgcagttgtcctcgtcggcggcgagcttcccgaggatgcgctggccctgcaccaccagattcttgtacttctcgagtgacagatggggaggctcacgctcgtagaccagcctgtacatctccacgaactcaacctcctcatcagggcatggtggtggtctcaattgcagcttctcgagcaccaaatcacggtcgtatggctcggcgaggcggtactcgtcgtcgagcagtgaggttacgcagcagagcgctcggggtagccgttctaggtgaacgccaccggcgatgtaagccactatcaccgtggcgcgctccctcgcctccgcgtcgtgcgggcctcgtggctccagcgtctgtatcagtttcagcatcacgacatggtggcgagaaatgagcatatgtttgatcatcctgtgctgctcaacgtgagtcgtggtacaagcgtagctggacgctatctccccgacgagcgtgctcagtatcctgagcccggagaggtagccatcaggtgagctcgacgactccacctgctcaacggcgtaggtgaccatgtttctccctcgagcgaacgaggggtcctcctcgcatccgatcatggtgtcccgcaggtagtcccacaccgactcccgcgcgtccatgtggtaatatcggcatacatcattcactattgcttctgctgcagatgaatagctgaccctgtaggtgaagatgacgccctggaagatagccaacgagtagaagacgtccaaggctggtgttatgttggtgtccccctctcctgttaccgagtagtagtcccgacgcctcgcgaggcgccacagcgagagcgccgtggagatatatatagatcccgaacatgtacagaacaatcagagggcacattaggacggcgatcaccaccacctgaactcccagctttagatagtgcagtagctaggatgtatgtgatgttgaatatgcaggaacccctagctgtgttgcactccaggtagcttaaaacgttcattagtgaaactgatgtccttactgttgtctgtaacaagcctctgtagccatcccaaatactgctcagcttttctttcatgaagacatcgaagaccctgtaagaaaaaaaaatatggagtatcatcaagttttaatgaactcagtagacaggaatagtgaaggcacaacaattcttcttaattaataggcaaatcttgctacaggatatccaaaaaaagtgtaattagctacgagacaacgcaagaacgtgtttctgctatagagcactgtaaaaaactggtaattatagttgttggacacccgcgggattattttattatatctagaagaattggagagagaaacagctgtgtaagtacggttcaaccctttgattttttttcttttctttttcatttttcttccttatccttttctccctctctcattctttctctatttctgtctctgctctcaaccgccgccttcaacctctcccgccgcttcgcctatcatcacggcgctcgctcgccgccgccactcctcccacagcgtgagcagtgtgttcagcatatccaccagcagcctcccggccgccagccgcggcaccgaccgatagtccgcgccgccgtcccgcatcagccccagcaagaacccctcgtcatgcggcacgctcctcgcgtagcacggccacctcgcctccgcggcgcttctgcaggcctcgctcgcgcctgtgtcgacatccttgccaccgcccccatcgtccacaaccctatggaagtagatgcggtgggattcctcctcgaatgcgacgacggtgacggcgcccgcgcggaggccagccaggaggtccgagtaggccacctccttggctgcattcttgggcagcgcgaagcgagcggcgaggaggaggaccgctaggacgatgggcgcggccgccgcgggcggcacgcgtcgaacggctcaccgcagcgcggctgcagcatccccggggaggtcccgcggcaagagccgctggagccacaggcgtatcctcctccgttccggcttgcggaaccccaaaccgacctccttgtccacctcgtccaccttggcacacaccggtgccctccactgcaatcgcattcattccctccgctaagcaacccgcagccattgctcgcggcgaggcagctcgaagaacctgggggactcacgaagcaaacccgagtgcgtgggacggaggcagcggcagcgcagacgggggacaagcaagccgccaccaccaccacggcagccatgccaatctctacggtacactcactttggattaatttgagccaagggcaaaatggtctttaatgattgtttctctctcctattcctctaaaaataataaaataattttgtcggtgtccagcagctaattaccatttttttacgatgttctacagcaaatacacgttcttacaatgtcccctacctaattgcactttttttatgtactatagcaaattttgcctaattaataatgtatggaaacatccctacatccctcttatcctcctgttactggatacgtgttgatggagtcgaattgtccgacaaacatagtgttgacagccacaattggcacatcccaagcaaactggatggtctggtctgctcatccaaatgaccagtttttgggtagttaaagattaccgttccgtcctagctagttttgaagctaccgcatgtgattgtaaacaccctgaaaatgataaaatggttgttcttggcattattgcttcgttttcttgtagtcaacaagaaaatactccctccgtccctaaatatttgacgccgttgagtttttaaacatgtttgaccgttgtcttattcaaaaaatttaagtaattattaattcttttcctatcatttgattcactgttaaatatacttttatatatatatatatatatatatatatatatatatatatatatatatatatatatatatatagttttatatatttcataaaagtttttgaataagacaaacggtcaaacatgttttagaagagtcaacggcgtcaaatatttaggaatggagggagtaaaatatagcggttgcttatgttgaataaagattggattacttttgcatgtgaaattatgaagtgtcttttttttcaaatgatgttctccctcatattgaaatcattacgtaataaacacgtagttgaaatagttagttaacagtttgcttcctgagatttattctcacaaccgtaattacaatctttttatgcacttaatgcggttttgcgcgtgacttatccaagtcgcacgtgtaccacgtggcgggtcatcgtacgatcgatcgtgcacgcttcttttttctttttttccttttttttcggttgcgcaactgctgtgtttttttttcttttttttctttttgccattaactaccacacgcatctaagagtaggagtcaatatttgaaaactttcaagttaaagatttaaaaaacttttaactcagatttgaaaactttcaagtcaagatttaaaaactttcaactcggatttgaaaactttcaattcaaacttgaaaactttcaactcggatttaaaaacgttaaactcggatttgaaaactttcacctcggacttgaaaactttcaactaaagatttgaaactttcaattcaaacttgaaaactttcaagtcggatttgaaaacgttcaactcggatttgaaaacttttaactcagatttgaaaactttcaactctgacttgaaaactttcaactaaagatttgaaactttcaattcaaatttaaaaaattcaagtcaagatttgaaaacttaactcaggtttgaaaacttttagctcaaatttaaaagctttcacttcaaaattcaaaataatcaacttaaatttgaaaactttcatctcaaaattcaaaacattcaacttaaattttagaaacttttcaactcaaattcaaaactctcaactgatgttgaagctgaaagattgaatttataaaatatcgtataaaaatcaagcgcgcaagtggaaaagaaagaagcgattccaaaaaatctggaaattttaaaaaggaaacgaaaaggtgacgccaaaataggagatctagagaaaaaaagaaacgcgtagggacgcggctagcgcgcgccggctcctttcctggcgcgcacgcacgcactagcaaccccctacttaatgtggcatgtgtgcgcgaggaaatgggagtagcagaacgtctgcacgccatgatgtacttattgtgcacagatgagtttgttgatttattggtttaattgaatactagatatgttaatcttggaagggcttgaagttgcaactaaagtaaggtaaatatgttctattatgtaataaggatggcgatcatgcatatctgttaccgtagataccggcactgtgtctgaggattatctgtactggtatcatggctctgtgggacactttatgcgctctcatgtagtaattcctatctacttccttcgtcccactagtctagatttgttgtaataggatatattatattcagtactagg

SEQ ID NO: 2718 - DNA, 24838 bp, Oryza sativa
taaatcacacttaaagtactatgagtgataaaaaaacccataataaaataaattataattacataaattttttgaataagacgaatggtcaaacatgtgagaaaaagtcaacggcgtcatctattaaaaaatggagggagtattaaccagtgtccaaatcattcatggtgcttacaattaaatggtacggttatgcgtattcataggttggtatagattaacgaatatatagttctatgtttcccaatcgactttcgacttggaagaatttaaatatatgcatgcatcctactgccatactatacactttatggtttttcctgattgagttcctgtttcccactttaaataatgagaaattttatggtacataagaaagtaactagaggtattaagattttacgctaaaaattttggtacctcaagaagatacttggtacctgtaggtatttacgctacaagtgtgatacatctcaataccttatcaagaatagtatctaatcaggaatagtaaaattagccttgaataattcatgcgtatgcatgcatcctatcccagagcatatgcatatgagtgtgggagaagggaagtaaagatcaggaagaggaaactaacaaccagatcgacaagagaaactgaaaataactgaaacaatggacaaaataactcgatgtaatagctatggggaggatcgtcggaggcaagacgactaacccggcagtctggatgagggtaatcatcgtgagacaccaaaagtccttcttgttcaacgcagagacgaagccaccaaggagaacaacggtggtccaggtgaacatcaagaaggccaggcccctgactgccatcgacaagtaccccatgagcaccgcatacttgttgatgttgactacttccggccacagctcgtccatgggctgccgctgccgctggccgtggcgatttgttcgctcagatcgactgtaactgatcagctccgactcctcatcacctagctcggacattcttgtttctttccctctcataccagcagaagcagattcgatcgatcgaatgaagcatgcagcagcaatccaatgtgactgtgtatacactactagaaaattaagctgatcgatgaaggcatggatctgcctgctgctgctacttaattagctacctaccatgggcatgggttttttttccagttatatataaacgacctgcagaaattaaatgatagatggtttaccttgaagaataaaatagtgggaaacgagtattgtatatatgcttgcttaccgcatgattgggaaggaattaaaccaaggtctagctaggccagctcactccatgatgggaaagcaaacaccttgttgatcttgcttgtcgctgagctcaacacgttagcagctggctggagaatggagatacaaatagtagtagtaattaacgaaaaaaaataaaacctcgaccactttctcctctgaccacataaacaaatactccctccgtttcgaaatgtttgacgccgttgactttttatcacatgtttgaccattcgtcttattaaaaaaattaattaattattaattcttttcctatcatttgattcgttgttaaatatatttttatgtaggcatataattttacatatctcacataagtttttaaataagacgaacggtcaaacatatgctaaaaagtcaacggtgtcaaatatttcgaaacggagggagtatatcgtttactcagatcgaatcccaatcaatcagcttgccattatatatgtactccacatgatgtgaaagcaaaaacatggatcacttgctgcatgtcaatacctaatctcgcgctcagcataaataaatattccaatatcatcgtttacttcaaatccaatcctaatcgagatcagctcgctattatgtagtcagcttgaagttcaaagctggccctgctaacaacagagctcaattcaatgaaattagcctagtcttttcttttctttccctttatagatttatacttgtacggttttcctcctgttctattcagtgaaattggcactttctagtgccggttccttaaaaacaacaacaatagagctcaaccaatgagaggaagaacagccaaccggaggaccgagagcagagcggatttgggtgtcgtcgatgctaggctgctagtcatggtcgcaagtaacgttttctgaactcgagatatcattaaaggaaatacatcattttttcaatgattttgtaggaaatatacacgtttagaatgcagaaatataacattatcgcagaatggaagtgcgagaccaaggtcttgcgcggcgagcatgcgacactgcacaatctcgcgcagcacaagaccgcgcgaactcgcacgattagttaagttttcgcttatactccctccatctacttttgatagtcatatttcattttaacacacagatcaaggataagtaattctacttatcatctatttaaacatgctactagacattcatcgtaaacaagcgattcattaatatttgcatttctcgatgtccatgtagccaattttatgtggaagaatgaagagtcatgcattaaatttgagaaagttattaagataataggttgttggattgaaatatgcctatctccactacttaaaaaattgaaaacgtttccatcgtccgtaataacgaaaaagggcgaaaaaaaacattaaaacaaaaaaaagaaagtccgattcaatttacttccgtcgtccgtgaaaatcttatcttatcttaatctcaatctttccgaggggactgaccgcgccctccgtcaccacccgcgcgatgaaacgccggccaaagcaaaaaaaagtaattaagcaaagggataaactagattaaagttcctaaaattaaaagtggataaacgatattgaaactcccataactagaaaaaaaagaaataaaatagattgcaatttcccaacaaaattccccaaattcgaagaaccctaatttcgggtaagaaccctaagaatcaaaatccaaatcaattaagctaagggtttgggttacttaccggacttgaagcccctaagctcaccggaactttctgggaagcggcacctccactccttcaccttctcgcagtcgcgtcgggttccccgtgcacgcgctgtcctggagtactcctccaccgtcccttgccgaagacgggaagcgtcggcttggcatcgcccctcccaccgacgaggtccaggccactcggcgcttgtcgccgtttgcgcgcccgcctggtcggaccgctgacgtcgtggcatggctttccgccaccctcgggtccgtcccccatccgccaaagcaggagccgcttggcggtcgtcaccgcacgcgtgccgccttcgccgttgtaccgctcgctcgtcgccagagagaaaggggatcgggagagagggatttgggagctagggttttgcccctctctcccggtcggtgcttcatccgacgcggggacgatcggagccatccaatagatcggacggctcagattcgtccaacatcgggccgctaccaccgctgattacgctgcgcaatgggccacggaagtgcatcgtcgccgcgtatgtgggccgcgctcatgtgctcggcttgtgggccatcgaatggactcagctcgcgtgaagatgggccagcccaagtttgggccggcttgggatgacctgggccgaaagcaaatttgatcaatcaatgtggctcagatttttaaattaaagttagataaactcctaagtagcctcgaaaaataaatctaagactaaagcctaaatccgatgctaattcatcaaattagactcgattctaccgatttggtaatatatcaaattagacttgatttttactgatttgagattctcaaggtgtcacactatcaaacggtgttttttccgttgcaatgcacgggcactattgctagtcaaaaataaatttttcagatttagaaatatgcctatcaaaagtagatggagagagtattgtttatacaaagatttgaaaaacaaaatatcccaacctccatctcccctcacatatgcacattactgctcaccccttcccttctcttgctcgagttgtatcctcttcatttgtaacatcctgaaaattaagtatattatctaagggtgtgtttggttggtgggatatacctggataggacatggccgccgctctttggagggtgtttgtttgctggacgaaagtgggatagggcggcccagaggggaatatacccccccagatgctggatagagggatctggccgatttggccggatgcaaccactcgaggctcgggcgagtcgggcgagtgagtcgcgtgactcgcgtcaccccttaccacgacgacacgagcgaggcggcggatagggcggccggcgcgagcgacgagcatggcagccgtgggtgacgagcgcggcggctggcgagagaggaggcgagctcggtagccagcgcgggtcacaagagaggaaggcgacggcgggaggaggcggccagcgggaggaaggcgtccggcgggaggaaggcggccggcgggaggtggctgccggcgggagtaggcggccgacgggaggaagtggcggcggcgagcccagatctggccctatttttttttcttttttctttttctttttttcttttttctatgtgtatttataatagaggtagtggagtaaaattgtattatgtattaatttgatgggggtattgttaacaacgaaatttggtaagcccaaagttatcatcggcctaaagtcagtatcggcttcagagtcctggaatcggccgatgagaattatcaagccgccagttgtcggattcttgctaaggaaattgatctagtaaagaaagcttatccagaagagaccgagttcaaagagaatgcggcatggcaagttgtctattaattaggaatagtttggtagtttcctttttatctttaggaaagtgtgtttagtgtcctataaggactttatgttttccttttatctttaggaaagtttctttcttgtcctacaaggattagtatctacccatgggtataaatatgtacacgcggggtcattgtaatctatcctcacgatcaatacaattcggcgcatcgccaccctttttacttttacttttgtttctacgttctggcggaacttggcacccgacgcggggctgcatcggtgttcgatctccggctaaggggtaagtccaatgttccgtcggcccaggcaattatatcgtctacgtcggcgtcgttcaaggctgcatcaggacattcgacctcttagattgctctggtttggatgatatacttgcctacctatttatcatatgtctctgttaatctagtcttagcatatcaatttagctctatcggctgcttcttgttttagggtttctgccggtatcagctaaatcgcgttgctagattagattagcttagacatctaccaccctgaaaactcattcaacggtttgattgtctagattgtgtatcttttcatacttaatgctgtatcagttaagtttgatctactaagtcgtgcttagaaccataatctctatcctgcttcttgattgccaataagggtttcatcggggtttcagccggtgagttatctagacgttgcatcggctcataaggattgcatatacatataagttggatttagccgatgacaacaaaggtttcactgtttaatctaatcttgtggattttatgacattggacctccagtcgatgtatgctttaaccatcggatcagtgcttattctatcatgtcattgttagccgattggtttctactggattatattattgttatattttaatatcatcagctgattgtctttgcatcattatctacattggacacatagccgattgctcaaaccctatcgctatcggctagtatcggcatcggctggaatcactacattggcttgtcagccgatcggctatttgatctactgtttacatatcttgtcagttgcaggatcaaactgactagcacgcccgcatctcaacaatctttagacctgcacaggatttaagcagatctctcaggccggtgtgttcaattttttcgtcaacgggtatattcaccatctcaagtgagaggtgaccacacctacaaatccaccatacttcctccaaccaaacaaaaaaattagatcaccaactccaccttcgtccctacaaccaaataaaaaactggatcgccatattcacataaccaaacaaaaaactggaccgccatatcccatccaatcttagaaaccaaacacaccctaaaactacatcgagttgtattccgattctaaacctgcgctgcggcaccaccggtcaagtaccagctgcctatagctagtcccctcacggagacccaccatgcatatcgcctgaatttggatctgcagaaaaagagaaagggaaagggaaggaaatggagggggaaggaagagggtgggagaaaggatggggacagggaaggaggtgccatcgctggcggtcacgccgacggtggcgagtcaaggtggaacagaagaaaacgaggaaaggaaagggagagggaaggaggaaaggggaaaaggggtgggaggcgccaccaccgccgcaccgccgtcgccggtggcagcgacgcgagcggacgtggctggggagcattcgctcggggctgttcgcctccagtgtcgtcgcccatggagagcggcgcgggagtcgctccactttcacgaatatcgggacaacaaaactttctgaacttcccactattccgttttattacgaaaaagcactgatcaagcgatcgatcggttatctcgttgaggccatcgccgccggcgacgcaccggaacgaggcggtggcagggacaggcagtgacgcgcacaggaaatcgacaccgcttcttgctgctgggctcagtcatttcggtagtaccgaaatttcggaaatttcagcattttttggaccgaaatttttgacacagtttaactgaacttgactaaattttgatcaaattcacaaaaatttcagccgagatattgacttaccggggggtccgaaattttgtttcaaaatttcaatcactggctgggctgctggcagctaagaaatggatcacaagatgagactggttctgtttggggaggttaagatcacaggccgtcgccgttgatgtactagtgcagccagctaatgtcatcctgctatctactctctccatggccgctgcaagtacttgttgatggtgaatggactgtatgggttagtgtggttgtggtcgattgtaatggccccaaatggtttggaaattggaagggtggattgaacccatagatgggaaatggtttggtttagattctaaaagaagacttctggattgttgggttggtctggactactttagctggctgttgtggtttggattgggaacagggcgggttttaacctcattggcaggcctacagtcaagctgcatacagttctaccaaaaataaaatacgatacaattatattataagttcataattttttgaacaaagaaagttaacctctagttggtcaagaaagaacattattattgctgaatattttgcattcaatgaccaatgcataggacgcaagcacaaaaaactaacgattttcacacaaatactatatatatgtggtttcatatattaggaaagtccaaatagttgcccgagaatccatctcctaatccaaaaggtttagcgcctgaacttgctagccccccttgttaggctggctgtctaggcgattttggctgtgcggtgtgctgactggacgcactttccacgtcatcttgcctattgtaccactgactgaataagatgaatgggaatagtagacttagagtcatttcttcggtaaagctttcctcattccatctttccctctgaatgttgttttctctgtttagagtcctagatggactcttgggtaaagttcagaggatatttggacttctccttcctgcagagattacatttttttcgcggtaagaaatctaaataataagagaacagaaacaacatcattttccatgtagcattaagaggcttaacatcaacaccgtgaatgcagggcatgtaacactcagcttgccagagagaggaacccaaaaaaaaaagatgttctacaaatgcacgagtaaacataagaacgtagagccagctctaccttatagccatttcattgatagaaatgataagttacattgttacatgattgggaaagagtagaaaaaaagaagagaagaacagcaaaatggaatgtacaaaagtgtaagaaaaaaaatactatacattggcctcagatgattaaaggccgattttcactttgattttattactgaccggcacgagtaatttttaatttcggttttcagatcgattatcagatttccccggcacacagttttccaatgagggtatggattaaaataatacagattatgtacgatttaattaatctgatttcgattgacacagctaggatgctcaattatcacttccatttcggatgcccttgctctaggcaggagttcctcagcttctttcacgagggaaccaagagtctttaggctgctgctacagccagagataaccatgatgtcctcgatttccgacatgttcctcgcagccttcgacagtgatttaatcaagttctctgcttcttctacggtgtaacggcttccatgtctaacgattagtatgaatatctcagtgataagcttcaatgtgttcaatctgttcactatagtcaccttactcttcattgacagctttgtgaccatcgattggagctccgttaagatgctgaagccgttggctgccctgttaattgcatcgataagaggaggcaaatcttcagcatccattaagtttcgtgtcatcgtcacaatcagagataaaactgccgccagcatttgtctgtccacagattcggcacgaagtgttctcacaagcacctgcaacattatgtttatcttcagtatgacaagcgtaacgatccaacacaaagactaattatcaccctatatatgatgctgataaaaataaagcaagtgtttcttttcttgcctcaaacagactatacctctggactcttaacctttaaggcttccttgaggctctggatatattcatcatcatcagtgtgatgaacacacagctgctcgaggatttgcgcggcgcttattctgtattccttgggatatctgtcttgtacaagtatttttgtgagatcaccaacgacatcatctttcacttgtaagattaacttggcatttgctttgccatgggaacatagcgtcgcaagcttttcacctaccactgccaacccaaaaatgatgttggcctccttataaactttgtgagtgaagatgagtaacaatttctcaatgaaatattccctcgtcactatgttagaaagcgtgtgctcgtgcattcgtgtgtaaatgtccaatgcttgcataaacagggaactatcatggaacgatccgagcccacatccttggcaacctagaatcctctccatactagccatggcttccacgtctcctgagattttgcggcggagttccttgccagtctggccaggagcatccacaagccggagaatcacaaccatcgaagcatgcactgttctgaaccacgcactattagggtcatcgttgtggttgagcaggccagaccgcagaggcgccatgatcttggctagcaggccctccgtcttgttgatggatcgctgacagtcctcgtgtgcagcgagcttcatgaggatactcaggccctgcagcatcagttctcggtaatttacagggatgttgccatcacaatccttagggggaccttcgagcagagaagctatgcaatggatcccttgtggaaactgctccaggtggaggtcaccagcaaggtgcgccacgatccttgcagcgtgctccctcgcctcggcattgtatgccctcgtacaatcaagtgactgcagcagtgtgtgcaggccgccatcttggctgtaggatgccgataggaggagctgctttaccattgctttctgctcttcgacctcgacctcaacctcgagaaagaaattgtacttgtacattggcgtattcaggagggagtccaggatcctcaccccagagaggaagccatcaggggatccagacttggttaaaccgacggcatatgtgaccaggttccttcctttgacgaatgacgggtccttctcacacccgatcatcgtctcttgcatgtacgccatcactgactcgctcaaactagtaacaaagcgatatttgttaaccaccaaatccaccagccttttctgctcatagcacaatgtgaaccggtaacagaagagcacaccctggagcaaggcgatggagtagacgaacttcagcgcagatttcaggttggcgccgccattgttgacctcacccccgtagtcatgctgtatcagacgacacgcggatatggcagtggtgatgatcagcccaaacatgtagagcaccgctagagggcagatgatggtggcaaacacgaacaaatggagcagccatatgacaactactactaggttgttcaggtagtaggagcgtgaccgtgatcggccatagaaccagctaatggcacccctttccgtttccaatgtatccgtagctgagaaaaagcctaaaaacgacctccaagtatatcgtagcttttcgttcagaaagatgtcggagactctgtgggtaaatttcattgttccagttagatggtgagataagtaatcaagagctatataggctggtggtaaatctgtgcatttcacacttatcaggatatattacatagattttgaacctatctagcactaatatttttttttggaaaatacatatcaacagccatcggatacttacatttttcatatgtattcatatacaaaataaactttcaaatctctatccttgcaggggaaaaaaaccgatccattataattttgaagtttgaaatggattaatgtaagttttctattcattctggcctttgtgtgtcttcgacacaacagccctgatccattatactaaaaagttcaataataattcaaagttcaaaaaataattattaaaaatatgtatttggcttcaaaattacatgggcaatccatcctaaagtgttctcaccaatgtattaggataatgtcgaccccacgatggagtttggcacttggtgttgcacaaacgaccttgtcagcggtggaggaatttggagcttggcactgaggcactagtggagtttgaagatcagtgcactgcatggacgcactgagtaatggtggaatttcatgctcaggtaggacgatatatagaggtatgttttcctaattgaggaaatgaagctcttctcacaattgagagagattacaagataaagaatacaatcgtgtttggaataggccagattgtgcatatgctcatcgcggtattagtgtggccgtttttgtattggtcatagcctgaagtttgtaccaaaactaataaagttgacaaaaggtcaaaaagcacttacaccaaaagtgagacctttctaactcgcaatgaattcaattgttgaggtttgctagctctagaattcgactcaaaaaggagaattgtccaatactcgaatagttgttaagctattgagatttgctagctctagattttagctcctgatgtcctacatgccagtgactgaatggatatgcccacatgaactttcatcaggggatgtaaactacttgccagtgactgaatatttagaaagtggaactgtcttagcagaaaatatagctccaaaataaatgttttatgcgagcttaaaatataaaattaagatattgagcagtgcaaagagactaacccagcggtctggacaagggtaattattgtgagacaccaaaaatccttcttccccagtatggagacgaagccaccaagaaggataacagtggtccataaaacaagaagataacctagccccttgacggccatagacatgtgtcccatgaacagcgcgtagttgttgatggagctaacttcctcccactctgagtcatcaacgggctccattccactagtcattcttcccttgcagatgtgcagagtggaggtcaactgcaagtctgcaacgcaacaaagccaatatgtaagcccgcatgctcagaactctattcgttgtatactcgtacataataaagcctggagatgcacgccaagaatggaaaaaaaaactgatctacaagaagcatggtcattcttaacataaatatgtccatcctattaaatttaatcagttttgattagcatcaagcaaggtaggctgactttggttttgtcaaaatctgttcagttgattgtttgagaaagtcaaaggaaaaaaaatcatatggtgaggaagcaaaggcctcggctagctggctggagttagtgtaactaaagaagaacagcccagatcagtggatcacagatgttaccgtaattcgtaaacatataatctggttgtcagcataaataattgttggtgccttttcgggccaatacagattcacctaaatatttgttgcaaatttggcctagtgccaaattgtggtggtcaacaataatattccgttttctcaaatcgaatcccaatagatcaagttgacattatatatgtgtacgatgggaaagcaaataccatggcgtctgagctgaacagcagaatagtcaagctaactgttggggactttggaacagtcagtcacctgtttaaaacaagaaaaataaaattgattcgatagcatcaaaatttcacgatttcagttccatatagcacataaagtcagtgatttcagttcccttttccgaattggttgacttgcgttgaccggctcacaaatccaaacagcccatttcgctgcccaataaagcaaaaaaagattatccatctagggagcaacatgcgagagaactgcaataccttctcgtcggcgatgggcgaggagggacaaggcagccgggacgagggacggcggggtgaggctgatgctgccggagagccgcgagcccgcgacggacgaagctgatgcggggcgaggagcacgccggcggacggagatgaacgccggggacgatggccgccggcggtggggatcgactgataaaaggttgtgcagccaagggcagtatagtaaaaaccgagtcactcggctaggtcaacacaagtcaaccaaaacgggtaagcaagcagaatgactgatagggatatataccactaataaagtgaaatgcggagtttgtatgcaataaaactgaaattactacgaaatttcgacgatattataataccaatttcacctatgaaagcgattttgggtggaatttgccgtacgtgtatggcaactttggttaagtatgcgctccctctgtgatcaatctatctatacctctatactcgtattaattaggtactttctacgagcttttacgttaacatgaaagatccgaccattagattagattgatggtatactagggccgtagatttaaactgtaaacatggacttttttaagggaaactacggtgggtgtttaaggcaccagcctgaagttttattgaaatgaagaaacatttacaggagaggggttacaggggatgagagggggagaattaaattaagaattaattacaaagaggtataaggcccacttgcggagctattgtttgctcttaacatttttacatcgatgggaccaaatgtcaatgtcgctagcacaacgccggagaactaacttagcaggttcatcaagagaattgaagaccttgttgttgtgtcgtttccaaatattccacatgacggcaaggaggatagagcgccagactcgtggagtggcgggttgtctgggtggagggatgtcccagacaccttcaagctgcggcagggaggcgatctgttgttcgtccaggccaaaggtgtgccatattgttgccactccggtgcagcgtaggaagaggtgctccacatctttaacagaggagcaaaaaggacaacgtgcggatgctactaatccacatcgagcttgtctctcattggtgaagatgcgcctcttgtgtgtagtacaaaggaagatcttgcatttgacttgagcgtggttgtcccaaatgggcttagcgaaaaggtcatcctataaccctaagaagcttaagtcgtaggctgtttttgctgtgagggggcgatttgtggacaaggtgcgtctgttttttatctctgggtctagctttaggtggcataccagggcttggatattggccaattcgtgtatggccactgtcgacacagtcggggccggagatgaaggagcaattcaggagcggtctgttagaataattgggctaggcccaacttataatattaaatctcaaaggcccataatacatgttgaggataataataccacctctggatttaagcgagaaatatctcaacctaaatagggagttattagaggctccctgttgaccagttgaggtgggggtcggaatgccacacgcgcgcgcgcgcgccgggccgggccgtgggcgaggcgaggcgaggcgtggctggctggcggcgtgcgtgcgtgcgtcacgtcgctatccttttgcagccactaacccacgttcccacgattccctccgcaacagcgcgtccacgttctttctcctgatagataaggaggccgcgagtccgatccgagttcctcgcttctttcccggtgttagtttctccttctccgcgcctgagttgctctcgcttccccgcttctgatctcttgcgcgcacgagagattggaagaagcagtgcctccgaaaccacaccttcgcctgatatctgcaccgggtaggcgggtgatcaggtttttggggagtgcctcctgcacgactgctcatcgccatgtctggagttgctgccgccgctattggcggaggtggtgcgccgccgccgacaggagctgcgccgccgccgacgccgacaggagctggatccggagctggtgcgccaggaggaggtgccgtgaacgactacaacaacggaggcaattctgcctcaccatccagcggagggccattctcggggtataatcttctccttctactgctgttagcgctactcctgttcccattgttagcgctatactgtgtgcgctatgttcttgtttctgttctacatgatgcctctagcatgttatcgcattactggtatgttcctgtttctgacattcatgatgcgcatagtatgctactggttatgttaagatcaccctacactgcttatgccatgatcatagtttcaatttcttggattaaaatatgccgaataatgactatatttccaacattccaaaaacctgataggtcattttcggtagttggctttgctgctgcactgaaaccacatgcttttgatggttcaaactataagagatggaaagcacgtgcactattgtggttgacagcgatgcagtgcttctatgtttcacggggtaaacgaagtgaaccacctctttctcctgaggaagaggctaagttcgaggcttcggattgcctgttccgtggagcattgatcagtgtactcgctgacaacatagtggacgtgtacatgcacatgccttctgggaaggacatgtgggatgcacttgaggccaagttcggagtttctgacgccggcagtgagctgtatgtcatggagcagttctatgactacaagatggttgatgaccgttctgtagtagaacaagctcatgagattcagatgctggctaaggaacttgagaacaacaactgtgagttgccggacaagtttgtggcgggtggcattattgccaaactaccaccttcttggtcggactttgccacttctctaaagcacaagagacaagagttcagtgttcctgatctcattggctctttgggtgttgaggagaaggcgagggcaaaggacgtccggggcaaaaaggttgagggaggttctagtgccaatatggtacagaagaagaaccctcatgcatcccacaacaacaagaaagtcaagcctgatgtcaaacccaaggctgcaaccaattttaagaagaaaggcaagggaaaggcaaagggagactgctttgtgtgtggcaagtctgggcattgggccaaggactgtcctgagcgcaaagacaggaagtctgccaacatgatcattagcgagggcggaggaacatcggggtacggtaaaatattacctacagttctctctgtttttcattcacctgattggtgggtggatactggtgctaatattcatgtatgtgctgacatttctctgttttcttcttatcaggtcgggagaggttcctccttgttgatgggaaacgggtcgcttgcagttgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgtcgtatctaaatatgagacttttgttggaaaaggttatgacagcggaggcttgttccgcttttctttgaatgacatgtgtaataatcataacgctgtgaaccatattagcgagaatgatgagtctaatgtgtggcattcgcgactctgtcatgtgaatttcggttgtatgatgcgcttagctaacatgagtttaattccaaaattcactttggtcaaaggttccaagtgccatacttgtgttcaatcgaaacagcctcgtaagcctcacaaggcatctgaggcgaggaatttggcacctctagaacttgttcattccgatttgtgcgaaatgaacggcgtgttgactaaagggggaaagaaatatttcatgacactgatagatgattgcactagattttgctatgtgtatctattgaaaacaaaggatgaggcattgcattactttaaaatctataaagctgaggtagaaaaccaacttgaaaggaaaatcaaacggttgaggtctgatagaggtggggagtatttttccaatgagtttgcatccttttgcgaagagtttggaattattcatgagatgacgcctccctattcaccccaatcaaatggggtggccgaaagaaagaaccgtactctaactgagatggtgaatgccatgttagacactgcggggctttccaaggaatggtggggtgaggcagttctgactgcgtgtcatgtcctgaataaaattccaatgaagcacaaggaagtaacaccattcgaggaatgggaaaggaagaaattaaatctctcatacctacgaacatggggctgtttggccaaggtaaatgtacctatagtcaaaaagcggaaacttggaccaaaaactgttgattgtgtgtttcttggttatgctatccacagtgtgggttatagattcttaatagtaaactctggagtacccgacatgcatgctggtacaatttttgagtccagagatgctactttctttgagaatgaatttcctatgaaatatacacctagcacttctagtaaagaaactgtcatgccccatgagcactttgcaccgatagaacacaatgatcaaacgcctgaggaaaatcctgaggaggacaacattgtagatactcgcaagagtaagagacaaagggttgcaaaatcctttggagatgactacattgtatacctcgtggatgacaccccaagaaccatagaagaggcatatttatctcctgacgctgactactggaaggaagcagtacgcagtgaaatggactcgattatgtctaatggtacttgggaagtcgttgagcgtccatatggatgtaagcccgtaggatgcaaatgggttttcaagaaaaagcttaggcctgatggtacaatcgaaaagtataaggcaaggcttgtggccaagggttatacccaaaaggaaggcgaggatttcttcgacacatattcaccagttgctcgcttgactacgattcgagtactacttgctctggcagcctctcatggtcttctcgtccatcagatggacgttaagacagctttcctaaatggagagctggaggaggagatctatatggatcaaccagacgggtatgtactagaaggtcaggagggaatggtgtgtaaactattgaaatccttgtatggcctcaagcaagcacctaagcaatggcatgagaagtttgacaccacgcttacatctgcaggctttgttgtgaacgaagctgacaaatgtgtatactatcgctatggtgggggagaaggggtgatcttatgcttgtatgtcgatgacatactgatctttgggaccagccttaatgtgattgaggaggtcaaagactatctgtccaagagtgatttgggagaggctgatgttattcttaacatcaaactacaaagaggagatgagggtgggattacacttgtgcaatcccactatgtggacaaggttttgagtcgctttggatatagtgactgtaagccagctcctactccttatgatcccagcgtgctattaaggaaaaaccgaagaatagcaagggatcaactgagatactctcaaatcattggttcattgatgtacttggctagcgcaacgaggcctgacatctcatttgctgtaagcaagctgagccggtttgtctcaaatccgggagatgatcattggcaggctctggaaagagtaatgcgctatctaaagggcactatgagctatggaattcactataccgggtatccaaaagtactagaagggtatagtgactcaaactggatatctgatgctgatgagataaaagccacaagtggatatgcgttcacacttggaggtggcgctgtttcctggaagtcttgcaagcagaccatcttaacgaggtcaacaatggaagcagaacttacagcactagatactgcgacagttgaggctgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggagtgatagcattggactatgtccaaacggctagaaatctggcagatcagtttaccaaggggctaccacgtaatgtgatagacagtgcatcgagggaaatgggcttgatacccacctaaggttgcataatagtggaaacctgtccattgtgatcggagatcccgtgaatttggatggtgaaacaaattattgtgtgactgagagaagagacccttgaaaggggctcattttcatgatgtgcttctcttctttcctgcatggtaggatggcttatgtcttaatgtgatccgagtggcttttccaagcagagatgttgacctgcagaacatctcagaaggaacacacctatatgagttcgactgctagtcacagtctatgaggtttgggcaatctctagatactcatgaaaggcctggagtttgacttatatgctccaaacagaggggatgcgaacggcagcccagtaccagtcaaggttctgagtgaaacctgatcacacaaaacttacaattcaaggcatagtccattgttcagttgtggtctgatgtagctcatttcctaggtggaagttcaacttaacagtctccaccaaaaccctggtatatcaaacaggcacagccttgagaacatttcttatgagccttgaaatttggtggggattgttagaataattgggctaggcccaacttataatattaaatctcaaaggcccataataaatgttgaggataataataccacctctggatttaagcgagaaatatctcaacctaaatagggagttattagaggctccctgttgaccagttgaggtgggggtcggaatgccacacgcgcgcgcgcgccgggccgggccggggcgtgggcgtggcgtggcgtggctggctggcggcgggcgtgcgtgcgtgcgtcacgtcgctatccttttgcagccactaacccacgttcccacgattccctccgcaacagcgcgtccacgttctttctcctgatagataaggaggccgcgagtctgatccgagttcctcgcttctttcccggtgttagtttctccttctccgcgcctgagttgctctcgcttccccgcttctgatctcttgcgcgcacgagagattggaagaagcagtgcctccgaaaccacaccttcgcctgagatctgcaccgggtaggcgggtgatcaggtttttggggagtgcctcctgcacgactgctcatcgccatgtctggagttgctgccgccgctattggcggaggtggtgcgccgccgccgacgccgacaggagctggatccggagctggtgcgccaggaggaggtgccgtgaacgactacaacaacggaggcaattctgcctcaccatccagtggagggccattctcggggtataatcttctccttctactgctgttagcgctatactgtgtgcgctatgttcttggttctgttctacatgatgcctctagcatgttatcgcattactggtatgttcctgtttctgacattcatgatgcgcatagtatgctactggttatgttaagatcaccctacactgcttatgccatgatcatagtttcaatttcttggattaaaatatgccgaataatgactatatttccaacacggtctagggcgtccgtgatagagatgttgggggcgagttgcatgtgagaacaaggcaaggaacagttgaaagagggcgccgcctaaaatccaattatcaaaccagaaggaagtggaccgaccatctccaatgatggatttcgaaacactacggaagtgtgtaaggcccgcgacgatgtccttccagatgatcgtgtcaaggcgcaaaagatcgcctagatcacacgaggcagaccatccgtagtgatcgcgaaagcaatcgatccacggtgcagaatcaccctcgtgcattttgaggagaaatttttggagaagacatatgttctgtgtcttgagattttttatccagcaccacctttcgctttcggagagcaaactatgttacacgcaattttgcaattgccgctgtgacagttttcttcccccgtccagaagaaggcccttcagcgcttgtcaatagtggtaatcacttctttaggaggaaggatagcccccatcatgtatgatgggagggccgagagcaccgaattgatgagggcaagccgaccatcggaagacagaaggtgaccgcgccaaccggcaagtcgcttgtcaatcctagcgatgagaggttgacagtttgcaagacaaagcttggtaacaaacagagagagggaggcataaataaggttgggggaaggaagctatggagcaaccaagaatccccgccaactgaaacgccacgtcatgctgaacgttaatggggaggaaggtgcttttacccatgtcaattccttctttttaccatgcatcccccgttcgttttcccatgattttagatactttttttttgtccccgatcgaatcacagatcatttttcattactgcagttgcaaggatgtggcaaaaaatatcatctagaccagttggttgatttgtcacctacatttattcagatctaataagaatataagtcaacaagttggtttttaaattcgatgtgtatatatctttaagccgacgatatgtatttcagtaatgacctttacccggtgaagcttttttttcttaattggtatatacaggataatagtatgttttaaactctctatcaagaaagagcagctaagctggatgggctctccaatttatgttaatttaataattccctcgataacaagataaatgatctccagtcatttcttgaccattgttctactttacctatgactttataaaatcctgtagcaacgtgctgagtatcacccaataaacataagaaaacacaccatgcatgttctagtgagcatcttgatgctggtaggataactagcgagctaaataaagctaagggtcggatgcgacatgggtgctagcgaatagagcttttctgccttgttagggtgcgtttggaatcagctgttgcatgtccgagcagtatatgagcgcgtgattaattaagtattttcttttttttcaaaaatagataatataattttttaagcaactttcgtatataaactttttttaaaaaacacgccgtttagtagtttaaaaaacgtgcgcgcgaaatacaacggagagggattggaaacacaggattccaaacacagcctgaatcgtcattgatacaaggaaagatgggaggaggaacaagagggagaggagcaatagtttgggggatgatcccctccattaatttctcattctggatctgtgctacttcctccgtttcataatataagtcattctagcatttatctatctagattcattaatatcaatatgaatgtggaaaataccagaatgacttacattgtgaaacgggggagagtagctaggaatggataaataaataatgttatcccaaacagaaaaagttacgtacggccgggtatgtgcttcacgtgaaatgggaaatatatacaatcaatgacgactaatttggcagcaaacatgcatgcatgggccagttaattaattatgctaaatggatagtttgattcgatgagcagccggacgactgaggctttcttttgttgggaaaaaaattaggtttgattgtcacatcagatatacggatatacatttgaagtattaaacgtagtttaaaaacaaaataaattatagattctactaaaaaactgcgagataaatttattaagcctaattaattcgttattagcaaatgcttactgtagcaccacattgtcaaatcatggtgcaatttggtttaaaaattttgtctcgtaatttacacgtaatatgtgtaattggttttttcctacattaaatacttcatgcgtatgtctaaacatttgatgtgacagtgtgaaattttttttttaaatagggcctgagagcaaaacacatgctgcatgaatagtagtcgctcgctcgtgtatcatacttaaagaaagtttaactaggaaaaaaaaacctacttcatatataaaatcacaagaccttttatccaaaaattgaaactttcaactaaaagttcaaaaaaattatactcttggctcaaactttcaatataaaaacccaaaacttctaatccaaaaactgaaacttcccaaaaaaatcaaaaactttgtgctcatggctctcaatctttcgatacgaagttacagaatcatggtagggtagctagctaaataaagggacggatgcgatatgggtgctagcgaatagagcctttctaccttgctgaatcgtcattgataattaggggaggaggaacaagagggaaaggagcaatagtttggggatgatcccctccattgaataatttctcattctggatccgtgctagggatggatcaataatgttatcccaaacagaaacagctagtgttaggtacgggtatgtgcttcacgtgaaatgggaaatatatacaatcaacgatgactaatttggtagtaagcatacatgcatgggccaattaattaattatgctaaatggatatagtttgattcgatcagcagctgaacgactgatcgagagcaaaacacatgcataatgcataatgcattaatttatatatatgaatagtagtcgctcgctcgtgtatcacgcataaattatatatcaatgatcgatcacatgcaacaccggcaaattaaattgacccatcatcgatccatctagctagctatgcctatatatatacgccatatgcatgataaatacgcaagctaattaagctagctacatatatactctctcaaaagtttacattaattgctgatagctcatcatcagtttgatcgtgtccggaggtgtgaggtcgtcggcgagatgagctccggcggcgaggaggggaagacgtcgtggccggaggtggtggggctgcgggcggaggaggcgaagaaggtgatcctcaaggacatgcccgacgccgacatcgtcgtggttccggtggggacgccggtgaccatggacttccgccccaaccgcgtccgcatcttcgtcgacaccgtcgccggcacccccaccatcggctagagctagctactagcctcatctgcctgccttcagcatcctgcttatcttaattaaataatcacatgcacgcaagtgatatgtactgtgcatgtttcgatcgatccatcccccatctgaataatgttggttttaccctacgcacgtgttaatgtttttctcctacgaataaataaagagaccttcatttaatgcatggtagccaactactccctccgtttcacaatgtaagtcattctaacatttcccacattcatattcatattaatgaatctagacatatatatctatctagatttattaacatcaatacaaatgtgggaaatattagaatgacttacattgtgaaacagaggaagtacctagctaatctttaggaaacaactacaaatagaacgtcccattttattatttttctttaaaaaaatttggcggtgtttcgcctctcataaactaatgttgtagcatttagtgaaaaaatgttttagttcttaaaaagaagtaga

SEQ ID NO: 2719 - DNA, 15332 bp, Oryza sativa
gatccaagtgaaaatcgaagagaatgaaacactataaaaatacccactaaaacacttcgatctaactaataaaacatctaaaccatttttgttcgctggcatcgtgtttcgcaagcaggcatgctaagacagccgctagcaaaaataccatttttgtaggcagcaaactaaagaggacaatagatgaaaacattttttgggataaaacagttgaaaatcgagatgtcgtcgtatagcggcagggcagggtcgacgatagcggtcggcctgcgagggtcaacggccgtggtccggaggaccaccgctgccggatctacctccttcaccgcccctcatcttcgccgctgatggaccctaagttcctctcgacactcaaggctgttgttggcccgatctttcggtgagttgtgataactacgatttgggagaaacgttaacgatccgactacaaccgtacgagacgttgtgttgcgccttagcgatcgatacacctctccgtgggttgttgatcttgctggtgcagatcaaccctattcctgcaagcaaatcgaagaaacaagcaagaacaagataaaagcaatctgatattgcaaataggaatttaatacaaatgataagttggggttccgaatacaagcagacggacggtctagccgacacgcgcgctacaaggaagtagcaatagctaaactttcatctaaacaaaacctgactaaccctggaggggttactagctatttaagggatggaggaggtcagaagggcgtcctccctctgtttggggcacagccccccttgggccccacttgggccggggtcccagacgaagttacaggcccataggcccattacagacaatgcagccccttgtttcttcaattgcggctcactgagatggaatatcacaatgaggctggatccgttggaaagaggactctgagagctttccatcaagtactcacgggacgaaaacggagctcgaatggagatttggcggccgtttgaagtcagcaatgttgcaggtggccgaattggattccagcacttggaagacttgatcttgatatcttcttgttcatccatgatgtgaacaatgattgtatccatagtagccatgatcacatcagccgcagtcgaatctatcccctacactatcgccacccgtctccattgccactatggaggaggatatatgccaaggggaagccatagccgggaggaagtcgttgctgccagatccccaccatcgtcacctgccgccatcggattcgcgccaccgtgacccgctgtcgccggatccatgcccccgtgactcgtcgccgtcggatccatgcccccgtgactcgctgctgccagatctgcaccgtcacgacctgccgtcgccagatccggaccgagccaccccctcccctccaaccaaatctaggagggggaggggagagccaggccaccgcaactgctctgatccctacagtgcgaccgtctcgtcgtcgtggtcgcgtcctggacggaagcacaccgccgcctcccctccgctgctgccgacctccactacgtggctctccttgcctccgccaagcatggccaagtcgtgctgccgctgccgccgagcgccgccatcattgaccgccgccgctgcaccccttcgctgctactagctagagagagagagataaagaaagaaagaaagaaagaaagaaagagagaagggttggatctgaggggtcgaggaaaaaaagagggagcacgtgatgtttattccctcccacgatttttgcaagcgaggctcccaacaccccgccagtaaaaaatagtttttttttactggctgcatcttaagagcaccacttgcaaaaatacctctatttttgctggcggccctcttaacctggccaccaaggacgatccattttcgctgctggccattagcccccaacccttgttataattccactggtggttttcacgtatggccgccagagaaaaaaataagttgacgccatgaaaaatcaattttgtagtagtgagcgtgaggagcgggtggagagaaacggttgagagagaggaggggaatgcataatatggaaggtgggggtgcgagggctgggcagcgggtggagcgaggcgtggggcgcgggcgcccaatattcttgttcccatcgggcgcccgagtcaaagggttttcgtaatctttaccacatcgggagcagagaagttgtttttatcgaagtaaattgtttactccgataatggtggaagcaggatggcaggacgtgcggtggggtggggagcagggaagttgtttttatcaaagtaaatcgtttactctgataatggtgggagcaagatgatgggacgtggggtgaggtgggcttgggctgatgcatgcttggcgctcggaatactaggagcatgctgcgctcctagtagtatctctatataattcatagatttttcttttgttttgtaaggagtactccctccatttcatattataaattgttttaacttttttgggtttaaccaagtttatagaaatattagcaacatctataataccagattagttttattaaatgtagcattgtatgtattttgataatatgttgttttgtgttgaaaatattgctatatttttctacaaacttggtcatacttaaagcaagtttaactaggaaaaaataaacctacttcatatataaagtcacaagaccttttatccaaaaattgaaactttcaactaaaagttcaaaaaaattatactcttggctcaaactttcaatataaaatccaaaaactgaaacttcccaaaaaaaaatcaaaaactttgtgctcttggctctcaatctttcgatacgaagttacagaatttgagaaaactttcaactgaaactcctcacgagggtgtcaagtagggatgaaaacggtcggaaacaatcggaaaaaaggctcaaccattaccataaccatatttttctcagaaacaaaaacgatatcggaaatatcgaaaaaccagaaagggcagctacgctggatgggctctccaatttatcttaatttaataattccctcaataagaagaaaaattatcctcagtcaatttcttgaccattgttctacaattttacttataaccaaattttacttataaccaaatattacttatgactttatagtaataaaatcccgtaggctgcagcaacgtgctggatatcacccaacaaacataaaaaaaaaacatgccatgttctagtgagcatcttgatcgtggtaggatagctagctaaataaagggtcggatgcgatatggatgctagcgaatagagcttttctgaatcgtcattaatacaaggaaagagggaggaggaaccagaaggagaggagcaatagtttgggggatgatcccctccattaatttctcattctggatctttgctagggatggataaataatcttatcccaaacagaaaaggctagagtacgggtatgtgcttcacgtgaaatgggaaatatatatactatcaatgacgactaatttggcagcatacatgcgtgcatgggccagttaattaattatatatgctaaatggattgtttgcctcgatcagctgccggacgactgagagcaaaacataatgcatttatatactcgctcgtgtatcacgcataataatactatactactcctatgtatcaatgatcgatcacatgcaacaccgacaaattaaattacccaccatcgatccatctatctagctatgcctatatatatacgccatatgtatgacatatacgcaagctacatatacactctctccaaagtttacattcctgatatatagctcatcatcagttgatcgtgtccggaggtgtgagaggtcggcgatgagctccggcggcaagcaggacggtgcggcggcggcgggcgaggaggagcggaagacgtcgtggccggaggtggtggggctgccggtggaggaggcgaagaaggtgatcctcaaggacatgcccgacgccgacatcgtcgtgcttccggcggggtcgccggccggtgaccaaggacttccgccccaaccgcgtccgcatcttcgtcgacaccgtcgccggcacccccaccatcggctagcctgcctcatctgcctgccttcagcatcctgcttatcttaattaaataatgatcacatgcactcaagtgatatgtactgtgcatgttccgatcgatccatcctcatctgaatcatgttttacctacgtgttaatgttttttttcctacgaataaataaagagaccttcatttaatgcatggtagccaactacctagctaaaaacaactacaaatcgcacatcccattttattatttttctcttaaaaaaaatcggacggtgtttcgcctctcataaactaatgttgcagcatttagtgaaaaaaatatttcagttcttaaaaagaagtggaatacaatcggatagtcatatgaaacaatttgcttcaacatataaacaaatgatttaaaaagaagtggttataagaggctcagtagcaccataggtcgtggattcgactcctcatgggagcgaatttttcagaatttaatggctttgtgcagccctggattcaactccccatgggagcgaatttttcaagatttaacggctttgtgctttcagtggtaggtaacgtatccgtcgacagcgaggcgcctgtgatgactttgtccactccaggatgaatttgccggcccagtcttcaaaaatgctcatagggatagggtttgcgtgcgtgcgatcataggggtgattgtgcgtgcgttgtgagtgtctgttttgtaccatgtaattctaaaaaaaaaccatcaacaagatccaagtgaaaaccgaagagaaaaaatgaaacactaaaaaaaacccattaaaacacttcgatctaactaatgaaacatccaaaccatttttgttcactggcatcgagtttcgcaagcaggcgtgctaagacagccgctagcaaaaataccatttttgcaggtggcaaactaaagaggatagccaatgaaaacatgttttgggataaaaaaaatttgaaattcgagatgtcatcgtatgagggtagggtagggtcgacgacagcggtcggcctgcgaggatcaacggccgtggtccagaggaccaccgctgcctgatctacctccttcaccgcccctcatcttcgccgccgtggaggcggatccagtggtatcgaacaccaccccagtcagatctatcccctacactatcgccacccgtctcctttgccgctatggaggaggatatatgccaaggggaaaccatagccgagaggaagtcgttgccaccagatccatgccatcgtcacccgccgccatcggattcgcgccgccgcaacccactgtcgccggatccacgcccccgtgactcgtcgccgccggatccgtgcccccgtgacctgctgctgccgaatctgcaccctcacgacccacgatcgctagatccggaccgagccacccctgccctccagccaaatctaggagggaggggagagccgggccaccgtagcttctccctgcagcgcgaccgtctcgttgtcgcggccgcgtacgggacagaaccacaccaccgcctcccctccgctgccgccgacctccactacgtggctctccttgccgcccccaagcatggccaagtcatgtcgctgccgctgagcgccgccatcgttgaccgctgctcctgcaccacttcaccgctactagctatacagagagagaaatcgcgagagattcagagagagaaaaataaagaaagaaagaaagaaagaaagaaagagagaagggttggatctggggggttgagaaaaaaaagagggagcacgtgctgtttattctctcccactacttttgcaagcggagctcccaacaccccgccagtaaaaattgttttttttactggcagcatcttaagagcaccgcctgcaaaaatacctctatttttgtcggcggccctcttaacccggccgccaacgaagatccattttcgctgccgacccttgttaaaatttcgctggttgttttcacgtatggccgccagagaaaacaaataagttgatgccatgaaaaatcgattttgtagtagtgagcgtgaggaacgggtggagagaaatggttgagagagaggaggggaatggataagatggagggggtgcgagggtgtgggcggtgggtggagcgaggcgtggggcgcgggtgcccgatattctcgttcccatcgggcgcccgagtccaagggttttcgtaatctttacctattattaaaatttaagatgattatgtaggcacccaccttttcgtccgttgtgacattagtttactgatttttcgtaacctttacctattattaaaataatcttcctaggtggccatacgtgaaaatgatcttcacctggaaaaataaatgcaccccgtctaagaaaattgtattcataatagtgggtcctcccactgcagccaccaccgctgcccaatgcagttgcgtgccgcggcctgacagagccgacacctgctgcagtccacgtcaggagcagagaagttgtttttatcaaagtaaattgtttactccgataattgttggagcgggatggcaggacgtggggtggggtggggagcagggaagttgtttttatcaaagtaaatcgtttactctgataatggtgggagcgggatgacagaacatggattgaggtggacttgatgcatcaagagcgggatgacgggacatggattgaggtggacttgggctgatgcatgcttggcgctcggaatactaggagcacactgcgctcctagtagtatctctatataattcatagatttttcttttgttttgtaatgagtactccctccatttcatattataaattgttttgacttttttttgtttaaccaagtttatagaaatattagcaacatctataataccaaattagttttataaaatgtagcattggatatattttgatactatgtttttgtgttaaaaatattgctatattttactacaaacttggtcatacttaaagaaagtttaactaggaaaaaaataaacctacttcatatataaaatcacataccttttatccaaaaattgaaactttcaactaaaagatcaaaaaaaatattcttggctcaaactttcaatataatatcccaaaacttttaatccaaaaactgaaacttcccaaaaaaaaaaatcaaaaactttgtgctcatggctctcaatcttttgatacgaagttacaaaatttgggaaaacttccaaactcctcacgtgtcaagttgggatgaaaacggtcggaaacgatcataaaacaggctcaaccattaccataaccatatttttctcagaaacaaaaacgatatcggaaatatcgaaaaaccagaaagggcagctacgttggatgggctctccaatttatcttaatttaataattccctcaataacaagaaaaatgatctccagtcaatttcttgaccattgttctataattttacttataacaaaattttacttatgactttataaaatcccgcagctaggggtgaaaacggtcacggaaattcccaatcgaccgggcgctgtttctgtttaaggggtaccgtttccgaccataacgtttttggctattttaaaattttgttttttctaatttctttctgtgtcgtattaatgtcgatattgagtagtttaaatgataaatatgttcaattaccgaccgatcgagcatcgtttctgaagagatgctactgattccgactgttttcacccctacccgcagcaacttgctggataccacccaacaaacatataaaaaaaacacaccatgttctagtgagcatcttgatcgtggtaggatagctagctaaataaagggacggatgcgacaatgggtgctagcgaatagagcttttctgccttgctgaatcgtcattgatacaaggaaagatgggaggaggaacaagctagagggagaggagcaatagtttgggggatgatcccctccattaaataatttctcattctggatgtgtgctagggatggataaataatgttatcccaaacagaaaaagttacgtacggccgggtatgtgcttcacgtgaaatgggaaatatatgtacaatcaatgacgactaatttggcagcatgcatacgcgcatgggccagtttgattcgatcagcaaccggaccactgagagcaaaacacatgctgcatgcataatgcgtttatatactcgctcgtgtatcacgcatatcaatgatcgatcacatgcaacaccgacatattaaattgacccatgcatcgatcaatccatctctctagctatgcctataaatatacgccatattaagcaagctaattaagctagctacatatatatatatatatatatatatatatactctctccaaagtttacattgctgatatatagctcatcatcatcaatcgatcatggccggagttgtgaggtcggcggcgtgcagcggcggcgagggggagcggaagacgtcgtggccggaggtggtggggctgtcggcggaggaggcgaagaaggtgatcctcaaggacatgcccgacgccgacatcgtcgtgcttccggcggggtcgccggtgaccctcgacttccgctccaaccgcgtccgcatcttcgttgacaccgtcgccggcacccccaccatcggctagcctccctcatctgccttccttcagcgcccgggcccccggccatctttatcttaattaaataatgatcacatgcacgcaagtgatatgtactgtgtgcatgtttcgatcgatccatccccatctgaataatgttttaccgtcaatgtttttttcctatgaataaatatggaagaatcttctcccatcgaacgtccgacgtcccaaaaaaaaatcagacggtattccggtgaccaacgagtgaaacatcaaattatatatgactagtaatatacccgtgctaacgcaacggtgatatttagtagagtaaaatggacgggcggctcttaaacttgtagaggtgtatcatctaggtccctaaactcttaaaatgcatatccaagtatcagaacttgtcatagtatgttctctaggtcccaaatcgctacaaccttctggatcctacatgatactgatgtggcatgccatacgtgcatgacatggcataattttgactgacaaatgagacccatttaaaaaaaattctttttctttttttcttctttcttctcttttatttttcctttcttctcctttctctatgacccaagcagaagaaagaaaaaaaaaagaagaatgagaagaaaaccaaaaaaaagaaaaagaaaaagaaaagaagaaaaaaaagacccatcatgtccatgtggcatgccacattagtgccacataggatcttagaggggctgtgtcgatttgggacctagatgatacactttgataagttccgagacgtggatccattttaagagtttggggatctagataacataaccctacaagtgtaaggaccgtctatgtactttactctgtaatctccaaaagttaatattgtttttagtcaaaaagaagttaatattgttttaattataaagcatagaataaggctgctggatttattgaagaaatagcacctatagaacctttcaactgatatttgtaactattggttctatagaaatagcacctatagaacctttcaactatttgtataataataactttgggatttgaaggatcaaataacagtgacttcacagtcgaagtatgtgctgaaaaaggaaaaatagaaacgttgttgctaaatgaatagaaatgcccaatccccagctctcaaaaacaaatagaatgaaaaaaaaattgagaaaccgaggttaacttcaactgcttctctgtgtcagacttggcgagcgaaaccttcagccggtggcgagcgcacattactcttcactatgtgtaggtatcagctaaataccagaagcgtccgtattctattctaacaaaatacatatattatctaccctgcttatcccttgaaatgacaaattgaactgcagtctgaaaatgagacataattttatcaaaatactaatagtaattagagaagagtggcacttacattgtactcggaacaattctgcaagcctctctacatataaaagcatccggtcaaatatcaatggttgatatacatgcatgcatggttgctttttgcaaaacattcgatcaataaaggaaagggctctttatattttcttcggtacaacatctaacaaaaaataaaacacaacactaaatgctgtagcaattaccagtgtacatattctgtaaacatatacttatagtaatatgcctgtgctaatgcttcaaagccaatcagtaatgtaaattaaaagcataggatgagatggatttaagttagtatattgttgattccatagccgcatgcataaaataaaatcacaatttttatacatttctaactatctacaacacatataaattcgaccagctattaatttatcgtgttcaatacagtgtattacaaaaatatttttcctcacttttattcccagtgcagcctctcttctccactctacatatccatgatatgtacattttcttcagagaacaagtactacagtgttaatcagaaaaaaaaaggaccgtggaattgatatgcataacatcatttggaaaatgcttagtaataggacaaatctgcccgaaaaaaagattaccaatatttgactctggcatgccaacaacgagaagaaatgtttacataatcaattgatactttatttattacagttctaatccaaagcccaaaggtcaataatattagctcgtaggcagctacatatatcactacattcgtcatctgccctcttagccttgaagcctagtcattcattgatggaacatattaccaatctcacgaaccacatagtaaatattcagaaggtaccaagtagccaagcactgattattatcagtttgctgctctatgcaaaaagtaaaatataataaataataaataagaagaagaaagaaagaaaaaggagaatggaagttcaagaaatattaaataccaaggtgcatctttattttttacacatatgtacatgtaatggccaatcacattccagcattttttactgctgttacagcagaaggtgcattttgaaaaatcaagaaattatctggtttcgaattgcactgaacaacacgcaatgcacctgcatcaggtaaaattataacaccgtgtttagtccaaagaacattttaaaggaaatagcacttacatggcaatacctcagattgagggcaaattaccctgttgcaacaaccattagtaatccatcaatttcgtcccaaatcaatttccggagaggaagatatctgatgcattcagatccaattgataagccaaaaccataatgtcttgcttgcaattcctatcaggcaggatcagagaaatggacctgctcacgcgcatgagcttggaagtagatcagccagtggcctggttggtgtcgactcgggatcagcggcgtccgcgccgacggctgcaacgtcaggcggatggatgcctccacacttgcaggcttgcgtttccccaatcttcggaaggggaggagatcgcgttcgcgtgggggagggggaggaaatcacgcgcttgcgttgcggcgaggcgatctgcagccggccggctcagggagcaatagccaggcttggggagggggaggcgctactgcggccagggcgacgattgtgagggacatcggcgctgggagaggggcggattggcggattgcgggatggcgaccgtattctcgggcgtttgacgcgcgtgggaggtggagacgatcctgagcattggatttcacagaggtgatctgaaccgttgagtgatgaatgtaagagtgtaggagagaaagatgagtaaaatgagttggtgaattataaggtagatgaaataaaaaaaatcagcaactgacacatttaaaaattttaccattttcattttcgttccaatcgattaccattttcatatggcttggccggtagaaagtcggaaacgaacatcggtcagctaagaatttccgttaccgttttcatcccagtatcaagatttgacgaagaagttgtcgggtctccttaacgtcgctgaggagtgactagtgaggaagggctcgtaacgcctcgccgagtagagtagcgaggaagaagggaacccgggctcgcccaaatatcactgcgtgccattgggccgtgcttgggccggcacgaagcacgatgggccatgccgtgctagaccggcacggcccaagtccccacaattacctgagtgtgcccaacgctccagatttaatttcgcatgttgagccaatatgctttatggctaatctcaaacacaagcacttagctggtttttcacctatagtcttgattttgagattttatttattttcggctatgaagtaagaaaattatcaatgccttcagtgtccagactttcaggtgttgagaggctgaggtacaaatgagagcttctgggatgaaatatcaagcagtaaaacattatctcaagaaatgcaagcaccaaaaaagatcaaacgagtatcccttagcctcctcatttgtgggttgaacaccaatacggtgacaatttcataactgctgatcaagatatggctcatcagccaaatgaactctgcaactctgcacgagttcacctctgctgggagctatagtacaacagtgacaatcagtcatcggtcaactgcctgagataattttgaacgcattcatctgcataatgacttggaagttggagctttgctggtattgttctgaaccaattacagacatgccaggagatttgacaacagagagtaatcggtcaaacgcaaaaaagggaatgttgggtattacaaaaaaggggaatgtcagggtgtacagtcatgagaaggccgagctttggtataagctactttactctgctgatctgaactcatacataacccctcaaatcaagaacaagcactgcatccagttcttgcactgatctgggagcattactctacaagccatggtgtcagaacagattcccattcgcagagttcgccttctttgaaccatagagctacagacagaaaatgtgtaatgagtttatcatctgtttgtaaagaacaaaatagcaggtcacaataaagttaagtccaagctaacaaacatgcacgtctctaagcacatagtgctgctgaattattatttttaaaaaaaaaaaacatgatcctaatcactgtgtcaactacttcattcttcgtagtacttaaaactcatgattctatgcaccttatattgttataccatgactactgggaaaaggagtagaacttaccgatttcacgcttgccgttatcaggactgtcacttccatggacaacattcctggaaagcagagtccataagaaatttaatttctttgacagagatatatatgcagagatatccgctaaaatgtgaaagatgtggtagatataataatgttaaaacatgaaaggttgtttgattccaaccttcctgtttgaactgcaagatcgccccgtatggtccctggttcagcttgaaggggattagtagctcctattaacttgcgagctgatgcaacaacaccattcccctcccaagccttacagaacagaacaacaataaatttaattgaaaacagtttactgatcaaagtgcagagttacaaatatgtttggttctttacaaatatatataccatgcaaacaacagggccagaagttatgtactcgatcagaccgggaaagaaaggtttttccttcaaatccttgtagtgctcctgtgcacataagagagaattagcagctcgttgattaaacataatatactcctggtgattcccttcctatgtgaaaacaaagataatactgtatgctctgacggtgagcagaaaccaggtttaaccacaaatttcgatggcatttctacaaaattttctccagctgcttggatatttaatggatcacttttcgttggctgaatacaagaaaaagtgactcgaaagaactatctcagcagtcagcaaagaatgagtactttggatgatcaaggctgtcctgaaataacataccagacagacatgctatttatcatttattcgattgtgaaatttccattcacaacaataaaactgtgatctcctcaaataagtccattcaagtcttggcaaattgcccactaccaagaaaataaactgggcatgatattttgtcatgccacgcaaccatggtatattttgaaatggcaccattgctctccaacgatgattaaatggtgagtccccagatggtggaagaaaacactttacttttgaagaaaacggtggatattaagaggcaaacctgtgccaagtccttggggcactgaaaaagctttaagcccttcaacacaaagcctttcttctcgaaacgggaaataatctcgccaacctatatgaacgaatcgacaggagtgtttatctgagctgaaagaaactataatggaactacagtattcagtaatggaatatattacgtcaaaaaaaagtaatggaatctaaagttagaaaagtaagtaaaatgatataccaggcctcgctgaacaccatcaggcttgatcataatataggattgctcaacctacagaaaaaatagatttaatcttatggttgatcaggaagagatcacctaagtggagagttctcaacttctaactgaaataacagaatattgaggtaatcagaaatgtctgacatctattatataataaaagtccattaaacttcctacaaatgctcccaaactgccacgtgtaccctacaaacgctcccaagctgccacttggcactatgataaattatagaaattcttaaaattctaaaaaaaaagacaacacccaaccgttgattttcatttaatctggtggacccgatatttttaaccattagatcaatctataaagaaaaaataatcctccaatccctatcagtattgtacctacgtggagtcgtagtaggtatacgtacgtacttggacccgtatgcctcctctcttcctcctctgttccctctcttatttcttattcctattcttatgcaatattaggtagaaagcacaataggtgagcacaattgacaattaaacaaatataacatctaaactgcttatatttaatctttcaaaaagaatgt

SEQ ID NO: 2720 - DNA, 14478 bp, Oryza sativa
  unsure (1)..(14478): unsure at all n locations
aaaaataacgatatagattttatcatcaaacataattacccaataattaaattagaaaataaaatgacctccccggtaagtcaaaataatataattatacgtgtcttatattatattatatactataaacgcttataaattgccacatgactctttaataaattagaaaaattcctacaaattctaagaaaaaaagaaaaatatctttagcattgattttcatttaaaatgttagaccaattaattttaaccattagatctatataaaataatataatggtgtggaccatgcgtacatcgatctaatgtaaaggatatgagaatggttatagcttcgttcgtacacttacggaagaagaaaacattatatagtagtctaaaaaatcgagattcatttttctttctgaaacttaaaaaaatactaaaagtccattatacttccaataaacattatcaagccaccacatgcatattctacaaatgctcctaaatcatcactttacgctataataaattaggtaaaatcctataaattctaaaaaaaagaaaaatatcttaccatcggttttcattcaaatcggtggacctattaattttaaccattagatatatataaattaatggtgtgggccatatacattgatctaacgcaaaggaaaagagatcggttatagcttcgttcgtacatatagagtacaagacattggatagtagtctaaaaaattgagattcatttttttttcttgaactgaaaaaaattaagactttgatcggtcacaattttgcccccatcgacattactcaggacactgtcagcgtgagggggcaaattagcttgggactacatgtatgtatcatgcatgaccgagctaaaagctttatctaccaattattttagaaacttaaaagttaaaaactatttagtatttaaactaccatggttgtataaatggctaattctttcaaacaacaaagataaaataggataagcattgtaggcttcatatttaggattatgcaatataaacataatcactaaaggcctaatgcatgttagctaagataaaatcacaaagtgattgtttgcattatgtaaaatcctaatgtttaatcataaattttagagtaaaaatatttaaatcatgacaacaatcataccacactacataataatcacacatgcggagttatttttcgcaatgaaaattatgttcctgctaagctacatggagtctcacacactctacacgaaacaataaactatctcctacgctgcaaaatcaatttagactcgagaaggctttttatttgaaatatatattgtgtcacgtggaccgaaggcatccattaataaacaatgagacaatcaagtatacagagaaaaaaaagcaagtgcatctcagcaaaggatacagtaagttgtaaaatatgtagccaatttgctacataccaaaaggaacaccaaaagtaactatcaagttcgttgattgttggcaaacaatgatatcggcacaaagatttatatataccattattttcataaccaatcaatgtgaaatgacaactttaagccacttttctaacgtttttaattgaatatacaattatgttcatcacattctaaacaaatgatttccgcgagaatattgttctcatgttcctcaaatgtgcagcctcctatgtgatgagccttttgcctcggactcatgggctacctttagaaataacttttgtaatgtgtttacatataactactttagtggagtacttaacccagaaggtagagttgaagcttttacacagtgaactattttagtggagcacttaacccgcaaaagtagtattgaatcaatctattccattggttacagaggaaaaaaaagttcattttacatcctaacgatattttattcttttaaactttttttcttctctacatacaagtcatatttcactttgacacatcaggagatgaaggtcaatgataattaaacgaatacactaaattccacgacctgcatgtaaatgcctctaaggtgtcaatacaaaatcaataagcatttcgtataacgatatgattagaaatttcctactaatttttattttaagactcatattaacttggtatttttcttaaaaatactgtaggatcctacgcataagaatcactatcttacatatgtatatttggtcaatttaaaaaggtgatagcaggttagtaaaaaatatatatttatgagcaattaaagtttctcaagatttttaaagaaaaaatacaatgaacattcaattaagaagggaaacacctcactttaatttaaacttattttgttagacatgttttcgaaacgaaataaaaacatgcccgcgcaaatgcgcgggctaccttcctagtttcataaatagacagatccacacttattctgtgaaaatagaagcgacgaactcaggttccatacttaagctaagtcaaacagcatccgtaatacctctcagatataggcatatatcgtgccatgaaaagaataagtggacataaaaaatgaaacagttctacaagttctgctgatctgcatctttgatttcagggattaaatgcgtaagattaataaaaccaacattgatgcactaacacgttactgagattagcaaacagaaaatggctttatgcttgaggggaataatgaaaaactacaagaataaatttggcatcccttcaacataactcaattttctcaactatgcataaacagatttagattgttctacagtaccccttcactgtgtatttaagacattgcaagttgcaacaactgtcatgctgcatcgcaaaatgagattgcctaaggaaacttggacctgttcaagtactggaatttgaaacacgttgttgaataattcaaacaatctcacagtagaaccacagagatcattgcatttattaacaaaaagagtaaaaaaaatgaagaccaaattttggaattctgatgggcacaaaaattctacataatgacatatatagcaaacatcttcaattgtactgcacgaactaggcagcaaattagatggttatcagagcatccaaaataattgccatgaccatttccatatgcgcatcacggtacaaaagcaactcctacttggcaatcaacacaatgtagcatgcctaagtgccatattttcatcagtactgtctgccgctgacagcagcaaggcaaaattcttactttcagttcaagttcgcttcctttttttccaataacttatgtcaataaccatagaatattccagaaacgggtactaaaattttagactgactcttctcaacaaaaaaggaaattcagactggccaaagcaacgtatgaatatgtgggacatttcagtgaattatctgttcagtttttgcaatcaatagggagccaaaaaaacgattatcttcatctgtgctcagctagtagcatgtctttttcttccccaatctatcaaaaaaaatacgactcgggccaatacaacagtagagtaaaagtctgaaaccaacatcacaaccaaaccaaattgcccctctcaacccacaaaaaaggaactaatcttttcctgcaatttggaccaaacgcgagtaggtaaaaacaaggggattaattcgagaggtgaccaaccgacgacgcgacgatgcggccggcggcggagacgcgccccctggccgccctcccgccccacgcggcgctcagcgcgacgcggccgcgggaccccggggaggcggcggcggcgaaggagacggccgccgggcgccgggacaccgcgggggaggtcgcggcgaggagggtcggggcggggcgggaggtcctcgcgagcacggccatggcgtccatcccggtagctgcttctcctccaacgtccgcgcgagcgagcgagcgaccaaagcagccgcctttttttggattagggagagcggagaagaagaagatgatgagcaggagcagagcagagcagcggccatcttgtcacatttttcaagatttgtttattctcgagttgtgaagtgccgaaaatacccctgcctctcattttcctcctgcatgggggtgaaaaaatggacctgatttgtcctcatttcgagtcgctatatacctcgttcgtttatgaaaattatattaggagtagtctttttaaggttagctgaacataaaattaataatttctatgcaatgtcgaagagtcctcgtttagtgggattgttcatattgttacaacctctagcatatggtcaatgatttgttgtcataagtttgctcgattgaatttagtactaagatgtttgaattttttcaataaaagtactttttcgagataaatctatttatattgttttatgttttcaaactaaaagttatcccgattattgataggccaagcaataaaaaataaccagatttatcatagagcacaaatatttgtgatcacagggtgtacgcacccttgtttcaaacagaaatgaatgtatacgtgcttcatacaccactatcgactccttgattgatctcgcctctaccatgtacaacatgttattagtcgttttagattgtttttcctagtcccgtttctctctggttgaaatcaataaggttaatatggtatgagtttttgatatagccgtgttctatatggttttattcatcgggagataccattcttctataaattaaggtaagatgtacaccgctcttctacactatgctggtcctcgaatcatcgctaaacggtgatgcttaccttcttggcatggtacatgtatatacatgtgatgtgatgcttattttacaagtatatgcattgatacttggagcgaagaataacatacttttcttcaatgttcacttcattagaagagaaaaaagatgcctctccatccaaatgcccaataaaccatagctgcacaatgattgactttccttacaccccttatggttgcatacttaatcaacaattgccatccaaaaaagtgtgattccacaaagaaaaattgtgagcatctatcataaatgtatatctacttcatcctagtatcatatatgtacggcaagtataataaccttagtttacatgcaaacgttatcactcaagccatatcaacctacatcctacatgaatgagaaagaagtaatcatatgttcgttgagtgtgagcgcatagccaccaagtactagctgttgtgcatgagctagtccaaagtaaaagagaaagatttgagactcggtaaaagataaaataatttttaaagaaagcattgagaaatattgttgtatatgtatatggctttcaaatttaggtgattattctttagagccaacaaaaggtcatcttattggctgttgccaatttgaaagtgagtttagcttttgcaactcgttcgtttactatgagtatgtttcctaaattattagacggtgtatttttaaaataaatttttatataaaagcttattttaaaaaaaatcaaacaaatctagcttatcgatttaatacttaattaataatatgttaaatgtttttatttcacgtgcagaaaaaagctaagtcaaattgttgccactgcttcctccacactgcccacttgtccagtggttgccgaggtgcttattcctacacctaatttatggaggtcaataacaaaattattattgtaatatacttttttttatatagtactagctcatttcacccgttgttatgtaaactctttagcccatattgtatatgtggcatctgacgaccgtccagtataaaaagcatgaggcctactggcctacttaccgtaaaaagtcaaatgatacactttgtattcaaaacacatgttaccggtgtacacatgcatagaccaaacggaacacctcattttagtaaacctagtctgacgctttctatacagcaacgcggtacctcaaggtttacgccttcaggcggatcacgcacggtggagacggacgagcgcgagaaaggaacaaaccgaacaagtggacccacccacccgtgggcccatccacttcgtccaccacaccgcatcgcacaaaccacacaacaccggttccgaccaatcacatccgtccacgtaccccccaaacatcccccggccccacacaccgaatccccccgcacagcgcgtaagccgccaccgacgcgctggcactcccacgttcaagccctcctcaccaccctcacacctcacagacaggtgggaccaacaaaaaccagacccacctgtcagtgacgcggttcggacgaatcccccgtagccgtaacacgatctccaactttcctcgtgggctccacgtggcagtggggaaagcacgggtcccgatgatatcgcccacacaccacctctctctcttctctctctccccatctctctctctcctcctcgactcaccgtctctctctctcccctcccgtctccggcgatctctccggcggcgtctccggcgaccgggccaccgccgccgccgccaaggagcgctccccctcattccccagatcggtagctgtctcgtcgccgtccccgatcctcctcctcttcctttcccccagatccacaccccccccctcgcgtactcgctcttagcctccgcggcgggaggtggtggtggtgtgggcggggggtgagctcgtgagtcagatccggtgatctgtgcgctgttgcggttgccatggacgacttccagggcctcctggcccgcgactttgggctgcgcccgcaggggaaggcggcgcccatgtcggccgcccgcgccgccgcgtcctccggatccgcctggtccaactccagatccgcatcggcgtcctccgccgccgccgccaccgccccgcccgcgcccttgtacgatgacctcttcggggccgcggcgccctccgccccgccgcccaaggccgcgccctcgccctccctcgacgccatctttgactccttcaaggagccctccgccccggatgccccacccaagccgaagcactcgtccatgccggtgtttgacaagccggtctacgatgacgacatcttcgatggggttcccggggtgaagagcagctcctcggcgcggtttgacgatgtattcggtggcagccacgcgccgccgccacctgcgtacgatgatctgcttgggggatttgggagcaagccggaggtgaaggaggtgctgccggaggagaagaggaagcctgagccggccgcttcatcggctgggtttgatgatttgatcccagggtttggcgggaggatcccgatgcgtgccaggtgagcacacctttttgcatgggaatttcgggcattatgttgtctacatgtgcaatctaggagtaaatttagtagtagtttggatcaagcggaagctttgtcggtatgagccaactcggcaacgagagaaccatgtgataattcagttgagttggacaaattatggactcccatatctaatttatgttgcatttgcttagattttagcttgttaatgtgcacgtgcgattgtttgaattggtaacttataccagttgaggtaggaaattcattgatggcttatatcttcaaatctatttggtaattgaatttataggctattttccattaggtatgatctgtgttgaccattgaatatcaatggcatcttgtggataaacttatgggcatcttgtgaattttatgggctctacttcgattttactattagaaacgcctaggaacatatgctatgctttttataagcattccctactttcctaaagataccagtgcactttctcaggcaaacttgctttggcctctatattgcgttatgtggataatacagtgtatgctaggtttattatggtttatttaaattgcacatagttcatagagaatgttcagcatgcattaatgaccggatgtggtaggttcataggctgcacaactttgattgcaaattaccttaggttcaaatataacgctttatagtgatggaatatgtagtgagttatgcaagaagaatatctacgaggttctgaaattgctttgtttaaagaatgatttggatctttttaatctaaaatatgtcaatcatatacagatttgttaccataaattccctcatcctttttttttttgaatcatagggagactgttggaactaaagataagaatgtgtccatgtcaacgtctaagccagctagcatggcaagtgacccatttgatgttcttggtacaacttcaacctcaaagcatacatcttcagggatattcacggatcccttggatgaactgggcaggcctgcaaaatctcaagggaaaaaacatgataatactgctgttgacagtggcctattcgaggactcaagcacttttaatcaggtcccaaaatcagaacctctgtttacctcagagttgaatgatgacttgaaagataggaatggctccaccaaagatcgagattcaagtcctgtgcaaaatttttccagaaaaaatacaacccaaaaaccttctgtggagaacttcgaaaatatctttcctaagtcacagtctgctcgatattctgatgttcatgttgacattggtgcctctggttcagagaaatacagtgggaatggtatggatgaccagtctccaagatctgatgagtccgaagatgagatctggcttacagtttctgagattcccctcttcacacagccaactagtgccccaccaccttcaagaacaccaccacctcttgctgttaagcaaaaaccacatggatcacaagcaaaaagaaaagatgacaattatccacgccggtctaaccaaaaccacaatcatcacagaagctcgtcaaatcaagctggttcttcttcaatagatgaactggaagattttgccatgggcaagtctcaaagttctgcctatgacaatgcaaatccttttaatgaggaagaatttgagcatagttcatcagcagcagcatctgcagctgctatgaaggaagcaatggataaagctgaggcaaagttcaagcatgcgaaggttgtacgggaaagggaacgcgatgcaaaacatagaaatagagaacagcaggaacaagatgatgaagcaaggttcaacacccaggatcatgaagagagagataggcaggaaagactagaacgggagagagagatgagacaaagggaggaaaaggagagagagcaaagaagacttgaagaggagagggaacttgagaaacagagagaaagagagagggctgctaggcaagctgtggaaagggctacaaaggaagcacgggaaagagcagctgcagaagcacgtgcaaaagcagagagggaggcacgccagcgtgcagagcgggctgctgttcaaagagctcaaaaggaagcacgtgagagggctgctgtagacgctagggaacgagctgagagggcagctgctgaagcgaaggagagggctgctgctgaagccaaggagaaggttgcaactcaagccagggatagggctgcagcagaaagagctgcagtggagagagctcaacaagaagcaaggaggagagctgaaagagcagcagtagagagggctgcttctgaggctcgggaacgtcaagctgctgaggctcgagaaaggcaggctgctgctgctgctgctgcagcagctgcagcaaaagaaaaacagagtaaaccggacgatcttgagtccttctttggtatgggagctcgagccaatagtgcgccgaagcaaagggctccaacagcggtgattactctaccaaaacatgcatgctaaaattttgttcatggcaatttttgggttattgttttaccaactgtggacgtttcaggattcgatgttcaattctcaaactcaaaatagaggggcagcatcttctgcttcagcatctatgcggaaggcatcatcaacaacaaatattgcagatgacctatctgcaatatttggaggaggtacggatcaacccaaatgcagcagttctgaacatacaaggttttgcaatattattggctatcgctataactcatttggttgatttcttttcttttagctcccacatcatctgaagaatttcaagaaattgaaggagagagtgaagaaagaagacgtgctaggttcgaacggcatcaaaggacccgtgaacgagcggtaatgttgctaatgattttagtaactaaaatagatatttgtttgtaacttgctgttataatttggtactgtggacattcattttatgttcctgaattttatcatttacatgttatttttttctatttattaagagttgtgatgcatgaatttgagttgcagtgccatttattaacttcaccgtgtatgcaggcaaaagccctggctgaaaagaatgaacgggatatgcaggttcaaagggagcaggctgaaagacatgtaagtactttttatctttcaattgcccaattttacttcttttaaatacttgtcatactggttagtctccatttattttcatatacaagtttactgatgatgttgtggtgcattttatttgttgagtaaattacactcacggtacatggaacttgtgtggtgggtgcaaatagatacaaccacttgcaaattgctcactttgatacaataacttggctagttggtgtttaccgggccaaaatgatccacacaagtaaaattgctctaaattagcacacactaatgatatgacagcatacacgtatgactgtgatttggagatcttatttcgaatccaaataaaaagaggaattagatgtgcaaaagtttatttttcatgtccaggatagagtatttatttcatttattgggaaaatttgatcctctatataactcgtctaatgtttatttatctgttcaagaccaagacaatttttatctgtacatttaactcctaaaagaacactttaattttcatgttcatgttcagatactctttcatcgaaagtgtatttaatgattgggcatttttaattattttacttttttgttggtctaaatcttgaaaatatacgttgtcagtataaaattttgatgtgtaacaataattacacaccagtatgtaatgtatcatatttgatcaattttacttgtggatcggtttggcccaggtttgcacaaactggccaagttattgtactggaataagcaatttgcaagttattgtacctatttgcacccaccatacaagttagtgtaccatgaatgcactctctatcaatattttgctaatggctagttcctttgtttcgttatctgttaatccagagaatttcagaaacaatggactttgagattaagcgatgggctgctggaaaagaaggcaatttgcgtgcattgctatcaactttgcaatatgtaagtccttattcctgatgctgctaaaaattgaatcaattatccttgtcttctcaatttttctattcattctctcggtgttattcttgcaaagaaagttgcttgactcttttgcttgtcttctggaagccatacttttccctgatcagtttggtagtgcaatttttaacgtagagtgtgttcctttatcatggtcacatttcaacacatgatattttctatccaagggtagttccgaggtaattttgttaagcatgcaggttccagtaattgtattccctgctacagctttttgtaagctttgttttcacctgtggtgaccaaaaccatggtattgaggtgaataggtgatatcagatagttttggtttcttgctgatgtttgaatgtaacatagctgagtggctcaaagaccagattgctggatgggctgaatatcttttgtttttctaagtcttccagtaaaaacgtttatctggtgttattctcttggtttgccattacctgcatacagtagctccttcctcgcaagctataatacatactctgtatgtaagtaaatagaaaattgtgaaggactaataattactcctattcaacaaacattgcattttagggctagtttgaagagaattattattaattctgttctttctgacaggtactttggccagaatgtggatggcaacctgtatccctgactgacttgattactgctgctgcggttaaaaaggtatatagaaaggcaacattgtgcatacatcctgacaaggtgcagcaaaagggggcaaatctacagcagaaatatgttgccgagaaggtgtttgatctccttaaggtgtgtatgctgccaaaatatattcacaaaccataatagcagcatgctgcttcacactaacaattggtcaaccgtatgtttttatttcccttttagtttattgtggagaaattagggactgcctagctacagagcctaacaggacttattaatgtgtttttccaattttaggacattggcctctacatggaaactgactatttgtcaattatgaatatttaggatctttcactgtacattttgagatattattattcatgtgtggtccattgagccaaataaggcttcctctatgatttcacatggaaagtgccaaggtttgacagttttcatatgattgatggtacactagaataacccatattaatgcaaactttggtttgtgtccacctggaccaccacctggtgccaacgcaagtatatctggcatgccctgcctactatgcccacaaccaaattaatgcaaaccttagtaatggcctgatagtctgcctagaggaacccaaaagcaaatgcttgacatatacacgatacgataatttaatacatcagattgatcttgttgatatttagtactttggctagtatatcttacattagcttacttctttatacaatgttgcatatttaggatcttattatttatttttagcaagaaaaaagagcttgtactcaattgttttccctaaaattgtttaccaagtgccgggacttttaaagagttctattttctagtgtttcccattacatccttttggtataaactttaattaaacctcctctatgtttgcacaaaacaggaggcatggaacaaattcaactcagaggaactcttctaaacggcctgcgcaaatgaaacatattgctcaccaatcttcacctgcatgaggcaatcggggtgggacagcacctcatagaacaaccgagctggagcagtcggtcggcggacccatgaaacgatgaagtgaaagttccaccataattacaattgtattgttattaccaatattgtttgttttattatacaccctcatcttctcccttctgtatgtgttgattcaaatgacatttcacagccacatgtggtggccctgcggcagaccctcatccagtaggtgtatattagcgttctttttgctcggttgatccagggttgtgtagcagcggatttggggtggccagtgttgtggtttttggattaggcacagggtttatttaccatggagggcccaaattgcatggatcatgaatgttgccagtttgatgccatgggcttttcgtaagttcaattatcttgtttatagtgaacttctggaacacacattggggatgttcctctgattcctgtgtgattttgtataaagttgatctggaattttgatttcctcttgttctctgttaccgcttcgttatttgctcgttccttgaacgtataacgctagtatcacaaaatcctgtagagtttcctttaaagagtaaattttacggaacttcatgtattaaccaattgtgcataagtcatttgttttggcatgttgcttataatggtattatgctcctataacttcagaaaacagcagcagtaaccaaaatttcatctgagttctttaattcgatcatataaaagttatagtaatctaagttaattcttttttattttgctatagtgttaattcagattgattactagtagtgtggttttgtgaaatctaataccgatggtcactgtgcaatatgccaaaacccatatatcttgttccatttaaaaccataataaatagggttatgtgatatttaataaaacagatctgttaactcaaataaagattgaattgggaagtgttttaatagtttattaaaggttggattgggaagtgttttatagtgtagtggcttgatgaaatcatgggtctgccaccgtgttgcatcgatctcccaaattcttttctcgtttcactcgcatcctcatcatcttcatgttacttctacctacaagtatattgttttctcactattttatatcttttgctcgttaaaggacaatgatttgggtgtattcccaatttcccatcggatccagtaactcgtgtaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2721 - DNA, 627 bp, Oryza sativa
atgcaaagtgctgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaag

SEQ ID NO: 2722 - DNA, 3233 bp, Oryza sativa
gtatttttgagacggatgtagtaccctttaactaggacatatatttggatcattcatgcatatttctggaagtgatcaaattttgagggcaatttttaccatccttaaagtaaatgttggaaggtaatatacattttatagtgtaaaatttgatgcgttcaaatactactacctcgatgtattaaaaatttttatgtaaaattttgataaataatgatactttcttaatgagcataaaatatcttatttcttgaactgaaataggagtgtttcgatcaggaaacagccccaacaatttgagtcttaatttcaccgttttgtacacaattaaagtaaattaagtaaaagaatcaacaaaatgttcatcacctttgacatctgtcatagaattgcaccggagaaagatgcaatgtttctgagagaaaaccgttgcattttccaggtgctctctctcatcattattgctaactttcaagtgtatttggtctctagaaagatgcaatgtatgtaaaaaattgaatattagggaaggacctattatcaaataattagaaggggtgaagcttataaacccagatcgttcggcccaccaccttgtggagctagctgaaaaaccctaggcgtttcttaagatgcaatgtatgtaagctactactacagtagcagcagctactatcatcatcatcatcatctcatcatatgcaaattaaaggtcatcattattaaatgtataattaattattttaaaagtgtgcatctgtttttcattacatgtcactgttaagatgtcgactagcgagtaccatgtaatgccagtccaaactaacctaatagttcacgacaaacatttttctcatagtttgactcccttgctgatcagctccatgattcaagccgaagcaactcccttatccatggaaatgtctatatctttgacatattatcattaatttccattcattgcatagctaagctaaagtcctaaattcctagctggaactctgaacagctataccaaagttttgtcgacgaacatcatcaatttccgacagaaatgatcggtgaagattaattacagtctcactgtctccgattgcatcacatccttgacagctgctggactgtcatctttaactacagattccttgagaatttcctcgtcgcagctgctggactgaagaatgaactgaatattagctttgcttctagaagtgatagtagtggttagcaatcgtattttctcagaatcagtcagcagctagaatcattaattgttagtcaatgaagagtatctttactttaaaaatgatgaaaagcgtcttgctcttacgtagctagctagccattctccatttattttagtactcagaaaaaataaaattaaccaagtgtttgaattgaggatagattcagttttttgactattggcccggtccatgcttacccatttgacatgttagtggtgccagttatgtactgcagcctctgatgctgatcgagtgataggctcatagcaaacatagttgacgaaaacacatgaatgaccatatgagttgtctaggacaaaatattctgacaattgactaatatattaccccaatttgtccaaaacagttttgacatagtacactcggagagttttattttccttgtgcatgaggtgcaagaacgaaaagttcctcgtatttcgtactcctacatgataatatatactccctccgttttaaaatgtttgacaccattgactttttagtatgtgtttgaccattcgtcttattcaaaaaatttaagtaattatttattctttttatatcatttgattcatcattaaatatattttcatatacacatatagttttacatatttcacaaatttttttgaataaggcgaatggttaaatatgtgctaaaaagttaatggtgtcaaatattttgaaacggatggagtatatcacagcaaaacatcctgtcatagatcgattctcaaggtctaaactctagcaagatgctaaaattctaatcaacacttagtcacaaatgcatgtcattaagggtgtgttcgtctttaccacctcttcccaacttttactcaatcattttccatgcgcacgcttctcaaactactaaatacatttcttttgcaaaaagtttctataggaaaattgctttaaaaattaatattaatcaacttttaactttatttcagctaatatttaattaattatacactaaattaatattaaacaattcgaatgatatttatagttcaaactccgaaattttgatcgagtggttgttgaaaacaactaatcttactgtgtttttccccattagctgagtagctttttcggcccctgcagttttaattagtattcctcccagccattgattttgaagacaatattgaaaacctcaaaaagtcttttagctagttctacaatttatgtgctttgtcttgcacatgtattgagaaaggctagacttccaatcaattattctctaaggctccatttggtgttgcattggatactattctctagacatctcgttgggtacaattgttttgaacttgttattgttatgatgcaaaggataataatattttgtctagccttaatttgtctgtggaacaatactacaaacaattattgtctttattttcccaacaacttaaaaatatgagcacgaggcaacataacaaccacaaactgagtgtaccccttttacttctcacctagaatatataaagttcaactttctaaaaattgaagttagcaagttaaaataatgtgactatctataaaaacaatatcgattggtacatttattttcaaaatattactagccacatcgtcgtgctttgtgcgactattgattatgtttaagaacttatgtatatagtttattagttcagcttagcttttaaaaaggttttgacataagttaatttatttatagaatatcgattggcctagtcaactattgtcttttttaagttatatatgtttataagaggaattggagcctcctgttttaattcttcattatctttggcccctctctatttgtatcagtgtctaagatgagacactagaaacatacagaaattctcatatgtttagccatttgtgtttttttattaatgcatgtatcttttgacctaatgatcattggttatctaaactcttgatccgacggtcaatatgtttttgtgatgtagcacatccttatgc

SEQ ID NO: 2723 - DNA, 973 bp, Oryza sativa
atataaagagctttccataatccacacgggttataaattatgaggcccgccagtatagacctcgaaaggggcaataacgaaattttctcttcccatatttacaatcaaaacaaaaaatcgactatttttaaaatcgaaacaattctcgtgagccaatgagggtgaaacgaaacaaagttggcgcataactcacgggaataatttgttctagcttggacattaacacatcaaccaacaggatgaataaaatcattagtagaaactagtcaagcttttttcctgcaataattttcaaaattccactcaattatacagttaccatgaccgtaacccagaaaacctagccgacagtttcgatgctcttcgtcgtgaaaggaaacattttagtagccaaattaaaaacaatcttgcaagcaattgatcagaatttcaacgaaggaaattgcatagtctagtatgttgttttgcctatctattgcgccagccggcgatcttcggttcagtcagtgtcattgcaattcgtctacgcgcatggtcaagatgttcacatcacagcagtcagaaaattatgttcaacaggggaattaatcaatttggcggcaaagtttgcaaactaatgataagatcaacgtcatgcttaattagttggagcacgtgcaaacgtgcacaattaattactttgggatcaaacctcacaacgacaggaaatgtctgtgtttgaaatgggggaaagaagcctccaaaattacagattgacatatgatttgtcatagttttacaagtttcgagtttaatgggactggctttaatttgaagggatttagaagactctgaaaggtgtgtgctttgaagctgacttttcccttccactccagtaaaatgtgatttgattacgttagtagttaaaataacactacgatagtgaagacaactttgacatatattattagtcagacattgttatggagtagta

SEQ ID NO: 2724 - DNA, 40678 bp, Oryza sativa
  unsure (1)..(40678): unsure at all n locations
acagcgagcagtgttgtgaacagcaattgcatccttcagtttctgaaactgcaagcaagaacagtttctgataagtggaaaacacacataaaagcagatataaacccttaatgtttcactacagaacactctctataccatcagaaaaagagaggaaatgtacttcagggaaaagaattatcaccaaggaaaacttgagtttctgaaattaacagtgactggccaaaacaataacgtgatattataaaatgagccttatatacataagctgcaggtggacaatttattgcattacaactggggctgttcaatccgggttcactggatcaaggaacatggttgaggagcatgagcggtgggttagcatgccgactgctggtacacacatggccagctaacccatgtcccatgagagggttgttcaaaaagtaaaaatgcctttttgaaccgactattatgaagaattgaagattaagtgattaactacttgaaaggtgaagcaaattaacttatgaacgcactggtgcatccttaccttcgccaaggaacatgagaacgcctccaattgcccgtcagctccacggtaaaaatggaagtaaggaaggactttcacattcaaccgtttgcacataggtttattttcatcaaaatttacttttaagaacaagatatcaggattctccacagctgttctgcagagctgcaaaacaataaagaacacattagtttaagcaacatgctctaaggaagtcctcgcaatataacagtcagctgggtgagatggaaatgttaaaactattttatccatgaaaacaagtaggacaagggcaaaaaaagatgcatgggatgagattataatgttccccattatcattatcgacgtccctaaaattgtctctctgagaacaaggccttcctaaaacattcaaaatacatcatgataaaacaccttgaagtgtgatgtagcagtccaaagggaaggttatttgttagccctagttgaatggccagagcaacatgagttgcctcgtgatggtaatgaagtagcctttttccttcagctagctagcacaacccaatcatggttctgagcaaaagaacctagttactaaagcacaatgcaccaagcttgccacactaacgtcatgcacagatgttaagttgttaacagccatcgatttcaacaataatccatcagttccatgctagtaactaaacacagaaagggcaatatgaaacctttatctggatgcaaagaaggaagagacctaattctgaaatagggcaaatgctctagagatatgataagatgacagttttggggaatactgttacacatgtaatatatggtgctcacaagtttcaagcacttcaggtattggcctttttattgtcacctggtcagcatatgggcagcataagcttctacaagaaggaccagagacctcttatttgggtatctgcagaagcattcaagttcagagggctaaaatagcctcccagtaaattaaaaaaaaaaaggaaaaacacaccatatgcaactcccattaggccgctgtatgtgctgctcttctatatggtccaaatgatacaaaaccaagtgcatggatgcaattatacaacctatgcatgtttgttgattataacttggaggccatatgactccagtttgggttcccttctgttcattagaggcattacacggtttacaaggaaagaaaaaaagggtattgaactattgattactcctaaacatttcttctgtatatggtaattggtaaataatgttgcattacccctacacctacactgttgaagcaatactaacaagatggtctaacctgcagaatataagtcagagaatagaagaagagctagatatagcagaagctagcatgccctggaaacaagccaaacatagttccccccaaaagcacaacatatattcgactatttgcagatgaattcccacattcgagcgctttcaccaataccaactagggaaacacatcaataagcatgagcatgggtgacaaccgcggatgaataggtaatttgtactctataaaacaagaccaaaagttcaaagcatgaaagatataaaaactgaataaagaagagtgagttcagctaatcatgtatgttcacaattcagaaaatcaatactaccctttttggatgactccatcctaattttgacatctcatgagaagaccaagccacatgattctttcacgcacttctttagagcttaagagtaccaatctaaacccatataatgctaaacatcaattattaatctaactatgcaaggaaatttgataaagctcacatgagaaatttcagaattgtatcaaggagaagatcaaaacggcaaatagttatactcatggcagcagtaggaaatgagaaatacccttgggaagagtgccctgcaagaaccacaccaagttccataaaactccacaattacaagcctgtcgcctgcatccctcagtgcatccaagaactcttgtgtagagtggatgtcaatcatatttggaccagcattcttctcccaccattttggttgctcacttttgtctgagacggctgcatgggcctagagcaagatcaaccaaaacgatcaaaacatcagcggcaaacttgtccaataccatacgaactccaaagcacgtaaactcaagataaactagtaggacatccacaaaaatctcaagcaaggacaaattgacacgttttgaaagttcaatagttagttcataccactcacagttgccaaaacatatataaaatcctggcagaaaaggagaaagatgttaattgttaatgtgattcctatcggctaaataaaacaagcacaatacaatatataacaataacgtataaacataaatgcaaagcttatgcatgttttgtcgtgaataaagtaatcgtggagcaaagtctaatctaaaatccacaaaagaatgatgtaagaacccatttcgaggtgaaaaactgcggtcttcaaaataccaagttgccatgcattttccatcataacatgtaccatttcaattgacatcaagcaacagagatactgtacaaagacccagcaatggcacttatggtatgctaggtgatgaagcatgcatgatttcgagagacttgtttggctcaatttcaagttttgaacccctcaaaagacataaaagctagtagtagtagtaagcctttccttccccaatccacaccaaacgcaaagccgtttgtggtgctatagcgatctacagggtcgcgtagaatcaacaaattgacctccgaaaaaccctacacaattagcgcgacgaacagaagagaggagaaagggggacagcacacgtaccttgaggcggcggtggcgcgggggcgagggggcggccaagcgcggcgggcgcgggttggcgcgcgagaggaggcagtgaggcgacggggacgtggaggaggaggcagaggagcacgcgggcgtggaggcggtgacgacgaggcgccggggcagggggaggagggcctccgccatgcgctccggctccgctccgggaccgtgccaacagcgagcgagcggctagagcgcggccgccgccgatgactcggattgcggcggaggcggcggcgggagcatccgagggcggcgaggagcggtggttgccgcgggaggggcgaaggtgtggtggtgggagatggatggatggatggatggattttctcttcgtcgcggcggatgaaggatggaggatggatgggggagagcactggactacgacctgacacagtgggtcccacactccagtgccacggacgtttctactactattccaaatataaacgcacaagatcgtggcttttttccttttcaattacagtttggtctcctcttttttttttctaacaaatatttacaagtgaactcttttttttcctatctccttatacacagctcaaacaacttttgttgggattgaaggaaaaaaaaaagttcaacggagcttctactatggtctaaattagtaagaaccttaaatctcacttaacacctattcttcgctgtcgacactctcatcgtccttcctttggcgtgggcactgtcacaccttcagtcctcctccagacatcctatatatatacctatacaattgatccagttattgtcagaaatgtttaaattgttatgtccgttggatgccagataaacatttgtgatttgttgagatgcaggctgcagcagatcgatccaacgctatatcagtacgtatgcatcatatgattccatctgctggacctctcaatgcttgatgcaacgccggttccccttcctccgattcccccactgtagaggttcccaccgcatccccgcctagcgcctgctcgcctccttcaggtgtcacaagaaacggaaaccgcccggctggcttcccgctcccgtttatccatctctgtcttttatgatttgtagtttggattattcgattttgttttcttcacttcttatcttctctgcaatatataagtacatcccagtgtttggtggtaatcatgtactctacgtcgtatgaagaaagcaattcggatcctctgcattagaggtactaatgcagaggatgaacagtaccacgcattagaatcacagtgttttgaatcctgtagctacagtaaatcgacactgttcatggcattagctaactgttcccctcacatgaacagtgctcttctgcattacggcagacgatccggatcctgaagaaaagcagtacaaaggttggcggtgctcctcctccgaacaatgaagttgttgtgggatccatcccctctgccaatttgaaggcagatccacttgatctccatcgtttccagtgcaggttaatccccaatcaagttaaatctatctctaatcaatattgtgactgatgcaggttgagcactcaaactaatttctttgcaatcaattgtcaatttccaacagatttttgtatcccaatttgctcctccttttttccccatactacactattgcactagcagattaattatcctatttcgcatgactgactccttgattttagtcgcaggtatttcttccatgggaaattttcttccttggtatgcacacaagaaatcattttctattgctaaactatacaattcgtattatgctcctttgttttccaatttttctgttctgtgattattcatgttaccttgcctgtatccaatagctttatatttcatattgcttctcattttatattgtgccagggaaaactgagcagtaaacttgcttcactgaatcattgcagataattcatacctgcgagcaagtttcaatgatgcattgatttataagcagcgcattttgtggacatgatctaataactcgcattaagcaacgagatgaagaattgctgcaggtaattcatggaagtaaaaaaaaatatggaaagttagttgatcctatagacaggcatgtgatttcacagagaactttaagatttagagaagcattgatttagataaagatatttttttttatcatatgcagcatggagtgactcgtagcaatttttttgtgcgatccttccagcttcagcagttttctatgtaaccagcaattgtaagtgccacatatatcctatagggtcctgtctccttggattttcattacaacaatgtcacttgagttcataattttagtaatgatagcatgatctcaacaacctcaaattaacttagtattaatttagtatttatacacctcatgtctatctatactaatataaaaaggaggagttcacccctccaacactacaggtgaaataaatccatctaatctcaaccgtccatctgcatctcatctaatcgccaatcccatcccaccgattccgtccccccaccacgcacggtgactccgtcccccacacgcaatgactccgccccccgcgcgcgattcccctcgctcctcgctcctctctccgtgcgcattctctctcctcctcgcttcgcccgaatcccggctgccgctgcattactctgctactatccccaccggtgacactcctcctcgctcctcctgctgccgccgccgccttcgaccgctgccctggccggtgccgagttctcaagccgccgcgggagccgaggtcttcccctttcgccgctgctttccaccactgcccctgtcggagccaacgtcttccccacccccatccgccgcggccagagccgacgtcttccccacccccatccgcgcggccggagccgacgtcttccccacccccatccgccgcggccggagccgtccccagtcgccgccggagccaaggtcttccccatccggcgccgacgccccagtcccctgttggaaattggcaaacctagcactcaaacctcaccactcagctctgtgtatcactcccacgttctgaagaaacgagagttttcagactgctacagtaactgatgaaactgaagacgaacagaggaaacagagtttggcgctgcgtaaaacctggccgcattttctcggttctcttctattatttatactccgaactccaggagtttgttacaactgaaaaaagatccacaaaactcgcttaaatcctaatgaatcgcgccatcccacgatcgatcacgaccgagtttgcaactaagaaataacatacgaaataacataaaaaacagttagcggctacttctacgttctgaactcatcgtgaacacagcacgagtcaagctcgattatttcgtaaatttgaaaaactaaattgacccagctacaagattacattcaacaaacaccccctaatattgtggctgtatctcaagcattccaagtctgccttgcagctcctgaaacttaactcttccaagtgactttgtcagaatatcagcaacttgttcttcagttctcacgtactccacttcaatctccttcttctcaacataacctcggatgaaatggaaccgcgtgtcaatgtgcttacttctgtcattcagtaaaggatttttgcacaaggaaattgctgatttgttgtccaccttcagaacaacacacttcttctcatcacctgtgatttctgaaatcaaacgagcaagccaaattccttggcaggctgctgtggttacagctatatactcagcttcacaggatgataatgccaccaccttctgtttctgtgactgccatgtgatgatattttcacccaatgcaaacaccactcctgtagtgctcttcctatcatcaacatctccacccatatcactatcacaatagcctgtcagtggcacaatattactctgctttcttccataccagcagccccatccaactgtaccggcaacatatcttagcaaatgttttgcagcagcgaggtgatctgtagcaggcttctccatgaaacgactcaaatacccaactgcataagctaaatctagcctggtgttcgctaggtatctcaaacttccaatgagacttctatactgtgtagcatctacaagagaattggtactttctttactcaacctcaatcttgcctccattggaacctgacacggattgcatccatccatgccatttttcttcaagatattcagagcatatgcagactggtttaaagcaattccagtcgctgtttgcttcacctgaatccccagatagaaactcagcaaccccaaatcactcatcttgaattctttttgcatttcaaccttgaaaccttggatgactgaaacctgtgagcctataatgaccagatcatccacatacacccccacaatcagtgtagagtgctcactgtttctcttgtatactgctggatcagaagtgctcccttcaaaacccatcttaattagtgtggcatctaacttagcataccatgctcttggagcttgacgaagaccatacagagctttgtgcagacgatacaccttagcttcttcaccagtcacttcaaagcccaatggctgtgagacatacacctcctcttccaaatcaccattgagaaatgcagatttaacatccatatgatgcacctgccatccctcttgagcagccagtgctagtaacgacctaacggtttcaatccttgccactggagcaaacacttcctcaaaatcaatgccatgttgttgcacataacccttagctaccaatctggccttgtacttcacaatgctgccaacaagatcacgcttgatcttgtacacccatttcagacctatcggtcgatgttcagcaggcagtggaactagactccacgtcttgttttcctcgatgctcttcacctcatcaatcatagccttgcgccagcaggcctgcacttcagcttccgtgaagcttactggctcatcggccgccagaaggcacagcccggagtactgaaactctcggacaggactggtagtctcgttgatgtttgcaagtgtgcgatagcgtcgtggcgcctcgttagatggttgcgacgcatcagtcggcggagtggcaaactccactcagcttgtctgcgtggtgctgattggtgtggagggagacgccggcgagtgcacacccggcgatgactcccacaccggtgtaacagcatcttgtggctcgtctgcgtcagggcgtgctccagagcactgttcatcatctaggacagagtgaaaagtgtacgagatagaaaatatatcagcagggtcagcttcatcatcaccggtcccggttgccgcccagtcccacttcgcttcttcgtcgaacaccacatctctgctcacatgaacgcggttagtcaccaggtcgaacaccctgtaagccttacttccgtcctcataaccaaggaacaccatcgccttgcttctgtcctccagcttcgacaagtgtggtctcacattcttcacatacgccacacagccaaaagtgcgaaaataatgcacattcgggcgcctgccataccaagcttcatagggtgtcaggccgtcgagcgccctcgtcggcgaccggttcaggatgtgcactgcggtgacgacgacctcaccccaaaaacgaccaggcatctcctttgccttcaacagactccgcgccattgccacgatcgtctgatttcgccgttcaacaacaccattctgctgcggtgaatagggcaacggtgaggtgacgtcgcacgccacgccctgcgcagtactcaccaaattcaaccgaggtgaattcacccccccccccggtctgtacgaagaactttcagttttctcccacattcaagtttcaccttcgcctggatgtccctgatggccgccggagcttggtctttggttcccagtaggacaacccacatatatcttgacatatcatcaacaagcaacagtaaatggcgtttaccacctggcgtggctgggctgattggtccacagagatcaccatggacgagttcgagcggctccgttgctcggtatttcgcctccgacgggaacggcgcacgccgctgcttcgcgatctgacagcaatcgcaaatgcgatccacctgttcgatgtcaggcagaccacgcaccatagcgccctgagccagccgacgcaaggagtcgaaattgagatgcccgtagcgtgcatgccacaaccacggcacctcttcacagctcgccaccaagcatacaggctgagccaccttcaaatccaacaggtacgagcgcccttcagtcctcgtcaccttcgcaactagagcgcgcgccctgtcccggatcgtcatcacaccatcgtcaatgtggattgcgcagccgttctcatcaagctggccaagactgatcaagttgctcttgagttttgggatgtaatacaccccagacacgatacggtgtgccccgttgtagcattccagggtcacgtcgccgaagccgcaaatgtcgatgacggagccgtcgccgaagcgcacgacaccgcgcaccgtgtcatcgaggtcggtgaagaattctcggtgacccgacatgtgattgcttgcgccggtgtctaggaaccagcgatccggggacaactgttcatggcggccaacatgcagttgggcgtgcggttcatccagcacgatcgtccctggcgcggccgtggtgaccatcgcactcgcggtcgccagcagcagaacaggctcctcctgagcctcagcaacatgcgcctcttggcgacgctcacgccgtggtttgcggcactccttggcatagtgaccataattatcacaattgaaacaacgtaccgatgatctatcacgcgacgccgccggcgcgccaccatccttgccggagctgccctcaccggagcacccttgtcctccgcgcttgccgcgccactgcttctttgagctggacgatgagccagcaccctttttaccaggagaggtgtcctgcggctccttcttcttcatgcgagcagtccattcctgctcggtgagcagcaccaagccacccagtgcctcagctcgccagacgcactgacaggcttataggattcgatggcggcaaggcgcccgaccagctcctccagtggcatggtcttgagatcaagcatctgctcaatcgacaaagcaagctgatgatagtggaatggtacaactcgcaacagtttcttcaacatgtgttcgtcggtaagggtgccacccatgtcacggatatcgatgacgagtgcatgcagacgaagggcgaaatcctccaccgtctcgccgtccttgaactggatggcctcatactgagaccgcaacgcctgctcgcgcgcttcccggacacgatccacgccgacgcgcatcgtcttgatcgcgtcccacacctccttggctgtatccttcttggacaaagggcgcagcatctccttggggactgcctgaagaagagcagccatcgcttgccggtcctccctgaactcggcgtagcctggatcaacagccgcccacaggccttgcgcctgcaaattcacacgcatcaacaacgcccagtcggcatagttggttctcgtcagcacggggtaacgcagtggcacgcatgtctctcgcggtgcctgctgcatcacaatctgcccgtcattgccggcgcctgagctgccgcttccgccggcggctccacgccgccccggcggggtgtaccgtggatttccgtcttcactcgacatggccacataatcggcaatgaaccgctctgataccacttgttggaaattggcaaacctagcactcaaacctcaccactcagctctgtgtatcactcccacgttctgaagaaacgagagttttcagactgctacagtaactgacgaaactgaagacgaacagaggaaacagagtttggcgctgagtaaaacctggccgcattttctcggttctcttctattatttatactccgaactccaggagtttgttacaactgaaaaaagatccacaaaactcgctccaatcctactgaatcgcaccatcccacgatcgatcacgaccgagtttgcagctaagaaataacagacgaaataacagaaaaaacagttagcgactacttctacgttctgaactcctcgtgaacacagcacgagtcaagctcgattatttcgtaaatttgaaaaactaaattgacccacctacaagattacattcaacatccccttccccatcgccatccgcagcggccagagccgacgccatccccatccagcgtcgtcgtcgttgccgaagttcaccgctgccgcaagtcgccccgccgaggtggttcccacagtaactttcaattatcatctgtttaggtctgtttatgtttagattatgtgcatgtgtgcatccagcaatagaactactgttcagggctagaaggaattcagttacaaaaagatcctcaatgatctgaaaaagattctgttacaatggtactgcagtcccaagatccagagcttggctaggtatgatgcacttggcaatgcttaactggttctcaattttctgcttcacgggtatgttgataacataattaaatggttgtaggtcattcagctttaaggcgatcagtgtaagaatgttggtatccaaccgggtggcatccgctttgcaaaaaatgtctatgtaaatgtaatctcatttttttatgcatggacattatgtctttttttatgcatggacataggtttaatctctatgtagattaagaagtattattgtctgaaaatatttggtagctgcctgaaatattatttgatggttatgttaataggatgtacagaaattatacttctcttatctggaattgcaacttcaactgtcatgacgttcaccatgcctaagatgttgctgactaagcttatgtcctaatctaggttctgaaattgtagctagaagtttgaagaaatagtattttgtgcaaatacaactgatgagcaactcagacaagaacccatatcaggtttgttttctcgagaaattgcatataggaaaggggtgagattagcagtaatgtttctttattcttctaattgcatatgcccgattgcaagcggtgttgtcacaagcaggaaatggtaagaactaagagaagtgtgtgtatatatgtacatacattatcagttactttaaaggtcagcaggtcacaaccagaaaattgattttctcaatgttcttgcaagaacatttaaaattttgcttcacattgtaaatttgatgtgtgattgagcttccagggtcatcagcttcaagtgattgagctgatatactgcatactgagattctgcggactaaagatagtatattctttcatcatacaatttatcgagcttcatttatttggctaatatttcttatggaacacacatgctgatttcagtctttccaatttgttctgccctttttggtacggaatttctgttacagcttaaatgatccttggaacacctggcaagttctttcctatggtcctatttaacaagaatcaatcacatattttgtgcaaatagaacatgtgttggcaatggcaagttcattggtctacttattacttaacagtaatcagtgaaatactctcagcaaaatttaagtctgaatttgttatatgttgaacactgaaggacaggggcggagccaggattaaaagccaccggggtcatcaacttaaagcgtttgacagaatggaaaagaagaagattaaagaagacatgcaaaatgagtttattgttagcacaagattaattgagtattagttattttaaatttggaaaatgtattaatatgatttttttaaaaacatttaaagaattttttttgaaaaaatatacaccgtttagcagtctaaaaagcgtatacatgaaaaagagagcagaattccggtatataaatgaacaccgctataattttgatttaactaaaagactaggtagatcattctgttctctcgattaatgcaaaatcttttttaaagttgttcttgtgttttttatcgatcaccagcaacgaatgaatgataattggaataggctaagagcgtttcctttcatcatacaaagaggtataaatctgaaattagctagtactaactgcttaacagacgaagcaaaagcacaacgaagaaacaattaataacaatgaggcttaggaaacaaaagaaaactgactcggactttatgcatgctaataaaagaatcattaatcaactaggatcgtaacaccaccaagtgaattgttttagtttcacgtactacgtgccagctgaagacgatggctggggtcatttaccatctgatgccggggtcacagctggtagaaattgagcatcaccgtgcattcgctggatgtcatcggtgtcagatgaccccggtcgttagactgtggatccgcccctgctgaaggacatgtacagcgagttagcaagctaattcagaactaaagtatagttgattactagaatgtactactttatttgatcagaataggttaattattcatttgctctttttagtattttactggagtataaaggtctgtgctattcttggttagcattaaagttgaaagcttagatactttcttgttttccttggagttgtggggttgtgtgagaacgatgtagatgttaaaatgaattgtttttctgattttccaactgtagacctgaactttaagttgctcatgcatgatagccatgggcaaacccgacatgcacattatgcagccaagaagaatgcatgctgactgccacagcgaaggagctagagaagtgctgccggaatcaaatagtttactttggttgttacatgaagatctgcttagccattttttctctgcttaaaaatatgtggcagtgtacgatgccgtgtgagataaaaatgtaagtgacaatttttggtaatttatttatcaaatattatgtcacatggatttcacgtgcaagtgcatgtttctctagaaatacacacggcgcatgttttttaatagatctatcaaaattgtcagtctactatagtctatgaaactctttatttacctttagaatttgtatggagtacacggcataaaaagttacatttattattctattatatatatatataatatcaaaacatgtcttgcacgtgcacgataactagtatataaaaaaaagaccaaatgaaagaaactgtgggcccacgcgagaaatcctaaccacagcaaattcctccacgcaaatcatccgcgctattaatcgcatcgctgccccactcgcacccgctccatcaccattcatgggttccccaaaatcacgcccgtgcctcctctctaagccgttgtcatcgccaatctctcgcctcacaccccatgcaatccctagctgtcccctctcccaccaccatgtctaccgccgtcgtccctaaagggagaagcaccatctccgtcgaccttacatcatcgacgattttaaagccggcccgccgcccgcatccttcggtccttcccccattgctcggcgccgcaacacagtaacagcaacaacagctgccgccggacccaaaatcagcgttgtccctgttttggtgttgtccgtctcgccattccgcggcttcgttggtcacgccgccgttgcacgaacgcaagagcgtgagggtccttctgcggcggttcgccatcagccgtctcgctgttttttatccaccatcacaatctggaggcctcactattttgccacatttgcaatctgaagcgtgcaaatgacataaacaacaaatcaggtttctaatctccctttctcaatctcacttgctatgctttttaatgccaacagatcacgctttcgtgggctcttataagagagcttccaaataatttacttaattttactggaagctctgatattcttttgtatggaaattgccaaatattttaggctccttttatattgtctttctttgcagatttgattaatatgcaactctgaagctggtttgcacttaaggaattagtaattgaagggaagaactttgccctctaattcatggctcactgctttcgaaacagctaaatcaatggcttgtacttgctagaatttagactccacattgcaaattgcaatgatgaactttgaaatttcctggttcactgttttctcctgtacttaaattgaaattatgaactttgttctttattaactctttcagcctctataagttggaacaccagtaattaaaatgttgattaagtttatttttgtcaatatttaaataaatatttgatttggtgtatttaccttctcttctctagatagcaccagtttcaattaaaaattagctgcaataatgtgctctgaattgatgtggaagctaggcaaaccaattgagtgttagattgttaatcaggttgttgatgtcgcttgcggtcactgtcatccctagcgtagcgtcttttgtcgcccagggttatgtaacaccacgattactatgttgccaacatacacacaattgttttcagcccagatatgttctctttcattgttccttcaatttatttaacccctttcaggatggatgtgtgtgcaagaaggataggaattcaggatggtagttggcgatctcatgcaggtatgaatctattatgttttactatcactttgtcaatcattgcaagcactctttttatctgaagctttggagacggagtattagagtttgtttcagtatctaaaaattttctcctaactatcaacacagtttatctgaagcttttatcgtacaagactcagctcgatcacttattccattttatgtgccatggaatattaagattgacagaaaaaaaatagcttgcatggagcaattcccctgccaatgcatctcacagtttaatttcttattgaatgttgactatccctaccaatccatcacacaattccttataactgaatgctactccattcaattaatttcatttgttgaactccttaccaatgatcaatctgttcataactaggattaatgggtgcaaagatattgcctagaccatctttaagaatttattgccttcttcgttcaaatttggtaatatatctctccccatgttggggaatcatgtgtcttttgtaccgactacacaaaggttcttaaactggccggattgtccatttcacttcagaagcttattacgttactttcttggctatatttcctgccatcgcattttacatttacaagtaggaatgaagtgatcaccagctagatagctaccttcttgatcactacgacgtgcatgcttcaaggatatgcataaatccaaggttattctcatcttacaaatctctctcgatattttccctagggatatagatattcgaaaacatcgagcattgggatcattttatacaagaaaatgtcgaggagatctagaagctattgtaagttagaaggtgtgttgtttcattaaatatatcatatgtgtatttctgaatatatcttctttgttttgtttttccaatctggcactcctccgctactattctaggtaaccagtccacaacctgcaatattattttgatgtgtaaaatttttattatgcatcataatctccatatcagcgcactgtcagattacctatataaaatgagatgtaagatgtcacaaacgcattgttaatttatttcatttatttgcttcttctttcagcaacttttacaggctagaagcagttctacaacagatggatttgccttaggtatttttttatactagagcacaaacctgaatttctctaccttttacagttctagatggagacatgaaatttctttaatggtaaaatatattggttgggtttgattagtgtatattgttagtcatcattgtattttattagcgaaagtattaatattaccatgtttcctacaattgatgctctacttgtgatccttatttgcctatgaagatttattgtgtcttggtgtttttgtgagatggactcaaagattctgctgttcgaaacgtgctaaatatttagacgttttatatttgcttttataattgttcaaagtacaaaaaaagggtaattctgaatatgttcatatacgttcaaccttattgtatcaagataagaggtcaaactgcataaattatctgacagaagccttagacaagatgagaatacaagtaatcggttgtttctgttgaagtagtatgcctttggcccttgccatgggcatggaaatgcaaggaattatgggcctgtgccctgtagtctgtacctgcttaagggcactacatttggctatgccctggtttcttgagatgtaagaatttttttctaccaccagttgtggtgaagccaattacatggattttgttcttagtcaggttagctgattgctaattgaagctttgttgtgttgctttctatctacattaaagagtgtagttttataaattgggatatgactctacaatttagtgttcaaataattccttatgaaaatatagaatgtttgtattttgtttctagattcagatgtaatatcgatggagacctaagctagaacctaaaccaaagcttttctaaagagctccaattaaccataattgtttcccttatttacaggctttcaactgagtgaattcaacgttgtagtgttcaagaataaattagaagggaaaatcatttattctgtattactctctctattttgtttaccttaccataataattatggatccttttggtcaggttcttgaatgattactggccattttttttactgaactactgtggactgccatgtctttttttgttgaactactgtcggctgaccatgttttcttagaaacatagaaatattgttccaaatggattatattatatacataggccgtgtttagttccttgtcaaaattttttttgacgtatacagacacacatttgaagtattaaacgtagactaataacaaaagaaattacagatttcgtatgtaaactgcgagacgaatctattaagcataattaatccgtcattagcaaatgtttattgtagcaccatattgtcaaattatggcgcaattaggttcaaaagattcgtctcgcaatttacattcaaactgtgcaatttaggtttttttcgtccacatttaatgctccatacatatgtccaaacatttgatgtgatgaaatttttggaagtttgaagggaactaaacacagccatattcgtgctttttgaaacaacagggtgttacaactaataattaagactgcacactttctcaaaacatgttaatagggcaatgcatgatggtggaaggcacttaatgtggaggccactcatcaaaatatgatctccgaacatcgtgctaggtaccttttgtaattaaagctcttgatcatttgtaaaacttgtcatttgaagaaccgcgggataatagatcaggcattaaggaatttatccttaaatttatctccgtgctattttcatgaacttatccatcttgcctcccaaaatgaactttatgtaatagatatctaccgattgtttttcaatcattctagcgccttgaagtgagtgcattggaaaccgtggaagtgaaaatgaaactcagtttatgtctttgttttgaaattgaaatgaaaattgtgcatgcctttttcactatcattttagatgaaaacagaaacagcctatgtctatgtcacatggctctcgagaatataatttgacacaattgggaaattgtaaatgtaaatcgtgaaaacgtgtattgcatgtgcatgattactagtattgataatattgcagatttggtgaattattcatgaatcccattttctcatatggtggtacttcaggttagccagtcagtttgcataatttagttcctgaaatttttatgtatctcggtgacttttgtttgtttctttttagatgttctgatgatctttagacttccatctaggacacgtataaataataggaattgtaccaaatatttttatattagcatcgtccaccaatgtcctaccctttgatcaacaataagtgggttctgttatacctgtcattcagcaatggtaatagtaataacataacatatgaaaattttcaattgttgccgctgcaagaataacaaatttgctcttttggtttaaccttatccctatcctatcggttcatcatgcttagataagttcctattttctgcaaagcaccattttggggctttatatattaattaggaattgatatcggtgctctcaaaatgccatgcgtgtttgtttctttgttatctattcattccttgcgaaagttgtacattcggaataccttctatattgcctcactttcccttcttttcttattactttcattagctcactaagtgtgagttgatcattaaaatttgtgtcaaatacatttatcccgcagcaacgcgcggtgtatcatctagtttttatggtaaccgacaccatccctctcctcaatctccggtgtgctttccttcaaaacccaaattgggttgtactgcagtcttaagctcacgtttccacgttgatgtcatcatcgatcgaccgcctctcgagcctccaccgctctgtccatccttttttttgcccaagcttagtcattgtgtcgttgtcccaagcttggtcaatgtgtcggcaatgtcgccaaccgcctccccatcctcttccaccctgtgcccaagctccggccaagctgcgtcaagggtcccttgcatggagttctattgtggtgtttgaaaccgagaatttaaatatggttaacttatatgtattagaaatattttatttaattaaagtggtattttttttctcttatatttcaacatacattttatgtggtggaaaattagtgagtcggatgagtggatcgatatgtgggctaatatgggtcgggttgcgccaattttttcttgaaatcaatcggtatatgcaggtacttgaggtcaactttaatcaattgcatattggaaccaaactcaaagggagttgtggtctaatatgatcaagaatggtatgtcatgaggtgtgatgtaatcatgtaaatgtacatgatggacggataccacgtaggagactgttgcaattcggtggcaaaatgaatgagaaaaagagaagagagaggaaggtggtctaagccaccaaggcccagctaagccggcttccctctccctctccactagctggtccaattcgccgttatatcactgaatttagatcaaattactacaaaaggcttacttcagagttgggcatgatagacagtggtggagccagcaccaccgtgaagccgggacgactagtagcattttctggtgaccaactgatatttatacgcgtcgatgactaacggcaatggagattgcatatgaaaatcagattgaaaaacatagcatatacaggaatttaatggcacagagcgttcgaaggatgggtctttccacaatgggctggataggtggggaatggggttgggccttaactgatgatcgaaggttgcacagtacatcttgatacacatcgctataaactcgttttcctgattttatcattatattcctttgaaccttttggatcaaatcatagtgctatgcaatcatcgtaatacggaaaacatatattgttcccattaaacggaaaacagtcaccaggaatgtcatacgaagtacccaaaaaaaaggacgcctaaaaccacagtattaaactgcagcaagatttatttcacctctagaaatgcaatattttcaaccaccgtcaccaccacagacacaggcaaaatgggaaaaatacaagatacagttttccgagatgtggcactccagcagggtacagaattttacatagtcaatagaccctgaggagaaagcagcatagagaacagaatctaagaaacggagaatccacagtgctttcttcacaatcggctgaatttatacaggtttggttcacaaactgaccacacgaatccatccgaacgctgtccactcttcagactagaatcaggaacttctgcgacaactccagatctccaggattatttgcttaaacgatatttacactaatgtgtgtgatacacgtgccatccatcgttgagtcctgcaaacacaggttgaacattcaagtttctaaaatcaaaatttagatcagtatttgcatatgcttctgatgagactacagtcagaaatagcaaccaacaagcaacaaccaggcaagcaacatatgattctgaccccaaataaaaacatccacaagctagctactttctgcatgttatccacagttctgtacctatcaattgttcggttccaagcagacatgcggggcgcagatgaggatggggatgttcaggatcttgtcataatatagtcgtcagcttgtaactgacagttcataacaaaaccaacagatatctcatgatattaaaaagccatgcggctaaggcatctatttctacataggtttctgagaattattgccaacatcagttctctactgtcctaactcaaatgctcagtttgaaattggatggtcaagcgatggcaagaatgaatgcgatataaatttcccaacaggatattaatgtttctattgacagtcaactgaacgctggatcttgattttcattttgaatgggcataccgaacacccaaaagaacagttctctactgccttatcctacatgaacccctgctaatgaccaaatggaataatccaaatcccatcaggatatgctactattttggcctcaatagctggcacaccaatcattgtgctctcacaaaaaagaaaaaaaaagagaaagaaaatcataactgtcactgaatttgaaacaaattgatgcgtacagtacgaatatatatttctgaacaaattggaattatatgtactaatagatatgatgcttaaagtttaccacattataacatgatattgtcagatgccatattgccacttaatagctgaaactgacgtgtacgaagttgatttgataaaaaaaagggtcagataatggcaacaggaggactacattatactagctaatgaatgagataattctacagcagtagtactgtataatagtacaggataatgaattttcagcatgaaacttaaacccatccagttgtagatgacttctacggataagtacaagagtctttttgctattggtcagagacaattaacaaagtagttggtttcaatggctcatatggctacacggtttagcccaaaaactatggtcacatgacgtctctatctctcttgggaacgtcaattttctggacaccccttgaagcacaaggcaaattaagctcgttgagtttgaccatgcaattccttcttgaggacgcattctaatcgatcccaatgcaagcaaacacatcaccagagccaaaattggctccaaattgatcacaagttctcaccaaattcatccaccacacaactaattccttggtttgtcactaatacatcatgtagaaattgggaatttgaaaaatgaaacaaacaagaacagcaattcacaaagtaaaggagcagcaatcaagaaggaagaagatgattggggaggcaactcacatactagtaggacggctgcggcgggacgggggtgtaataccggccggcctcctcgtcgatgctgtcggcggggcggtggaagacggcgtggaggaggacgatgacgacgccgacgagcagcgaggtgaggatgttgacggtggcgccggtgaggaggaggaggacgagggtgagcacggagagcaccgcgagaacggcgccctccccgacggcgcggccgcagagcgcgagcggctcgtcgcggaggaagtagaggaagagccaggcgaccatgcaggcgaggaagacgatgagggagaccgggtgccagagcagggagaggaacaccacggcgagcaccacgatggcgtagttcatggagaagtggcccaggttggcgcgcgcgcggcggtacgcgccgccgagcccgcgcggcacggacgccgcccgcgggtcggcgagctcccgccacggccgccgctccgccagcgccgtcgcgccgcgcgccttggcgcgggagatgaagtcgagcggggaggaggaggaggagcccgggggcggcccgtccgaggacgaggaggtcgggatggtgccatacttcgacatggcgcggaggcggaggcggcggacggtggccggcgccggcgagacgcggcgagggaggcgaagtggacttgacgtggaggagagggagggagtcttgactctggaaggggcgaagcgaccgcccaattaatggagaggaatggcatgggtggggcccaccgcgacagctaggtggacacgtggcggtggaggttacggcaagatcgtggccgttggtttcgattcgggcctagtgaagttttggttaggcaatagaaggcccagaatgaatgggctttttcctggtaactaaattggcccacacgtcaggcataggtccgttgcggcccaactagtatgggccgcacattaggcgagatccagtttcggcccatgtagtacgggccgccatgccattccggcctgatataaacggggctccagtttggcctggtcgcattctggcccatgttgtgatcttctgtttatcacctgctacgtgatgtgtgttgtgttgcctgcttgattttgcaagttttgctcggcaaattgagctgagattcaagttgagaaaaacttgcagtaccaattgttcatttgtttctatttactctctccgtttcacaacatgatatcttttggtctctttatctctggactaaattcactaacattcatataaaatatatatgaagatccatacatgaatctgtttaatacataaaatgtcttataatataaaacaaagtactccctccatttcgaaatgtttgacgctgttgactttttagcacatgtttaaccgttcgtcttattcaaaaaaaataagtaattattaattctttttctatcatttgattcattgctaaatatatttttatgtaggcatataattttacatatttcacaaaattttttgaataagacgaacggtaaaacatgtgctaaaaaattaatggtgtcaaacatttcgaaacggagggagtaagtaagtagtgatttactatgaggtgctatgctcatccaatgttgctcttcacaacgtcaatggaacccgcatccgaagaaagggatagtcactagacgattaaatctctatgtttgagttttagtttgcaatcttgctagagaggctgaaaattttggatagcatatgatctgatcctgtaagacataaccttccaaaatctgtattatggtatcttttgacgtggagcaggtctacgtacacatagaactcatttcacgcttatgttcttacttcatgtacaatatgaaataaaccatatatactacagttgtaatgtgtttgtttatatgctagctcggacctatatatctacgttattaacaaatagactatgcactacttaaaaaaacagccacgagagtctttttactactcggtcggggtccagtggccgactgcctgcagagattcattatcgtagatggcagattgaggacgtcacctacgataatggattttcacaagcaacatcataagccagccgcctatgaaacatagccactataaggccttctccccgagacacacacattttatccaaactctttcttctaaaacaagtaaaatgatgaaaggggaaggcttttaactcaaaatttttcgtggagttcgctatccttagaccctttgatttgtaaaagtagggaatttgtaggattttaatcctacttcccccatactaatacatcgtgagggttgctatggacaatattaatgtccgttatcagtgcaagctcatgatgtcctaatcttttcctcaagaacgtaacatatttattctggtatagattagttactataagcttctttactaagtaaccccctaccccactactaaggaatcctagcatcaagcatcaaatgctagctaatggtttccccaaaattatttgtttttgtttaagggaagtgcatggggactaatgatttcatcacttggcgccacatactaaattagttaaaaaaaacaaagctcctttggacctaacaaacttttggcgttggtttgaccactctgtataatgatatctttgatgcaaagttttgaacagaaccatgcaaattaagatatatgaaaagaggagaagaacctcagcatcagggcattgtgtaatcatactctctgccacctctaaacagagtgattaatttagaaactcgttgaaccactttaatggcatgggcttttggtttgggtactctctggtcacatcattgcttacagccagcactgtggatatactattaattactagctcactaattttaatttactccaaagtgctgtgtggtgatgctatcaattatgccatcagcggctacacatgtgtttatctgctctctgacgtgtcgacactcgactccaagaaaattaggagtagcacatgtagcctagtggttacgagagtctcagtaacatttaaggtcgttggttcgactctctatggaagcgaattttctaggatttaatggcattgtgctttcagtggtaggcgacgtacccgtcgaagcgaggcgtctgtggtgacttcgtcaatcttaaggatttgccaggccagtcttcgaagatgctcataggggtagggtttgcgtgcgtgcgttcataggagtgagtgcgcgtgcattgtaagtgtctacgttgtactgtgtaattctaaaaaaaaagagtgctccctccgtctcaaaatacaagaacctagataggagcggatgggacgtttcctaatactatgaatctgctcctatccgctcctatctaggttcttatattttgggacggagggagcattagggtctgtttggttggagggactaatgattagtccctccactttagccccttttagtccctaaagtcccaaacaagggtgactaaaagaaataaaagggattaaaagtacattagttcattagtcctcgtgggaggagcttgactaaaagggactaaaagtacattagttcattagtccttgtgggaggagcttgcagggactaaaatgttttctttccacctcttgtcccgctgcctccacatagccctatccttttctcatctccctcctttcctcctctcgaccccgcaccgccgccgccgcgccgctaccctgcgcaagccaccgcaccagcttcgcacaagagccaccactgccccgcgcaagccccagcggcgtagtgcaagccgccgctgcccgcgcaagccaccgctagtcgggcaacagccatcagccatggcaggcaacgaggaagagccggtggatatcttgtccccgtcacacacacatcaccttcgactacggcttctcgcaggctgtcaggccacgccggatctggcgtcggcttccactttcgggggagtggatccaggggcctagatctgaactcccaggccgacgccttccccgactttgcctcctaccaccaaatcctgcaatcggatggccatgacttacctccgattcgccctggcagtagatccaccggcgccctgtcgcgccctcctttcctaggggtgagacgcgacataagtcgtggaggaagaggaggacgaggccgcgccaggtccttgaccattggcgcgggatccgccagggggatgcggggattcgttcccccggctcagcttccagcgatggaggtgtcataggccatggggactatttggacagttatgtgatgaatcaattttgggactgggttgccgatggtttgtggagtttgaaacaaatgtaatttctggtttattggtcttgtggaacatgtaatttgtattaataagcacttgcagtaatttgaggaacttgtaatttgtattttgggactgcttcgatctatcaattttgttcatgttctagcgtgatgtttcaaacctgtttgcaagctgattcctgtcattgccgatcactgatgcagtgcaaatatgtgatctgatcagcaaatgtgtgttccgattcctgtccttgccgattgcatggttaggggtaatatggtctttgtacagtacaattaatgatttttttagtccctacatccagacaaacagggactaaaatttttagtcctaggactagaggatccaaacacccttcccttcaaaacgcagaatagaaaaaacacaggaatatgaaaaacgtaggaattgaaattgtatatttttctaatcctacaggaattgaaaacacaggaaatggagagaatagccctttgattataccacaggatacactcaacaaaggaaagtttcacaagaggtctaacctcttgcttattttcctatggaattgatcataggaatgcaatcctatggaagttttcctatcctcttccaatgaatcaaatggctctataggaaaaaatccttaggaaaatgaatcctccaaaattcctttgctaatcctccatttcaaaggggcccttagtatcacaatataaaaataaggggaaacatccactacaaatttggacgtggacagttaaacttatctatctagattcgtagtactataatatttcttttcgtatttagtgtccagttatgttttttaatttgatactagtttgaatttgctagtatattatatgacggaaggattagtttttccatttgttgacactcgaactgaaaccttactggtgtgtttagttcacgtcaaaattagaagtttggttgaaattggaacgatgtgatggaaaaattggaagtttatgtgtgtaggaaagttttgatgtgatgaaaaagttgaaaatttgaagaaaaattttggagctaaactcagcctctgaggattttgactggcaagagacaagatggattttgtttttcttgtttgagagtgagaagtgagaaggaaaggaatcttcaacttcctttgcatccccaccaccgaggtcccatctcagatacccgaaatcgttaggttcatgagtttctctatagttattcgaggacataaacgactgaattaactattataaatttgaatatgagttttataaaaatattacaaagaaaaaaatgtatatagaaatcttttacgcgaaatgtactatttaggagcttggaaagcatatatgccaacgaaaatctaaaattcagaatgaaaataaaatacaatgcctgtagatattagatgagcaaatttaatgaagctatcacaaagaactctgaagttgcaaaatagcgttacaaaggaaaaatgccattgggaatgacactgacgagagtctctctacctgtttacgttaattaaaaaaagaacttaccattcatataatggttataaaggcagagtatctctacctttttacttaaataaatggtgttatgtttttccatccaaaactgctgttattgcatttttttacagagagaaattaagttccacgaaagcaaacactaccgttgctttctctgttatatagtatgctacagtacgatccttttttttttgttttacatttgctacgattctattctatacgatgtgaaatctactctatactttgatatgtaataaataatttgttttcctgaatttattaagacaaattgagcatgatgttgaaaattcaactaacacagagagagacaggatccggccggccttctagtttttttttttttgagaaacacagtacaaacgcagacgctcacaacatgcgcatactcacccctatgaacgcacacacgtacaccctacccctatgagcacctctatgagcacctccggaagactgggccgacatatcttgagattgacgaagtcaccacaggcgcctcgctgtcgatgggtacgtcacctaccactgaaagaataattagccgtaaatgcgagcacccgtgtcaaatctaggatttgaacccaggtgggctggttccaccacaagaaacctaaccagttgagctatgctcacttcaccnnnnnnnnnnnnnnnnnnnnnnnnnnnnaccagaaaggaggaacatgaagatgtataatgtgccagcaagttgaggataggaatcatgtattttttttaaccgccccatgttaggtttgactggagcatgagttctaaacgtctattccgatcggctacttccttattctttgtgagcacatctttcgaactactaaatattgtgtttcatacttatgtataaaagtttctttaagaaaatcatattaacttaattttcaagtttgaaataattaatacccaattaactcgttttgtgtgttaccgaatagatgagtccaaaacgctccttcaaatgcagccttatagatgtcataggtttataaaatgggctagtgtacttttaggtagtcgtgtcaagatgattaagcaaaagttgagggtgagagtaggactggttctaattgcgagcttttactggggttgtggctaactaagaatggtttttttaggttgcttacaaattgttaatttgatgcagcgctaagggctcttcaggcagcctattcgacaatgcacaatataaaaggttgatggataatatgattcagcttcgccatgtggatatgctacccgacgatctagaaattggattgtggtgtttggtgtgtctagaaatttgatagtggtgtgtctttgtttttcgctggtccatttgttccaaggttttcggctatgagggtatgttagctcatctgatctttggctgcctgtgtggaaggttggagctaaaaacggtaaagctggtatccccagctatgtgttctttagctattgttctagtgtactccctccataaaaaaatccaacgtagaaaggaatgtcacccctcctattagtacaacgaatctggacgaggaggggtcatatcccctcctagattgattttttttaggacggagggagtaagactctgtatgttgttttggctttttaaaaagagggtactgtctgaaaacaacaattcaaccaatttaaatagtaggccaaaatagaatcaataaaacattgagtgaatttcaccttagaccgcctcttcttaataaggttctatttattttgtattttcacattaggccagcttttttcccctttggatttctccttagactacctcttttacttattttagttaggctttgcgtgccacccggttttctctctaggcacactcctcttatctatagcaccttaccgatgttcaccatctatatggattaagggagtataagttgaaacttcagtaatgaaatagagctcgacctgatatacacttagaataaaagaactaaatatacgttgtttggagtcttcaaaaaattaataatgattttaatttgaaatccctatagctatcactacaaaccaacaagtagagaaagaagagaggggggggggtgtcctagttggtttgtggcttggtgatgtagttttcgttgccttggaagggaaaaattgacgaaaatggtactcatactttacagttcaaattctttctaataaaatctagcagcttgacttttgtgccatggtattttacaacccatttagttcactgcaatggtactgagcagaaaatatttgtaatgtagacctatataacaaattagataaaatatttatttccttggaaaataaatatttttcctccttattgcacgaaaaacgaaaccatcgaattaagttaggatcgtataatgtatatctaagtcaaggttaactaactttataggaaaagcatagcaattaatattttttaacaccaaacatatattataaaagcatgtttaactgagaatttaatgaaattaatttagtattgtaaattaataactgtgttcttttatatgcttgatcaaacttaaaaaaaagttttacttagcacacaggaccaaaggacctcacacgaagggggaatctatttctgtgtgccactagctgtgggctattgtagatatcctgcccccctttatcattttctgggattgcatgcccatttgtacaatattatacagagtatttgcatttgtttgcatatgaggctgcaatgtgcatatgccctttttttggcgcatcgctgcctaggagtgctttctcacgtgctgtctggatacatccccttccatgcatgcatctaaagtcttggacctggaatcttgtgaaaatttctattatacttaagtttgacacaaaattaattagtagttggtgcttactctatcctaaaatatagcaacttaggacaagatataatgcatactagtactaatataatgtccagattcgtagtattatgatgtgttctaatcataggttgctatattttgaaactgatcgatgtagtaataatatatgcaagaccatcatgcacacccgcttaaaatataattagtcaataatatcaactaacatcctttgcatttcataatcttttcactggtgttagttacttaatttatttttattattacgagaaaggtgtatacgcacccacaccacaagtgaatatgagcaaacatatactcgaagggatatggaccagtgacaaattcctagccccactaaaattttattaaaaaacatccgcgtgcatgtaatatttaggcaaggaattgtagggaaggaaatgctaacagatgtatgggaggcaacataatcaaatattacacaaacaaacgacacaatctattttaagtaaatgaagacaacataaacgcacaacctacaaatatttcaaatattacacaatctatttcaacgaagacaacatacgacacacaaacgcacccaatctattttaacgtttcttcatgggtatctgtccacctaatctatattaagtaaatgaagtaattaaatacataatataagttataaacattatacttataaattattttaaaaaaaactaaagtgggtcattaactaatatatacatacgggtgataattggcctagctaagtccatcataacacatgagaaacataatctctccctctcttgctagctagataggacccaaaaacaactacatgatagctaactacccaacaatcatcacactatcaacatggggctaaactaatttctccaaaaagaaagagaaacataattgaaaaagccgtgtgagagactaaagggcctatttgttgttagcaaaacaacactacaatcaaattttgataatgcatgaattggagttatcaaaatttgacaacgtaaaagaaatggagataatatttgctttgaagccatatcaaaccttgggttggcattaaagagtcggagttttaagagttaacatttttttcataatggaattcatttgggcttttgctttaaagaagttacgaccaattattatagagactgtaggatgaacagctgcgaattaaaataattagtataccatcataaatttccattgtagctgtttctatcagcgacttactagttgcatgtactccttgtgttacttaaacaagaaggtagaatcttcgaaatcatagtctgattatattgtcgatcaaattccactcccagcatctccaatgattaatgttgaaccaaagcggaatgtatcatccaagagtaactaagtggtaaatcagtcgtttgtccatatcatgccgccaccattgcgatgaaatccaaccggttatgataccgccataaggatgcctcaccaattaagatggaacttccaacgcgacgccttcaagaaggttgcaacactaatttagaacatcgtcttcatcgctattccagaaatatgtgctgtcgccggccacctagctacatccaaaatatgtataattcattggcttcccaaattttaataggattgctttaggcaacaaacaaaacaggttccaatttcagagtataaagtattggatatgggacttacacgtcactctatttcttgccttcatgttctttgttcactattggttgactacatctatatatatcgaagtaattaaatatatatataggttttgtatctatagatacacattcatatatatgcactcgatatatatagacgcacatcttctcttccaaaagctggaatactcgatcctcacagtcacacagctagcaacgccggcggccatgcaaccactcgctgccggcggcggcgtctcttggccgttgtacgccgccaccgtcgcggcggcgctgctcgtcaccgccatcgtcctgcggctcgccgcgcggtcgacggcggccgcctgcaaggcacgtccccccgccgggtctctcggctggccgctcgtcggcgagacgctgcagttcatctccgccgcctactcctcccgccccgagtccttcgtcgagaagcgctgccgccggtgagcaccaccgccgccgccatggcaccggcagcgcgcgtacgtagtagctgcgtctgtggtgctgaaaatttctcttgttcttgttgattgattgattccgtaggtacgggaaggtgttcaggtcgcacctgtgggggtcgccggcggtggtgagcgcggacgccgaggcgagccgcgcggtgctgcagagcgacgcgtcggcgttcgtgccgtggtacccgaggtcgctgatggagctgatgggggagtcgtccatcctggtgctcggcggcgccctccagcgccgggtgcacggcctcgccggcgccttcttcaagtcgccggagctcaaggcccgggtcaccgccgacatgcgcagccgcctcgccgccgccatggacgcgtggcgcgccaccgccgccaccggcgccggcgcggccgtgcgcgtccaggacgaggccaagttggtacgtacgtggcatgacacgcgctgctacctacctagctatagctaagctaggctaacccaagagaatatgaggagtagcttgcattggagtggatcgtttgtccgtttataagtgtcttttttcttcaactaatagtgaaattcataggaatttcttcctagagaaacttcaacccctatagaaatggggatcagagcctagttatcatgtttatggtttacctagttcattattagtaatatctacggaagtactagatatcccagtatatataggattctacaacatatggaccgagctcctaacttgatgaaaaagtcttagcctagctagaaatatatccctttatgcaaaaaaaatatctcgataatattgcgtacaataatgcaaactatattaattttcttataaaatttctagtgtgtaagatgattgtatgtgggaaatatgtattctctatattatcttttttttgtttttatatatagtaataaattttattgtctacgtacgtggcacatcttattgacttcgattcaaaaagtcaaaaaataatgccatgcttatactgtacacttaattggcatttttccgtcgaatgtggaattatagaactccttgttctttaatttatttgttctgatgttgactggctaacttaatcattttttttttgttccatcgcttcatagattgtttttgaaatcttagtgagggcactgatagggttagagcaaggtcaggaaatgaattacctcaggcagcagttccacatattcattgccggcctgatctccctgcccatcaagcttccagggactcagctctacagatccctcaaggtaaacacatatattagtcaattcggcatgcgagttgctccaaatttctgaacaataatacccacatgacaacctctcaatttatgtttcttttttttttgtatatatacatctaggctaagaagaggatgacaagtttgatacaaaatatcattcaagagaaaaggaggaggatctttgaaggcaaggatctctgcgctgtttcgcgcgacttgatcgatgtgctgatgagcaacgggagcgacgagctcagcctcaccgacgagctgatatccgacaatatgatcgacttcatgatccccgcagaggactccgtgccagtgctcatcacacttgccatcaagtacctcagcgaatgcccattggctttgcagcaactagaggtacggtatatatatgctctaaaatgatttctacttttaattgtaactaaattcgggtgtttgagaagagaggtgccagggatgggatccgggtttgaaattccggttcaaaatttcaagaatttccttgtgggaagtgcctccggcaaaaaaaaagtttcaaatttgtttgaatttagcaaaaggttgctcaagttcagtgaaaatctattcacttttaattttttggttcaaaaattcttaagctgatccccttcctgaaatttttttgtattatgaaatgcaaatataaacatataatcatgtagatatcattgtcaatcgatctcttgcatgatcatgacttgaaccatctagtgcgtgcatgattagtatagtagtgctatttgtcaatttgacaagctgtgatatgatatcaatgtccaggaggcccaactgactgtttgttgcctagctctctggcgtgcaaccttaattagataacaaattctgatatgccggcagcaccagggcatttgatgtagactcctacctaaaaacacaagcactattctgttgacccatgcacatcatcaagtcataagaaagtcttaattatattccaagttgaatgtacgataaggtttacaaaaggaaatactccccttgttttcaaataaccgaaactggacattatttatttttcaagcttttggctactcttttttttggcaaaaaaattccaaatactaaaattgtgtttttattaaagtttatatgcatcctaaatataagcataaaactttcatttattttagtctatatcctttagtttaggagcaattattagttgaagttgaaatagtaatacatttatttaaaaacagagaaagtactatatccggattaataacacttgtcattttgaaaaaaacacggtctttaaaaaataactttgagcactattttctattataatatttataaaatcttcaataaatatatgattttattaaagtatttttaatactaatatatatatatatatatcatatttataagataaatattttacaaattattcacactaaaaaaattttaaattttgacatcagccttgtgcaaaaaagacaagtattatcaactgagggagcagtacattactagaaattaatgtgctagcaataaatggaatatgtccattgatttttaacctgtagatatttttttgaagattttactgtcctaaagaaaatgagtagaacaaggaagatgtactcatctttgtacttaatgcaggaggagaacatggagctgaagaggcagaaatcagacgtgggcgaaaccctagagtggacagactacatgtcactgacgttcacgcagcatgtaattaatcaaaacatattacatatgttggatattccaagattcaccctaccgtatgtgtctgacatgtgtgtctagaatccacatatggactgacatgtccagaccaagtcctgattccttaagctaatgcataatccctctgtaaaaaaagcaaacaaacttctagcttggcaaagcggaacaaaggagagagagagaaactaaaatacctaatattttagtttaaaagaagccttacattaatagattaatagtatagtagtattgatgggttgatagataagaagtattgaagagatgtaagccacgtataatttgatttatttgaaacaaaatttaaactccatgaattaatttattttaggacatgggtataatcttctagagtatatatacaaccaaactccgtcatatatacatatatatgccaatatgaatgcattcttaaaacagaatgcatttttacttgtcgtccatcatgcataattgcgaagttatgaactatgtatattttgtgtgcaggtaatcacggagaccctacggataggcaacatcatcagcgggataatgaggaaggcagtaagggatgtggaggtgaaggggcagggtgacgtggtgatccccaaggggtggtgtgtcctcgtttacttccgttctgtccacctagacgccaacatctacgacgacccctatgccttcaacccatggagatggaaagagagggacatggcggccgcgactgccaacagtggtagcggcttcactccctttgggggcgggcaaaggctatgcccggggctagacttggcaggctccagacctccatctttctccaccacctcgtcactaatttcacgtatgtcaactatacctacctaagtacgtatgcattctcgcttcaatttgatcacgttaacacgttgttttggatagatttttttttattacacggaagacacaccacacgcgtgtgcgagcacgcacactaacacttattcaaaaatagagaccaaaaaattcttagcctcactatattcctcttgaaagagtaagtgcgtatacataatatttgtgaataccattatggtcaaagtcatgcacccactactccagcatcacactgctagtaattctccaccgttttggacattgacgtagtcttagaaatgcatattgcataatgaaatttctgaaattttggaagtttgggactgttggtcctgctagataagatattcatttgaccataaagaattggtttttaaatttagcaaaatatgtccaaattttaatatttggggtctcgaactttcgaaatgccagttttatcagtccccttcccctcgatttttttttaaacaaaaagagagatccacaacactaaaccccggtttctacatatatcatagtgtctttataagatatgttaaaaaatatatgcatagggaatgaactggtgcttactgttgcttgaatggatggatctctgttgtaggtgggtggcacagggggacgtcgtcgtcaacttcccaacagtgcggctcaaacgaggaatgcccatcaaggtcacgcccaagacataacatgcaaatcagtccagatcatttgaaggtgagaggagagtgaactatacacgtgtatgtacaacaaagagagaacaaatgacagtttagataaaaggaaaccagaagctacagttcagtaaatcctgtttctttttctctgtttttcttcacccctttgtgtggctatgtaaagtcgaccagtctctgttcgaagtttcccaccagtttggtgaaagagttgaaaggctaaaagcaacagcatgtagatcaacaaacatgtgtaaatacttgctgaatcagtgctttcttcgagtatttcgagcatgtggctaacttgatgtgatttgtgaagtttcctctgatgtccttgccgccgttcatccattggtgatacagtgactgaacacaaagctaccaagatcagaaatattagaggggctgggaaagcaggtacatatcagattagcaccaaatcaacaggatcgcagaatcagatataaatgagtagaatagaacagaattgcataggaatttggagatgaataactagtgacgaaatgtactgtgcttagcttcatgcaatctgaaattaaccaaacagaattacacataagtgatggactgcaagagtgaatgataatagattcaccagtcactagatgcatgcattgcagatttaatttacagatgagaactccgaactttggagctcaaaaagaaaaaaagaactccaaactctaagcactatagggggttcacaaacacgaaaaagccaaaacagagaaataacaggaccgcagactcgagttagctttgtacaattttgtcgcctacctccaggttaaatataaatttaaactatatgcacgacttctaaacatggtacaactcgctaacttacaacatggcgactttagcaatctatggacaagggggtacaacaacaggacagcacagtatacattatgcaacttccaggctggggcacctatacagaacacacgcaggaggcttggccatctatcaattcagttaactataggtaagcaattaaaaatatcattgcccttcaaaattcgcattctaaatcatatctccagcggttgatatgaataaactctacaaagaagcagccaaacagaatgtggacctcatgacaccgttcttccatagcaaatggaagctaggtaaagattcttcgaccatttctcctgcagatatattaaatcattatagttgcacaagtatggctgttcagtagaatttagacagaaaatcaaattaccttcacatgctggctggggaaagcagatgtcctcagggtttcctgtgtttcatcagcaggctttcttctgggaatgctcaagataaatgccgcctggtcccatgtagctgctgttgcagttatgcgaaaaccattgtcccaacgccgatgtattccctcacttggatacaggaagtcaagctccacaacctacaaaagaaaattgtgttgtcaaccgaaggaactgaatttctacccctattgtatatcatatcactgttgaacctaagctatcctattgaagattcagaaagggaaagcacatacatgtgtatacatgttttaggttagtaaaaggcctgattagaaagacagaaatacctgatctgtaaagccagcattccgggacatgaccactgcccaccggcttcctgcagtggccatagcagtgacatagaaaccctccttccacttcttgtttatccacttgaagggaaatgagtcgcttactttgtaggattgttgggcatattgcgtccctgctcaaaatcagttacaatctataaggacatgctagtgtaataacaacaggggaacgtatcctgtgcacacaaactttccatgtacacaccaactaataaatttcaccaaaaaatctagaaaaaaatgtatatgtacttcgaatagcattacacttatgtgtaaaggcctggtttagttccccaaatttttttcccaaaaacatcacatcaaatctttggacacatgcatggagcattaaatatagattaaaaaaaactaattgcacagttaggggggaaatcgcaggacaaatcttttgagcctaattagtccatg

SEQ ID NO: 2725 - DNA, 1728 bp, Oryza sativa
atatatcaacacaaaggtaactaaggacaaaaggttgcaaaacgaacagataaaaaaagattcgcactgcaaacaaacttcacctggtatccttgccaaggaaggcgaccccgtaaaagaaaaacaagtgtataggcaagggattcaagatcatctcttctgcttccagttcttcctaagtgagcatgcacactagcatagcgaacagttccccttttcaggtaatcagtatgacaagtcagtttattagtaacacaagaaaatcgagggctttaggacttagttttcaataaagtatctccctcacaaacctaaagatatcaggcctctgatcatactcaacatgctcccccgaaccagtgtctttccacctagtagctgtgatgagaataaatattgagtacaaaaacagtataatgaggttcttgtgaaatgaaacagaagtacctaatccaaggtcaacaagaaaaagttttttctcttccagggttcctggggttccaagcaaaaaattctcaggttttacatcaccatgaacatacctaacataaataagagttagctatatttcaaaatgcaacatgcaaaaaactattaggcttcactgccaagagaggatcagagaaaaaaacaaataccctttcgaatgcatcttctccaatatggagattgcttctatagcaatacaagcaaccatttcaacagacattctgtaatagaaagaaaaatatcatattaactgagctaattaaacatgaacattcaagaatatattgacgaacaactagaaaacttacgagtgggaattattattccaaacatcccacaggcttggacccaacatgtccataatctgcatataagttggtttgcatcagagaacttcatgttttctaggtaatgaagaaccaatccatttaattttgctctgttcatgattaattatgaatcaatgtgataaaggaaaacagaatatcttggcttgcgattactaaaagttgaagatccacagagtcaggctttcatgcctactttggcaaagtatagttaagagtgcctttctaaatgaatggtctgacacacactataaacaaagttctatcttaaaagtgtaatgatctgagaatacatattttacaagattataggaaaacatttttactccacatctcatatcaaaactttgaggggaagtaaaaaagaagttttccctagtttctataaaatacatgaacaattttatttcttttgttggcagatttagtgcagccttagcaggatctttcttcaaaggctattggatgtgaggcacgaagacaaactacacaacattggaaaggtatcgttgcagcatcgagcatatggtcaaaagaatagagaaacagactggacactggaaatagcgaattgagaaggtagtggtttcttgcttcgcgaaataatacataggactccatatacagagtgctaatatatcttgccatcgaagacaaggacggcttgttaaccgaaaacttaactagacttgcctaaaatggatttccctagccgactagaactaaagttcctaatgccttgcaccttcttctgtcatgcaaaaagaagttgctgatgctgtcctgagctccaacataccttctgtagttcatccacaataggaattcagaacataattttaagattgtgcgcaatctactgctcaatctaaatttatctattgtctctgtg

SEQ ID NO: 2726 - DNA, 20942 bp, Oryza sativa
tccatcatacatcagggtgtaaaaggagcaggtatttcttgcctctgcctgcccaggaattgtggagcagatagaatggagaaatggtaatttggcattatccatatccatttggaatcagagaaaatttaggatatgatatgttgatatatgattagggctatccactgacatacatccgaatgcaagtgttgtgataaacctatctgatttcacttaagattaccaacattaattgctatcgttttgacatcttacaatcttagttatcagtctacccatgctcacgctgaatgtacccatattgtccatggtctcatgtaaggattaaaggatgcaaacatagtctgtccgaccaactgactgacagaatgcagagtggatacgggatagagaaatggttatccggtactatctgattgcgactaataaagaaacatgggggaaggatgcgggagttgtcatctcagtttgcaccctctccaattccatcctacatacgaattgtccattgcaagctacaactccattttgtgtcggtcaccagcaacaagattgtggaaaaatttgacaatttgttgatgatgttttgaattgattcaaagtaaagattcaatgttgcagcagtaatcactcgaacaaccaaataaaaaaatatttctcttaatccataaaacttttctgttgtataataacttctactaaccagcagaactttgtttatcgtatgcttacatcatatgcagagcacctttcatcaatggtctcaaacttttaactgataataactgccattaatgttttttcatattattggacattacctgctaatgttactaatgccagattgcccttgccagttttaatgattgagtgagctagtgctatccctccctccaaatgacttctacacagtatacactgctatttactactccctcctacccaaattgatcatcatatagtggaatctgaaatttctcaaactgatcatcatataaccgcatggacaccggtttcatcggaatacaattaatgcagcatgggatagtgtgtgcatgctagggtgtaattggcatggtcttttaatcgatgcatgcattgtgggagaatgtgtgcatggtgtcttgattgatgtgatttaaattatccttggtcttggtgcataaacatatatgatgatcaatttgggatggagggagtatataacacataaagtggggccaagagtatatgctccgttaccatgatatagtaatccccctgcctccctttataatgtactcttggtacaccatgaatgccgcttagagtgctgccaaatggatgtttacagaaagaaaatgttagtatgcattctagaatgccagctgccatcaaaatgtgtacagaatagcaaggcggacaaaggttgtgctgaataaaaaaacagttgatcatgccagaaaaaatggacaaaatgtcacttacttgtaaacttgccactcatagggagctccataattgcagcctttgctggttcgatgttcaaattttattgccacctggtataaagaaaagcgtgaatataaatgcaactatgatattttaaatatggaaatgaaaaagacatccggattagaagagctgacctccaaagcatttgctccaggtgtcctgtcggtaacaccaggagaggaaatacgccgaccaacatatacttgcccaaatcctccctttcccagctttctatcaagtttgtaagtaggtgaattggcaacttggacctgttcaaataaatcaaaaaagaatttgggtcaccctcagaaaatcacccaacacaccatttaaggtacccaggctatcctattccgctgttttgaagtcagatagtcctataactgcagtaactgaaacgagatgcatgtacctacaagagaattgagtataggcatctataagtgtacatggctatatgcaaaatgagaatggtttggaattttgtatgaaagaaaaaggtcagcttgtgtttttttgtaatgataaaaattaggcctccaatgtatattatgccacagaacttaatcactatataaaatgcaaacaagaaaagggagacaaacagctaagtgctagcaattaataggggcatcaaatgcaaaagatttgaaatatatagttatcttgagcagcaggtaaacatactcatctatgaaaactaacatcaaacttcagtgactgggctattacctaatagaattgctgtatacattagcagctttctgtagattaaaatgggaggcctaatgtggacatcctattatattacttaatcattgctatgcagtatacagtaatattgtgtggatggaacaagcccaaggtgcaactcacccaattctctcaattccattatatataacaggtcaactaaatgttctcccctttcatcacacatccacatggaatttaaccattctatgtactactatactttagacaagatcatgaaacacacaacatagggaacttgggggtgtcctaagtatcaacaaaaagatcacacaagttagaaaacaacattgctgcgtcactgatatgcaggtccagaccccatatgtcatcctcatatgtatattttaatctatacatgtttatagtatagctgaacaacttttcgctatacttggtagctcaaacagtcatgttattcaaatttcaatctgaaatgttaaacagcatggtactataaaatatgaaaaccatacacttctttgactgttgttcagtatgccactttcaatcgaggccactagatcaaacccattaaaacatcaatcatcagatcatacatactcgagagatgctttgattagacacctagttgaaagggtggaagtacaaatactaaagaagtaaataatataaatgcatgctattttgcacaaaaagtggcacgcacattgcaaatggcaaaccagaaccagaacaagaactatataaggtttcatgttgctcgtctataagaaaagcgcttgccgccctaaaataataaatacttgcacaacatatctcaaccaacctaatctattcactagtcactacatataaacacctcctttcagaatattgcaaaacacagtaatgtagccctttttgcataagtaactactacattaaaacattcgaactcgtgcgcctatttgtcagataaggaaacacaattttttttctaatccccaacaccacaagacaagagcatgaaatctgcgcacaacatttcatactcataactcatccataacaccaaataacctctcgaatcctactgttccacaggtgattatccacactatcccatacctaacaccaattttcatccatcctcgcgcttctagcatgcaaattcaccccccaaggccccaacccctatgcactacggccaagcggcctcacaccctcatcgcttccccccaagcacgaattgcgagtccaatcgcgggtgcccaaaccctaaacgcagtgcccaatttcgaacccacactactcgtggcaaaggcaacaaagggaggagaggagatcgatcctcaccgtctcggggagcggcgtggagctcccgtcgtcgcccggcgcctcgccggccttgtccccgctcccgacgacgctgtcgacgtcgtccattaccacttcccccccccccccccgctctccagtcccacgaacgcggctcggaatctccgtcaccgggaaccgccgcgtcgagagccggggctcgccggcgtggtgtgtgcgtggatgccgccgcttctacgagggcctccacccggcgtgggggtggattggtctagggtttggagcggaggcggcggcggcggcgaggcggaggcgaggtggtcggcgacggagaagggaagaagaagaagaaataaaaggcgagagaaaagcagaaaggagaggagaggagaagcgatggaaaattctggactctgctcgtgtgatcgattcctccggctcgtcggttacgggaaatttcattttacgcctttcagtggggaagacgtatcaacgtaagtatttgcgctttcgtgaaccgtcgggcatctcgtccgcgtgggacggcgtttttggttttcgtggaagttctgagaaattgatctcgtgatgatagagttcttagaaattggatacatccagcctttacttagaaaaaaaaagctatagttatcaattataatgtttttggataaaccaaaagcaaaagttcaacctaataaagttaaagaaaggatatacttgagaagaacaagcacataagaagacaacttaggttgtgttcggtagccatggttcctaacttatatttctcgttttttacgcatacgctttccaaattgttcaatggtactccctccatcctaaaatataagcacttttgaattttgatatgatattcgagatgttactttgactaacaatatctacaaaagtaagattttttaaataaaaatagtagtatattatgatagtttgttcaatgatagatcaagtaacatcaaatttacatgattgatttttgttgctattaatggtcaaaattaagaaagtttgacttggcactgttgtaaaaatacttatattttgaagcggaaggagtatgtaatcaatacttaattaaccaggtactaatgagtcgctcagccttatggtgttttcttttaccacctctttcgtctaatacttcattgtttttatgcgcacgcttcctaaactataaaacaatgtgttttaaattctatagaaaagctgctttaacaaatctgttaatctattttttaagttcattttagctaatttctaattaataatgtgttaatagacaacttcattttacatacaaattttacatacaaggaggtgaagttttcaacctctacctccgaatgcagccttatcaggtaaacaatttgattgctaaatctttattcagtgtgggggaatttctcatgctagattgatgtaactttctactcctaatgatgtgtatttatttttgtgtttatttatgatccttttaacagatacaatcaacgagatgacttataattatcgctatttaataaaaagagcaccacatgaagctacatcgtttcattaatctccgtacatttttacaaggtgctttggtgataccggatatgactaatcacagtactattttggattaaaattaaaacgtgttctactaatattttggtaacttaaatagtagacactggtgggttcagtttgaagccaatgttcagcttggcactttttgataacattacactatccaaatgaatcaattttcttgggcttctgaaagacaaagagcctaagccctagatgtggcccaagtatcacacgaggtttagtggtcaggcccaacccaaggcacacgacctccccgcatcgcttccttgcacgactgcgctagtataaccttctgtgaagtagtagcacatatttttctttcatttccttcccttttttttttcaaatgaaaagcagcaccgattttgctactagtagtactaattaaagtcatcatcattattttttaaaaataataaacacagaacaacgcatacactcatccctatgaatgcacgcacgtaaaccttacccctacgagcatctttgaagactagaccgacaaatcctttatattgatgaagtcactataggtgtctcactgtcgatagatacgtcacctaccactgaaatcacaatgccattaaaccctaccctatgagcaccttcgaagactgggtcggcaaatccttgagtttgacgaaatcaccacaggtgcctcgctgtcgctgttaacaagtacgtcgcctgccactgaaagcacgatgccattaaatcctgtaaaattcgctctcatgggaagtcaaacccagaaattaaggtgctactgagactcttataagttataaccactaggctacaggccctttcgcatcatcatcattattttacattcaaggagataccaaagtttatgttataggaaaagtgtacatctctacatattattttatgacaaatgagttaaccaggcgtaataacagagaataatgatgtcaagcattcgaaaatgaaaaaaaaaagagaacaattcagtgcaacacaagtctgctttcatcactaaccatacacgagaaaaaaaataagagaatattttaaagctcctcgtgctctaatcaaggttcactgctacagaaaacatctttctaaactgttaaaagtgattttgaaggcggtcaagccacccatagcgctttagttgtctgtaaagattacgattgggtaggtgtcataactgcacctgaaaaccaattttcgcaaactgtcaagttaggatacccaattgcaacgacctttccaaaaacaaattaatccagaaaccctagtgttcgtcctcgaagccgtcaccgccgccgttagaacccactgtcatcgcagctaacaactggcaaattacagtagtcatcgtagccctcgtcgtggttgaggtcgtcattgtctatgcatggtcgtcagatctgcctcctcttcaccacatcgcctgagcccgctgcggatccactgctcttgagctcaccgccgacggattcgacgctcccatggccgtaagcaacgaatcccctcttccatggtcaccactgtcgcatgaagcccaccgctagcatggtcgttgcgactacttgaagccattgcttccgccgtcctcggcctcccaacagcggatccaccagtcccgtagacgcgggtggtggatccgcctagcccgaggccaccgccactccccaagcccattacgccactgcctggagaggtgagtaggttggctgagagtgggatatagaagagagtaggggcggagccagagagaaatcagggggtgcctaaccttcctttgcgcacaacacaaaccaggagtagtattatgcagataattgtgtatcctaaacatctattctcccattgatggcattatactaaaaggaagtgttcagaaaaagggcagaaattgtgtacctgaattatgaaatcagctaaaaatatttgtgaaattgataatttgtcaatcgtataaaaaagtcacaaatcacaaaatatatcataaaaaatgtgatatcactgtcttcattcatccattaggactgaataaagaaagagaggaacatagttaaattttaagtaaagaataagtcatgaaatcatttacaaatacaaacagttatctattcgaactatgcacaacagtacggtcaaatactcaaaatttgtgaaagttcaacttgaaaccagacattaaaatatagagaaaaaactattcaagattaattaaaaaatttcaagctttatgttggtacatattacattaactgaaaacaaaagaaattaaggatgacatgggacaaaaggaccttgcatctgctcacttgctctagtgcccggttggcatcattggcttgccatgtcgggctgttggagaaggcgacgccgtccagtcattccacgaggagatggtgatgacaaacttagactctcctcacagtgctcaccctagccaaatgccaacaagccaataactataaggcaaaatcacccaatcaaagattcaagagcagcagcgaaagacgaaatcggcatggcggcggcacagtgtgacggcgttctattttagccaatgggcgacggcgtggcgtggcgattttggccaacaggcggcgggccggcggcggcgcaacgctgagtcgaggagagagaggaagaggtggaagatggaaagacgatgcgtgccgtgcccaacgattgacgttggattaacatgtgaagcgctagctgttgccttgttgggccttggtgtcttgcagattttgggctgaaggccagcgagggggttcctgagttttttactaaggggtgcctgtatggtggatttataggggtaatagctaattttttgtttcggcccgggtgcctaggaaccccccgggcctattgggctccgcccctggaagagaggggtggtgggagtgagggagaggagtaggaaaaggagagggaataggagagaaaaggtaaggggccagatgagggaactgaggggagaaaaaaatagagtggaggagtacggctattgtaggggttggagaagatggagaagataaaacatcgttgcgacgggacttggccgaacatcccgaatgaattttcacaaacagatctctttttagcccgattgtgaaaataatgaggtattcgtaaaaatctaactattctataatagtgctttttccggggacactttagaacttaagaaacgacgtacaaatgttcaatacaagcggttcaaatcctgtagtagtataatttagcggtcagttatacttatccttgtttcatcctgctatctcacgtagttcatgcatgtaatattcggtgaatagtctactgttctcgcgtagcaaagctatattgtgcttgcgggtgcacatgaacccccaaatttctaatttctcacttaaaaaaactagaatgtacagtattatactgaaattttctagattttcaatagtagtgcacatctgttttgatgctagcttcgcctctgctcgcatataagcctcctataacatactatcatctaacatttaagttaaaaaaaaactcatctaacattgtataactaacatgtaggtaggctcttcgcgtcagataattggtcaggaaaattagttcatcgatacttgagttccgtcgaaaagtgagatgcgcaaactgcaaacacaacaagcatgcaccgtaccgatatgatgcacatgcacggcgactgttgctccgatccaagtgttataatcgtgttccaaatctccgaaagtaaaaaggttaatctccaaagttcgattagaatgagagtcacgtcatctcacaattattgaccccgattgaaaagcaaatcaagtgaggtaggataaatctcaaccataaatgaaggatggagtgggagtcataatacgtagtattacaattcgtggataaatttaaatttaccatcaaaatacgtattataattggtggataaatgaaatatctcaagcagcagcgaagaggagggttatggttggatacatagagaggacggaataacgtcgaagaagatgaatagaaaatttaagacttaatcacagtcattgcactcattgttttgttcagttgaaagatgagtatggtatttcatatttcaatcttatttataatattattataaatagcacatccattaaatcaattaaagaaaagaaggtgacaagcgcagtaatgaaaaagaaattattagccgttataataaatatttttattttagaaacaagataaatttgcgaatgtcatagaaaatatttgatgcatacatttattaaaaatttaagttaattatctatacctaattaaaaaataagtaagacttccttaaattattcttgtccgtcattttttttcttccgcaacgtggttttttttccatggtttaacgtggttttttgcctggtttttttccgtacggttggttttttctccgcacgtggtttttctttgggcccggttttttgtccgatttttttgttagtgggtcgcgatttttttgttccggttttgtggtgggccccgtataaaaccaaatcggaccggaaaaaaatcaactggcaacacgacaaaaaaccagatcgaacaaaaaaaccgttcacccgtgacccggacaaaaactaccagatgaaaaacctcggcgacctggatcggagcagaaaaaccatgtgtattactaaaaaaacagatcaaccatgtgtattattaggagaaaaaccacattagacggaaaaatataagcaacccggatcagacctgaaaaaaccatgtgtattatgcaacatgtatattattaaaaaaccagatcaggcaaaaaaaatcggcaaaaatcatgtgtattattagaagaaaagcgagattggaccggaaaaaaatgagcgacccaaatcagacccggaggtcgccgttgttgtttctctctctctctaccatgttgtcaatcgcgtttctgcttttatggttttcttcgttaccaatgtccaccatcaatagatgagtctaattgtgggacacgtcctaccacagtcgtcaccgccgtttgatcatcagaccatccacgcccatcgttagtattatgagaacatgaatatatcaatattaaatagtgatctttatccatcctaattatcattaaaatttctaagcctagctaagaaaaaaaattatctatagcgaagcccgggtattttgctagttataaacaacatgtatagagggagactctagtcggacgaacgtgggacataatgcgctggttagacttggtgtctgtaaaatcttttgtgttaaaagtcgtcaggctaggctggctggagtgctggactgtctgcaagagtaaaaactgtctgcaagagctagggaatctttgaaattgttactactacttaccgacacctaccccctcaatggaagatttggcataaagatgctctttaacttcttttaggacccatgcataaaggcaataaagcaagcacttttagattcagacatgccagatactccctccgttttttaatagatgacgccgttgactttttatcacatgtttgaccatttgtcttatttaaaaaatttacataattataatttattttgttatgagttgttttatcactcacaatactttaagtgtgatttatatattatacatttgtaaaaaaaatttgaataagacgaatgatcaaacatgtaagaaaaagtcaacggcgtcatatattaaaaaacggaggagtggttgctgaacatggaacactatcgatccacatttgttttgaatatgcatatagaatttgaagaagaaatttgttaaatcatcaatcaatttttttttagtttttcatttcaaatgaaatgatcatgcgtgcatattttatgtttgaaattaactagtagttacagaattccaatggacttgacagatcggatgctgggaatggtggggctcgagcccgaaactccaaaacggcttcgaaaagtcccagtgcaagacactagcagtgtttagtactcctactagctaaacccaactccctatattgacactgcttcaatacgttgcttccatttcatataatcattttaatattttttctaatcaattttttgtttgatcaagtttataaaaatattagtaacattaacaacacaaaattagttttattaaatctaacattaaatatatattaatgacatgtttgttttaggttagagatgatatagctttttctaaaaagttgtacacattggggaaaaaatcaaagtgttttatatataaaacgggggagtaattaatactctttccattttattttataagtcgctttgacttttttaaggcctgatcaaatttatagaaaaatttagcaatacttataacaccaaattagtttattacatctaacattaaacatatttctatagtttcataaaaactattgctatattttttataaatttgattaaatctaaaaaagtttaattactaaaaagtcaaaacgacgtaatatgagacggatgtagtataacttatttcacacccaagtcctagatgtcatatacaaattaaactacgtctcaagcaaaactcaatcttcttttgttttagagtaccgttaattaaattcccccctcatcataactcctttgtatttgccacatcattataagtagtcgtatgtaccacatcggcagacaacatatttaattctatggatactatcgtgtacgaagtattgggacatcatgcacagaaaaatatttagctaaactcttgggtggctattctagttacaaaattttttagaagaaattcaacgagatagattaatatgtgataaattattctacaaacatacaagattaaatttaacttttacaagttaaagaaaacaattttaactgcgaatatacgtcaactatagtttaatttgttttaacttatagatatgataggttgaattttaacttacatctttatatagagtgatgtgttatatattaatctattttgctgaagttttccattatcagttagtagatgacacgtaaataacaggatagaatgtccactaccccggccgcatgcacttggctcgcacgcggtcgccgccggttgggtgaggtggtgactcggccggaagccgacgcgtaccaagaaaagccgcgcgcaaaggcgcaggaaaagcgaccccctcgctttggtagcgcgtgcaggcgatcgatcgagagatggatggatcattggtggcgagcgagcgaatcgtaaagcagccagagccagcgtggtcaccacgacgacgacgacccaaactaaagatggccaactcacatctcatctcatctcatcacgatcacggccttttcttttaatttctcccttttttgtctgctccaatccattcacttcacattttggttcatctataggtacatgcatggcctgccatgcgtgcatactatttttttccgttataatggatgacacatatacgaagtgagcgtaactcaactgattagatttttttatgatatttgtatttacggctaattattttttcaataatccataagcgacgtatccgtgtgatacattatcactaaagtctatatatacgatattggaataatatattattggtagcgtccaaaaaggatgcaactgaacatatgcaagaaagcacgcagcatatatacaggctgccctgccgtgcagtgcaggtgaggtgaggacatatatatgtagacgcacatgaactaggaatactagctatttgagcaggcaggcagggcatctgtaggctgttgttgagaggaaagggtcaggtttgcttagcattattaagggcctttaacctcaccatcttctttcttttccgatcctttcctacaagggtgtgaactcagatccctgccttgttcagacatcaacctaagaatctcaaagctagggctcatactgccggcactgcatgtacgtacttgtcggtgcatggtaagtatattcatacatatacgtaccgacctactaccaaattaattttcttaatttgtaatcgtacgataaaatttaacagttttgttaaaaatatggcatgacattttttttttgttttgcgattgcactctttcctatatatgtaagtatgtgctcatactgtatcttctctttcaattagataaaaaatactttaaaaattattttttatatactttgtgtattaaaaaattacaatgtaaatattgaaactaacatggtcagttttgaaatttataatataattataatgtaattaagtacgtaatctataatgtaaaaacgacttgatagttttctatataaaatatatatggggccaaaaagtagatactctcttaaactaattgctccacgaactaattaaaactcgtttggcgacgaaaacgatctcaaatttgatacaaatgcatgaaaaatactccccatgtagccagacaccaatatcatggtataataacaatttaattcgtgtacgcacgtatgtacgtacgaacgctcgtatacgctgccaagtatgtagaatcctccgctgcatccgcatcgccatcgccccatgcatgcatgcaacaacacaatcgaacgtacaagctcacgccacgtcgccgccgcgcgcatgctagagcttggcggcgccggcgacggcgccgccgcagcaacgccagcggtggtatatcgagctagctagggagcacggccgccgccggccggctacctgccgcggcggcgcagctggcagtccggcgtggcggcggacggctgcatccgcagctgctcgtagaacttgttgatgaagtcctcgaactcggcgtcgtccacgcgctgctcgccgccgccgccgccgccgttctccggcacggcggggaacggcgagtcggtgacgcggagcggccggacaccggcggggcttcgccccaggatccacgccaccatcggcgacggagtcgcggtggcccagccgccgccgccgccgccctgcaccgccgccgccgacgacgacggcgtgccttccacctcggcgctcatcatctcgaacgcccgcgccaccgccgccgcgtcgaggccgccatactcgccgccgcctccgccgccgcggcggccaccgccgccgccgcggctcttgaaggggaacagcccgtagtgcgggtacgacgacggcgtggtggtgcagctgaactccacctcccgcgggcggcggccgtagaacgacgccagcgcggcggacgacgacgacgacgccgcgaggtggtggccgtgccccgcggcggcgtggtgggcgaggaggccgcggagcgccttgccggcgagcttgccgcggccgaggaggacgtggaggtccaccatgaggcgcttccggcagaggcctcgccggagcatgtggcacacggcgaggacgacgtgccacagccgccgcgccatcccggcctccatgggccgccgcgccggcgtcgtcgcgagatccatcaattttacccaataataataatactcaggggtgtatttgcaaaaacgcaacacacacacactaaagagaaaaacgaaggctaacggatcggagaagggactggttgttaattttgtgaggtttcgaggagctgattagcttaattggctaaactagcgaaggggttgatggaatggaatgagtaggattggggggggaggcagaggaggtatttaagggaaggaaaggcttcaagggacccacaaaaacacaacttaatttggaaggaagggttaagtctagtttaattatttactgatagtatgatgctactgttttttctgctgcttggacctgaggctgctgttagcttagctctgttcatattgtcatctttgaatactctgtctttgtttggttgacagctaaaggctgttctacacatgttacgttttaagtcaaacaataaaaacttttttaaaagtctgttgaaatatttacactgggctagctattgtccgtgcgttgcaacgggattttaattttaaaaaattattattgttaacctattgccatcatcatcatcattattttctacatatatttgttcataacatacttatgtatatatttgttattaacatattgatcttatactttctccttaaaaaaagtagggtgtcgatggtacgagtggtggcagagttatcattcaccatcatcatcactctttttaaaggaatatagatatatgaaaattgtatgcatataagtatatgtttgttttaaaaactactccgatccataatattataatttagaagtgctacaacgtgtagtttcattagttttccacaatattttgccatagtaattagtggttgcatctcgacgacgactggttctgttcaaaacgatatgattttgtaactaaagggtgtaatagtgatcaaactttactaatggaatgctaatgggaaagactataagagattagctttggtgctacttggcttgtggttaggtagcagtgacagtgattgtctgattgacacttaaagatgagatagtctcaagtctggttaataatgtctatgtttttgttggtgtgaaattgacacaaataacttaacaattaacgtccatctgtggggagtggttaattctcccaaagttttccttcattggtcaaggcttaaaaacgttgcttttggagaatatgcccttgattccttaaaccatccatatatcttcttgtaggaaactgagaggaatgtggtggcagatgcaaaacacaagaggaagaaggatatgttaatgatgatcagtgaaggattaattaataaaggacactgctatggaactagtagtgcttctaaataccccgctccaaaaagcacaagctagctaggtcccaaagatttggaatatcttaggtgatatagatcgagcatcactttgcaagttaattacacaaacctgtcttttcatgcttttagaaacacatgtattaggaaaaagaacaaatatggacgtttatatgaacattctgtgcgcttgtgttaaagattaatttacagcatatgtgttggattagtaaatattgcccaaatgacgaaacaagaaatccagatattttttttcctgaacacgcaaaagctttgcatctgtaactgccaaagagaattgaagtgcaccctccatccataagtataaaacatttctagattggtctatgtgattaaattagggctagttagggataagatagtaaactattaaatgagtgataattaatgggataagtagtaggagtactctataaatccacaactttcaaacgcttagaatattttatatctatgcttatatagaggaagtaaaagttagcagcaaccagtataatacactgatataaactgcccctgcgtcgccctcgcgcatgcgacacggggggtgaaacgcccagagccgccgcccccttctcctccctcccctcacctcgctgccaccggagctcaccgccggaaagccagctggcgagcgaggagggcggcggcggcgccttctccgacgacggcgcatcctcttaggtgcgggggaggcggtgaacgctgacgacggggagtggatctggcgtgccccaggttggattcggtcgaagcgggtggtggctcgacggcgtggcgcgtggccggcggcgggccgttgtagtgcgtgtcggcaagaggctagcgcgcatgggtggcggaggccggcgcatgcgaggcggcacgcgtcgccctcttcggcggtccggtggggcggtcgtcgtcggggcgcgtggccggcggtggggcgctgtagcgcatgtcggcgggagactggcgcgcgcgggtggcggaggccggcgcatgcgaggcgacacacgtcgtcctcttcggtagtccggtggggcggtcatcgtcggggcacatcggcgactccggcgcctctccgggcatccaccccctcccccacccccacctctgctaccacctcccttcctctcctcctcccaccccctccttttcctcccttcctctcacccccacctagttgtctagttgctctgctgttctgctcaccccagctcttctatgtgttggtggtaaagttggaggtggttgttgcagttgccagaggtggtttcccgcaaagcccggtgattcttggtggagatgtggcctccgccgcaaagctcttcttacatctcatcagaaacatagaagactccgatgtctctgttgccctgtcttcaactttcagctcctcttccggcaggccagacctcctcgccttccttgatgctccacccttctgttggccggtctacttctagaccttggtcgtgaagtcttttggtggatgaggagatatgttcgtcgacgaagttggtccagcttgtttgtggtcagggctctttggcctcgcctgtgcttcaagtgccttgtgtgttagtgaacctgtcgtagggccgagtttggagcggtgtgttttgctctctgtagtgccagagttttagtgcttaggaggagccagagctgctgcattgggattagttgatgagctgggcaacgataactctcagcactttcgctctggtttcttggaggtcttgcacctttcgagggagccttgggcaaaagccatacctggtttcctagctaggattggcgacatcgacacctgcgggtgccgtatcctccttggaggtgtcgccttgtttgactctcttcaccttcgggtgaaaacccagtccagttttggacgggtgttggcagcggcatctgtcgttgcttccctccttggaggcttcgctttgaaggtctcgctcttcccttggtcacttttgtggttcgtagttttttcgctttgtcttctgtgtggggttttgccggtttcactgtagcaaactgtacagttgtatgtttttggacccggttttccttataaacagggttaattctcttctgcttataaattccggtagaactcgtaccgtcgtttcttcgaaaaaaaaagagggagtataagttacatgaatgctttgctattaccaatcagcttaaatatatctaagctcaagaattagttttttctctgctactatcatactccctccgttttaggttataagatgttttgagtttggtcaaagtcaaactgctttaagtctaactaagtttatagacaaatatagtaatatttacattaccaaatcagttttattaaattaataattaaatatatttttattataaatttatcttgggtcaaaaatattactatttttttctataaactaggtcaaacttaaagctgtttgactttaactaaagttaaaacatcttataatctttagtaaagtacgtacatttgactctaaatgaaaaaaaaatccaaggtttaataattggacttaaatattattgcacaaaactaaacctataattcgccaagattgaagtaaaattcggtatagctcgctagctagtggcggattcataatttttcttgagcctaatgcaaatctaataaaagatataatctatatatatatacataaaaccataaaactaataacttcatagaccatttaccattttattgagccttgctttgcttgtttgttagctgatcatcgagctaaactccattagaacaaataagcaaggtaattaggtaaatatttgtgagtaattatgccgttgaatcaatgcgttgttgtgcatgtggaggaatgggccctgctccgccactgtcgctagctattacgattatcctgcatatttgcatatatattgtctcaatttggtcaaaaaagaggaaatacacaacgccggtttcgtgctcgaatgcttagcaaaagctaaccctaagccttattccttagtaagcaagtgaagaattttcttggcctttattatttggattccttttcttttcctgcatggcattggctgccttgtattctctattagctttgtctaaagctggtcatcgatcagctcggagctcaggactcaagacgtagtacctactactactagtaccttgcagcagatggcttttcacagagaataatgcttgatgcttttgttgttaagattgattaatatactgtcaaatatctgcttttgttgttaaattaattagtgtactactgtacgtatgcatagggaattatagttgtgtactgctggtttccttgccaagaacatataaaagttgaattaaggtgcccttttcttttggacacacatatagaagcagaacatcatgaatggttattgagaaaaaaaaaggttttctagaattatttactggtatgttggttatggggttgatgataagacatatataagatatgagagtagtatttttcaagttatttctagacgtcctagatgttttgtatatatatttgacaaagatgaatgcaattaaaatccaactaacatgaacgtttgccctccaaataagctatgatcatgatctactgaaaatagacaaaaaaaatatatatctagacctattatttttggaaatatatatatgcaggaacatctctaattgtatatgatttttctttataatgggcctaatatgcataagaacatgcattctaatatataattaagcattgtttagttagtatcacactattaacaataaaagaaaactatttgagctacatttacgcacgtgggtccttgcaaagtttatctccatgaacgactgtacttgaaagctaactcaactttaatcggtggtaacagtaacaagtagctttagaggtagcttgtatgtcacgtccatgtacatttggattctttgcaggacaattggaaaagatcaaatgtgctctaggaaggctcttgctttgtttcagctttgacttacagcaactgtaatgtttatatttactaagttaatagtaacatgggtcccattaatgctagtcattagttgttactgtggaaaatctaatttgttgtattacgatgttttctgatctattagatcgagtctctcatggggtatatataggagtacatagaagatagagacttggagtacaatacaagtaagagtagatttatctcttggattctatctttaggatatatcttatctatatatttgtatttgactcttatctctaactagcatgtctatacttctaacattccccctcagtcgtagcaggagccaagcgaacgattgcgattggatttgaaatcttctatccttcatcttgttcgactcaccattatcgattgcatctctgatggatagttctccacctggtgcctgcatccccttctgtgtcgtcccttgactcttctctattccctcttgcagtcataggggagtgtcatggacgatagcgatgacatgaacgctttgactagagtttccatcaatgatttttgttgtagatgttcattgatttagccgatcatatagtagccgtggttgtaggtgtagccgcatacagccgaaggcgaaatttttttttacgccattacgttgtgaagatggaactgcaattgttagcatcttgcaccttgtagatatcagaggatgccattggggacgtcttgcataagatgacgtcgttggagatgaagccaccactttggttggtccgtctgcaccgtgaagcagtcatcacaatagtgatgctgagttgatacaatcgttgtcgtcgtacatgacatgatcaatgctgttgccgctgacgcggtcgttgtcgtcgta

SEQ ID NO: 2727 - DNA, 2289 bp, Oryza sativa
tctattagatcgaccctctcatggggtatatataggagtacataggagatagagacttggagtacaatacaagtaagagtagatttatctctaggattctatctttaggatatatcttatctctatatttgtatttgactcttatctctaactaacatatctatacttctaaccgttactagcgagcttcattatgtttgatacataaatcgaaaaatatggtaggatccatattaaatgctatatatgagagaagattgtgagatgtacaccaagtaattttcttgtggaggtgaggatgaaccttcgcaaatttttctaagctatccacaaagattggatatactcgcgggtaacacctagctggctagaaggagaacctccaagagtaacaagccggatgtccaaagcaggttgtcgatccacaaatgctcaactaaactttagctcacacactactatgaaaacgatttttgcagatgtggtccttttttctttctttgtgggtatgttttttgtaaccatagatctgcctgcaaaatggggacaggggcgagatggccgtccacttgcgtagatatatcttcccaagtggacgacataaggtgccgccttggaagataaatctttgcaagtggagctcctaaggcatccgcctaggataatagcctaggaagataaatctctgcaggcggagctcttaaggcgtccgtctgggataatagcaccttatgtcgtccgcctgggaagatatccctatatagctttgaactcaaaatcttcggttgcctaagagaaaaaatagaggattttcgtaccctgcaggcggacccgctatccacccgtaaaaaccatttctggcctcctataaatccactatccccctctctctctctccaagaagtttggctcaagaacctaagagaagaagaggtggaaaccctagaaccctaaaacacagttataccattgaaactttttcagaaaagtggaattatggagaaaaaaaaagactgatattactagctagcatatttataaattactctagaaaataaattaatcaaatcataaattgtgcacataataagcaatataatacaagactagatgtaccagaaatcaacacatccaaatcgaactatcacatcagattacgctagccattttgattaatatatctatccatcttatccataggaaggtttacattttgtatgtaatcttggaggctaattggccagattagatgtggggtattaggcttggtgcgcaagtgggttggtgctccccagcatggtgtcccctctgatggtggtagaaattagattaaaaaaaagcatcaccaatcaaaggcacaacacaacaaaaggaaacccacaaaaccctagcttatgcacttttgccaaacctggccctaacctttgttgcttttactccagctgtggcgcccttttagctagctagtatgcttgttacttgatagtactactctcttttttttttatcaaaaatactatactcaattttcagtttccattctgtaaagaaaagatatatgtatttggtgtcactagtggtgaaatataattatgacatagaactattaattggagattcatgtgagcattgtgtcacttgagctgtttgtactctttaattcctctaattagttacactaattggtttcatataccatagagtgttctcactactagtccaagtagtaattaagaagttgatcaaattggcaacacaatgatgaactttctcgggattggcctttccaaaaggagggctgaagaagggagcaaaggaagagactgaaaggaactatacaccattttttctgttgttgcctaatggcaattatttggtgttgctatctagcttctgatggagaagtccaaaccatggaactaggtttttgccgtctctcctcaagttagcaacataaattctgagagaatgctaacttagctgctaagacatactacttccatcgattgcgaaatccaattgacctataattggtgggtctaacctctatctgctagtctatatccatattatttggctcacactagctattttaattttgaacttactgaaaacacctttcacttaattatgtacacagacagtagaatcttttttctgccattacatctgctaatttgttgcgtccatttattagtactttgttaatttgagttgtcaaatttacacaaacgcacaatctttgtttcttttttgagcttataaggttgattggtagtgctaatatat

SEQ ID NO: 2728 - DNA, 18241 bp, Oryza sativa
  unsure (1)..(18241): unsure at all n locations
taaaatttgtgaataatattactaacatttcgtcggatgaagaaataacaaaagtaaaagttttagatcttgatgagttattcaactttgttgttgatgactttttcaattgaaatcatttagtatttgaaaatattgtttgaatttgttatattttcaaattcaaattcaaaatgttcaaaaaaaaatgttatatagaaaaatgaccaaactaaaagttgtaaatcttgataagttatacaactttattgttgacattttttccatttgaaatcatttactacccgtaaaattattttaactcataaaataaattattatactgcacttaattattttgctatagttcaacttacaaatataaacatttcatatgaaaaataaaaaaatagtcatcggtgacgggctttagttaatgctcgatagagattaagtatatagcccgtcactgatgagtcatctgtgacaggcctagttgctatctcaaacgagcctcaagttggtgcacgtcacggataatggtcatctgtgacgggtcacaacttgaggcccatttaagatatggaatgttatctcaatcgggcctaaagttggcgtccgtcacagatgatggtcatctgtgacggccacatctttaggcccgtttgagatatggaatgttatcttaatcgggcctaaactacggcccgtcactgatagttgtcatccgtgacgggcttaagttttatgcccatctaatatgtctgtgcgaccatatctcaatcgggcattttttggcccgattgagatgacttccttgtgacggcccgctatttctaggcatattagagcccgtcacagatagaaggatctgtactagtgacgttatgtggaatttatttttcctttatatcaatgataaatagttgattctgctctctgtattcgcagtcgagatattttacatggtattgtattcatatctgtttgatatctgtgtccaactttcaatccgaaaaaaagggtagtttaattaggagatgaaaaggattgatatctagttgaatccaagccaaatattgcaccaatactttcataagttattcttactaagctcacattttatcatatagtatgtaacttcttgtcatgggaaaaatggttaatttcacatatataagaaattattcagttagctgcctggttgagcttatccataaccttgcactttgctaatgatttggcaataaaataacttggtaacctttgctctttatgcaagtatattctggtgcattttgctttctgtcttgcttttccctatttgagactaaattacttccacaccatgatccggccagagaggtggctttggttttgggcctgctttttcatcctactccaagtttggtgacatttgagaaatattactctagattattaagtagattcatcatcatgcatacgttgatgaatggagaattttatatcatgatgcattattgaggaaacaaaagctacttagattcagcaaggcgacacacattttgcacacgaattcctcaggttgtnggcaccaaatttttttttnggnnntnttaaaaaaaatttttgtattgcttccaactttaaaaagatcatatcccgttgtgctctctccactagtgaaaagaggaagaggaaaaggctgccatctttaattcatgtacttacatatacaattagatgccccttttctttgagaagggacaaagatttctgaatttgtgatacatttgtgtggaaattgcatgcaagcccttaatttatccatgatcaatcttaactaacacatgtgtttggtgtcgtatactagagagtgaacattgcagctcaagttgaagctaccgaattgtactattgttcatattttcggaacggttttggcacatggaattcattatctagatacaaaatatttgaaaccaagaactgggccgttgcagatgtcatgcgtgtgtaccaccaacacaaaacaaaacaaaacaaaacaagaagtaatcaacgaggttaaacacaccaatcttaattcatcttttagtgattgatatgtactctagtgccacaaccaatatccgttataaattttatggagtctggacgaaaccaattataaccgactatatagcattataactatttctatccacgtgccaacgaaccccgtgcaaaaccatgtgccaacgaggccctggctctaccagtgatcagactgttaacgtagaatcacgctgccacaccttgaacacattatgtgcaacctgggacaatatccaaagacgtaccgccatagggagtgggtagatctcaccgaatgaacactcgggagggaccctattagggtgaacgcaccggtttattctagactcggcaggccagctaagacgtcctttaacgtagtagaaacgatggacgacgagaaatttgagggaggataatagactttgggataggtataaaaaatgaggaagatgtagaatatagagggtttaggtaataaattgattttgagtattgatttgttgttgtttcaatcggccttagcccccttatatttataggaggggtggacttacttctcaggatcttttaatttccacgtccaattagatgaagaaaccaattggaaccctaaaatctgaggtcttagcaaggaaacctgagaaccgacaggctcgaactccgtcggtttgaccggtcccttgccactggtcagactagcccgatggctgcagtcagacatgcctcgcgtggtaagtctgggcctttaacacatacaacctacattcacacatacattgcttataataattctcgaacaaactgtgaaaaatgatacactattttgtcacgttattttttgcctgcaaaatagtctgcagcccaggaagaagagatctaaacattagtagagagaaaaaaaaaaaacttttagatggtgagtgattgatggatagcccaggagtgatcggtcgactaaccttctctactagtcttttagttaccttttctcagctgagtcagctgggatagtatggctaagcccaaatatgtccttatgtcgagttgatcgattgatcaatataagtttatcagtattaaaagtgtaaatatgtttgggataattaagataccacacgtacaaaagagcacatccgtaccatgcaatgtcactgatcgggcagagtacgaagaaaatggtccatttgatcagtgcttgtcagcttacgatggatggtgcatgcatttgaatatgggtgacacttggctgttgatcttgtgattggaccattgttatcctgcacttttagtactatttagtttttttttcttctcacttaccttattgtattttctgtggaattcagatataaatatgttctcaaatattttatagaagtacttgacatggcatattttaattttgaaaggtaaattctgtcaatttcaaaaagttgagcggtggctttcttctttgcatgggggtgagatggagtcgcagaagccgctggtatgtctctgcgtgtcaacgatctacagtatggcgaggcggtccgtctggtaaattggagacagggggagatggggaggcagcaactcctacgccatcggttcgggtgcctcgccactagccacctcccacctaattgggtccagccaccaccatcgctgttgtgctaggaaaaccacttatgtcatctgatgccggggaggtcgagttcatattatcgcagatctgaggctgtggctatcaatgctaggatcaccaacatcggtgggcgccacacgccttcctagaggagatattgttgacgcccccggcctctcaccccttcattccttcggggtttactctctgcgtgaaaattttgttccggatatccggaatagtgatgaaataaaatagttctggatatccagagtagcaatggtaacactacagctatcttgaccttctttaaagagtcgtattggaggttccctgcttgttgggcgtccttggcatcggatcggctttgatggctatgacagtggcaagatctgggatatgacttatttacaactcaattactctccaatcttatcttccgctttagtttgacattcatcgtccatggtgacatgtgaataattcgatcgacataatgattgaccattgatttcagagatactattttattttggtatggagaagacatggattacatataatttgtaagttgttaaaaaatattggttatgtagattttcactaatcatataaagaaataatatgtctttaaggtggtgttataagtagttttattatttttaatcaatatatgattttataattcacaatagtttgccatacaacttctataataattggttgtgacttccttgaagtaaagtctaaagtgaatttcatcattaaaaaattccgtagattttagctaataatgacgagtccaattacaaaggcctttttaattaaaatgcaccgctgtaatatcaacataacggaagtagcatagtatatcactgcataacaaacatggcttacattatatatgcataaatgcaactttcatccgtcgtctataacaaaaaattgaccaaatatcatcaaacgtcaaaattcaaaaacttggttgaattgttggcaaatgtaagggccccttagaatcgaagggttgaaaaaagaatagaaaaaacacatgattctgatatgaattgaagtgtaaaacagaggattgcaagacacaggaaaaacacaggaatagtcgtttgattggagcgtaggaaaaacgtaggaatcggatgagagagatagactcagagggaattttccaagaggttagagctcttactatatttcctccaaaatccacatacaatgtgccattccataggaatttcatatataggatttggaaaacttcaatcctttaaatcaaatggccaagtagaaaaatttcctatagaatttgaatcctatgaaatttttagataaatcctttgattcaaaggggcccttaaatgtgtagtagaatcgcttgtatagttgggacctggatggttggatcggggaggattggatcacccgtggcagaggaagaagctagctactcctatagctatgcacaaggataaggacaagatgagagaggctggtagttagaaaggggctggatgaagaggagaggaggggcactacggttttgattggtagggcgcgccaagaaagcaacaaaggtgaccaatatgaggagctttatgtaaaaaagaggaaaaataaagggtaacaatcaatggatggatggatggatggatagagtttggacagcaaattttttttattaatcccccttaatgtgttgcaggttttagtttcaactggatggacacagtgtgtgtggtgtttgttactcctgtacggagactcagctagcttaccagctacggccaaaattttaaatttaaaacttaatcctagagttgattttaatttttttttattttttacactagttttttaagtttatatatatataacttttgcttataaattattttttcgctaatatgtattgcgggttataatcagctatacttaaagcgatgaggcatggcctttttcttgtagttgacttcgggctttggctattgatcaagagctagtacacacatcgttttaaacagtactaataagtattttgattaacaaatctgtcatatgcactagattttcatccaatatcgtccatgccctgtatgcaggaggcaaagtacctaatagctgggacaaggaaatttcttgttaagaaaattcacagaagccaaaacggtattagtcacctattagccaatagggcgagaactaattccctttctggttttttggttagaaggaagttgtaatttcatctcacagctagcttgtgaggatattttgagtgagtagcatattcctttcttcctcgaaaaaaaaaacatatcctccatgccccgaagtttttgttgtggttgtttaattagttgacaattgaccattagttctcgacctctcgtgaaataatggtacactgaccttggctcattcttactaagtaagaagactccccagcgcaatcaaaacaattcaggaaaatatttttactggaggggtaaccctaatacgcagctgaccgcgtccggtcatgggcatgcggtcggcctccccttacgtatacatagtatatacacaaaagcattatatataaagtttatacgtataccgataaacgttatatttatatatataggtaataatttataactaatataaatatttggatttttccggtcgtcacaccggtttttcgtcccgcttcgtcgcccccccctcccccaaaatcccaatccgaatccaatcaaaccccggaaaaaaaaaatcaaaatcacaacggagttcaatcgcacaaatcatgatgcatgtacacacatatatccaaataaaaacaaaaaattagatcgaagggggtcgccgccgccgccgccgtcgccgccgccgccgccgtcaccgtcgccgccgccgtcgccgtcgccgtcgttgccgaaccgccgccgtcgccgtcgctgtggatccggtggaggggagagcgccgccgccgctgcctcccctcccgatagatccgccggcagcggcggcggagggcactctccggtggtgggggagagtgccgccgccaccgtcggtggtgggggaggactccaccgccgccgccgctcggggaggaggggcgccgtcgccgccgctcgcggggcgcctccccacccgctagatccgccgccggtggtaggggagggtgctgccgccgccgctcgcggggtgcctcccctcccgctagatccgccgccggtggtgggggaggatgccgccgacgccgccgtgggtggtgcgggtgccgccgccgccgccatcggtggtgggggaggggcggcgtcgtcgccgccgccgctcgggggcgcggaggagagggcggcgaagtgagatgggagggagggaaatgggctagggttccgcggctgagagggagtgggttttgtttccccactatcgacgctcggccgtccgatcaaaaccctagagatcggacggccggtgtcgtccgggccgaaatcggcccaagagggatcgagagtgaggcctcttttccggcccaagcccaggttgcggcctgggggaggaaaagtgcgcccacgcatgcgcaaaaggccgtgggccgaccggcatgggtcggaaataagtctatttttggtccctcgagccgaaaaaaagagaataagtacatttttagtgctcattttttcagaagcattacaattatagttatattgaatatgtttatttcgaagcaaacctataagaaagtattttctttctttttccaattaaataattgttaaatgatgtttgtattaataaaattagaaattaagctctgaaaattccaataaaattccaaagagcgtaactaattatggagaatttaataaaattaaatttaaccatgtcattttatttaaccatggagaatggagaattttacttgtaaattcatttaattatacacatacctacttaaaaataccaaatatttcagcgaatttgtattttaattaattgcatatttttctgatctgtaaacttcccggtgcaacgcacgggcacttttgctaaaccaaacaacacttttggtcaatatacacactctgtaatcacccggtgcaacgcacgggcacttttgctagtaattatatatttatacatataaactctatctatatgtatatataaacttagcgtttatatatttttacaaattttatatttatatgcatacttacacaatttgtgcgtaaaaaaagtttatacatacatataattgttgctttgtacgtataaactttgtacatactccctccatctatttttggtagtcatatttccaaatctgaaaattttatttttgataggcatatttcaatccaacaacctatcctcttaatgattttctcgaatttaatgcgtgactttccgttcttccacacatgattggctacatgggcattgagaaatgtaaatattaattaattgcttgtttacgaggaatgactagtagcatgtttaaatggatgataagtagaattacttatccttggtctatgtgtcaagataaaatatgactatcaaaagtagatggagggagtattacataaaaaacagttgtacggacgcgatcaaccgcatgcatggctaattgcccattagcattcttgtgttggatttgagactcaagaatccattgatttttttatttttacattttttattaaaatatttacataaatatttttttgtttcgaaaatttgcaaatctaatcgcctctcgccctttgggagggcgtttttttaaaaatcgtccttccagaaggcgttaagggacctaaatgcaaattttttatttgtgttcaaaccctttccactagttttaattgcttaaaaactaataatgcttattcgacactccaaatgattttaaatggaaaaataataaactacaaagttgtagatctcatcgagatctacaacttttatataaagtttatctccattcgatgtcgtttgaaatgtagatttgagatttttttaaataggttttatattttgtaacgaatatttggatactaaaagatcttaaatgaaaaagttgtttactacaaagttgtagatctactctagctctacaatttcgatataaagttttgtttcatctgactttatatggtataattttaaattataatatcatagagccaataagctatactgggaaatttgcatctaggtcccttaacgccctctggaagggcgatttttaaaaaacgcactcccataaggcgagaggcgactggatttgtaaattttcgaaacaagtttttttttaaaatattataataaaaaatgtaaaaataaaaaaatttgaatccattgatccataccggatgaaaaataggtggaaaaagtcgacgggtatagaatccctcaactattaaaactaactttgtttacctccccaagtagttttaactatggttctgtctaacatggcggcctacgcgtcaacaaaagttaagaaatttaaaaaaaatgttgccgccctcacaagttagtgagacaatttttccttcctttccctacctgtccctttctcctctcttctctatctgccctactcgggagcctactatgtgctatccccgccggcagggtcgacctcggctccccctcattgatagagggcttgagcttgagcttgacaaggtggtggccgccgcagctgcctgcctctacggtgtcgacgagaatcaaagagctggagaggaggaccgctcaagcgcaggaccactgcagtccatcctcttcgtgctctcacccctttacctccgcggagaggaggccaaggctaaggcatgcggagatgtatctgccgccaccgccaacctctttctcgcttcctccttgttattgttgcaagaggcaaggacgggcggatcgaaggctgcccgcgcaagccgatcccacctcctcccaacatcctctcgccatcactcctagcatcctagtcttcgtcgttgtctcaccgtcctccggtcgtgcattgtttttggtccctccaccgcctcaccacaatgtgaccacaggacttcgaaagctcctcgacagccgcccatcaccgctgccatcttaccatagatgggatggcgagctcaaactcggtggcttcctcgccttccaaccctctccctcgcctccatcctatcctcttccactaacgttggtcgatgccttccatcatcacagctaacacctcatcgggaaaaatagcctcccgctcgagcaccatcttcacagtctcacggtctccgattgattctggtcttgggtggactcaactgagccccgccccatcgccgccatcgtccaccgctaatcgccgccctacactgctttgtcggcctctatcaacttaacacgcatggagaagaagcagagaccggggagagagaaaagggtagatagagagggtaaaggggagaaaggggtgactgaaatgtgggccattatatttttattttttttactaacacgtgggtcccattaattttttatttttatttcagtgccacgtcaacgccacatgagataaagaccaagtcattccatcaagtgagcaccacgtaggatgaaaccatcaaaacccactgacagactctatttggttcagttttcgaagatgatcaaaagtttagggaggtacagtagacttattccaaaataggtaagattcatattgggccgttccatgtgcgtaacattccaacgcattaagttcatcggaggtcccttaaattatcaacgaatttgattttcgtccttcaactagaaaactagatataattggtccttcaactatcaaaaccggtgcaatataggttccatggcggtttggacggcggtttcggctgatgtgacgcctacgtggctaatttgactcggtcttcatctgatgtggcattcacgtggcacacgaagaaaaaattaataatttaaaaaatgttccattgagaattaatctgatcatctaaacaaaagtctagatagcaaccaatcctcgtttcaggctatggtaacccacacgctcgtctgatcaatgatgttgatgaagcatgcaatcatcctggtgatgtcagtggcgacgttgcaaaggcgtttgacagcgctgttgcacgcgacgagcatctccggcagccgcgcatcgcatgcatggtcgcaccccttcttgcacagttgcacagctccgcctccgtcgtgcccggtgctgaccagcagcgtcgtcgcctcgtcgaactcgcgggtgtccagcagcgccaccaccgcgttgcagatggggcaggtacgccgttgcgtactttctgcttcgctagcagcaccaccgcgcgtgtccgctgctgccctcgcgcggtaaatggcagcgacgacagcgactccggtcctcgacggccctgcaagtcgatctccgcgatgctagccggcgcgcatgacgacgttggcggcgaggcagccgcctcggccgcgaagcaggaggcgaagggcaatggagacggagacggagaggctgctcctctgctccgccgaccgcagctccgctctgactactccacccaccgcccaccgcccggcggaagaagcagagggagaagtcgccatcccagaaaggcggaatccaccagcccaagcatcagcggcggcgaccggggatcgaggagcgggccgtggaggcagctgaagcggtggaggaaggtggcgtcgcgggcggtgcagaggaagagcctgcctgcaggcgagagaggcgcggacgaggtctgcagcggtggggagcataggaggaagacctcccggaggaggtcgttggtcagcgcggcgacggcgacggctgacatgcctttcccgtcctcgctgcctacgcctttgcgccggtcgcatccggggaagaggatgggaggaccggaagagggggaaggagaaggggaggagacaaagaagaggggatgagatggaggaagtggggcattgacatcgtgggtttcactattttttaatcttattatttgactgatatgttgatccatatattttgttttattattttttaaattgttaaattttgcttcgagtgccacgtcagatgaagaccgagttaaattagctatgtaggcaacatgtcaattgaaaccaccgtccaaaccgtcttgggacctatgttatatcggtttttgatagttgagagacacgttgtatctagttttctagttgaaagacgaaaatcggatttgttgacaagttaagtcacctcaagtaaacttaggccctgtttgattcagcttaaaattattataatctaaattattagaaataagctgaaacaaacagataacttattatgatagattattataatctataagtcagattactataatctagtaatccactctaaatgtgcttattttagattattgggtggctaacaactaacaaacaacttataatctagagaaacaaacagctcacagcttattctacatcggcttattataattcagtttacagtaatctggctcaattatctatattacaataaagctaaaataaacagggccttattcctattccaaccccccggcgtgatcatcccaacaatcctgcaaggcctttgcaatcctagctagcagcatgcatcctcaattgaaacgagaacgaaactcatgactggaaaaaaaaaagggctaacagtcacaaattctatatacttataaagttatcctcaccaatagttttatcttctatcgtgaagccatatcattccaattacttttaggcattatttatctattatgcaaattacctatatcttctcgtaaagctatgcacatgtatatcataattatctacagctgttttctatcataatcatctcgaattatttttagcatttggatatgatctattttattttttctcttataaaactacatcatctattttctagtagtagaggataactttaaattatttttagcatttagattattgatctattatctattttttgcttatgaagctacattatttacattttgtaattggaggttcttttattgtgtaaagcatgtgaagacaaattttctagtatcaaattggaggttcatacaatttttccgcaatattgtatagggtttcatgtagttaatattacaaaagtgcgtgtgtggcctgagtgcagcaaattaacattactattacagtggattattggcatgaggatttactgtttagagtggattatttgcacgaggattacagtttttaatttgctacaattttttatcacgatgtcttcttgatgtaatattgtaatatggtacatatacatctatatatattcacttagaaattgcatcaaacaggcctgggtcagccaggcccattttgcatgcatggccatagcatccatgcaaatagggccagaaaagtgcatttttactccctcaactataacctaaatatgatttatatctctcaaccacatatctggattataaaacctccccttcattaaaactggcacattttgacttctttagcagtttcatcatgcatggcgctcatgtaccacattgacccgattttcatcctacgtggagtctatgtgatgctcaagtgacattatagttaactagtgttgtatctaggatttttatatgggtgatccattacatatatatatttttaaattcctaaatgtaacaaagttaaaagtataaatgaatcaaaagtgtatcataatatattaaaaagtggagattcaaacacacccaacatgcatgtctggtgtagactttgatcatgtcgatggagcatggtttatccgcacatgtatcaaatcgagccgagagtatcgtccttatctactccagcccggtgctcgcgtccttatccctcccatctctcgtgtctctctccctcctctctctctatctcttgcgcgtctctcgtccgacgctcgctctctctctctctctctctctcttgcgtctctctgccttccatctctcgcgtctctttccctcccctctctctctcgtggcctggcggcggcagtggctgtgacctcccctacagcagatccggcgggaggggaggaggcaggctctcgtggctggcggctgcctggcagaggcggcagcgtcggaggcgggtgcaccctcgcctccgccagatccggtgggtgcggaggcggcgggctcccctcggcgcgcgcggccatggcggcagttctcctctccaacactcgccttgtctccctctcctctgtgccccaccgatggctctcctcctctctgccacggtggggcgcggcctcctcttgtcgttggccaccgtgacggtaggccctttttttatttggaaccttaaaggtgccagttcctaaaccggcacatttaaggataccacaaatgtgccgactaataggtgctggttgggggtttcctatgggggttctcaaatagcacctgtagctatttctatagtagtgttttaatccgatgtccagtgttatcattgcctaatacgcttataatttttttttgaataatatgtggaggtacgtctctctctcttcaaaacttcttttttactagaaaaggactagatgctgattacttggtttggacattagtctccggaaggcatatggaattgaattgaagccacgcgcgggcggatctggtcggcctgttgcgaaacaaagtcgagctctaagctccaacgtcgccgtcctcctcgtcattatcgtccaggatcatcattacgctgctaaagttttctgcactcttagagcaagtttatatatcttagtagaattggttgatgactctaattttatccgcgttatttacttattaatttggagaaaacatataccatatattaataataatacgttggcaatttcaaaaataatttaattttatttatttacgaggggaataattggcgccgatttgactggtcaagcaaacttattgatgttaatttcctctccaacatatagagtggcttgaatccaaacgagattggattgatcaacgggtcgtcattgccggaggagaggaggggaagaaaacatgtggttaattaccgacatcgacgggtaaggcgaaggaagggatgactgagatagggaaggaaaaccggtggtcgctagcgttgattggtgagagagaggaaagggattcgaattcagtgacattgttatggcatggcacggtgtgacattggagcgatctggagcgttgaaatctaatcgaacggtctgctgcgccggcccacctgcagcctccgttttcatcccacgctttctgtttcctgccgcccaatgcccaaatctcgcggctctccccaatcccgcgcgtgcgctctagtcccgccgccctgcgcgcgcccgatcccgcaccaaagcagggctgctggcggagttccaatcccgcggaggttccaatcacggtgttcactttgacaccgctgacattagcctgattgtaagcagctacaaactggcaactcctgtcctggatttccctacagttcaagctaaacctgaaaatgattttgtctcagaaagttcagttcagtcacttcaagcaattgcatagcccaattttcacatggtttagaaatgccatattgccatggatacaagataagtaaggtatatttctcatttcacacaatcaagacacaatgtacaaaaaagagatgaattatttggaatacaaattcagatatttgtttggtactgtgttgatcagtattttcaacatttcagcaggtatgccataccactttcctaagcaaaccatcaacagtttggatcaaattatagtgtgagaagtaaaaacaaaatgacaaaactaagaactctgacactggcatcgacaaaaactgcttcatacgtgcctaccaggcggtgatggtgcccaagttcggctacatccgcaaggccgtcgcggcggcgcgcggtggcatcaccaccaccgtcgagtttgacctcttcacgctgcccggtggcgtcgatgccttcgacaaggccgcgcgctactgctaccgtgccaacttccagctatcagtgcgcaacgcggccgcgcttctctgcgcctctgccttcctcgacatgcagccgccgttggcccggtggccggacgcctccacgcgcccccggtcgtggcggcagggcagggtgccctggttgcggcggcacagcagggcctcggccccggcctcgcgcggcgagggaggcgaagcagcgaggcagccgcccggtcccctccccactcgtggctgcctggcacctctccggcctggcgtggcggcggcggctcccagctagctccggcctggcgcggcggcggcggcctagcgcgggcgaggaaggcgaagcggcgaggcggcgatgcgaccacgggggatttgggcgtcgggcggcaggaaacggagagcgtgggctgaaaacggaggctgcaggtgggccggcgcagcggaccgttcgattagatttcaacgctccagatcgctccaatgtcacaccgtgccatgccataacaatgtcactgaatccgaatccagaggaaagaggggagggaaaccagaggtcgctgggcgtcgatgttgcgcgagagagaagagagagtgaggaaaagcagtactcgggatttgggagaaaacaatttagtgcttgcaaccatttgcaagaaagtagaagaatacccttgcatcttagtactcaatataatcatggcatcagttgaatcaactatgatggatggctctgatttctttcttatctctcaaggatgataaaaatcataaattactaacaatcagaatgcacatacatatacggcaacctatgcacacaagctttcatatgtacacatgtgcacaccaactaacaattatcaccaaaaaaaaatctagaaaaattcatacatgtactttcaatagtattatacctagtggtaaaatcttcacgtcaaattcattatattttagccataacaaaaaaaaaatctgacagttttaaggttgtaagttctgtcagaattttgtcttttttattactctgtataatgaatttgaagatgcgactttacacgtaaatgtaatactattggaagtatatgtatgaatttttctacaatttttttgtcataatttttagttggtgtacacaatgtgtacacgcgaaggcctgtgtgcataggatacgctctctacatatacaggagtatgtctatactagctgaatgcacgtgctttgctacgggtaaaaaaactaaaaactatatgtgggtggaatgagaactagggtatctcattcccccgatgaatcaataactaacacacaattaagataaatggcgtgcttaaaccatccataaaaatatatgggagacttaggttaaggtagttagggatccaccccatatgtgggtcccgggcttcaccctaggtaatttagcatccacgtatcttaattaaataaggaaagggctgggtagaccaggacccggactgttccgggcccggacatgcccttatttccactgaaaacaccgctcggagagtagtgacatacaaaacctatgtattaagatgttaagtgaaggggattcggatgtctagtctggggtccccaagtctgtgtaagttggaacagatccccctgagataagtgaagcttacacgaaatatatcttagtaataataggaagagatagatttagggtcggcttgtttaaggaccccaggcccacttctgtcgatatgtgaaccactgctaaagagcagtattgaaacatatagaatctttaatgactcaaaactctgagcacgaggaatcgcaacttccttatgtctacattagcagaggatggcctcggacccagccctgtccttggtcccgggcttacctctgtccttgtaaatcctacgatccttagtgagagaagcgtagagacctataagatctacatcttaagaatgtaaatagaggtcggcttcggacccacccctgtcctgggtcccaggctcactctatccttgtacgtcctacgatcttcagcgagaggagtgtagaaacacatacaagatacacagcttggggaataagcaaagaccgaccttgggcccagccctatcccgggtcccatgctcatctctgcctacatcggaattctggagtcctttgtgagaggagcgtggagacatgttatatgtatattcatcaaagacatcttcgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2729 - DNA, 370 bp, Oryza sativa
cgcttttgaccagccttcacataaacaggccgccacgtgaccttgcatttgactcagtttgagggtggaaacgccctgagctcgttccgcgcccagcaactcctgaccgatctggtcgccatccaccccaagatcacgggcatcagcgcccgatttgtgcacctggttgccaccgaggccgccccgactgccgagcaagctcagcgtctggcggccttgttgacgtatggcgacccgtatgtcggcggcagcgacggtgtggccctggtcgtcaccccgcgcctgggcaccatctcgccctgggcctccaaggccaccgacatcgcgcgcaactgcggcctggaggtgtttcgcgttgaacgcatgaccg

SEQ ID NO: 2730 - DNA, 13131 bp, Oryza sativa
aaccgggactaaagaggagataacagcagtccagatgccccctttcttctttttttcttttttattttcttccgaatcaagtgggatgcatatccccaaattaaaccccaaatcccaaatcaaggtaacatcccaaatccacatcacaaatctttaaagttacttatacacacaaatcaaatacatcacaaatcctaaaaaaaattgcacacaaatcaaattacatcacaagttctacaaaattaatcgcaaatacatcacacacaaatcaatacatcacaggatcatgcaataaatcacaaattctaaaataaaaatcacagaggcgccagccggccgctgccgcctcctctccgcgcccgccggccaccgccgcgctagcccactgctgcgccgctgcccgccgcctccgcactgccctccgccccgccgcgctggccctccgcgccggcccgctctcgctctcagcgctctcgcttgatctatccaaaaagaaaagagataaggcaggaaagagggagggagttagagaggaaaaaaagagatagagagagtttgttgtgtggacgagagaagaggataagtaatagggattatatagtacgtgttagatttttattcccggaattagtaacaccaaccgggactaaagttatatctttagtcccggttggtgttacaaaccgggaataaagatcctaggcgcctgacacggtctgatagggaaccatctttagtcccggttagtaacaccaaccgggaataaagattatctagccctgttattcttataaaccgggactaaaaatcgtttttagtcccggtttttaatagaacccagactattgtggatttgggtcgacagaccaaagatggtttctccaccagtgtataccatatgtttttgggctagtcaatctatgatacgatattatcggtctaatgatcttattaacgggttgcactagttcttacctctccattcatagggtggaagtcccggaggaattagtgtcattatttattaatgtaagcatggtgcttggattaattaaatgtcgtttggatgcgggtgttcctcacggaaagtgagataggcagcaggtggtgacaacccctatttgttctctatattcctccacgttcgggtatgatgtaagagttcataaaatgctatagccacactggcagaccaacagggagtggcctcctggtagattctggttgcctataattaactatgtcctagccatgtgtatgtatatggttgttgtatcgactaagcatgattagtatatagaagtacatttgaaaccatagctatttctttagttctttctccactagctagctaatacattgggatgattattttgtgtgtcacattacccaaatactatcattatcatttacccatgtttggactatggtatattgattatagtatatggttatgaatatatcaacctactctttacaccaccgtgtttcctgtggaaaaacaaataacgatacccatggaatactcctaaatgaaatgctacagcggtattcgtgcgcttgtggatttatctctgaccgtatcaaataccaacacatgggtgggcaaggaactggtcgaaccaatgctcaagatattcaaatccatgtcagttaggaagggcctcaacctcaatcctaagtggatccattatagggttaaggctagggattactgtcgaagaaacgggaagcaaagtccaatctccgactgctcgaggcatatctatcgcttgccctcgtgcacggccccccattgggctgagcttggggcacatttgccctagaattgaggacacatccacctttgggcatgccacccgtgggctatggtcgaggcatgctcgcctctgggtgcggccctccatgggctgtgctctgggctctatccctgagctcgttccccgtggctcggggtagcagtaacgcattgatccaatcaaacttcacattcaattcaaggcgacatatatcaacccgacatacgtaattaataaaacaatgcacgcggttcatagtttagatctgactagtgaaataacagcccgtacaaaacgtattccatacgtggagactacagatatccatttgcgtaaatatatttttttggggtggttcttggtacctgcaaacgtccacgattttcataggcccttgttttgcatgcggagtggaaaatgccagtgaaaacagcttattcatcgcctggatagtagtgaatgtttccacgggcggatgcctttagtaatagcccattcaaaacatatttcaatagacggagaaaggatatccgtctgcgtaaaatatattttctagggtggttaatttatgatgcacctgtaaaaatccatgattttctgcagacgtttggttacaggtggagcagagaaaatgcccatataaacaggtaatgcgtcacccagacaaaatggtagtgtaaaaagggttggaccttagcttgcttggaagtagtggttaaattggtataacactactcctagtaaaacaaatacgactcgttgaaaaggttaactcatcacacgtattatggttgaaatacatgcactacatattgaagcaagtgagtctatctaggtactcaaatcactaagttctactctctccgtttctaaatatttgacgccgttgacttttctaaacatgtttgaccgtttgttttattaaaaaaatttaagtaattattaattcttttccggaaatgaatcaaatgataggatccaataaaataaacgtcaaacatgtttaaaaaagtcaacggcgtcgaatatttaggggcggagggagtataaaaaaagtactaaaatttctacagcttctctatattaaacaattgaccactcggatctctaataatgtgtccggtatattatagttgggccttggagatggccctcattcagtttagacttttctctcctatccaactcagatttttgaacaaatacggtgtacctgtcgtcgtcgctgaaggcaactcaacaacggtatatcagcttatagcttaattagcaaattaagtactaaacactctatatagtcagttcccagtttgaccatctgctagtgtggcttaactgcatgcatgcgttcgccatacatttatcgtccttaatctgatcagctatcaacttaattaagaccctgtttgtttcagcttaggattattataatctagattattataatctataaaccagattactataatctagtaatccactttaaaggtgatttttttagattattagatagctaacaccaaacaaccagctaataatccagagaaacaaacagctaacaacttattattttactgtaatctaaattacaatagtcttaagctaaaataaatagggcctaaatagcccataaccttaaagaatcccatgcgtaccgctctaattccctattgtgtttttcttctgtaaaatgatttttactgatactcctttatatttttacgaatggactgaaaagagattcgcctgcaaaaatatactggtgatgttcagtctataaatatcgatttttacgaacggtggtttctctctcctctacctcaggtctccgcaccggccgccctcctccgctcctttccttttttttaatcttttcagctcccccacccctaccatttatttcctctttcccactcctctcccctagtcccactttccctctcctctctctcccactctctaccagaatcctcgcctctcatgggtagcggcgtgggtttgagtgtagtggcctccgattgggtgaatacaccgcctgcatgcatgggagcggtggatctgtagccagggaggtcattgatggtgagagtagtggcctcaggcttcatgcggtggcagtggcgggtttcgtgtagcggcggtgacaacggcaaagcagtggatccgccacctgcgacaacgacctcgatcacgatgagggctacaatgatgaccgtgacctgccagttgctagctgtgatgacggtggcgcccgatagcaatggaatgccacggcaacaacgacggtggcttcacaaggaaggtggctagggtttctggatttgcttttattttttaatgttttggggaaaaatcatcgtaattaggtgccttggccgtttgtaaaaatgggttttcatgtacagttatgatgctcacatgtaaaaataccaatttttatagatatttggagccatgtggatgctctacccatctaaaaaatgtgtttaggctgtaaaaaattagaagtgtcataagtacaagtatttgtatataagcttgtattacttaataatcggtagcactcctgattactatagtgctgccatagttagtaatacaagtgcctgtacagaaggaagaaggaagctagggaaaaaaaaaacacaccagagaatcagaacatgaccaaacgtgcataatttcttcttaattggtacggacatcatgatcacatcaaccagcaaattaagtacaggtgttgccatcaggtgaatcatgaatgcgaaatcagcgtgatttttgtaccaaagtgctagtcatctaaattccacggagaaatcagtgtttttctgttacccaaagtctgaaaaccaagccgatattttggatgggaatatttgtgctagttagctactcaaagaacaagcttgcaagtaattacgccgtgtttagtggattttccaaaagggaattgattaaaatggaccttcagtcgttcaggcaatcgtttctattcgtctagcgggtcaagatgttgacattacagcatttattcagaattaacttcagatcggaagatgttaagttcagggtaacatggagaaaaagtttgtaaactacttgagcaagtaatagtgttaattttggtacatgatgcatccgacctttatcttcgagaattccatggagtactgtccttgccttgtttttccattggtttatatagtagggtttgttaattgtgatgacctaaaacagtggtctctactcgtagtaaatcaatcactacttctcaagcttgcaaatttcttgtcagctgattgttccatatgggcctacaaggttgaacaaagaaaaactgctgcagctaactatgcacctatgcttactgttcctcgttgcatttccttctcactgcttactattcctcattgcacttccaaggtctgtaatattaactgagaagatctggatcctcccggtgacttgaacaatactactactagaataggtatggcacatctgaaaatttgaaaaactaaaaaatagaaaaactagaaaaatataataaaatataaaaaattcggattgtggtcaaaaggaaaaaaaggaccaagactttttttaaggcttcagagcatgtataaataaaaataaataaatacataacataactaaaactattttaaaaacactagaacggataccctcatctcaatcgggtggtaagccccatctcaatcgggcacagcgttcgtcacaggctagaagtcactaatgtgaagagttatctcaatcgggcaaacggccgtcacggatgaatctatctcaatcaggccctaagtaaagcccgtcaccaatagttttgacccagacgaccagtcaaactatagcccgtcacagatgacctatctcaatcgggccacaactagagcccgtcacagatgactgttaacctcaatcgggcctaaactagagcccgtcacagatgactgctgacctcaatcgggcctaaacaagagcccgtcacagatgactgctgacctcaatcgagcctaaactagagcccgtcacagatgaccgtcatctcaatcgggcatttagttatggcccgtcacagatgactagaatccacaaaaaaaatattttttgttttttggctagcctcaggcctttgctagccatgcccgctgcaaaaatgatagaaacaaacacagatatccaatatccccagctccccagcatcacccattcatatacatatgcattcacatacacagacatcaacatatttcacacaactacacattcacagccatctcatatttcacatccattcacatccattcaaatatttatcatatttcacctggaaaaccaagttaattggatcaaatatttatttagaaagtcttaacataaacatatgaaatatatacataaatataagcatcacagttacatcatcacagtttcataataagtgttcatcattgcctagacataaaagttcaacattgttcatcattttagtttaagtctaaacattcctttgggattaattatttcgcggaggataaagctggctatctcctcgcgaacctcctcaaagctggtaggcagagacttggttattgtgccctacattgtcataattctagattagttgatcgatcatatataagtactaaaatgtagttagtctatcacaattgagaccaccgacctcaaactcagccaaagtcttcaccttttctctgtacagaaggcgcatgttgtggcacacatggaatccgcactggtcacctatttgttgcttcaccgggaagtcttttttgtggatgagggtgtcatgtcctgtcttcctgaggcctcctctttgcacgtattgggcccaagcttcatctatcgctagttgaattggggtccaatcatatgcgttcttatcaattctggagttcaggtagtgacatgtactccacttaggtgttatgaccagaaggatccaatgggcactgcggtattaatatagtgaaagttaattaagtactgaaggaatgtgtcatgctgttgtgtatatttagataacacacttactattgattataggcgcacataatgtactccttgtctcggcgggaccacaaggtgtcgtagatgtagttgaccattccttgacggacattctggagatttgtgacagtgaccacttgtggatcaaggaaggcaacttccggtgcattcttctgacaccattgacaacttaacctacacacaggataaacaatcttgtaaacgagttaaaccgattgttattaccagattgagttgggcgataatacttacaaggagtagcacttaaggaggcttgtgtccaccgctcggagcctgtagaggtcgaaaagatccttgaagtcgaccacgatataatttgttggaccaagaaatggctttccatcgtgctctccaaggatatcggtagctttattcggcttcctggcgttagatttctccatgtagtataagtgaaggtccttgcaagcggtgcccattgcggcaagcacgtcatctccaaccaatggcatgcctagttggaactcctgtggagcgacatatttcttcttgacctctttgcccttagtctcttcctggcccttgcccagatctagcttccttggagctagaagcgaggcctgcacctctcctccccttcctctcccctttgcttcgggtttatcgagagtaattctctgaggggaagagtgtgccttcctgctcttcttcatcagtgggggttcatgaatcgccttgctgtcggcctcagttcggtcctccccaaaatccgtgtcgtactgcaactgcacatcgtaagattgtgcatgacgatcttgagcaggaggggctgaaggagcagaggcgggtctcttcggtggacgaccgcctggtgcagtggttggcctcgctgtaaccctgatctcaatgaggtccttgggccattggatgaaggtaccacgggcatttcctagtgagaggacctcgtcgttcggtggatacttcagtgggaatagctcgtattcgggcttcaccgagtcgacttgaacttttgtatagtcgcccctgagttgcactccatgcactcttgtacgcaagtccctcggctgctggaaccgtgaaggtcggcatcaccctaactgtgagggtgcagctcgttggatcctgcgatagattaatcaatttttttagaatatcatatatcatatggattcgttaagtctttcatgtattgtggacgaaacttttaccgttatgtggtcgacggcgctgtcagccgatgttggattttttgccaactcagttgatgcgcaactgctgcgtttttgggtgggacttcctaactcttcgtgcgcagcagcagcggcgagctgggggttctgttgctcttctcggatctcttgcctaatcttggccctcatcgacttgagcttttcgttgaattcagatgttagctcagctcttatagacgcccggatcttcgcttcaaggcgtgcatctttctccgccttgttggaagtccgcttcttgtactgccacgcgtagtttggaaatccatacttccagggaatagaagacccaacgccccgtgtctgtccacggtgttccttgttgcccaacgatttcgtgaggaggtcgtcctcgcatctttgagagcaggcctcttgcgaggcttgttgctcggcaaccaactccttttgcattacaatttagtggggttaaataaactgcatgatgggaaacaatgcgaacatctagtttgattagacacttactatagcttcatatactcgttgatcttctgcatttggcatgaagattgtgccatcatcattcttctggtacctggccctagcccagttcctagcccgagggtgtgggatatcgctaaacacgagcggcgtgttcgattcctccgcttcttcatcctcacgctgccattcctcttccttactggcatatccggcggtgccaagccggtgcggatgctggttcctggtctggagcaagcgatatgcctcgcttctagctctggactcgggggtcgacttcttcgcatggaattcctcccagacctgttccgtgatccaaggaaatttctttcttggatctggattcgccgggttgtagacgaactcgccgactagcttagtcttgaagttcttccaagcattgcccataaccttgaaagcagcccgcctgagatggtcctcatgctccgcaggataatcgaagctctccttgaacgttagccaagcaatgtccttctctgcggccggcacgagcttgatgtcatcttgcagaatactgaatttctgcctccctatgaccccacagatagatctaaatcggctcaatattttccttggagatgtcggcaaccctacggcatccaccgctgttatgcggaaccgttccttagggattttgttccctgtcctaggagtacatgcccttaaggacccactagttgtcgtcgacattggttcgccttgctgagacatcgtctactttttttcaaaataacaaaaatacacaattcagtgctacaatctattacaatgaattgaatgtcacttataaataaatgaaacataaataaactaaattgcacatctcacagtaatagaatgaattgaatgtcacatataaataaattaaacatatcatcaaatcctaaaatcatgcatctatcactaaattcattaatgcaccacattccatctattcatcaacatgtcatcaatcaaaaaaatcattcgttcaccacatatcatcaatccctaaaatcatctatcactaaattcattaatgctccacatttcatctattcatcatcatgtcatcaatcactaaaaacatctatcactaaattcatcccaacatccacatttcatcccaacatccacatttcatcattaaccacatgcaggtagcagagggcggcgcgatggaggactcacctgaggtcggctgggggggctcggtggtggcggtgccaggctcggtggagggcgtcgccggtcggtagaggcggcgccgggctcggtggcggcagcggcgggctcggcgaaggaggagttcgcggcggcggcgccgggctcagtggagggcggcgtcggtcggtgtagacgctggtcgggcaagtcggcgtcaggcgggcggcgtcgggcgtcggtgaggagtaggcgacgacgatgaggaaggacgtcgccggcctcggtgggggcagctattcgcgtcggtgaagaggcaggcggcgacgacgaggaaggccgacgccggtcagtgtagaggcttggtggcggcggcggcgggctcggtggaggcggcgggctcggcggcggcggcggcgggctcggtggcggcggtggcggtctcggtggcttggggttcatcgtcaaggtcaatgtgaggtcttacatgaagattatggttgtattcttcttcatcgacaacgttgtcaactcctacaattcggcgctttccatccctcacgatgtgcatcttcttgtttgaagggtcttttatgtagaatatctgctcgacctgtttcgcaagtacaaatggttcatcggcgtatccctcctttgatagatctactaaagtgaaacctttcttgtcgactttgacaccagtgcgtagattcacccaacggcagcagaacaaagaaaccttgaacttgacgtagtttaactcccatatctcctcaatgcggccgtagtatgtgtttgacccaacttgatcctggaatgcatttgtacggacgctgctgttttgcactgtgcttttgccatcttgtttgacggtgtaaaatgtgtatccatttatatcgtatccttgccatgtgtctacggtccaagacggtcccatccccaacaactgtactgtctcatttgggacatctgtggacattgtcacacgattcttgaaccattcgttgaaccgagaattatgttctctgttaatccatgcatcagatcacctcaagttctcatctcggattttcgctaagtgctcctcaaagtatgggccaacttctgccatatgttggagcacagcgtaatgagcctgcgcgtacgacgcttgatcgggcctaattcttttccttccgattgagccaacacctgacaaccttccgatgacccatgtataccatctattgtgatttcttcagccatcggcttcgtgtatgttccttgcaatcggagcatgccttctttccttttatagtttgtccggaaagattaccgagtgcagagtagtcattaatggtgcagaacaatagaactcttagcttgaagttctcctgaccatatgcatcctaagtttccacaccttatttccaaagaatctccagatcgtcgataacaggctccaggaatacatcgatatcattgccgggttgcctcggaccttggattaacaagcacaacataatatatttccgtttaaagcataaccatggcgggaggttatagttcgcaataagaactggccaagtgctgtgagtactactcatgtcaccgaaaggattcatgccatccgtacgcagacatatcctcatgtttctagggtcggcagcaaagtctttgtgttttcgatcaatattcctccattcaatcgaatccgctgggtgtctaagcataccgtcattccttctctccgtggcgtgccaacgtactaacttcgcttcgttcgggttggcaaagattctcttgaaacgatcaatgataggtagataccacacaacctttgccggaccacccttctttgacttatttccttcgtcaggtcttttcttttgcttgtattgagaagccttgcagacaggacaagcatccaagtccgcatattgcttgtggtacaatatgcagtcgtttggacaagcgtgaattctacggacctctaaccccagtggacacagaacctgctttgcttcgtatgtcatctcgggcaatgtattctcaccaggaagcatagccttcaaaattcctaaaagatctgtgaaactcttatctgtccatccactacttaccttcagcttcattaggtccaaggtaactgacaacttagtgtgttttgctttgcatccagcgtacagaggcgtctcggaatcactgaccaacctgctgaacttcattccatctctctcattctgggctgggtcctcaacgtcacgtaacatgtcttgcagcagatcgtgatccacataaaccatttcaccgcccaatggagaaggtataaacatgtcatgctcatcttcatcttcctgattatgcgcaccacttctgtctgctgctgctccacttcctgattcttgctctccatgcttcacccaacatgtatagccctccatgaatcctcgttgtatcagatgaccgtgtacgtcctctccgctatcaaacatattctcattcttgcaatctgcacatggacaacacatgtaatcactgtttcttcttatccgatcctcctccgcgacgttcataaaatttgttacgccctttctgtagtccgtagaatgacgtttcaaatttttagcatacatccaactttaatcaattgctacaaaataaaaaaaaacaaattagaggcacatattataagatcagtattgcaaaagtaagacgtgatgaaattgctcaattaatgattaatattactcacttgattgatccattttgattactttgggaatttaatttctgttttccttggaaaaaggacaaaaaatcgccccaacagcctcccaccaaaatagtgaacagtgggatgcagttacactaggtggtggggggtatttatactgtgtaacaaatatctgtaacggccctaaaataatcaaccgtgacgggcatacaagtaatctctatcgggccttaataaaagcccgtcaaaaaagagtgtgaccctcatctgtgacgggcttcttttagggcccgattgagatatggaaccctcatctcaatcgagcctcaactatagcccgtcatagataagtgtcatccgtgacgggctttagttttatgccgatataccatggctgtgcgactatatctcaatcgggcgaaacttcggcccaattgagattacttgtgacggcccgtaaattccagtcttgttatgggccgtcacagatggaaggatctgtactagtgaaaaatagtgtggtgatgcactaacacgagcggcactgaattgcttttacgatcgtcggtgccacgcaaaatttggccaatcaattgtggtaaaatttgaaaactcaaaagctctcagacaaaagttcctaatctat

SEQ ID NO: 2731 - DNA, 1046 bp, Oryza sativa
aattcctgcagcccaacctctatgacatcattaagttttgtttttcggaaaaatcttaaccctgcaacattcgataggcagacaatttggtagcgctcacttgctcctcaggactggccacattttaagaactttttgattcattgattttagtcagagtgttcatatgatcctgcaaaggtggataaggatactgatagtcgtgtgtacgaccttcagccaaaatgtacccactttaggaatcacaaaacatggtgagacaaagcaaaaaaacacaacatctttccatttcaggcgaaaaactttgagcatcgcttgcaagaggtaaatatagtaatattcaaattgggggttgacgtgacagtatccataataaagcatttataatgaattaaatgtagaaatattcccctttccacagaatggattttatgccactgaataagaaagtatttttacacatccttgaagcaggaaaaattggcctatcaaacactaaaccaaagcatacctaattatatagggtcacataaaaattacttaattacttcatacatttcaaataattaaccatctgttcaaagaaaatacagataaatctggtgatactgctttactagtttttcttaaactgggagatatggatataaaaattcattagcaaaagaaattatttttgaggaagatttccagaaattagaatatgtgaaacagtcgaattaaattcttcaataggatacatgtacagtgtatatgttgtagaatgtagatcatcaaataaacttgaaatggtaaatggcaatacataattttatgtggttatgactggcgacttttgatgtcacagctgattcccaaactattaaccaaaataataattcagagattttgtaagaaaagatggaataattacatacacagtaaatacctcctgcctttgtgtaagatgaaatagtgaataattatacatgtaaatgtatatatatccatcgctttgtggtacaggtataataagtaagtttgacaccacaattatattttgattt

SEQ ID NO: 2732 - DNA, 2361 bp, Oryza sativa
gatgttcatgttcatgtctccttctgtatgtactgttttttgcgatctgccgtttcgatcctcccgaattgactagtgggtaggcctggcggccgcctggccgtcgacatttaggtgacactatagaaggatccgcggaattcagtattattcgggtttaccttcaaattattctactccttctttgttaatttaagaggggtaagggttggtggatggatatacttcaagcctggatcatcaaatattctatgcatttatagccatcacattaccatcagcgatgtagtcatagatccgtgcctcttgttctactgtatctgatcctacggctatcaggtactgatagacgaagagtgttggagccaggaatatcatggtttgttcgccatcgcctctaggtcgcctcactagatgatctagcccacctatgggatctgtggctgtagtttcagtcggaatacctgttcaatgaacattggaaagtggcaattacaggcattactataccaatgaatcatgcaacatttacaccttcgtacaataggtgccgatagcctcaacaaaatgtcatacaatgaaactcctagatcctttttatttcattttaaaatggggctatatgtacataagtaaaattggtccatgccatttccaatggcaaatacatgtatcccaagtttattatgagtagttccaaaagcacacagagtgtaagagcacctcaacacacgattacacacatacatgtatacgtaaataggtacgtaattaactttccgtatacactgttctttgtggggctaattcatactacatgtacattatttcaggtcctgtaaaaagaacagaccatcccgatacatacatttatgaaaaaattaaatgttagtccttttgcgtattggaaacaaatgggaaagttgtccgccactaaatcacatagacactatcaattttgtctatataaagagcccacacctatagttatcgcaactttcacaaatagtaactttcttctttttttgtccggttttattcgaactttctgtatttgtatgcttctctgattgttctggtttattctagaaaagtttgttattaaggttggattttcattatgcagatctgcaatcgaccaacaagcgccctttacatgtacgtacacaactcacgttttctgcataaatcaggagtttcttgacaccactttttttagaggagaatgcctaaccaaataattggctaggtataggaatatatactctggcttgcgtgcccttcctaacaggggcggcgatttcttttcatgaccgcctaccggtcaaaagttgtttaaaaatgcattttggcgagatccccattggttgacgtgtttgtttgttagtttgatttaatttctgcgttcaaaaagataaaaattcaaactaaaagtacaaacattcgaacaataacaaatacaatgaataaaatgtttacaaaagtaattaaacagaaaatcatgtacaattgtatcatacaataaacatgtacgaagcatacaaataagataagaaatttatagttaatatttttcaataaattagagaggcaatttagaacgcaggagactaccatcgtgagcggttaggctggaggtggatggcggcctcataaaaaagagaaagaattggcgacataattctcttgggaaaactgagtgatcaagtgggtgcagtgcaagtgcaggtgcagaaagcagtttcttgataaagaataaaataagtaacggttttattataccaatttgaagagggggagcatatgattgtattgtttgtcgtttaagtaaagcttatagggagtagattgttaaagaagactttatgttgtcaggaaaattattccaaatgtccaggtcagaatgtttaacagatttgcgtgttattgataatttgggatttgtaagatggaagtttccagatgagcgagtagggtacgaatgaacagaactattaaacctaaacatgttatcaaaggatggtggaagttaattattgatgtacttaaacataatgacttctacttgaatagtgttcaaatcgaaaatgtttggtgttttaagtttatagaataaatgatcagtgtgagctaagaaatgcgaacctgtacaaatacgtatggctttcttttgcagtttaaaaatagaattaatttttgtcgaaccacaatttgcccatacaatattacaatatgttatataagggagaactagcgtattatatagtaggactaaggttgcatgtggtagaagaaactttagcttggagattattccaatacttttggaaatgcacattttaacgtggtgtaaatgatcat

SEQ ID NO: 2733 - DNA, 2984 bp, Oryza sativa
attttgctccctccccctttcaattactagtattactgcactattaacgatgtagtccaatttttttggcatagttggtaaatgttacagttttgtatttgttatatttctttcccggtgtacatgtatctagttggtttaataagaaaaaaaactgataatcttttttttttctatttcagaaataaaatctttacaaaactgttctggttagcattctttaaatatttattgtacaaatcacaaaaacatgtttcgctctttatgtaaggggttccatgtccctatactgtattcaaaatatgagcttcaaaatgcggcacttctacaaaatagatatcaaggtaaatatataaccagcaaatatatagtaaaatgacttgttgagtacactagtcgattaatgcttacaagcttacatagaacagggtgcaccaagcggaaccaaagtcggaattttgttccatatgcgccattttatgttatcctttgttttcttcatacaccttaaaggtactatgtcccatttgcaggccccaaaaatgaaaaggttaaattccaacgtcatttgaaagataatactaatttagaacttccctttaaaaaaaaggggggcgggcttgaacattctttaagtgggaaaataacgacgattagttgtcgaatcgacttaagtactgcaaagtcagtaagtaatagtctgattgttcagaccattgtaccgaatggtcgtacgttttgtgctgcgcaaagattcaatcagtttaattcgggccattacaagaagtgggttattgatgtagacaaatgctcatgtacccattacagatcattgtatgtatgctattagcgaagaagaaaagccagtcagtcactcaatagtgtctgacagtgaagtctagcaagtaatcggatttccttgcataacttatattaggactggtaaagtagtttaggtcgatcttatacattctagctatacccaacaaattgttgtaggtgattggtacacttttctccttcggaaaataggtccagaaacaattaatctatgagatatttatacagctaacaaaatatgttgtaagacatgatatttatttgcaaaaatgatgacttgaagcgattcaaaattaaacctgtgatttcttacaaatgtactttaccttgggcaaagctgttattaggggacggtgttgtgacatcatcactgaacatcactctcccaggattcaggatcacagatctacctttcctcttcataaccccttgaggctattcacaaagaacaacgaaaaaattgtaaccgcaaactcagccagaagattaccaactgtgcggagctaccacccatggtgatctgccaaatatcacaatgactgtgtacgtttataaatcatcaaaaacatatttatacatggaatagtaccggtacatgaagtcgtagtgctcatcctccctcccctcaaacaaaaaggaaaaagaagagagaaaatgtaatatttatgataataaaaactccaaaggtttggattgggtttataaactttaaatttaaagtcctcataaagagcctgtggaaaaagagcaagattatctgcaaaccctgagccaatagtgatggcacccctacaaagtacatttatatcattcaatgccagaaagttttaagacaggaatatacatctaagcatcaacatccttaaattaacaacatattgaacgattcattatcactgtttccgcatctcttacaagacattatccagtaacaaattaatcaacaagtcaacttccaatattagtgaaaacccaaacttcaatcaggaaccaaactctattaaagctagaggatatgtaaccttaaccctaaccctatagtttgcaaaacccaatggcaactccatctctaagaacccttttattttttttccctatttcagaccaccataatttatcgtatagctatacgacaaatacttaaatttgtcctagtcttgacatcttaaagggatagctgagttttgatatagagggcgctacacacaattattttgttgtgagataatgaaaacttgagtgtaaaagcatacaatcgaaataacaaaaccctctatgtttgatcacaaacggttcaaagacggctgaaatatccgtaaatataaccatttgtggggcgccacaaatattcgataattttgaaccagccgttcaaaaaacgaaatggcatcttttacgtttgattccagccgatgcctattttggcgttttgttggctttttcgtgttggttataataaccagctggcccgtgttttgttattattaactaattaattaattaacggtcatctaatttttttaaagtaaagctgaatgggtatgatcagatttaatctaaatttcacgtattttggggtctaaaattaccttcaaagccatttcaggtcctaaaagggctctagaaatgtccgaaataagaataagagcaataaccatgcactttgaaggcatttgcggtctgaagcaaaaactcaactatcactttaaaagaaatgtcgtataaccaaacgttgtatggtgatatgcctgttcgagtatcgtttcggacgaaaacccaataaagaatcaggatcctaccttggtctaaatggtcggccttctcttagaattgtcacacaatatttctctgtgatattatgatgttattttcttgtctgtatggtcttgccgctctacgatgatactgtaccattttacgagtttcgtttcaatttcatatatagtttgaacaatgttatttgacaaaatgaacctggggcaattgtgacaggatgaaacacatttttcaatcaatatcatacatgtaaatatttctaaaagtataaattggtaccacgacgagaagagttttcctgacgatgtcccgcttattcacaaaatgaacctggggcaattgtgacaggatgaaacacatttttcaat

SEQ ID NO: 2734 - DNA, 2083 bp, Oryza sativa
acataatcatatcactagcaagtacaagcttaagatatgccaaaatgcatgaagttgcaaatgacaatatgcacactgagatgtgcattaaacagtttgcctacgcttttatatcatgatatgtcattcaatgcaaatgacggccccatgactgtgtgattcttggcatgttgattgggttcgtttcttacatgttttttatcaactttatattcacattgtcgacctgttttataaaacaaataaatgtacatctttttaagctcatgtattagcaatatgtacggcactcggttgaatcacaatgaaccagacaatgaactcgacaagtcttggtcaatatctaattgtaacttgacctgcgtgcataattctcaaaaatgaattatttgtgtactaatgtatcatgtaaacgataagggaatgaacattaagtgctaaacaatgcacaaacctcaaaacccctgataccatagttgaaaatagtggcgatgacttgcgtctgttcgagcctgacaactgagtagggaaggtggagctggatgaagaaatcctggaacacactcaccgtggtttcagaaatacacattccttgagtaggtgaaaaactgacagctgtcaaatgccaatccgtgatactacttgaggtggagatcgggtataagtacggactaccatcttcactggaaatgagaatttaaaataaaaatgagaaaactagatggatgttcaactgcacgcaatcgaaaatgatgcctccgccataaagcgattttacaaaccaaaacagaagcaatcttaaaattcaagtttgattgtaatccattaacaggttctcagaatatcgtgattaaaagctatttttcacatacacgtatgaccctttgaactttgacctcatgaccctaaaatctaatcagttcattggctctgatagatgcatacatgtcccgagtttgatagtaatccattcatctgtattaacaatgcgttcacaagctatttttgcatacataatgagccccatgacaattgaccgttgacctcatgaccccaaactctaatcagttcattggctctgcaagatacatacacgacccacgtttgacgctaatccatcaatcggttcttgagataacgcaatcccgagctatttttgcatacataataagccctgtggcctttagaccttgtgacccaaaaatgtatcagttcattggctctgcaagatacatacatgatccaagtttggcggtaatccatcaatcggttcttgagataacgcgatcacgagaacgggacgacatacgtacgtacgtacggacggacggacaaccagaaaacataatgcctccggctgctttgtagcggaggcataaaaaagccataggcttcactgagaacaatgaacttccaggttgcatgctcgatatctggaaggagacactaggggaagacacatgagcatctggttccatccaggcagatgctgaagaacgtaagcagagatgccaaccttcatcataaaacaaaaaccagtattttgggacaaaaaaaacagtatttttgaaaaaaatatctcaccttaacatattgcccaatcgagaagctttaaaaaattaacggcagtaccacgtaccgcaaatctccgcgtataagacgcacctctgttttgggggccacgagaaaaaaaaatcagtttttttttcgccgactttgtcggcagcaagccaagtccaaggactttcatttaactacgaggtgcagttgaaggcgcccatttttgcttgtgaactcgttacaaataatattaacaatgtcgtttttaaaagaatgtgtattaaagatcattaatgtaaattatatacagtagagtacctaggatagaaccttgtggtacgccgtgtgtaatagaaaaaaaggggaggaattattattataaactacatattgagatccgtctattagaaagattactttcaaaccaagataacagacaaatttgagtgttgttctagtttccgactggtgagtcaacaaaccgattactgagctgggagacattgccaggtgaaagggcata

SEQ ID NO: 2735 - DNA, 6402 bp, Oryza sativa
aaagggctgaaaatataaggacaatgaaaaacagatgcataatggtgagcatgaaacatgtagagctttgttaacccaaagccgataagtttagtgacgttttattcgtatcttttgatccaaaatgctctgaattactaatacataagcagaaaaaacataaactattagaactataaatttgagtccatttctgttgcagtaaactgtgccgttcattaataagagtaatttaatagaaaataatcactgaagtctctaaattggcacgcatacaatggatgcatgtttggcaagtgaccgaccaggcagagaaacaaagaaagcaaccaaaagtgttaattccttaaaccacaataacatgtatacccaaacagacgtcaacaattgacaaattggaggtacgtgatagccaactccactcaatccttgttcataaatacacgactcagtaatccgcattttaaaaagttttatttacatgcaactgtatggcaagtaggggtcatgtttgatttagttaatacaaatttgcctcatatctttagagtactgtgacattatagagcatagctattccacaacacaaaaggaagtggataatcacgtcttccaaaatttaaaacgacacaaggtcactattagtgggaagtgaattttggaatagattacttatgtcaggttaacaaggtctagaaatagatttcgaattccttacacgtcatttgttcaacaaatcataaacgacaactccatgtaaatactagtcggcaaatatatacaaaaatcaattttattttatcattttgtaaattgtaggactttgtttagtattcttatttttttaaatattgaatgttatagtaaattcaatacttttaatgttttttcgtgttctaaacttacttgtagaagttaggctcgacattcaagcacatgtgctataatctggcccccggtcttttaccaaacaaaagtttatcttcatgtttatatgaagagctaggtagtacactctcaatgaaaactgctcaatgttgagtaaaatattactcttttaagtagttaaaaaggaaccgctcaacttttgagtaaactaaactcagcttgtgttgagtaaaaactctgctcatctattgagtagaaatagtactcaataaaagactaaatatctactcagtttgaatgagtcaacctttactcaatatatattcctttgttgagcggttccctttgttactcagcatttgggtagaaacgtacacaactcacgtcgagtaagaaactgctcatgagttgagccaaatcttacttaattaacgagtacatattttgactcaatttattttgactcaatttgtttgagcaattttttgctcaaatattgagtatcatgttttctgggtaacgcttagttgagtagatttttttgctcaatcaataatgagtaaaaacatgtactaagctatttaatacatgttattagtacatgtttttactcaatactgattaacacaaaggtggattcaaccagggttgtaactttttgactaaggggttaactaaaccgctgattaatattgttctttttttaacagctgttaagtaaccttttttttttaatagagaaaataaaccataattttgcctgatttctaaatttagcattgatttgaagttcttcactcacacactatgcaaatcacataaaattcacgacattttaaattaaataacataatatgtggactttaatttcccaaatcagtttgaatcacagtaaaaactcagagttctcccatcatacatgatattaaaaagtatgtagtttaacaatttcaattttaaaacaatgttactttacatcgcatcatcataatcagcatttaagtttttggcatcaattctgaatgttaaatatcagtaacataatttgtggactttaatttccaaaatcagtttgaatcacagtgaaaactctcatcatacatgatattaaaaaagtatgttgtttaaaaattgtttaaaaccttcaattttaaagcagtgttactttacatcgcatcatcataatcagcattcaagtttttggtatcaattctgaatgctaaatatcgcactcatcttgttatgattaacgccatcaatgaaagtcaggtaaacaaaaattaatacatgaatctcctgattacagagttacaaatttaaagatttaaaagccgtggtgccgtggtgctgagtgggcttttcccaattatcccggcgtttttatctgaccgttaggccgtagaaagcccgtaaagggcccgaatggcacctaatgggtcccgcgcgggctccagacggtgcccggatgccccctcacgatttttgggggccaattctcatgaaaaatcttcacgggcgccttgcgatgctcaagaactccatacgtgtaccctaatgctccctcacgggcccctcaagagccccttgtgatatgcataacaacaggcgtctagtgtctgggggccatttgaaattgatattgcccgtgcgggtccctcacggcggcatctcagaatgttcaacgcagattaaaatacaggaggtgcggatgccagaggacacatagttcagtgaaccgcgcggcacctggccgggcgccttgaggatcccggtcgggcgccgacagggcaccttccgggagccatggatgtccctgcttatcggacgccttgcatttcactcgaccaatttttaccgggcacctcccgggtgtggcagattatgtgaccatacatccggtagaaattaaaggttcccgtatggtctctatatcctcggcaagctgccgggtagggaaaatcttaccgggcccggttaatatgtgacctaggcattatggggcttttacatattcactccgcggcccgtacggcgagtaaaaacagacatttttgaaattttcggccggtgcccggctggatcccgtacagttcctacgggcgccgggacatgtttcacttgccttacgggcactgtggtgatgagttggctgctcctaattctcccggcattttcatctgagtgttaggccgtataaagcccgtaaaggacctgtggggtaccgaacgggtccgagcgggtttcggtcggtgcacagacggcccctcccgattttcttcttgtaattttcaatggaggcgcggatgtcaaaggacaaatagtttagtgcaccgcacggcacccagccgggcgccttgaggtccccgtctgggccccgggagccattaggtgcacctgctaatcggacggagcgcgatgccttacgggctccttgcattttcaccgggcacctcccgggcgccgcagaatatgtgaccgaacgtgctgtagaaatgaaaatcggaagggtcccgtacggtccctaaaattcacggcaagccgccgggtagggaaaatcgtacggggtccggtgtatatgtgacctaggcattaccgtgccacatctgaacgagcctcttaaccgatatccttctgccggaaccaaatgtcccctgaatcaatgctatacaagaggattcagtagtcagcatgttaaaacgagaaatatcgcaatctctattgccgcgcaatgcgaatgtacccctcggcagcgtcatttttttctgcggcacatattgaggcttttttttcaaagaggtcttgattttaaccctaaccctaaccctaaccctaaactttcccataggctcaacacgcacctaaccccaatctgtgccgcagaaagaaaaaaaaacgccccccccggcattggcagcgatttttatgtcatccttatccctgaaacaaaatgacgacgtagagattgccactagtggctcggactattgtcaagactaggaacagcatatcaccataataatatgtgtgtagattagagtataacgcacctctatggaaaatttgaaagaaatgtgtgcagaaatgtgacctgcaaagcgacacaggatatcaccttaagtacgacctttgaccctataacagacggaacacgggtggcagcatcaccaaacacttaagatgtgcagcttttactaagaaacacctcgatccatacaaaatttgaacgaaatccgttaagaaatgtggtagttatagagcgcataaaagacgtatgacctttgaccgtataaaggacggaacaatgagggtagcatttcattttgtggcatggtttacacaatgtaataaatgaatcaatcaataaattactttaattataaagaaattaaaaaataatatgtttactcaaaaaatcaaaaaaatcaatacaaatgcactctacatgtgctttatggtcagtaaaatatactgtaaaccaaattcgtatcttcacccctgagccagaggctacatacaaaccaatatataagcctaacctaaaacccagttgcaaccctaaccctatatctttgacaaatgttgccatagcaaatgtacatgcaaaagcacaatttatacacatcataatggcaagcatcaagactggccctatttcattcctctcgggtaccagctgcacacatccataaggtggacaggctagatgtttgggggaagggactacgtgttctacttcataataattcaaacttgcatcatgtaaacatgacaatgacaatgggccagtttatcatacttatagttcagaagcagagggagattaggaaggagaggcagatgaataattatgtcaaacttacggcatggaaacgacgtcgaaaaaccaagtctctttgaagtcctctcggactcttacatcaccattctgataaccaacacccccgcctgatcttcgcaaccttggtttatcagctaaacagtttactagataagtcggatcatacagacactgttgatctgtaggcaaattcatagaaaaataaacaggtaattttacttcttgtatagattgaaaatagaaatatgaagaaacaaaaattaacaaacaacacatgacataatgtacatgtatgttgtttacaatacacttgaacctattgtaggccaaaatatcttgtgaaaaatatcatatacatgaaatgttatgtgtatggaattgatttttagctttgtttcacttttaattctgtgtagctggtaaactttatttccaggatttccagtttctgcttgaaggcccggtcacacagaggggacgcatgggggacgcacgaccagcgcattggaaattgctaggcgtgcgtcatcattcgttactcgttcgtcgagcgcgctggaccaacgatggaccagcgctatgcattcgtcgttattcgctgtgtgcgtcgggtttttgttagcatgctccacaaaagtgtgcgcggagctcgatgcatgaatgtacacgccaaaggcacgccagccatgcgtggagcgcgctagaccagcgccagacatacgcggagcacacgccctgtatacgcacagcgcgctagatacacgctgtccattttgtgtcagctcgctagcttttccaaaatcatgacaaaagttaaggccaggtcacacagaggggacgcatggggaacgcacggccagcgcattggaaatttgcaattttggccagtgcgttgtcgtgcgcccaacttttgtcgaagctacagcgagctgacaccaaaacgcgccagcaacacgatgtgcattcgtggaagttgttatcaagtgcgctctggtacggcctgtatacgcactgtatgcgccctgtatgcgctcagcgcgctagcaacacgctatgcatttggtgtcagctcgctgtagctacgataacagttgggcgcacgtcctcattcgttactcattcgtcgagcacgctggacccacgctatgcattcgtcgtcattcgatgtgtgcgtcggaattttttgagcatgctcaaaagtgtgcgcggagctcgacgcatgaatgtacacgccaaaggcacgccatacatgcgtggagcgcgctagaccagcgccagacatacacggagcacacgccctgtatacgcacagtgcgctagctacacgctgcttgcattttgtgtcagctcgctagcttttccaaaatcatgacaaaagttaggcacacggccttttctgatttccaatgcgcgggtcgtgcgtcgtctatgtgtgaccagcgcgctagcaacacgctgtgtattcgtggaagttgttatcatgtgcgttatgtgtacgttctgtattagcactatgcgccctgtatgcgctcagcgcgctagcaacacgctatgcatttggtgtcagctcgctgtagcttcgacaaaagttgggcgcacgacaacgcactggcaaaaattgcaaatttccaatgcgctggtagtccagattcagtccgttcattctttttatcccc

SEQ ID NO: 2736 - DNA, 683 bp, Oryza sativa
tcgtcaccgattggaagcaacccaagacagttactcaagtccgcagtttcttaggtttggcaggatactaccggagattcatcgagaacttctccaaaatcgctcgacccatgacacagttgttgaagaaagaagagaaatttgtgtggagcccgcaatgcgagaaggcgttccagactctcaaagaaaagctggtttcctcgccggtgttaatcttgccggatactcgcaaggatttcatggtgtactgtgatgcttcgcgccaaggattcgggtgcgtgctcatgcaggatggtcatgtggtggcctatgcctcacgccagctacggcctcatgaaggcaactatcctacccatgatttggagttagccgcggtggtgcatgctctaaaaatctggcggcactatctcattgggaatcgctgtgaaatatatactgatcataagagtttgaaatacatcttcactcagtcggacctgaatcttcggcaaaggagatggttagaactcatcaaggattatgatgtgggaattcactatcatcctggtaaggccaacgtggttgccgacgctctaagtcggaaaagccattgcaacactcttaacgtccgtgacatcccacccgaacttaatcaacagatggaagccctgaacctaagcatagttggtcgtggattcttggct

SEQ ID NO: 2737 - DNA, 536 bp, Oryza sativa
ggcaccttcatccacttcggccgccgttccagtagtcgccgtcgacccgtggtgagccgaagaccgccgcttcgctccctcttctctcctctctctcgggcgccgctccgttgcgccggtggtcgccggcggtgaccatctaggcgcgggcgcgccgcctcccgtcggccgtgccggcgaggccgcctttgggcgcgccctgcggctgccaggtggggcccggccgtcagctgcccgcgcccgcgggtgcggctgacgcgtgggacccacggcgccagccgccgccagccgcgtgcacccggtccaccgtggaccgagaggctgacgcgtgggccccactccgtggacccggtccgcgcaccctctctctcggctgacgcaataaatgagtttttaattaaaatttaaatgaagaaattcgcaaatatccatttaaagagcatatccccttcaaatggccataacttggccatttgaactcggaattggaccgttcaagtctctaatttttccttaagaagtcaagaagggggatc

SEQ ID NO: 2738 - DNA, 725 bp, Oryza sativa
cggtatgtaaacgatatatggactgctttaacattcgagacatgcatggaagagtctatactggctgtcggtgacgttgcatcatgccatgactcctcggcacggatctgggtcatttgcaggatgcaacgtccacttgagcctatataaacatccatgcctatcatagcagtcaatatatctatactaatgagcggtcattagtaaaattacgtgttaggcaaaataaacgcacggtcacctgtacgctctcaaccaatcatttgattaggatctgcttcatcatctcataatttccattattgtatcgatttttaggtaggcgatccacagtagtgcgtggagaggttaatgcatgaacaccctgtgtgagtgaatgcatgaatagcattgcgcattgacgagtatacaggtaactgtgcacagctctctgttagcgttaaagtaaacctattaaacttggagtttatttgtcagcgataaaaaaaaatcaaaaacaatcttgaaatgaattctctttacatcaaataatacggatctagggctttgtttgtaaaaaaaaaaaaaatgatgcacgtttttatttgttcataacagtatatatatgcactcttgttgaggctgttaatgcacctatcgaaagaagtcgtcaggcttcgtccgatagatgtatacagcctcaaaccgagtgcagatagatcatagaatgaactcattcgcatgca

SEQ ID NO: 2739 - DNA, 989 bp, Oryza sativa
tgctactatctacatgttgtacatcaggccagtgctagaatttgcagcacctgtttggacatcagggatcacaaacaaccactctgtaagcatcgagcgagttcagaggagagctcttaggattattacctaccctgactctagaacttatgatgaactgcaatctcatcttggtgtctcctctcttaaagagagacgcacatccctttctctaagatttgcagaatcacttctccaatctaaggttcatcgacatctcctgcctgagagcagagttaatgactgtagccgcattctgcgaaatgcacttgatttgtccttgcctaagatgagaactacgaggtaccgaacttcccccatcccatctttcactcgatctttgaataataataaatagaggcttaggtaattatcagtataatgtatgtcatgtatttcagcaataatataattatgtgcaatattaattgtcatgatgattggcacagcaggttcttccattcattcatattttgatgttgcatgtacttttatccttcctctcactctctcatcccttttctctatctgaacttgccacttttcaaatttccttttcttcttcagttctgatctttcctctctatttctatttcactcccaccccctctctctcagctctgtctctctgtctgtctgtctctctctctctctttgctctctctgtctcttcctccttatccctttgtctctccttcctcccctctgtttctctctcccactttctgtccctccctcctcctctccacctcttttctcttatgatgttttacagtacaacattctataattatatttctataattatatgttatttttactgtgaccaataacacctaaggaattccattttttttgttgaaaataatgataaattgaggcttaggtaattatcagtatgttttatatgtcatgtatttcaccaatataattatgtgcaatattaactg

SEQ ID NO: 2740 - DNA, 15503 bp, Oryza sativa
taggtaattatcagtatgttttatatgtcatgtatttcagcaatataattatgtgcaatattaactgccatgatgattggcaaagcgggtttttccattcattcgtattttgatattgcatgtacttttatcttcctctcactccctcattccttttttctattcgaacttgcttcttttcaaatttccttttctcttcttcagttctggtctttcctctttattctttatttcactcccattccctctctctcagctctatgtctgtctctctctctctctctgcctcttcctcttactcccttcatctcttcttcctcctctctgtttctctctctcactttctgtctctccctcctcttctccacctcattctcttctgatgatgttttacagtacaacattctttaattatctgctattcttactgtaaccaataatacctaaggaattccattgttctcatgtgcaatatgtttatacattatactgtactcatatcacgcttgtgattagcacactgccaagactccgattgtaatactatttaatactttttaatactttttaatactcaatattcaatattcaatactcaatacttaattacaatttttccaatgttacagttaattgaattcaagtatctgtatacattttatttgtttatatgtcaacatttattcatttttgccagcaatatttcatatcttgtatttttgttttaaatttttttttgttgttttgtttttttgttactactttaatgtttttaacttaaaaatgtattcattgttatatatttgtcctcatttactatgttatctttatgtttttgaatgttttttatattgatgtaaacttgcatttttagtcttcggacttgttgacaagtaatgaataaaaccttatttgaacttgaacttgaacttgaacttgaaccctatttgtctgaattcagtttcccctctctcgcgcgaatcgcggaagctttgacgtttctttaaactattagaggaagcagacgattcgttgtactgttcacgacttttaatccttatctgaattcagttttcctccgcccgcgcgaagcgcggaagcttagacgtttccttaaattattagagaaagaagacaattcgtcgtactgtattcgactcgtctaaatgaagttttccccacctgcgcggagcgcggaatttttggtgtttcatcaaaatattgagaaaggacgatgattcgtcgtataccgttattgactgttactttgattaaatttagtttccacgaaaatgttaaacctctgatttcttcagctgatattataggaaagtgaaacttcgaaaaaatacaagttgtagctgtagtcactctcgaagttgtcacagcggataaaaagtcacagttcgtagggaaaaaaaacttgtcggccgaccgacaatatacatctcaccgacttcaaacttctgcattgatattgtacacgaggatcgagcaagaataccgacacatgacccgacacagcaacatatttagccgtgtctttctactccctcgacgagacgactccacccaacaaccccctatctcaggctcttacctcccctctctcttctctcttttatcccctgtttctttgttttcccttttctcttttttgtttttgttcctttcctttcttttccttccttccctctcctccctcttttttttctctttctttcttctcttttctttcctttcctttcctttctttccttttcccccctttttttttcttccttttctttttttcttttctttccctttccctctctttgttcccctcccccttttcttttttttcccgacggcagcgcaattttaccgacaatatcctgacaggtgggggtgtcacatccccaacccccccccccttatggagatacccctgctgctacaactacacaaactcaacacaccttgacagtttttttcgtaatacaatatttcagaggtgtttttattttttatttgtagcccaccttttgacgaaaaagaatatttcgttaataatatttttaaaaaatcttgaaataccataattttggtgtcatacgaatgaaaactaaattatctacattttgatattaatttcaacgaaattgggattagttaacatcaacatttatatcaaaaatatgatttttttttttttttgtaatttttttcgaaatatttaattttatcaaaaaccgttattttccatatatcaaaatcgatgaggtgccttttttgtaacttttcagatatttgcccatgtacaaggacgatattctttgcgaaggtgatgctatctcatttcagtgaaaagttatattaacccaaacttattgatttgatttcgaaaaaaatgacatctttgcctattcgtatgcatatacgtgtattagtgtatcatgattgaggacgtgttactttggtgtgttaacatcaagatacattttaagttaaacctctaatcaacatggatttgtatcaaaagatggataattagaataccttaaagttaatatcaaattaatttggtttaatgtagtgtgcgaaatatacattttgagtaaaaaaggtgcttttttgtaggatatttttccccctaattttagccagtatctcggtatattaacgtactggacagtagtgattgtacattccgtagtacagaaagttcaaaggattcagagtgctgagggcaagtgataagtactttttttgaactttgtgctgttttaggaaatgtgggtattggcatttgccccccccccccccccaccctccccttccagccgcttgtcataaactaatacatgaccaagacacgttagtgcattaacatgaataaagtaatgcagacggtcaaaaccgggcgaaattcggggagcttctccgcccggcgtcccggcaaagaccgactgatctcccagcggggggtagtgagctctatatctttttctttggccctcgaaaatatgaacatttgcacccccccccctccttgagcgcaaggggagggaggggggggggcatctcccaaaaaaggtaaaattaacgcgtttttacacgttttttttcagggggggggggcctggatccgccactgtcctaaagcaactaaaaactatatttctatgtttgtcttcataagtgggagatatgaattgctatcaaattccgtgatatgtttctcaaagtcacatgatatattccagaataaaagaatacattattaataaattcggatatgagcagtgttaatatgcagaatgatgggtagtggataaatattattctactgtgagaaagtggatgaaaatatacaaaagagtttcaacattaaaaatgtggagtctttcattttttgtaatgattctagttacctgtatatttgcagatttgacattcatgaatgcgtaatttgtgtattcataatatatgaaaatgaacctatgcgcggcattttcaattatcttaacaataatgaaacgttatgaatttggaatgaaggaaacatttattcaatacatttcaagattcttaacaagtccaaaaacaaataggcctatgctgatttttctgtaaaatgcattttgcacatttgcaaattaggaaaaaacgaattatatcatcttgttccttacgtgaatatctacaaacatacaaattgcaaaaacactgcttatacagtatacagaaccaccctatccaagtttggtcaatacatgaacttatggaagaccctatttgggttttcaacacaaaattgcgctgttttaggcgggctttgaaataaagttgatgaacagtaaagtctagttgacatatgcttggtaaatggtggccgatttttgttttctcctttaaaaacaacaacaataatgcactataatcctatacatacatgcgcccactaacatgtatctgtgcatgtgttgtacgacaaacagatgtgacgagtagaacgttacgaaaaaaacacggttttgacctatactgcagtttaaaagcagtttatcaaacatgcatgtagaatgtaagtgcacttaaataaacttacaagaaagtggaggtctatgtcttcatttcctgttgttccaattctctgaaccaagaaatcagttgtcacatcaacctacatcatgaaaaaaagacaagtggaaattagctgatcctacatttgctcctaagtcttattttgtcacatgtgtagggctgcgggtagggctgcaattgggttttaggttaggttccagttagggtaagagttacaaggtatactggtagtgtttagtccttcaccatgccaaattgcttatgaattttattaccctaaactatgttgttatacccttgttacggtttcttttacacaatttgtttttatcagtgtgtatacaaatttgtaaaatatatttcatatttcatcaaagatagatatacaaacattcatgtatacagtcagggctggattcgctatgggttttctgttcagcatagggttatgaatgcaatacattttccgttaggtttagggttagcgacggggcttggttcagggccgatattcaattcaatacttatgtcaggaatgtgaatattttacacaattcttggcttggataaaatactttgacaactttggtattcagttcaagattttggctcagtattttaccctaaatttaagacagcttcctattacagacttaagctaataatttgtggaggccttgactggcagcgcaggcatatggttttcaaagcagtcttcataagctgtgagcaaatatatttgtgcagtttaatacgacgcatcaattatattgcgcatcattttggattttggatcagtaaagtattttaccctaaatttggcttactaaggtagctcagatgtgatctgaatacgagttaagacatggccaagtaaaatgctaagtaaaatactgtcttaatccacgtactaaattaaatagggcgccaggattgattttcagctcttataacttgctgatcacgctatctcttgtaatgagattttggtattggttggtctgcacctacctttctgctattgagtctcccatgaaacagacaaagtattaagcaagaagatattttggaaactcatttacgataaccacaataatattcaaagcttataagcacagagtgggtgaaacccagtaaaaaaatatattttctgacttacattcaggctacggtaatctgcatatcggggtctgatgaccaagtaatcattcccattggccgagtctgctagacttactccaaaggacatatcggcttggttgttcggatattgcggatcatgagttgatgcctaaaaaatgacacatgcataaaatatgatattacttctgtgaccacatccctttgtagaggtttctacaaatacacccccctaatatgctaaaaatgtccagaatgaaaatggaacaataaaaaagaaagagcataacatttccaaatgtttgcctatgatgttaattatgaagaacaatgtcaggcatcataaagacacaaataacaaaaaactggacatgtaaattactgactgaagttatatgtacctggttgacagtcattggactaatacacaagatgtccgtagaccttacgttcacatgagctcatgaaagaaggagccgtgcaaaaaggacctagctcccatcccctttgcaccaggaacataagatttattagacattagggcaatttaggggtgctgccccaaagtcccctacaggggacctggttggtggagacatgacagtcattggactaatcaaaaagggacctagctcccatcccattttccccaggatcatataagatttattggagcattaggacaattaatagggttgctacttcaaagtcccctgcaggggcaggtatcccattcaaacaaatataagtcttcttcacaaaaaagaatttctacattgtttagccagaatccataccaatattttggtatgaaatcatatctatattgcatgatctattatatgaaacaaattagatggatcttcgactgctcgcagtcgaaaatgatgcccccgcaatagagcgattttacaaacaagacggaagaaaaatttaaattcaagtttgattgtaatctaaaaaaggtatagaccagttttggaaacgcccccctctcaacaaatgaaacggaagctcttattgacatgacccaagtttggcaggaatccaccaatcggttcttgagataacacgatcacgggaacggaatgtacggagggatgtaccgtgccgtgacggaaggacggacggacaacccgtaaacattatgcctccggctacttggttgcggcataaaaatgaggctaaccttgggggcatatacccagtcttacagacgacggacaaaataagtcgcaatcattcacttgagccgttggctcaggtcaacttaaaagagaaagacctcagaccaaacctctcaaaaaaaatgaaaactcaagtttgatcgattatagctgtcttatcatggcattatcattgttttaaataatatcattagaaaatgtttttattcctctttaaaatgataccatatttgttatgattttgaagccatgaaataagcagtacatacgaataaaaggcagggtgaagagtgaaaagtttcaaaatgaactggtaaacactggtctagtattgtataacatacagagcactcttctttctttgacctaagagagtgttatttttgtatatgacagtggggctattatggttcccaactggtcatccatgaaagctaaattctaaagaatcaaaacttgaaattcatgccctatggtgaaatgtcaagcaagattttatactgtatagtcataaactttctgaagtatcatgcctaggttgacaactgttgaaaaaagcttgggttatggtataatttgaatgaacaagggcagtgcattttgtaacgttcacttttgaccttgcccttattttgatctactgcacattctatgacttaaagatcataaattgggttttatcttttgcatgcaagaatctttcacaaaatgtgtgaggcgctcggattcctgaaagtttcatgcgacataataattaggttgcaactggcacaatgttgaatttttgctaatcacaaagtgttgttccacaaaaatgccttttctttaaaaattgtcgttccacattttgtggtttagctcaataactttttattcaaatataaacaaatgcatgattagaaagagcaaacatttctgcacatactacgtccattttagtttcatgaccacgtagcatttgatgccaggaattttaaaaaggcaacacaaaactaaaaacttttaaggtttagaccagttttggaaacgcccccttctcaaaaaatgaagtggaaggtcttattaccaatcatgtgaaaaatgtgtttttactaatacgtaatgatacaaattttgccaggaaaccgcctacttattgatatatttggtaaattatcatatcgatttggactggatagatatcgagctcgggtatatagtcctatatacatctttctgtgtacaagtgcttgtaactttaccaagactgggctaaatttcttatcatccagaaccttgcagtacacacaaatacttatatgctagatgatcaacctcttctgatagtttccacaacgtttctttcacattgcaatcgcaccaccagaactggtctatacctttaaaattcgtaacttgacaacacattgaaggtttgaaattattttgttttaatgaaaactggccattatttttacttatcgataaagttcttacccatgtacatgaatattgtatttagccacattacataaattaatgagaaaaatgtagtgatgaaagaaaagaatcttgatgccaatttgaagaacaacatgtgaaccattaagccctctagcaaagggtcctgttctaaataagtttgttttctttgtcttcttaccacaatgttaatgctccttatacttgattggacaccaaaatccatactgactcctccttgatcatcagtgttggatctcaggtctacctgactaccatatatatcagtcctccgtagtggctcctctcgaccacctagaaatctggcagttgctatgacacttacaggaacatcggtggccacatctccatttgcaaatgttaaatccagctgcgaagaaaggagaagtaatttatggtacgaaaggtcccgggtttaattccccgacaggcctccaatattttaggttgggcgcttcaaaatttatttttaatcctctacctccctttttaacaatttaaccatgatgtctcaaacagaatgaacgtaaaaaaacagacaattgattaagtcatctactgcaattggcacatacatgtaggggcctggggtcgcttcacaaaactgtcatataagtacaagatcaactaaatctcgaccctgtcatcgacttgtctactaattgttttacaaaaccgtctttgccaagacgagcgacaacttccctaacaagagacttgttgcgactccaaacctgtcaaatcttgttagaacgccatctcatgtcaaaggggatagttgagttctgttgcagagggcgctacacaaaataatttttttgtgagataatgaaaaactgagtgtcaaatttgaaagaacataatattgaaattacaaaatcatctttgtttgatcaaaatcggttcagagatggctgaaatataccgatttctaatacttgtgtaccaccacaaatattagatattttgaaaaacttgaaaaaaccgttgaaaaaaacgaaataacgccttttacgtcgtatttcagccaatgccgatgttggctttttttgttggcatttttgtattgcttataatatccacaattagtcggctcgtgtaatgttattttcaattcaataattaattaacggtcaccatgttttttttaaaagtggagctgaattggtatgatcgtattggctgaatttcacacattttggggtctacaattacctttatagcaattttaggttctaaaagggcactataaatgtcatagataagaataagagccataaccatgcactttgaaggcatttgcggtctgaaaacagaactcaactatccctttaactttaaataagtctttgggcagcaaaaatatggagactgaaatctattttaaaacttctttctttatcttcgagctctcaatttattgaacagttcatattggtgttaatacaaaagcactaaacaagcataccgtgacaacttattcttatataaaaaaaaaagaatgactgtattcttcccatacatctttctaccatagcaaagtcgcgaaagatggaacattctgtaattatgaacccatgagaatgatgacaattgtcgtgtaggtacttctctcgatattttccctttacaagcataaccttgatacaaattcaatcgcataatttaattatttgataagaaaatgtaaaaactttgagtactaaaatgttatgttttcattattttgttaaatagatatagtaatagtggcttccaatctttaattttttttaaacagttttagtaaatctaagcctcataacaattttttgtgatatagaataaaattaatcgatcataatgaagattatattttttagccgatagtatcgaaatcatgaatttgtcggttatcatggatttgtgaaattggttgtccgcttcccgacatctctcaggtcgcagacctcctatattctaatgttctttgacaagacatttgtcactctccacccaggtgtgaaatgggtaccggtagaaaggaattccttcaatgctgtgagcactgaaattggtagccttgtagagccagagaaatattggagcgcattgagcaccttgggtggtgaatatatgtacactttaacaatattaaatattattattattattctgctgaaatttaaacaaagagggttagactgaggtgtaagttttactttgtcaaaagtgatctgagacccaggaaaaaatttaactaaattaatagaatacagaccaatgaattttaatctttattgagtttcttcttatcttacatttacttgcagattgagcccagccttgaagtactgcacagttcgctttctactgaatttgtatggtgagtcgacgaaaattgccttcgtgttgatgcttgcttcactgaactgagtcgctgattcgtgtacgattgcctttgcatggaaatggcgacctctgaaccgatcaaaccagtctggaccatcaaaatcattactgagatcatccaaagtaactacagcccttccagtatcaccaatctgatagaaagatgaataaaaagtgataatattggttatatcagatgcgacggttcaaattaaaataaagacccacgggccaaatgttacatgcgagaggacttgatgcggcctgccaaaaataccccaaaatacatgtaccacaaaaatgaatttgttgtttcgttcattttcattctacatgtataagtagatcttttttttacttgtcacaaatttgtcatagataatcctggatccaccactgcaatcacaaggctctctcccttctcccccttgtagattaatcttgtgaccttaacctagtgatagaggtaccattaaaccccccccccccgggggggggggggggtggggttggacaggggtgtgccgctcaagcctcaaaacccctacccattttcaagggtcattttggcagatttttctcgaaaaataggccattttccacaattcttttaaaaacacggacccaaaatgagacccatgtttaggggttttatggtgagaaatcgactcattagagcggcacatcactgtatgtctaaatatggcccccttccctgatgagaacactgaggagatcacatgggtgtgaggcagacccacaatgaacaagacaaatgcgactgcatctcctatatgcctccaatacaaaaaagattgataacagttttgtttaggttttgttttatacatttatgtgatacacaacaaatctaagcatttgtgacatatcacgatgaagaaaaaaatcctatattcatatgtcaactgacgattacgattaggtctatagcttgtagcccctaactgaaattggatcatcttcctatagtaattctgtcaccatgtttggagctcatacctcaagttcttgacatattatgataacaaggatactcagatattgacctctgtgacctatgaccttcgaccaatttactaaaaatccaatcagatcatcttcctagggtaataaatactaccatctagtttgagcttcatatctccagtggttcttgagatatcgaaataacaaggatgatatctagaatttcagatatttaccttgtgatctttaacctttgacctatcaagccaacgtcttgtcagatcatcttcctaaggtcatacatgttatcaccaagtaagagcctcatatctatatagtggttatatagattgtgtaataacgaggctaatttagccggaatttcagaagttgccctctctgaccttaaatctttgacctagttactccaaaatctaaccagattgttttcctatcatgatacatacaatcataaagttttaaggttatatctcaagtggttcttgagatatcgtgatagcgaaaatgcaggacggacaattgaccaaaccataatgccttcggaaccaccttcggtgggtggaggcacaacaacaacaaaattctcaataattcattgcattttgccccgacccccaacattaaaaaaaaaaatcccctatgtgggcatgacctgaaccataatgcatggccctacaaagaaatttttcctgttggggaccggggggcaatgcaatgaattattgataattaattgcatttgtcttgttggggaccgggggacaatgcaatgaattattgataattaattgcttttttttgggtgtatttgtgggggcgccgcacagtgggccagggaggaaccaaagtgcgccaaaactaagtttgggtgatttatttttttcaatttttttcttgcccagttgaaaggtaatacatagaggaatacctcagtgaaatatttaattccggtatgcacaataagggtataaatttactgcttcaaacagcaaaatcctacatattcacagttttagtgcaaaagtgacttattttataaatctttcaattaaacatgaagtttttaagttattgatatgaaattgctctcacatattcctgatagttcatttcgttgaatgaatgggttaaaattaatagaaacacaatcttcatgatatattatagggaaattcaatgaaaaatggactaattatccatgttttttaaaaatccagaagaaatgtttagatctctgcggtgtaccgcttaaattttaataccaccattttctctgatgtctaagcttcaagttgataccaaatttggctgcccaaacttgcccattgttatgttagagccgatttcccttgccacattgccccgaaaatgttggtttttggggtccgcggctgaatcatgaaggattcgtggtcataaatcacggcgcgagggggcgcgtgacacgtgatctgacaccgcggaccaaaataaacacatttttcggggcaatgttgcaaggaaaacggctctaacataataatgggcagaatcgggcagccaaatctggtatcaacttaaagacatcagagaaaatgttggtaataaaatttaagcggcaatccctggaaatctttatttataaaaaataaatccccaaacatgagttttggcgcactttggttcctccctggcccactgtgcggcgtaccctagcccccgctgcgtacattaatgattcagtggctaagcaatggcctcgctagtgtgagcccgaggatcaaaaccatgttgatgtgctatattagtgcccttttacgaggcattaatcctcattactgtcagttatgacttagctctaaggacgtaggtcccccagattagcatagtagcatacacatgctttagcagtcacgcaaaacaaacactcgcaaattatttttcagtaaaatctgagaatgtatactatcatctagaccaaaagcttcagtttctctatatcgtcggttgatccactgagactacgtctggctccactagacctccgattataatattgtattagggcatgtcaacaaatgtcagttatattattaaaataaatgacccaaatcagacggttatttctgtctaactattatctagatctattaggaataaatcattgtcaaagtcatttcataaattggggtaaaaataattattccaccattttgaccaacagtgtgtagatttatccttttgaaaaaaatcacaatccacttaccagaccttgcctctctcccagctcttgaacagtaccatcctggataacgccatacttaaaggtatagcggccaagcacaggcttgccaaatacgtacctacatagacagttcgaacaaatgatagtggtggtttaaagccatccaatggtatacaaatgatgcgcagatatgagtaggtcggaaaggaattttgagcacaagataactttgggcatggtttaaagccacccaacggtatacaaatgatgcgcaggtatgagtgggtcagtaggaattgtgtgcataagggaaaattgcgcatggtttaaacacacgagacgtagccgagtgtgttttacatcaccgcaaagttaccgttacctgcacaattctaccgaaccacaaaataaacctgcgcaatgcgcattgatatctgatttatagaatgggagtaaaaagagttatcgcccaatttagagaagaaaatataccagacgcatgaaagtgatttaccggaagcatgaaagtagttgagagtcacttctttattcaggaattgggtatttttttcatgcgtatgaaggtgaagaacggtcaaatgactaaattgccattcaactagtcaccagtattacactgtcttcatgaaatttaaaaaaaaaaatgtttactgatttgaactggtttttaaaacaaggcagcagttcatgaaactgtattaacttcaagttcgccgacaattctttgaaacacgtgtattaaattcaacgagtattccaataggatgtcggggaacatatatggcagttttctgaaatgattttctgatttccttactgagcatttattgtcgagaccactgaataagctccggctagaatgtatttaggcgtttcgatgctcactgaaaatgtcggtagaactgcagtggagaattaaaatacatatccaattacatgtgattagaatcatgaatacacattaacccatgtatgcaagagcagtagagcatataaaatgtcaacaaatcagaattataacaaaaaccataacaaaatataataataactacgaatacagtaagaaaatgaaggaagagattcaagagagcataacaagtggaagcgaaataataggtttatgacgaaaaaagttagaaaagtaactgaaatgaacagactattaaaactctatttacatcctttcgttcagtgaacaaattatatttttcttcatttgtatatatgtgttcctattgtattttttcttccctaaattgaactgcattacctgctaatgatggtggaaaacacatttccacatttgtgaacaggaattcaattcttaattattatcattctttttcacctgttaaaggaaacctcaccccaagaaataaccaaaaggcattacatcatgccaataatatcttcattcttttgaacatttcgtaaagaaaattgttcatcaataggctggaaataaatttcagcattgtacccatacttattatctgggggtgaagtttcttgtttagagccgttcgctccgcaaccagtttgtctatacattggtctatttccatatgcctaataatcatttttgtctacttatcattcggtttactgaccatttaggctaaaagtcattttgatctaatttccatttggtttaaaggtacatgtcccttttgcagccaacctcaaattctgtagaactttgcaggaattatgaatatgtcatgtatgtcctctctgtgaaatttgaacgttagcaatgtcctaatattcaaattatgcaacgaaacccgtttacttgctagacttcactgtcagacaccattgattgacttacttctttggtaataacatacataaaatgagctttaaagggtacatgagcatttgtccacatcaataaccaacttcttgtgatggccaaaattaaactgattgaatctttgcgcagcataaaacgtatg

SEQ ID NO: 2741 - DNA, 2501 bp, Oryza sativa
cggggggcgggagtgcgcacgtatttatttttaattttttgttggccggggggcacgtccctgtttgccagtacatttttggcgcaatttggggctgatttcaagattattttttttgcacgtgccccctgtgccccccccccggatccgccactgtagaaggctcatagtggttcgaaaatgtggccagcgctcgtacgtacgtgatcacgtgatatccgccatctttgttagtcctctttttgtgttggccgcatttttctcaacgacagttcaggctggaattctcgaaatttgtgagctgaaaagatcgagcactaagcaaaatggcggcgtgtgcactcgagcggatctcacagcgcgttcaacggccacacgtctaatcgtgcattgtgaattgggatgagcactctacgtattttacagttctgtgcacttgatcgacccatgcactcaacgctgtgagttatggtcgacttcttttatgagacaaatccaagcaaacgtttccatatgctcaggttattgcaaacaatagactcccgttacaatgtaccaatcaaattgtgtgcagtaagaatgtacaaaatcgacttcctcaataaaaatctactaagctttctatggaccaacatataaggaccatgaagaaaataaagaataacatgaaaccaagctcatggaatccaagtcggacttgagttacgtgcggtccatattttttgtaagttctaactaaacgcttgattacaggtgggccgagtaatctactcattggttgcctttaggttgggtgagagtgcatttaactcctatctaatctctttaagctcttattctgaatatagttttaagacatggaactactagcatacaagacaaaactgttttttcgtcgataagtatatttcaagtgataggagcctacagataaaatgcacatataaaggggcatgttcccgccagtgcagttatcgctgctctagtcatcgccatcttggttccgaaggtcgacttctaatttgcatacagctgtcaatcaaagtacgcgcggcctggcctgccttcgccaagccagctgattgctgccgatcgcgacgtcacgaaagtgggcggaaacagcagccgaatcttagagccgaactgcgattggtattacttcggcacatgtatgtgataatcggcattgtccgggcattcggaacatgccatctgcgtaagagccgtattctgttgatgtcaataggcagctagcaccgtccgccagcgggtacgtattttgaacgccctctggaatacggggaacatgcccctttaagtgaaatcaggaaacccatattggtatctttaaacaaaataaaagaagatttagcctatatacatatgtgttggagaaagtaaaaagggcacttaaatatcaaaaggaaaaggacacctgttagaatagaaaaggagcacatgtcaaattacaaagggtaaacagaggtgaaaatgtgcacttcttgcacctaaaaaggggcactcacaagatagtgaaaatagggcgcttttgagaatggaaaaggggcatctatcagagcatttctgagcattcctgtccaatacatgaatacaaaagtcaaatatttagtcaattagatatgaaaatatcatacataaaattatctggtgcccggatgtgacaatattcaggcacatgactgtcaaagagatattctggcacctcgttgacgacctgggtattcaggcacttcactggctataatcatactgtttctaaatgtagcgagcgagtgaagcgagcaaggaaaaaacatttaattgctcttaaaatgttacttctttaggaaaatatgaagtctctaatattttgttaccatgaaattgacctttatctttcaatggatcctaaaatagatctttaattaatttctgtcgcggcacccctagagacttctcgaaaagggtgccgttacgataaaaaggttgaaaaacgctgcttttatatgacgtttcttttacgatatttaagtcttctagtctgtaagctcttttcgccttagatgatactttatgtttctttataacatagtttcagataaatttccttcagtctgaaaggataaagtaaagtaatgtacataattacctcgggtccgtagaaagccgaaacggtccatatacctaaggctggatgactatggaacctatactcgcctgataggaacccggaaggcagggcttgagtctgtctgagtctttttacactggtcccacttggatcaattatttcgacgtggagctataaaaacaagaatgagaaaaagatgattggagttgaaaaaaggaagattaaaaagggaaatatcattgctttgctgctttagaaaccgtaaggtaatgacactatactgtcgctagtttaacgaaattctcaactttaaaaccctggtcagtacacacctaacctgaaactctatggcccgaattcacaaaggagg

SEQ ID NO: 2742 - DNA, 3001 bp, Oryza sativa
ccgatccagcggcccgttgattggctgagtaccgtatgcgtcggcaaataggcctggtgtattagccgaaccagcggccgaatccagcggcctggtgattggtcgatcaccgtgtgcgtcgaccaataggcattgtgcgttattgttccaattatcgatcgaattatggaccgctccgcacggtcctcccgtagagtataaaagacccttgcttacagtagtttttatcacctgacgaagtatcgcagtagcatacgaaacgtcgtgatcttttagattccttattgaccacattgcgagacaaacgaatatcactagcgatattattttcgatactatatccgcaatgagtaatatatttagcaagggaaaagttgcttgaatgacttaatagtgacattatcaacttactagtaattcagaattccagtacgactatcacttgaatttataattattttttttagattgtatcccgtaatagcggaaatatttaaaatttgacatttttagtagtttccctctttattatcttggctaaatgcaactcgaacaaaaaaaaaatcttccttgaatacaattaagctacaatttcatttaaaataaaaatcgtataaatgcatatgattattacagtatagtaacattaaaaagtagtaacaaagcaataaattacgtacagaacaaaatttaaataaaggaaaatacaatgggtatttcaaatacagcataacagaaatatggacaaacgcatacatataaagagaaaagttacaatgtatacgttgatcaacagaacaaaagtgagggaaactaaataacaaataaaaaaaagtttaaatttatacaatatataaatgcataaagacaaactaaaatgttatatgtatgtgatgacctaaacaacagctttccaattgtgcccaattgctgtcctcccttttggggaattgtttgcaaaaaaggttgaaaaaatgtacccaccgggaaccgaactggcttaaaacaccaattggttgaaaatacatgtatgagtcagaatagctgtaaataaagctaataacctatacaacagcttggcaactctcgaggaaatatttataatgtaaaaggaaatgagagaatcaatggatgcgcagcaaaaaaaaatcaaaatggagtacaatctaataatttgcaattaacaattacaaagtgtcttaacaatttcttctagaatacggaggattactttttctcgagtttttttacatctagtaaaaatgtgagtactatgcaaatattgattgcaagcgttattttcttcaaacataacttcttacttttaacagaaactaaacttttattcatggtaaagagtaaatcttttgaggagagccctatacaggaatttatcttcttttggtgattaacaggctttatagctgataggttccatttttgtttgttattttaggcctactttgttttatgtattctatattatggttataatccattttgttcatgggaataagataagatgagatgtatattatataaataattgaaacaatgaattacgtaactaaccgaataactaactgactaaaaataatgttaaaaataccgtaccgtcttggttaggggtgtagattggcttgtccgtctgtacgaagacgtaaccagattgaagagtgaccaggatttctgtttccttttggaatgggtagctagggtccagagattcagcctttaagaccatgtgttggaaatctccttcatttctcatcaaattatcggcttgaatttcgaccgtaaaaagttgagatgaacctagatcaaagcaaaggggtatagtcagtggtattttctatggagctcgttcagaagtaaacggctttttctcatttccaccatgtccatgtgtgcataaatggcaactgcgcaacatagttcactacgcgtctcagctctgtgtttgctaaagattttaagtcattgaagaaaattgaaactgccgcagttgaaatctgattgatgcttaatcgtatttcaccattcatgtttaacagagttggtgtgaccatatggaaatcacaacataaggctcatttacacatccaaaataccattttgaagaaaaaaaatcatcgatattttgaactaccatttacaatactggaaaaaccaatgaaaaaccttcgaagtttgctcatacctgttttttttttggtgagtagtgctcatgtgcgactcgttggtgccccgtatgccctgtatgaaaaaatgacccctaaaaatctaaaaaaaccataaatttctcataccaactctgtttcgtctcaatttcttacagtatctttatatcataattgagcatacccatgcagaatttcacgctctaatggctatgcacaaaataaatagcgccctctataaatttctgaaattggttttctttctgtggccgtagcttcatcgtgtctggccgaacccggagccattttggatttagatacttgaatatcaagacttccagcaaaatatacaaatatataccctaacgctgaccgactttttaaaaaattgccctctaaatttgcaggtttcaagaaaattgcgaaataacttcaacttcctcaaaaatggcgatcttgatacctacgtcaacgaaacttagcagacaaatgtaaccatacacctgacaatggtttgtcaagtttggtaaaaattgatgacgatatgatgattgatatttactatgcaacacgtaacagcccgttaaatgcgtggagtacattatgtgtatattaaaatggtttcagactgaccgcaatgaagtgcccttttgaatgataccaagtacggtatatgttcacgcagacaattttgagtaaatcgcatttgaacaagggttactgtacgtattccgctgagtatccgcctagttataacacgtatcggctatgacgtcatttttacagactgcttttcccaatccatgttggcccgaattcac

SEQ ID NO: 2743 - DNA, 6701 bp, Oryza sativa
aataaatgtctcatagtctggcttacagtgcttcttatttaaagcgactgagagcaatctttctcaaatttgctccaaaactcgctagcttcactcgatcgcatatatgattgattaactagcatattaggggtcttattcattgttttattgtgagattgtgcttaaaacccaccagagtccgttattttaatgacaacaaatcggtcgcagtgaggccttaaaattatattaacattcttgctcgcttgctttgctcactttcaaataaatattcacccaatcacacaaaacagcaaagtatggtgctcaagcaggatcttggaccacgtaacgagtcaatcttgaagatcatccctgatataaattacaatttaggatgtatacgatgtttaaaaatggttatttatggctttgaggttaccccttgtaggtgcacttttttaagtttgaagtttgaagtttaaattattccacattttacatagaaaaacagtttatattcttttcttttttatacaggcgtatattatattgagaaatgatttcacacaagagactgcacatttttattagtgccccaacctctatgaaagaccctctgtcgcccttgctattaaggttggaatttcgtttactacctgggctgacagctcttgtatcttccgaaaaatgtacacccgaaccaggccgcctcaaagagactctcacttgaacattctgaacgtttggtgtggatctgatgagggttacgacgacgctctcgggcacatcaacccgaaacacgttgggagaggtcacgaaaaaggtgctgtataagagagaagaaggaatatagagaataaagagagacgtatgagagagagagagtgaaagagaaagagaagagatgtgataaggagaggtaaaagagagagatagacatagacagacagagagagagagagagagagaaggagacagaaagaatgggtagagtgagagagagagagagagagaggggggggggaagaagaagataaagagagagagggtaaaaaagaaggagagaaagttataaagagagagagagagagagagcggatatgaactaagaagagctggtatggtgtggtattcattttcaaaatcataattaaaaaagcccacaatacacacaaaatggaaagtacgtgtaaaatcaaaattatatagaaaacggattgatagcggcccactctttgtaaaaacgagttgatacaaatacaacttgaacgtacattaaaaagaaaagaaacccaaataattatactcttaatcggaaattaaggacatctagagctcatagtacacatctattattgtaaccccccccccctctcccgccaaacttaattggcataaaagatacatcctttaaagatcacagcaaaaatgatttcgtatattcaaatgtttgcagaaagtgctcgagttcttcgataatttaatataaaatggtaggtcattgtattgacgtgaccctcggttaaaacatcacgaaaaagtgagagggagagagagagagagaaagagcatcttactccaatgacatgactttagaatgtaaaataaaacactacataaaattatgcctaatgtgtgctgacgatgatgcaggttaccctggtggcaataagatttataacggatgtttgacgacataaaaggtgaatggaaaagtaactttttgaataattatgacaaagacctcacgtaaatgacgtaaaaagaaatgtccatgtaaaaatgataataaccacatttgattgattttggattatatacatacattgtaaaaagttttagaagaaaaacaaacccatagaaaacgttaatgcacagtttctgtaaaaccactctaatcgacagagaaatactttttaaaagtgagaaagagaatactctcattatattaatcctatattttgtaataccttgtggcttctggttctttgttgatggtgccacttcctatttatttgcgtaacaaaatatgctagtgcacatcaacattttacaccaaatacgacattttgcgtaaacacaggtacaaaatattttgtttatactttttcggcttatcgattacacacaaactaaaagtaaccatttccacggaagaaaaaagattcatacgcctgcataatcatgtttgcaaacatgaaacagagggagagagagagaaataggggagagggggggggggggggaggagaggagcgaggggagggggaggggggggggagaagaaaccgaaaatgaaaataatcgagagggaaacgaattgaaattcaaaagaacttgtacaagtgaaacgcctttggcgaaatcctgcatttttagacgtgttttaggtaagcctatatgccaagagacataaaatgcttcgggccatcaaggctacatggagtttggtccgaaagttcagtaatccgaagtttcacgtttcatgtatttcgaattctgttactacgaatgctcgtttgttccaaaggttcgttattccgaaaatggaatagggttcaaggatagaatggggtctcaagtgttcacaaggttcttaatttcgaaacgcaatagaattaagaaccatcttcacaagattttggaaagattcggaataatacccacatcatcctcgatattatcaactttcggattaagaaaatttctgaatataacgaaactttggaacttaccatgaaccttcatagaaatatacaccaattgcttgaaattatgaaacctattcatttcttcaaaagtattaacgcctggtggaagaaatggggaattacaaaaatacatacaatagaagtatacagtgcgtataaaaaaaaatgtacccagctttagtagctcctgattaacaattcataaccaatatgattttgaacttgatttcatattgaagagtaccttatttttcgtccgatgatgacctatttataatatttttgccacggatgaatgagcaccagggtctttaaaaagtgttgtcgaaatcgccttgtaccaagtttgggcttaaggaacgaatatgggtcaggccattatatgcatgtgcttatttggtcttaaatccttttaaaagttaaatttatgcctcatgcttcagtgcttcagtgtttaaaatgatgcgttttatctagtctttttaagaaccttgttacaggataacctttaattattttgaacagcctcataacttcttgtctcatgacatctaaattctctgtgctcacttttccgctgcgccatttgtttatctcgaatagcgaatgaaaactcaaacttgactaaacccatatgcaacacagaacacatatgatgataaatatcaaataaattgacaggagactttcatgaaaaaatataacatcccccaaaaaaattatccattttgtatcacttaatgagaaggtttaccttaaacaagggatgcgaatgaagtcaaaattgtaatcatcgtaacgaagagaatatcataaatgtttacgtgtaataagcatttccttgagtttgagttgttattaatacctttttttattccactgtctaaaagtcaatgtaaataaatgagcatttgcttttggaatgagataacactctcataataccttttgacccccattcatttacaagaggattttgaaaatacttttaaaaagcctgttgttcaataatcctcggcagtagaattatgaacatgtattattttacagggtattggttcctctttacgatgaaatatgatacaaggtcacatactcataactttgaaataagaaagctacctaagtagggtacattatttgttatgcacactgtacaataaggaaggtgaaaacaaatagttataaaaagacggacggaatagataaaaaacatgggagattgtgagaaaagaatacgtaaataaatatttgtaataatatcaaaactggaaggaggccattgttacttacgcaggtgaactttgagtcacccctcccggtacaagtgatgcactaatcgcgattacaaagatgagaacaaacgaccccatggtgatcgagacacccattcattgacaacgtcttcggcaaggtgtttcgtcttcaccaaatctaggaggaatctgcagcaccttgactgatcatgcagtaggttagaattcaaaaggggtgccacaccgacgacggcaaacgctcaattgacgttcgtatcaggcagcaacgagttttattgcgcccaatgttgtgaacttctagttccttaaagtaaaccggtaacattgttgaaggttgatgaaaaaatgcgtaactttggtatgaaatgttacttgttatcttccttctactgtacttactctctaacatgccacaaatcctgacaaaattctcaaacctcaaagatatttatggttttctttgaaggcgtagatatgtaacccccattctaacagtaagttttcccaaccaatcttttaattttccaaaccgtttttccatgaatggaatggtatatagagccaattcattgctttgtgacgatttacattcacctaaaatgtaatcaaattataataatatagctgggagaattaaggaatccatcagataatttttttctaatttttatcattaataatgttctgctttcactcaaactttcagattatctttaattgtacatctagcattgtagttaccaaacggaaaagtcatcaaactactactcctactaatactttagcaccattttccctcatttgaacaacgttaccaagtccctttaattggtcttttatgtcgaggtctgagaaatcgtataacttccaggtgtttgtataactaggaattgacagctactttcaatgtattgattccttgtcttaacccataacgagaaatacccctccccttgaaaaagaagaaggaaaaaaagaccgttttgattcatatccgtttctatcataacatgtaatttagaggaatacgaccaatattaatttgttctgactaggtagacattgtcagaggcagtatttcctttctctttctctctctctctgaccctctctctctctctctatctcctctctcttactctcactctctttctctttctccctcttcctctcctccaacttcttcccccttttctctctctttctgactcaccctctccacccctctcttaatctctctctctctatccctcttttttatataaacttttttaatagttctctgggacttttgtagagtctgttggtccctagatcatctgaggtgacctcttttcctggatgaggaaagaaagatcatgagggatcaaaataacaggaaatgaatcccacctcgtattcgacctaggtctgcttgtcgaaaacatagaaaaagaccccaaacatgatttcgcaatgaaagtatgctatcttttactaggcagatttcctgatagtttacagacaaaaagcctttttaatcgctgtgcgtatcagagtctgcacagtgagactaggctgaaagcttactgtaaaggctctacttgctgatttgatgcagccagatgtggtaacgtgtcaaatttgagtggattccttgactatgacaacagtaagaaaggcattaataatctgtttaagtaggcctgtgtaagtaaaaatccctctggttcaagttttattataatatccatagtgttaggaataacgatagattcatgtgtttaaagataaagttgagttctggtcaccctgcagcattgtgaaagaaacagtgtggcatcgatcagaaaaagttgatgatgtagcatgtaagtattgatgtgtactgcaagtttctggaatcatcaacatgataagaaatttggctcagtcttggtaaaagtaacaagcactgtacacagaaaaaatgtatatgggactacacaaacacgtggcaaaaaaatagaatatgaaggtatttgacgagccatgcttttcagggaaaatttgtttctctgatgttcttccacacttgcataataacaatgaaatcgctaacaaattattttcccctcaccccacaaatcaactttctcgttaagcaattttttcttgtgccaaaagagtgtggctcgcagtcgtgtagtgaccaagataagagctggggtctcacagagtcctacctttccccttcttctcgttggcctgcgagcgggcggtaaagggacgtttcgtccaaggtgctacacatcccacccttaccccactttcaaagatcgagtcgatattgtatggtttgttggtttgatatttgtgttttcatttgtttgtattgtcactttgtttgattcattttcgttttgatttgttctgttttcgcttgatctggaattttcgaacacaaagtgtgatccctatcaggtgattaccttataccctcgactcccctagtaacaaaaagaaaaatatcacccccacagggcctgcctgtcccatcttcctatcaatgctaacaatataataatattcactatagggaatatgaataatttaaaacctttctatttcacgtgagaatgtacgtacttgtttcgtgaaacaatttgttttattaattccttgttgctttagaatatggaggattttggacccaggatagtcttatgtttttttcttatcttagtggatgttggaccccccccctccc

SEQ ID NO: 2744 - DNA, 3206 bp, Oryza sativa
gtgcagttgtgatccccatcaggtaattaccttatttatacccttcgctcctctaattacaagaagaaaaaaaatcaccccacatggccctgcccatccgcccctcctgtcattggtaagataatactcactagagaatatgaacaatttaacccctttctatttcacgtgagaatgtacgtacttgttccttgaaacaatttgtttatattaattccttgttgagctagaatcaggaagtgtttggagccaggataatggcatgttttcctcttatcttatgatctaggaggtcataacctgttctgttccgatgctctgtttaatttgtgttaaagctatgacattcagcttttggagatggaaattaaacattaccatagttcaccgaaaaacattgggtgcaagataagttgaatccctctatgccacatataattttacttggcgtttcaatgaattaaaaaagaaaaaaaaagaaaagaaagaaagaaaaaatacattataggcctacgtaagaaagaaaaaaaacaaaaacaagggaagaaactgaaagtaagcaaaaacatagaaagaaagaaaatttaagtaagttagaaagaaagaaagaaagaatcgaaaggaagaaagaaagagagaaaattcaagtaaatactaatgcaagagggaaataaaactagagctttgctttttcaagtacccgaaaagtgcgcattttacgtaaggaaaatgttcctttttcttcctaataagcgctccttaatccccattgtcataagtgtcccttgttacctttgataagtgtccctatccagatctgatagttgcctattgtatttggaaaagtgtctcttttcctttgtagtaagtgcattttccccttttgataggtgcccctttttatttctgattaaagcccatttttgtatatatttatatcataaatgcccactttcctttcaaatacgtggcttttgcccttctgaatagtgcccctttgtttctttcaaaaaaaaattctcctttaatatcctcaaaatacccctttttgcccccggtaaaagccccctcttaaatatgacaaattcccccttgttactttgatgaatatccattttccttatcaataattgccctcccaggtcgaaattccagttgataccagttgaaaccagtaaggatttccaactggtatctactggtttgaactggtctcaactggtatcaactggtctcaactggtaccagttgataccagttgatacaatttggaaaccagtagaaataccagttgacatctgagaccagttgatattaccagttgatttaccagttgctttaccagttgaaaaccagtagatgattacaagttgatttaccagttggaaaccagtagatgatcaccagttgatttaccagttgaaaaccattagatgattaccagttgatttaccagttgaaaaccagtagatgattaccagttgatttcccagttgaaaaccagtagatgagtaccagttgatttaccagttgaaaaccagtagatgattaccagttgatttaccagttgaaaaccagtagatgattaccagttgatttcccagttgaaaaccagtagatgattaccagttgatttaccagttgaaaaccagtagatgattaccagttgatttcccagttgaaaaccagtagatgattaccagttgatttaccagttgaaaaccagtacgaataccagttgatttaccagttgaaaaaccagtttaatgtatcttatgaatattcatgattaattcgcatgttgtcacagaaaatataattatcatgttctggtaaatcaactggtaattcaactggtaaatcaactggtcccagatagcgttgtttcaatttccatattaaaaaccagttgaacctactggtttcaactggtaccagttgatttactggttttaactggtaccagttgcctactggtttcaactggaattccgacctgggctttgaaaagtgtacctttttatcgaaatttcccaccgtcccttacaaaatgtactcttttggggtcatctaaagagccacatggagtttaaaagaatcgaagcaactttgtgtagtactactacaggttccctatttcaaccaccacaatgaaaggcagtgcatacagttgaagacaaggaagggttctttactctagaggtgttgttctagaggtgtcgatcacaaggtccgcggttcgagtcccgccgccgcactaatgtcctttggcaagatattgatctacatttgccacactccacccaggtgaagtaaatgggtacctggtacgaatttattcgttgaaacgcagcgcgcgtaacagctgcactgctaaagccagggtaattatgctgcattattgtagagcgcttagagacttctgataaagtaagtgttaggcgctatataagcaaggataattattattattattatcatctatcattgattactttgcatgtaaatcttgcattgtatggccaaatatataaacatatcaattatattctttttactgtactaacgctttaacatgccaaaaatctggaaaaattctcaaacttcaaagatatctttgaaggcgtcaatgtgtaacccgctctaacagtaaattctcccaaccatattttgaattttcccaaccgtttttctattaaaataagacataaaacagtcttttaaaattcttttaacacttacacgtttgaatggtatatagagccaattcattgccttgtgacgatataaattcacataagattaattaaattataatagtataatgctaaatatattactcattgcggatatagtatcgaaaataatatcgctagtgatattcgtttgtctcgcaatgtggtcaataaggaatctaaaagatcacgacgtttcgtatgctactgcaatacttcgtcaggtgataaaaactgttgtaagcaagggtcttttatactttacgggaggaccgtaaagcggtctaaaattcgatcgataattggaacaataacgcccaatgcctattggtcgacgcacacggtgatcgaccaatcaccaaggccgctggttcggccgctggttcagctgatgcaccaggcctattggccgacgcatacggtactcgaccaatcaacgggccgctggctcgggccgtctgctgaatggaa

SEQ ID NO: 2745 - DNA, 12141 bp, Oryza sativa
ttgaaattattaggattgagacggatattgatagcttcttttaccctccgtgtataccaatgccgttcttgggaaaggcactgaaccccgtcccagtctggttgatgctggttgtcccaagcatgttcggctacggctgagttgtcagttcgacggagtctgacgtccctcttatgctcagtgattctttcttttatcggacgggcagtttcaccgatgtaggatctatcacatcctttacaagggatgttgtacacaatgccgtcccgtctatgtggaggaattggatccttggggcgtgtaagttgttgacgtagggtggtatctgatctgaaaaccgttcgaatgccatggcgttattgttccaattatcgatcgaattttagaccgctttacggtcctcccgtaaagtataaaagacccttgcttacaacagtttttatcacctgacgaagtattgcagtagcatacgaaacgtcgtgatcttttagattccttattgaccacattgcgagacaaacgaatatcactagcgatattattttcgatataatagtatagttgggaaaatttaggaatcgatcagattacttttccacaattgttataattaatactggtccgtttttactcaaattttcaaattatctttaattgtacattttacatttaagtcactaccttaaggcccggtcacacagaggggacgcatggggaacgcacggccagcgcattggaaatttgcaattttggccagtgcgttgtcgtgcgcccaacttttgtcgtagctgacaccaaattcatagcgtgttgctagcgcgctgagcgcatacagggcgcatacagtgcgcatacagaccgtacccagagcgcacatgataacaacttccacgaatgcacagcgtgttgctagcgcgctggacgaatggtccacgcatgcaccgcgttctacgacgcacggccagcgcattgggaatcggaaaaggccgtgtgcctaacttttgtcatgattttggaaaagctagcgagctgacacaaaatgcacagcgtgtagctagcgcgctgtgcgtatacagggcgtgtgctccgcgtatgtctggcgctggactagcgcgctcaacgcacgtctgggtgccttcggcgtgtacattcatgcgtcgagctccgcgcacacttttgagcatgctcaaaaaatcccgacgcacacagcgaatgacgacgaatgcatagcgctggtccagcgttgttccagcgcgctcgacgaacgagtaacgaatgatgacgcacgcctagcgaaggacaacgcactggcccaaattgcaaatttccaatgcgctggccgtgcgtcccccatgcgtcccctctgtgtgaccgggcctttagcaccattttctcttatctgaacaatgttacttggtccctgtaattggtcttttatgtcggagatccgggattttgcataactttcatgtgtttgtataagtaggaagcgacaaccgcgttcacttaattgatttattttctttatccatagcgagaatcctggcaaaaaatattaccccccccccccacaaaacaaataaaacaaatattagtttgggtttatatccgtatctattataacatttaatttagaggaatacgaccaatattaatttgttctgaccacgtgtaccgctttctctctctctctctctgtgactatctctctatctccctctctctcactttcaccctctctctctctcattctcccttcctcccccttcttccccctctctcccttttttctatatattgtttaatatagttccctgggatttttgtagagtctgttgatcctttaattatctgaggtgaactctgctcatggatgaggaaagaaagatcatgagagttcaaaataataagcaaataattaccgttggtgaaggtgatgggacaaactatcatttccgaggcgatctggatgtagctatatttccgaagcggagctgaggaaagatagcgtatacattctgatcgaaaaggaagtgatagtttgccatcgcctgaaaccaaaaggtcattatttgctttataatccccattaaaacaatttatctacaaaaagaaaaggacgtgtatgcatttacataaaagacacctaggcccaaattcacacccaaaaggtttaagttaaaccaaaccccttgagggtacggtgcgcgcatgtgttttctttaattgcgctcaatggtaatgcgcgcctaattacgcctgttttagtgcgcttttggataatctttagtgaaagtgagttgccctgtgtagatagtacctctatcttcagtgaaagtgcgttgcactgtgtagatagtagtactatctacacagtgtaacgaactttttgcttctcccttcaataatgggcgaactatctttcatcacgtgatttacttttgaccaatcgtagagcaatattcttagtatgtggaatataacaagaaataataaccatctcttgatgcagccagagactgacagagcttcccctctctttcccctccctctcttccttttttctatatactttttaaatagttccctaggatttttgtagagtctgtttatcctttgattatccgaggtgaactctgctcatggatgaggaaagaaagatcatgagagttcaaaataacaggaaataatacccatctcttgatgcagccagagactgacagagcttcccatctctctcccctctctctcccttttttatatatacattttaaatagttccctgggatttgtgcagagtctgttgataccttgattatctgaggtaaactctgctcatggttgaggaaagaaagatcatgagagttcaaaataacaggaaataatacccatctcttgatgcagccagagactgacagagcttcccctctctttcccctctctctctcccttttttctatatactttttaaatagttccctgggatttgtgtagagtctgttgataccttgattatatgaggtaacctctgctcatggttgaggaaagaaagatcatgagagttcaaaataacaggaaataatacccatctcttgatgcagccagagactgacagagcttcccctctctctctttttttctatatactttttaaatagttccctgggatttgtgtagagtctgttgatcccttgattatctgaggtaaactctgctcctggatgacgaaagaaagatcaggcccccccccaaaaaaaaaaaaataataataatttggttatcctcgaccgcctgctcgtcatttttgggctgctcgtattattattattatttttttttaattctatttttttttgtatttgattttttgttctgggggggggggggggagtaatcttaaatgccaaacataccattttgcaaggatcaaaacgcgtcctgttgccagtttggtcttttcagtacgcaattctgtatttattaaacttgtcatttttatttttatatgtcaaaaatgccgttcatttaaatcaggttctgagcattcttaaattcattttaaagcacatctgtactagtttacaggagggattagaccaccctgcaaggtcactggacaggtggttatctcatcaaatcagctctaagttaccaaaatataaagaggatcatgggggaccaatggccaccgattaggcattgtttggaatattatgggcgcaagtaccgataagtagtacagtgggaatttaaaaggtgctgtatttcaaagccaaaaatactttctgtattggatttgctattcattgtacatcaaactagtcttttaccatattaaagtgttgtatagactttgttgttgaaatgcttgacatccaaatgactttttttttgttagggaaaaatatttataaaacaaataataacaaaataaaaaaaatccacccgcccgcccctactccagaaaagcaatcgagaacaaccaaatgattttttttgttgggcctcatgagagttcaaaataacaggaaataaaacccatctctcctggatgaggaaagaaagatcatgagagttcaaactaacaggaaataatacccatctcttgatgcagccagagactgaaagagcttcccctctctctcccctctctctcccttttttctatatactttttaaatagttcgctgggatttttgtcgagtctgtttatcctttgattatccgaggtgaagtctgctcatggatgaggaaagaaagatcatgagagttcaaaataacaggaaataatacccatctctgtatgcagccagagactgacagagcttcccctctctctcccttttttctatatactttttaaatagttccctgggatttttgtagagtctgttgatcctttgattatctgaggtgaactctgctcatggttgaggaaagaaagatcatgagagttcaaaataacaggaaataataccaatctcttgatgcagccagagactgacagagctagactctactcaatgcatgctttaggatttgtgtcaattcggagtgtgtgcttgctgactggtttccttgagtagataatagtaagaagggcatttatgctcttttcaggtgggctgtataacgtacagaccacctaataatttcgttagaattgcctttatttatttattatatatttttcttatttctaaccacttttttgttggcaagataacttgaaaatggctcaatcaaatgccttgaaatttggcacacatatgtataggcatatgtacaaagcacaataacgttttcaacattgaccttcactgatgacgtcatctaggcgccattttgtaaaatgttacgaaaatcaactcatgatcatatcttcataaccaaaagatatttctcattcatatttaccatgatcaaggtcaatatccgtccggtcaatttcaggtcaaataacgcgcgcgtgcgcgtacgtccgcgcgtcaatgcgcgcgcaaaattttgaaatgctcaaaatcgtctcaaaatcattttgcatacattttaggccattctaagcattttataaaaaaatcgcgcacacacgcattcgcgcgcgttttcgcgcgtaaaactattgcacaacatagaattgcctttttttttctttcataatattccacatatatttacaaacaaattgacaccacgtttgtctctttatgactattaataagggattgatcgaccgtttaacaaaaatttccgtgcgcgcgagctcttgtaatacatagcatatatgggcaaaaacatgcctatacaaaatccattgtagctctttaggatgcaaggtgaccccaatttgttttcatattttaatagagtatgattcgaagatattgtttcatgtctcatttgaccctcaattaactcatgacgtcatcataatggcctccgaactcaaaattccaatttgcatattatgacttcagcatatttatggaaaattgattgaatctctgtaaatattgatcgattttcttccaaattttgatatgttctagctgagacgattttctacaaatgcagttactattattcttcattttgacaaaggcatcatggcgtgtttttgcggttgaaggaggcatgtcaattttttacattttgcgtgtattctttatgggacatgactttttctcaaaactcgattctacattcccgtctttcgcgagcaatatctacgtcgttttagcttcgtttatgctgaacttcgagtatgttgtagatgagacaaaaatttatctcaaatgtaccctttattttgttttaattctttgttggatcagcccacctatacttgttccaaacaagtattacaaatctagttaagtagtctaatccctctggttaatctttgttttggtttgttctgttttcgcttgacctggaattttgggacgccagttgtgatccccatcagggcattaccttataccctcaactccccaagtgatgaaaagaaaaaaaatcacccccacatttaagtaactacattagcaccattttctcttatctatttttttaaattttagtccctttaattggtattttatatcaaggtctctgacttcgcataattttaatgtgttggcataattaggaagcgacaaacgctttcatttatttgattccttgtctttatccatatcaacaatcctgaatttgtaaaaaaattcctccccaacaaagttttggcaaggtttatatccatatctatgataaaattacatttaaaggaatatgaccaatattagttttgttctgactacgtagaatttgtcagaggcaatactttcttgatatttctctcttttccctctctttttgaccatctctctatctcctcctctctctctctcattcactctctctctctctctctccctctctccctctctctctctccccctcctcacctcctcccccttctcccctctctccctttgttctatatacttgtttagcaattcctttggacttttgtagagtctgttgatcctttgattatcggaggtgaactctgctcatggatgagaaaagaaagatcacgagagttcaaaataacaggaaataatacccatctctcctggatgaggaaagaaagatcacgagagttcaaaataacaggaaaaatacgcatatcttgatgcagccagaaaccgacagagcttcccctctctctcccttttttctttatactttttaaatagttccctgggacttttgtagagtctgtagatcccttgattatctgaggtgaactctgctcatggatgaggaaagaaagatcgtgagagttcaaaataacaggaaataatacccatctcccctggatgaggaaagaaagatcacgagagttcaaaataacagggaaaaatacccatctcttgatgcagccagagactggcagagcttcccctctctctcccctctctctcccatctctctcccatctctctcccttttttctatatactttttaaagagttccctgggacttttgtagagtctgttgatcctttgattatccgaggtgaactctgctaatggatgaggaaagaaagctcatgagagttcaaaataacaggaaataataccaatctctttatgcagccagagactgacagagctagactctactcaatgcatgctttaggatttgtgtcaattcggagtgtgtgcctgcagcctagtttccttgagtagattccttaaccatgataataataagaagggcatttatactcttttgaagtaggcctgtgtattaagtcaaaatccctctggttcaagttgtatgttaattaatatccatagtgttatgaataacgatagagtcatgtgttaaagaattccccttttttattttgccatatgatctaatcggtcgaaatgcgacctcttcaattttttgactcgttcccttagctcgcgtccgacgatcacactcaactgcaaggcattgtggtgaagcattatcttagaccacgtcgagagaaaatctttaaagtcatccctgagaatgtagtaggagtatatataaatgtttaaaaaatggaattcttctccagtgcaggtgcacgttcccccacccagaaagtaccatctttgttggagcccccccccccccctcacgttacaagatgctccgccaccactggatcatagtcgaccaaaggttgataccccctcccccatgcctgagcctacactacgccactgtctatcattataatttataataattacagaaagagagagagaaagagaggacaaaagagagagagagagagagagagggaggggggggggggttggggtagggagagagaaagggggccatgtctttgtagtttaaaagtcattcattaggacgaattatttttgttttaatcgccattttcatgtttctggaataaagacaaaataatgctatcaatatgtgtataatatgttttagaataaaatgagacaatacagaaaacagatctatgaaattgtctttaaaggtaggtatcccttttgcagccaacagccaacatgaattatgaatttgtcacgtatgtcctatctgagaaatgttaactttagcagtgccctactattcaaatttacccgtttactttttagacttcactgtcagacactattgagtgactgactgaccttttttctttggtaataacatacataaaatgagctgtaaatgatatgagcttttgtacacatcactaacccgcttcttgtaatggtcaaaattaagctgcttaaatctttgcgcagctcaaaacgtaagaccgcacgtaacaaggctctgaaaatcagactattttcgacgcattaatttaaggagcgcgtttcgtaaattcctaccggtcgatagatttcaataaagcggcaattaccagttctaatcttttaagatgagttttaatttggtattatattttgtttaccccaggatttacataattctatattttcagcttgcaaaagggacacacctcctttaagagagaaggagagatgatttctatcgaaatgaaatgattgtttgtttgtttgtttattttattttagcacggtagcacttcagccaatggctgttcttcagcatggccgtgcatataaaaagcaatcacaattttacaaagaaacatacatataaatatagattaacatgatttacatacaaagttaaataaaaacatacacatatatataaacaaataggttagaaggcgagaaataaagaaacgagccctaatttagaaaagaatacgaacagaaaaaaacaaaaacataataggatattattttttttaaagaagaaaaacaaatcagttgtttttgtttgctattaaaagtaaacatgacattacaaatattatattataaactgcttttgaaagtatagtaagtttgtttatatttagtttctaccggtaattcattccatagttttgcaccataataacttagacttttcttttaaaagcaggttttgattcttggtaaagtaaatatacgaggagcatttcttaagctataggaagtgtatttaaaattaaatttacttaaaagataatccggggttgattggtctgcaattttatacattatacatagaacatggttgttacgtctttgtagaatttgtagttttttaatattttgtttcttcatattattccaaacaacatcacaataatctaatttaatttgagcaattgacttataaaaaagtaatgccgttttttgcgagatgcaatgttttattctttttagcaaatacaaattcttcacagtacttttacacaaatgtttcacatgtttatcccaatctaacgagttatcaatgtataccccaaggtatttacacacagtaacctggttcagttttttgttatcaataaaaacatctactttttttagatccaattagcattgtttcacatttctttgtatttagtgccaatcgattacatgaaagcaaatcagaagtattccgtaagtcttgattcaaatgattttcaatatcttatacagtattactagcataataaatgcaggtatcgtcggcatataatgaaacaaaacaatttttaagacagtttggtaagtcgttaataaagattaaaaatgaaagggtgtgtgtgaattttaaggataaatttacaattgatatcgatcatgagggccatattgaaggttttgaacaaaactcatgagcttcaggggacctgggtattaactaacataattattgtttcacttcattattactaaaatctatgaaagttatatctggtcccaacatgggtaagttcctaccgctggtctaattatactgctttgaacaaacaatagaatgctaataagagttgacaactttgaaatccattaccactagtgaaataacgaaataagccttcactgtaaaaaagaatttgttcattggtaatttttacgtattttttccatgtagaatttacttgaaaacattacttttgccacttacgcactaaatttaagtcttgctaactcaaactttcaatttagtagaacatacgtggaatatttaagtaaaatcaaatacataagaactttaagtaatttcagcttgtattaatttagtaattttaactcaaaatcagaaattatacgtattactcaaacaatttatgttgattattcttatctttttaaagtaaggaccgatgcagtgcgtaatagaaatatttacataatttatgaatattcattaagaccaaattaaactcttttttaaataaaaaacaattcttttttgtggttgaatgaaaatttaaggactttaaaacatttactaattcatttaacatggctaagcaaagacaagacaatttttaattgttacccagttcaaaacaaatcaaaacttgatatttcaggaaattgtcaaccaattttccttttaagatgctacgatcaagtatatataaaatttggagcctttcaatatgtgtcgaattgaagcgtatgtaatagtttgtgatggtggtagatatatatatacggttaaatcttaaatagaagtagtgaatgattagtggatgttacttgttagattagatggataccaaatcgtgcaatatgtaatcctatcatagcttttttttaattatctaaaatgattacaatacttaaattatttacgttaatgtaactcgatttaactgagtaaaaatgtattcagcaaaataagtaaattctacttaagatgccgtaggtaatatttacttaataaaaataaggcaattcttttcctcaattttattgagttatttcgactattattttttttacagtgttggagaagctgcagtgagtgaattaaggcagattatacgcaaatgatcggtttattattcaaagccattaaacaaatatgcagaaaagggttacattatccatgtcgtacacaaacattttgttaaaattattaatgtcatgtttttatttgtttatatacacatcatgataacggtcttttaaaatcgatgttcgtgtgtttttattttcgtaagagaaaaaaataaatgatataacaataataactagcacaacataattcgtaaacatatacattcaatattattgttttaattcatgtctctgttataaaagaaaaggtcatattcaagtaatattcaacgatgtataaacatacgattcaaacaaagaacaatcaggaaactcaagtgcaggaatggactttcgtttcaaggacattcatgaaggttactgaaacaatgagggccgattataatcaacgttttgccaaaagagtaatcttcttccggcttctttttcttcttaagcttttttataatcacgaacagtacttgcagctgctagattagagccatatataaacaatatttgaaaacaagaaactgcgcattataagttcagcatactcagtggcatttatttatgagaaatatcgtttttgttcctctcaatcatgaattgtacagattcgtttattgtggagggggtggttaatacaaaggataagtgcctcatatgttgtattgtaacgggttatgttttatacacaaggaaatgagggtaatatacagtagtaatatatcgtgattttttttctattactacgtgttttatatttgctaggtcctatgtaacattttgacatcacctatatcatttacatttgttcaagtagtaacagacttctaacaaattgctcttgatagtcctagagacgctctttcctctaccacgtaaaacacgggcgccaatgcatgcacatcgtcctaatatgattgtagttctagtattcttctttttcttcccctaaatcccattcgtttagcaaatagtgcttgttactcctattaaggtcccttccttgatcccgattcctttcaaaatgtgtaggcttaatctccagcttctaatgtagggcacttaatactctttattttccaaaatcactcacgcataaccgtccaggcgccattttgtccgttttaaccctaaaaaggccgggctatttgaggtcttgatacggctgggggggggggg

SEQ ID NO: 2746 - DNA, 2781 bp, Oryza sativa
ccacggaactatattctatctgaataaagtttgtcatgaccttgtcaggattgtatattataattaaaagaggttacaactaagaaatttaaaatgatttatatttcctgaattaaaagcgaaaaaacatctggatttcttgcaaaaaggtcggtcgatatgactttgtttctgaccccatcccactcccatgaaatcatgaactaaaaaaaaatgtttattgatcttcggtttaaagtccattaattaacaatttttcaggacaatgtttggatgtggttatctaagtatagttgagtgaaaagatgtccctatacccccgctttaatttctacaagtatcgcccactctctaccaaggttcaagaaaacaacggaaccaatgtctacttcttggaattgttccaagtaacgaaacaaacaatacaaaaatgaaaaggagggaatgttgacctttagtatttgatgagaatacctcgctgcacctcaagctacaaaagggtagggacacgtaccacaccaacaaaatggcggaataaggaagaagaaaaaacagagaaagaattaaagaagaacacgtgaaacgtgaaaagtaaatggtatgacccactcccagaacccatataaactttaaagccacgttatcttgaattgtatacacatagttggatcgatcccccccccccccacatcattggggcatgtaactcatacaaaaattgcaaacagatcacctatcccccccccccacaaaaagagagagagagagagagggtgagggaaagagagaggggtgatcaaaagaaaatgcaacccgatactaagacctactcccagaccttttggtggctctgttgccatgttccttgtatttcatacacacgactggtgcccctttaaatggctaaacccaggctgcgccactgccgcgacggacttaaaaatagatttaccgatttattgttcactttcacctcgagggctgccgcaacaagacgtgttttttccgctgtctgggcaacaattcgcttcttggagtaagaaattatattttacttctagtttgattgctggtgctttttctcttcttacttgtattatttccgtattttggtttggggtacgattttggacagtcattatgcatttgtttttgtcgcttgaaccctataccattaatcaaaagctgtttatgaatagcgcccctacagataaaactagctgatacaagcgcttcacattgtaataactaatgttgttttaacatttcagatattttgaatttaagcctgtcaaaagtgttgggaaccccaaaaacttgatagcaaaatttcacttaaattgtatcataatctgaaagaggatgtcatttgagacacattttttgaaggattttcaacaaaaaaatgtgtttggaatcgaatattgaagaaagactacaacatttaggtttcctgcgggggggggggggatctttacagaagtgtatcttaaatgaaatcctctttcatattatgattatttaagtgaaattttgacatcaaaacttcggcgaatttggggctcccaacactttaaagggtccttaaatggtgataatatggtacatgtattgtattgtatttattaaacttcattgacatacatcaataatctgtttataaaaaagaaaatcatataaatcaatttacaatttacaatgcaatgtaacgaaacattatactttttgtaaacattatatcatatcaatcaattcacaatgcagtgtagcaaaacagaaggaaaattgtatacagcagaaaaactcttttttcttcttgtaatcacatgacacatagtgcataaagtaaataatacaatgtaccataatacatatataaaacctaatatagcaagtttctaaataaattattactcatgctatacaaaataggcaaatcaggtacatggaatgcaatagataatcgtttcgcctaaaatgaatgacgtaatagtacctatatatatatatatacatatatgcgacctactgtgaaattaaaccaaacacgtaaggttttaaaacaaaaattgccttgtttatataggcggggtcattgtcgtttaatacagaaaagaaatatagaggaaataatagggttgtttacttgttatttaaataattgtataaggagtttttttaacttagtagttacatagtatctaacagttacccttcactgcaattatgtatttggtgatcgaagagaaaatatctattatatctttattgtctaatctcattatatatatcaattattcttggcattctaaatcactaacatcttcttcaaaattgctaatttttttcaagaaaatctattcgtaaatcgttatatttatcacatttcataatcaaatggaattcatctcctacttgattcatattgcagtcttcacagaatcgtagataagggggcgtttttctcgtcttttatattcctatgggtaagttgtgtgcgctcagtcgtagtttggtcatattttttctttaatttatatttggtatatgagatgaatgcttttcttgcttgattgtctgaaggttctgagtttatttccgttacgggtttccctatcatcgaataaatctagttttaaatgttcatcaattcgtctttccaaacaaagtttacatagctcgacagcatgttgttgacaaattggtatatttttagggtctaatacggtctcatttccattattactacaaatattaagtaaacttaatatatcccgaatt

SEQ ID NO: 2747 - DNA, 8134 bp, Oryza sativa
ctgtgaacaaaaaacatctaaggaggaggatgctcatttatagttaaaggaaacaatgcaacgatgcaaacaacataggtaggacacatttacgagctgaaaccgttgcggtgttcaaattgtatctaaaacttgatttcagacaggaaaatgccaaagtgttttacttaccctgggagggggaacaccagaaccggcgctcctggatcacctctgaaaaaattgctgtttttactttgacgcttgctccttttcttttcttataaagtcctttccccggaaaatgaacccccggaaaactacccccaaggacaattaccccccccccccggtgaattacaccccgaggacaactaccccaaggacaattaccccccggaaattacccccggagaattaccccctgaggacaactactcccccccccccgattaggcaagacattaggcaagagttaccgtctgtgtatcactagctagcacccccctccctctccccgttgtgcgttaggcaagagttaccgtctgtgtttctgagaagattgataaacggttctattatttatttccctataccagacggttatttctgtctcattcatctccaaaacgaagtgatcattgatgtgacatataagagagtggatttccactactatccatttagagctgggctcatattaacaaatcattactataagcctagttgtcaactagtatataatagttgtcaacttgctgagtaaggatatgaatatgagcccaagtggtgtttcacaaagacttagattgccttaagttggacttgaactacagcaggccattcatgccactggttgctctcaccattcgtctctcaagggaaatcccgaatctacataatttacattttttgatagttcattgttgaaaaaaagaagttacattgtaaacttaagttttttaagacttggacatatcctacggtaggcgatctttgcccttaaaaggtcttgaaccagatgtaaaattagaggaaaaaaccttataaattgtgatctttagatgatatattttttttccttcaataatcaaaaaatgtaaattctgtagatttgtgaccacgatgtgtacgttccttgagagactaatgccaggaatggtgagatcaacaagtggcattaaagggcttgccacagttccagtccaacttaagtcgatcaggtatacaataatgatggctttactctagcttttggtaaattcctagaaatatttgatgaatcgttcaattccaacttaccattacagtgtcttgctcgagcttaccacaacaaggtgcctagatccccttggatttcgaaaactcttttaaggtccataaatagaaaaaaacagattattatatatatagaaagctgaaccaaacgaaaagaataaaagtaaatatactcatctatcggaataagctaactgttatacttcgcatagcaaaaaaaacaatattattaccgtcaattcgatatattcaagtccgacatcaaaagtacgtcgaaggtaatcaaccaatctgactattacaaaaaaatgtatgttgatggtgaacatatacacaataatactagcgttgcaaatgcgtacactaaaaattcatttttcgttaacatacgccccaatcttgcccgcaacattcccgattccaattcaccattccatttttatttatgaggcaacattccaaatagtattttctttttatagttcaggttatgatggtatcactaatgttttactaactaaaaaaaaatcatccatgtaatagtttctcctatatttgtaatctatcactaacaaccggcactgtccctgataaaaaaaaaagatcgcaacggttatacccattttttaagaaaggtgatcaacaggacgtagcaaattaccgctccatttcacttctaactattttctcaaagatcctcgaatttgttttttgtttattctcgccttattgcttttttttaaattttaatcatgttctctcctgctcccaatttggtttttgcaagaagcactcatccgcgtacgcacttctattatttatcaataagattgcaaatgctatcgatgccatgttgccatgaagaggaaatcactctgttaaaggagaagccctctccgatgtccagttggttttgccgggaacgggaattattttgaaagaaatagatcagtaaaagtttcaccaaaatcctattagaaataagaaagttaagacttttgaaattgtaatcatgcaaataaaaattgacaaccctgtgacgtatcttccaaattactctcccgtttgctctgtcttataacatatcatagatttataatttctttgatggcagttttaactcaattacactcatcctagataataattgcaaatacgattttcatcaataagaaaatagaagtatttgtgttcgttgattacggcataaaaaacttaaaaactttctaatacttgttagaatcggatcatttcgcgcaagaaattcccgctatctctcggagagacttcgggtgagggagatgctaaagaatatcaagacaatttaccattccttactttcgtagtacgttcggcaggtaaaattgcttcgtgaagaaaacgggctcgacaaattacgttcgcaataggttaacacgtgaaaacagttttcgttttcctagagatttcatacctcattttatctcaaagtctgatttttgcacgagagcaaggaaaaagcgttcgaaaactctaaacaaaaaattcatctccaaaaaatgtccgcatcaatcccagtgaatatgcatgattgtatgccacaagttaacgcgcgaaacacaaggattactagcatttccttcagattatgtaaaatgtgacttatataaaatttgagggtatggagcggatcaatgaaagaccccggggaataaggttctctttggccttggacaaaaatccccacaaaaaaaatgttataggccctaatcaagtagaggtggatttatctgatatatatatatatatatatgaaatagagtggttttcaacaagtatcaagtgcaaagtgttctttccgagtggcacatttctttcaaaattaatgacaaaacatcttaatttgctacacagctctttccgtgtcacttatctttttattattcacatgacagaaatcatacactctaaaaaccatctgctcttttttgtaacagccccactcatcaccctatcacttttccgtatgtgtctgtccatcgtccgtggtccgtctgtctttctgtatgtttaactgaaaggagctcgttgccaaagctcgtcatatcaccacttggtggttctgtgctggaacgcagggttattaactatcacatacatgcatttctgagtttcattggttgtcatttttctctgcagctcgctcgctcggccagactcacttcagtttgtctgagaaggctatctacgaagtattgaaatgaagttttcggcgatcatcgtagccgccattataggagttctctgttcctgtgcaggtaaggcaaagtttaacattttatatatgataatacgataagttagtgtttattgtgaaaatagtttctttctaattattttaaactgtttcagaaaataaaagttgtcatcgaccatggcgttttacggaaatggcatatcagaacaaaacagactggattgacgcagttttacgtcagacagatgacgcctcgtgtttaataagaattaaagaatgttgttgttcgctcttagtagcatgggccatggcccctggacccacctatcgttaaataagtgtttttaagcatttttttaccgaaatatttgacattctttcagagggtactagctgtcgtccaccgaggagtttacggaaaggacgttacgaatatcagcacagtacaggctatggattgacgcatctacctgtgaattacatggtgcgcgcagtgtgtgagcctgacgcagcgcttgtaggagatgaattcatcatctgccaggacaatggacaatggagcgattacccatattgccatggtaagtgaaaggtggttctaccttttattttcgttgatttttaacaaaagcttgactagcatttttgtattattagttactacacgataagtgtgtccatcgctaagtcagtaagttgcgagacactattctggcggtaaacaaatgccaatctattcatgtattcaattttttaaagaatttaaacaattaaaaaaaaatcacagaaatacatgaaagtagaggtgttgtggtataagcataatggataagtcaccgaactgtagaccacaaggttcggggttcgatttattgccgcggcatttactcgatttggcaatacatgaatctaaatttgccacactcgaatagactcgacccctatgtatttagtgagtacatagtacatagtaggattaatcccgtgagtacaatcagcgctactgctgcaggagctcgagccggggtaataatatgcaaattgcaacttaggctaaaatatctgtcagcataattggtctgttttgcaaatcaaatgtattccttatttttcctcatgaactgaattttcttctaaactctcgatttctttcctttgacttacatacaaaacaaattgatataacaatgttctttcaatataagcctaacttttaatgttcatggctttcccaattaagctccttcattcggggttttgctctcaattctacaatatttactgtactcatttctatattaaacattttataatattaggcagtaagaaaggagaaaataaatatagatatcactttctacaaagaagaggtcaatttgtaatgaataaggcatcttgctattttgttccattaatcatttcgcttatattttataaatatcgtccaaattttgttctttaaattgctaggacctccatcatgccccgacccaaacaaaccgttcggaatgctagccttggttcttgataccaactctggaatcaaacgtggtgatctctacaccgaacgcacagtgttcaactatacctgccaaacaggatatcatccaaccggggacgtcacaatcacgtgtcagaatggcacatgggaagcggatgcggatgtcccagaatgcaacagtaaggttcaagcagggagttgaaagaaaggaggcgaaactcttgtaatttattcaaacgcattcgtgagttctaaagcgtaacaaaggaatgtgtaacattatacttggctttgaagttccatgctccgaaccgcggttccactgcggggactttcggaagccaggcaccagttttacatttattacaaaatattaatttaccggcaacatttcagtgtaaatcaaaaacgttatatggggattgtattgggaatagtgcatcaaacaaatcttcaaattaggtactccgttcttcctttaatgtgtgtgccagagttggtaaaaagaaaaattaaatcctgccaaaaaactcaatgtttttaatgcgataatttgtgcatgttttaacaaatcgatcgaaatttggtgagggggaggggatgcagaatgcgggagaagatgaacagatgaagggcgtttaaaacttaagggaattcgtacaaaggggcacttctgcatccctgccctttgacaaatgaaatgagattggaatcgtttgaaatgttcctaatttgtcagggacgttaaataaatgaaatggatcttttgtttctgctttcttgtaatgtttttaactcgttaatctttacgacatatggcatttgaagcctcccccttaactttttaaagtcagtgacgatcgtcaaacgcacctccgattaattattttgagagttgtttaaagcaaatcggaaggagagctttttcatttttgttatcttatttttttaatacaaattccaatgtcaaaacgcaattcatcaagcaaaactgtcaaaacatatacaagtgcaatagtgtatattatcaaataagttcacatataatgtatattttcataactgggtgtgggatagcttgcgagaaatacgaacgtcatgggataacttttagacgtttaggttatgaaaatgaccttacagatgatggcccgaattcacaaagcaaggtttgagctcagaccaaggtttgagctcaaacctccttttgtttcgccaaacctccttttgttctttacaaaccaggtttgtaaaaaaacgcgtaaaacgcgtcatatgacgtacgaaaaccaaggtttgtcgacaaacctcctttgtgaattcgagccgatgggtctatccgtgtaggttaatccgtttcgggaaaaatggacaggggggcatgattgagccctaaccactcccacggaccctgtgcgttattgtcattcaatgagccaaacgttggtacatctttattcttatgatgcagtgatcacctgtgccccacccaccctggagcccataaagaatggttcacataacattgagaacaggacctaccatgttggagaagtaagtctttagttgtctctcatttattggggaacaaaaaaaaaatccaagttattaataaaagaacaagatcatggccttatggatagtggatttgttactatcaccattatgtattatctagcatgatgacgaataaagatgataatgataacaataataattataattataacaataataataatgataataatgtaataataatattgatattatgatataataataataataataataaaatcatattgtattttataagaagggataattgttgcttgaaatcgcacattcaatgagaaataacttaagaattcattgattgatttagacagattttttttttatctgctcgccattgatccgtttagatagttttttactaattgatcgtttgattaatttgttaatcagttaagtgactgattaaacttagattatcgaatagctaatcaagttattgggttaataaatccatagattcgttaatcagttacgttatttattaataagttaattgagtcggttgttttatcgcagtttatttattggttaatcagatgtttaaaatcactagatgattttttttttaagaagtttaatttcaatggtattctgaatcttcgtccacagatggtgcaatatcaatgtaacgacgggtatcacgtcgaaggaataagttggcaagtatgtcagagtcaaggtggacccaatgggatatggtccgatagcgttccaagctgcaaaggtttgtggtactatcattgataaagagaattaaatccaagaagtatcaacaagtcatttaaatgtatttataaatagggctgttttaattagggctgtgttaaataggctgtgttctttctctttcttatttatgcttacttaaaagttctacacattcctttttttaaaaaggttttttttttcattaccgagtagtcctttgctttcgtttttcattgcttccgtgtattgaaaattaagtacattttatctaaactgttgtaaatatacgtgagtaggcaccgtgcgagtgaagatgcctctgcgttgaagcatgtgggaaccagctggaggcttgaccacacgaatgactggtagagcagcttatctaaatgcagatgggttggtgaatttgacaacgggtctgtcgctcgtaacgttggaatttttgttttaccctaatttatggaattattttgacaatgatttattcctaataaatctagataatagtatacattctcagatttcaatgaataataatttgccagtgtttgttttggttgactgctaaggcattgtgtttgctattcaactaggggacctacgcccttaagccatacattacagtaatgaggattaatgccccacaaaagggcactaatatagcacatcgacacggttttgatcctggggcctcacagttccgaggccattgatgtgccactgaatcgtgactgttcgcagcgggggcaaaggtagggggcagttcccaccaataaaaaaataaataataataagatgcaccaaaatataaataatgcattgcattttaccccggtcctcaacataaa

SEQ ID NO: 2748 - DNA, 2184 bp, Oryza sativa
gggaactgctccctaccctagcccccgctgtgtacagtcatggttaagtggcaaagcaaaggcctcggaactgtgaggccccaggatcaaaaccgtgtcgatgtgctatattagtgcctttttgtggggcattaatcctcattactgtaatttatgacttaagggcgtaggttccctagttaataagcatatttagagcatgcacatgctttagcagtcacgcaaaacaaacactggcaaattattattcaataaaatctgagaatgtatactattatccagttctatgagaaataaatcattgtcaaaataattccataaattggggtaaaaaaaatattccaacgttatgagcgacagtgtacatccattttgtaagtttatcaattgtaaaattctttattaaatgcaatatccccggtgtctctttgataattaaactatttgatctataaaagaagaaataatctgttaaataagatgtagaccgttggatacttttttgtaaatctttagtcgcaaggtgtcccaaccctggttcccgtcaccttgacaacggccggatttctttctcgccgagaaacggacgaggcgccacgaatttttggcccgtaggaacgatgatgaccctcaggtgtccgtcacatctagagctgatggggtcaagtgagagggtgtgtcaacctgatggtcactggaatggtagcctgacgtcatgccacagtgaaggttattataccgatgttgttttgggtgtgaaaagcacggactgttagcacatgtgttgttgagggtttagcccttttttgtaccatttacaaaatgttcctgcttaaactagtagatattttatgcacgacaaagacatttatatttatttaaagagacgttttgagaacctctcataccaattcattgcttagtacattatgggattaaaaaatccagtttaggggggacggggggtctttgaaaatatttgaaccattggtaatgcctggattacatttgaccgtaccctgcccgtatgcccttttccgtgcggccaccgtacggaggtaggaggcggccgtgatattttcgtacggattcacgggctccgcggggcaccgcggcctctacgaatttgtttcgcagaaagttatacaaatttagaaaatcgtaagcccgtatacatgtcgtaggtgtcattgcacaatctccacacgggcatcgcgcggaggacgcgcgctgatcgtgcaacaaatacgattttacggtgaatatggaggcaaaaaacgcttaaaacgacacggttgctgcacggtcactgagccttctccgcgcaacttttgcaagctgcacgggctccgtacgatttccgtgcggaggctggggagactgcatggctactgcattgaaattgcacgatttccgtaaatctccgagcagcctctgtacggatttaccctggcctgccccggaaggtcaatacaagaaatggcacgatggtcgtagataaacaaataaacacaaacatcgtagcccgtagcctcctacgatgccccgaaaagcgcaagagaaatcgtagactaatttatcgtacggtgtcaggggcaactgttatccaggcataattgtgctgacaagcgacaagaaatcagtggcaatgttgcacattcgtgcaataggttgaaatattgattattggtgtaagaaatgtaaaagaagtacaaactgtttatggctgggttaaaaaattattcctatgttttggttggggctgattaactggttataagtcgtaggtgttctaatagaacaacacggcttggtaataagtcgcatattcaggatggtgaagtcgcaggacggtccgaaacaaaacagatctcataaatgaatgtacaatgttgtacattttcacgcacacacaaacacttttttctttttcaatattttgtaattagaaatttcattaaaaataaatcattgcatagaaatcattgtaaataattccatacaaatacacatattcatttcatttcataacatgaataaattattcacaaaacagtgagcaaagaaggagaataatggaatgaaatcactaaattttctaataataataatgaaatactgaacttaactattaccatcattcatgaaaaaaaaggaaaaaaaaacattatacatatttaaata

SEQ ID NO: 2749 - DNA, 4487 bp, Oryza sativa
atgcaccttaaaccatccacccctccacccattttattacttaccccccccccccccccaagaaaaaagcatttacattcactcgcacctcacagtacatacactatttcacacgcgcacaacactgaaactctagccaatcatcctcactcaaaagatcacaccacggacacaacacttatccactcaacacatagaacactgcacaaatacgccattcacacaacagcacccacccatacatctaaccacatacctaacatcctaactcctaagaaaccaacaaacttaaaccttctttgattagatttacataaaataaaacactaatgcgcattgaccagttgcacataaaaagaaagaacatcaatgacatccctttcggatcctgcacccgacattgtaattcatgtcaatgatacaacaaaaagattgagaggtaccatgagtataatattttcttcagctagttaccctgcactgcattggtatatttgtttaatagagatttcattcagaacaaatcattacaaacaaatcaatgtatgaaattcttacttaattactgaccaattatgcctcctaacacatagggcagcaacaaagtctttcactccgtccgatcctgggccagtctttggatggttccccatgtgtttaatctatccttccacagttcttcgccaagtgtttttaggacgtcccctctttcttttgccttctggtgtccagtggagggcttttcgtgtgatgtcatctatgttctttttcatcatatgttcgatccatctccaccttcttctcatgatgatgttctccatgctgtcccgatggcatttggcatacagtgcttcgtttgaaatgttgtttggcaagaaaatgcgacatattcttctcagactctttgtgtggaagaccgacagcttttgaggtcgttttttgtcattctccaacattcagagccgtacagaagagtggaaaggacacagctctggtacaactttatcttggtcgtgatgctgtactgatgtgatctccatatattattgagcattctgaatgcatttctggctttattaagacagttcctaatgtctttgcctgcgccttcatcgtgcctgacagtgctgtccattgcttgtattggtaagggtcagaaatgttcagggtcatcacctctgttttcttttggctgatcttcaggccaatttctaggcaaaatcactgagtctggatattttttcttgcatatgctggcgggtgtgtgaaagaagagcgagatcatctgcaacgtcgaggtcctcaagtgtagaaaagagggttcatcttatgcctcttttttggtcttcagttgcctgtcttctcacccagtctatggcgatattgaagagcagtgctgatatgacacatccttgcctatctcaatcttcacctggaacttatggttactgtttccaactctgcatgtgaaattgatgtaaaagctcttaattacaagatctagctgctctggtatcccatatttacgtagtattctccaaaggctgtttaggtggatgctatcgaattgctctatgctattacgtagtgcaaatatatggtcagtgcatccttttcctttccgaaaacctgtctgttcccttctgaggctttggtcaacagcatctatggtacgggtaaaaactatctttgccaatattttgcttggtattgacaatagtgtgatgccacgccagttattgcagttttttagtgatcccttctttggtaattttacaataactccctctgaccaatcgtcaggaactgcctttgtttcccatatagttgcgaatagtggcagaaggatttttgctgctaattctgggaccgccttaaaaagttctgcgttgagattgtcagagccggggctttaacattttttaagagatttaattgcagttattacttcttatttagttggtggtatgctgctgacatccaagtcatcctctgcctcttgtatgccagcctctactgtcggtggtggtctattcaaaacctcgctaaattgctcggcccatctagcttcccgttctgcttctgttgtaagaagcctcacctgcttgtcttcactaggtgaatttgtgattcctctttacttgccgctgattattttagtagttgtatatacttttccttgttcgcctttaatggttgcttcctctgcctgatttgcaaggtcttcaacaaaggcacgtttgcttgctcttgtcttcgtctttacgaccatgtttgccactcggtactgaagcttttacctttctttcagtatgtctgattttgcttccatggcttgttttttcgcacccttccgtttatctatggcttgccaagtatcatcagttatccactctttcttttccgtctttgtgactcctagaaatgaatcgctaatatttaagtaggctgtcttaacctgttcttgtaaatacttccgtacaaatacaaatcttcattttgttttcataacacaaataaattattcacaaagcagtgaacaaagaaggaaaataatagaatgaaatcactaaatttgtctaataataataaaacataatgaatttattcattaccatcactcgtgaaaaataacaaaatacaatttgtatacaatgcaccctccgttagtattccctgccacccctcaatcccttcttctaattccccccccccgcaaccattcgcattcacactcacaagctcgcacctcacaaacatacagatattcacacgcgcacgacatttcacacgtcatacctgttcacattcatattcttattcacttttagctcttcccacttttgtaggtgcaaattcaacttgcccacctttactgctaagttttttttcttcctcataaagtccgctatatattcacactggaaggtacatggccttgagccctacaatggaagattctacgaaagaagattacatatttgataaatatgaccaaagaattcacacatttatttatattcaattcaagagttctttattcgctttaaaaagcacatataaaaaaataacaaaaaatatacaatatattctacaaatagtcacattcacaatatatgtaaagacaaaaaaacaacatcaacaacagaatacatgtataacagggtaagatcagagtgtgcataaatacaagataatttcctcgcactcctctcggttaaggaaacccttacataaataatcatccctcgagttgatcaattcctttacttgttcaactattcgtattgtctcatcattcacttggcattgcacagcccactgcttttgaatttcattgttatccatgaagtacttatcattcaagaatcttatgttacctcccaacacagaatgagctccatacctggccattccagctatatgtgccactgtataatttttggaattcatagctttcaaaacaaaagataaacatctttttgcaaaccataactctggatccataacacctgctaaataaggcaaaagatgacagtgtgtctgccatggaattttccaaacccttcttattgcaacccgccattgtctacaaatattatcaaaacatttatcaaacagaggatataactgtgagccatagaaactcgaacaatatttatgaaacaatatatttcttatgtgagagttagcatatttgaaattaaacaaaaacatattacattgtcgattgaaatctccaacacactttgagatatcaaaatcatttatattcttagaaatatcattccctagatgagttacttttgatgcaatatcaatatgtcttccatttatcgtgattcctggatccataactggtttaccattacagctgaaaactattaactgactcttttcagggttaaacaaaatatcaaatttaatggcataatctaaacaagttttaatcatttcttgaagagcagtcacgctaggtgacagcagtgtcaagtcatctgcataaccaaatgctcctgcaaaaacattgcccataaagcaccctatcccattgtcacataactcttctatcagcccatctagatacaaacagaacatgcaaggagagataactccaccctgtttaacaccatttttaactgtaaaataatcagaatatgcattgttccatttcaaccttagcctttgattcttatacatattaagcaatagcctgcatatcattgggcagacccctttgctcagcataatgtcaaacaatttcacataattaactctatcaaatgctttactagcatctagcaataatccatacacattactcccttcatgattaaagtacgatacagtttctttaaccatagcagtacatagtgtagttgataaccctgctttgaaaccaaactgtaggtcattagtctgcaagttcccttcttcccttttcataaatacataatctaaaactttaccaatgatactaccaagtg

SEQ ID NO: 2750 - DNA, 8089 bp, Oryza sativa
  unsure (1)..(8089): unsure at all n locations
ctctgttgaacaaaacagttattaatagtgttagatgtatctacctggaaagctatttcctgctaagcaatattcatgtttatgttaaagtctacaaaatcatatatttgttatttaaccgaaggagtagcattcttcaaactagttggtattgcatgagcaatatcgattatctggagtaattgatttgcattaatcccaagattttggaaataagccaaacgctttatatgtccattatcgaaaatttaatttacagtgcgtatgcctttattaaatagatcataatcaaaaatcattttacgtcttatacatatattatgattatttaatataactggatttacctcctcttcatacaatccatacttcctcatatcctgccaagcctttagcatttcttaataaaatggtggtattttcaatgttaatttggacgtgtcaaggtcacatttaaacagaaatctccctccaactgttctaaaacaaaattgtaaatactattccatccagcacacctatctccatacaataaatatttcagccacatcaaacgttgcgcctttacaaacaatttaaaattcatcatttttaaccctccatgagagtaatccttatacattatctttttctttacgcggtctttacctgcccacaaaaattcaaaattaatgttttccacctaacttaacaaccactgaggaataactttaagtgatgagacatactgtagtttaactttgataatgcatatgtttttaacaattgtattttacccatacgtatgagatctctttgtttccaccatctcaaattttggatgtataatggattttgccttctttttccaataacgtaatcacacacacttacgcacacacgcaaactcgtgcacgcacacgcacgtcccctttaaaacatacaggaccacagtagaatgtgttgtacaagggattggttattttataaaccttacacatatcgtctctgagagagaatcctacgtcatttatatatttacagccctgatagtgggtgcgtgcgtgtaggtgtatgtccagggttgtggagttacatgtaatgtacctgcattatgaaccacaccgttttgcggtattcaacttttatgttcttattttcactatagagtacgactgtcccgcattggggaatcccatacacggctctaaagtcagctctccgcagtacagagtaaacaccaaggtcaattttcgatgcaaccatggttatgagatggttggttccgaagagaggatatgtacgttttctggagagtggacaggagagatgccaagatgcatgggtaagaataacattttacaccccccccctaaaggtaggcgtaccaagtaactctttattacataatttcgaaatgcgcaagtgttcaccgcaccacaaaaaaaatattaactgattaaaaaacacctggtacactaatttacaccccccccccccttaaaaaaatgaaaaagaaatggaaacttccattgtattatactcacgtataaaaaccatctcccggagggcccggaaacgtagttttcaaacttcaaagtgctcggtctgtcatttgacacatcatacgtcaaatttactttgctgctcaggggcgcactggatgggctcttagactgtgtaccattattattacccatgttcggatgatcttgtagcagaaatctcctctgtttaaatttaaggtcgtgatgagttcgacgaactttctcgagtgataaatgggctagggaagaccttcgacgaaatcgtcatcgacggcggctcttgggtgggtcaaaatgacacgagctcgaactcaggtgtgcgaagaaaacgtacaattaatctctcttctggaatggatatctattttgcgtttgatgcgtcgaggagtgttggaattgaaaacttcaagataggcaagaaatttgccaagcttctagtgcgaaaggttagagaagtataaagcaaaaatataagaaagtgaatgtctatgttaaagaggaaaagagttaatagagtttgacaaatctttaaatttctatttttaataacaacttataaacattacctatagaattgtgttaaaatgaattattgaggataaaaaagtcgatcaattgataattttacataattttatgccattgttatataatttattttaaatcaatgggtgaatttgaaatgttccgagtaaacaaaggcatagaaagggcaagattaccatttttcctggcgggaaccctgtatgacacttagtggcttgaaaagggatggactccttttaacctcaaacaggctgaatatccttttttggtttgttcaaaaggaattattatggatttatagcactaaaccttggttaattatggtggctcctaaagggacacgcaaacgcaaaggattggcgtgtatatatatatatatacatgaaacatttttgtcttcttttacgttccaagacgtgacacaaaaatacgtatacctatgcagctttttttggtctttacgttaaagacgtgaaaataacaaaattgacgaatacctatgcaacaatttttgttatttcttacgtccaaaacgtgaatattaaaagagagggacaagcagaattttgtttaagtgagcttaaaggtaatacaaagttttggtaaagggtcatgaattcggttcaaatgaacatattggaagcatatgcgatcctacaatactcagtgatggttgtcgcggttgaaatcgagtctaaagtgattaaattgtaaataaactctttatgttgtatagctccctctcacggtcaagatattaattaagctataaaacaatgtttcttgactaaaattgaccgattagttattctcgtttgaaagttatatatcccaactactgtacatatcctgagattttcatggtcgcagctaccagtgtacggccgtaggcgctatttaaactgtataaacatttaccgggagcaccagtaaatttgtatattcaatttttctcaaaagcagaagtgttttagaggctaaattttctagtgcttatcatacatccgcaggggcatccaaatatatcataattaaaaaaatcactatccaacaaattttcaaaaattcccaaaactttatattacttttaactataccgttcggttcgtctgatgtatgtttagtgaaagtcaggcgcggatccaggggaccgagcgggcccccacccccccccccccatcatctgatggtaattaaattactaaaacccttgagctcattggggctacgccccttaaccccacgccaattagtgtcctgccagtgtcacaaataaggtatcaaaataatgctcatctgaccgtaattaattgcccaaaacccctgaacttccggtggttccgccccctagacccaaccaagggccctaaggcgggcccctggacactcatcagacgataatttaatgcctaaaaccctgagcttctgggggctccatccccggacctcacgccaataagtgtcccgccagtgtcacaaataaggtatcaaaatatgttcatctgaccgtatgtaaatgcctaaaacccctgagctaccgaagggcctaaggcgggcctctgaatgcttatctgaccgttataaaacggcttaaatccctgaacttgtgggggctccgcccctagacccaacgcaaattagtgacctgccagtgtcatgaataaagtatcaaaatatgctcatctgactggaatcaaatgcacataccccctaagatttcgggggggctaagccccttgacccccgacggggcttttccctagacccaacgccaattaacggtacgctctaactaattgtaaatattttagcctccccccacccactttgaaaaacgttcagcagggcctgcatgtaagagtgcggtgatgcggatttttgtctgcccccccccacccaactggtcaccattacgtaccaatagttggctctcataatttcaaatttgggcccccctccccctaagaaatcctggatccgcgcctggtgaaagtaggacatttaaatttcaaaagttgcatcgcaggcaaaaacacacttacaaacatgcatttgtcatcatttattcaaatcattcatatggatgatatttatttaatatgtacattgttttgtgtaccaatagaggccgattgtctctgttttgaagatatgggttgatgaaataatctgattatgaatctaaatatatacatttatttgttgcagcttcaagtgacttcctcgcctggtggaacgcgtgtcggggcagtctcctactcgtctcaagcaagcagattgttcaatgtcaacgattattcgtcttcagaagctgtagttaatgccatcgaaaggcatgtcaattacaaaagtaaatataagcgacgttcagacaagataagaccaactgcctcctatatccgttgctgggcgagaatggcaaaagcatgtgagattgtacaagaataggggtcggggctnaagggnagggcggctggggaggggctggggagggctttgagttcatgcattatgattttgaactcaagggagatgtgagttggtccagcagcacgttcacttggtcagctctgtcttcgcctacaaactggctcatgtaggcaaccccgtttcgagactgagtcaagtcattcggatggtgacgttaaaggtcggcccctatacgtaaaaaaaattatattttattgatatgacacagacacacacacgcgcgcatgcacacgcgcacacacacgcaattttatatgtgcctcgttctatatttttgttgttgttaggggagtgagggggtgatgcttaaagggaaagtccacccccaaaataagtttgtttcgatagaggcagaataataagaaaatcaggtgagtgaaagtttgagcaaattctgaatgaaaataagaaagttatgaattattgaagttgtgatcaatctaatacaaattggcaactctgtgacttatcatacgagctctccttcatttgctttgtgcataatattccataaaatcatgttttcttcgttattgatgacggaatatatatttgttccttgcagggggagtatagaaacatatttgcaattattatatttagggtgcatgtatggttgaaatttttcttgagggaaaatgaaaattttagatttttttagtactgagcaaatggaagttgagctcgcatgatacgtcatagagttgccaatttgtgtttgattgctcacaacttcaaaaatgctaacttccttatttttaatcggaatttgctcaaactttcactgacttgtttctttcatttttctactcctattaaaactaacttaatttcagggtggactttccctttaaagaaatatcttggtgattgctgtgcatgttgtattatcaattgtgtctcgaaacattttaaccaccacccttgcaaagttatgtaatcgaatggaatacttgatacctaaagaagttaagtaaatttttccgtcaaaaaccgatccatcattgacttcaaaaccaaactgattcgatattgatatagaaaatgaatgattaattgaaagaagtataaagaaaggatttcaaaaaatactaaatcttcggctttcttgtgacagataaaggaacgaatttgcccgctgctctcaatgaaatcaaggaaatgattaccggcgaaaccctggaaccatatgggaacagtagcaggaaacgaattatatttatcataacagacggtaagttcatcttaacgagaaggctaaatgttcttgtaaaggtgaaaatgatttattactattcatatattctttctttgtgttaaaacaccatagtgaaaatatcacattaagatattgctcttgaaatacatcttctaaatttgacgagagatagtttgaaactttggataaacatttttgcgccacatgactgtacgtgtgtaccaaaatatgtatgcataggtttgcacggttttgaccttcagcaagattagtcgaattacattcattttgattctgaaacgttacactacacatctattcaactattccttaataataataatagcctaatagtccactccaaattttattaaaccgaaacgaaaattctttttgcccaattgatcgtgagcccggcagccacagatcgacgttgctctatcccttattgttgaacgccaaacaaggtagcaacaactcccatcttttaacgtcttttggtattttgcggccggggttcgaacccacgacctcccggttgtgaggcggacgctctactgactgagccaatactccggtatcattccttatcatctttgtattaatatagccactgccatttgtcctccatttgaagggatagttgagttctgttgcagagggcgatacacgaaataattttgtttgtgagataatgataaactgaatatcaaatttgaaagaacctacaatttaaatgacaaaatcatctttgtttgatcaaaatcggttcagagacggctgaaatatcaataaatataacgatttctactacttgggtaccatcacaaatattagaaaatttgaaaaagccgttgaaaaaacgaaatggcatcttttacgtcgtatttcagccaatgccgatgtcggttttttgttggcattttcgtgatggttatattacgctcaaccagccggcccatgaattgttatttttaattaaataattagttaaaggttatcttatttttgtttaaagtggagctgaattggtataatcgtattgggtaaatttcacacatttggaggtctaaacttaccttcatagcaattgtaggttcttaaaggcgctacaaatgtcttagataagaataagagcaataaccatgcactttgaaggcattagcggtctgaaaacagaacttaactatccctttaatctagagaatcgaattttacaatttcgttgaaatgagggtggttactaacttggatttaaaaaatatatatattccaaagatcagttttcccgaaggattataattcaaataaaaaaaaatgcaatacaaattttccataacaaagggttgatagcctttttattcttgcgcttttcggaggtggattgaaattaaaattaaattagttcgtaattataaagccgaaaaataaaataggttcaatacagtatatttacagataattcataatttgaaaattatgtaatttctatttaatgttcggtgttatgaatcttcgaagaaaaaaaatgccatacgggtcatcacccccccccccctatcatccccaggaaaaaaaatgggagggggtatcctgtgtaaccgttaattataaatcgcaagattcatggctgttgttatctatcaggtttcagtaacgttggtggcgacccatctgaacgcgctcaaccactaaaagaagatttggccgtcaagatacactgcataggaattagccagaacattaataagcaagcacttgccgaaatcgcctctctgcctgtcagcgaacatatatttcctctctcgggttatccggcgctggaacgcgccgtggaagccattacctgtacaaagagatgtgagtaatcccaacaaaagtatttggtccatcaattaccataaagaaaaccaaactgacaacatacaaagaaataaaacaaaatcttggtttataattgaagtagccttgaaataacattttaaaatcatcacgatgatctatcatgttggccgatataggctatattaactgccctcgagtggatttctcgaaattctttgcgatcttgtctgcgtgaagattattgagtaagcctatgtaaaaaaagaagcagaagatagtcttgtgttttcaaagtgccttccatttttatataaattagcattaagacttatattttaagtgtcatattgcctcttaatttacctattctattcacagttctacctctcacttaacctgatgagtaacattaatcaaaccatgggcgtagatctttaattgatacctattgttcggggggggg

SEQ ID NO: 2751 - DNA, 3939 bp, Oryza sativa
cccccccccccgaacaataggtattacgtaaggattgacgcccatgaatcaaactcgtaaaaggttgtccgcttttattatccggcacgctttgcttgtcgttgttgttttactatgtttctgcttttacttttaatttgttctctttaactgactggagattcgaattcgattttgtaaatttctagcactttgcaactccatgagcacgctttcatgggcagaaaaagagaggcccctttttaaaaaatcgggtctattgaccgcctccacttcccaggactaaatctgccctaaactctcaaccaagtacaaatgtaatgttgcatatggcgaattcttggaaatgaaaaacgagtgaaaatactcgtttttcatttccaagaattcgtcacatgccaaaaaaaatagatataaagtatattataccttatatctatttgttgttacttcatttatttgcatagtcatttatgtatattcattcatttcttcattcatttcttcattctatttatatgtttacttatttttttatttttttttcgggggggggggggttatttatttattcataaagtttttcattcactttgcctatttattccagggttttaaaaaaacgtgatcttataaaatctaaatcgcaatttttacacttacacaattttgttgcaaggttgttttttgttgttgtaaaaatcaaggacgtgtgcgattaaaacttgtacgcgtacctgaagtcatgagcactggcgtacagatgggggtgcaaaaaagacctcaaacgaggtttatttcaaaaattcaataccagtgatttacaaatgctgaaatgacatgattttccgggatttttttgtaaattatacttttgtatgcgtttgttggaaaataacaaattcccaaattctaagtcaggccaaaaaatatgcttatttagaagcctacatgtaagggcccgtggaacggcggggctcagggggctcgagccccctcactttttaacttgggaaatggaccaaagacaatagcatgaaactgaaccctagcaaatgtgtcatcatgagcattcagttcattagaaaccaggcaaccgtcccaaaagtaaaattggtgacctggaaataagtgaagtacaactagttataagcttttgggtgtgtttgtacaggaggacttaaaatggacatatcatgtcacagaaatggtcaaggcggcaaagcatgaggctacacaatgatgcgtatcttgaaagattttcggctacctgttgaggatctgaaagttgtgtattgttcgtacgtgcgcccgaaagtcgaatactgcgcacctgtttgccattcaggtttgactcgggcagacaagaaactgatggagagaatttagaaacgagcgtgtctcctcatgcttggccaaagatacacgagttatgatgatgccttcaatgttcttgaccttccctcactggaggggaggagggaaaggttaacaaagaaatttgcgagtaacctcacaaaggaaacgtcccccttctatcactggctcccccctacgcgagcttcccgcacttcccgcgacctgcgcaacgctaaagactattcagaaataaaatgcaaaaatgagcgctacataaagagcgcactccccttcattgtgaggttgcacaattcaaaactggaataatgtaaaaacagatctcttgttcataaatgctgagcatatacgtaaatcaaattgttatctaatagatgtgcttgaatgaaaaattatattgtttactgaaggtttactgattgtttatacggattatattaatttcaatattgcattaccaaccatattctctattagccaataatagaaagtgaaactatattttcactctccattcgtattaggttaattatatgtccattttgttctccatatacatgaaccttgcacccacatgacaataggcctacatttaaaaaaaaatggttgcgtccatgtcatgctaaaaggcatcaaatcatgccaagcatatcttcacttatatatcttttgtatgtttcgtaaggaatattgtacatcaaagggcaggaatacatatcatattattattaagaacgcctacacttatttttttttctgggggggggggggggtgttctttcaactgtaaagtaacctattattggaattaagataccggtagttttcgtacatgtataagaggacttacttgacggtcaaattttaatacgaataacattaggaaagataaaagaaaagtttaaagaaagttaaaaacaaaaaataacataagcgaagcgaaagaaaggatacatgaataaaaataaagaaatgcatggggaattatccaagaaaagatgaacggacggagaaaaagagctgtaaatctgtattgaaacggtcatagaagaacgaaaaggatgaaaactcaataggagatttcagtgtggtgctgttgcatcaatgtatgcattggcctaggttttagctatatcaacaacaaaatcttaaattaaacgatatagtatattagtagcacaaatctgtgcaaaagaaggaaaatatgaacacatatgtgaatggaagtgattgaaatcaccgatttcaaaacaattttttttttttttaaatcacgatttagatctcgtcaaccctgattcattaaattctttaattattcatatgtggtttcaatattccatagcttacgaggaatgtggagagtcaaaacacctgtcggggacgtctcgcattgttggtggtaatagagccggttcaggggattggccgtggcaggcagccctttacgataaagacacagacgaagtaagaataccttttattaacgatattatcttcgtcggcgaggggatatagtaacgctgccgtccgtctgtaacaaatctggtttccgtttgataactttagtaatgattgacggattttaatgaaattttatatgaaggtacatggtataaaaacacatcctaagttcgatttcggagtttgtatgtcaaaagtcaaaggtcatagctcattagatagcctatgcgaaaaaagctaatcgtgtattcgaaaatttgatttccgttcgataactttagtaacgtttgacggattgacgtggaggtacatggtatcaaaatacaggccaagttcgatttagtagtatttaggagtttttggagtatttaggtcaaaggtcaaaggtcatatctcactaaatgtgcgaaaatacgaaattatatttgcgaagatgtggttttcattcaataacgtaagttatgttgttgagtatgtacgtgaaatgtcaaagctcacagctcattaaatatgtaaagaatcgctaattatgtacatgataaatagctacaataattatgtatgcaaaaatgtggtttccgtttgataacttaagtaatgttgggcggattttgatagaatttctaacgtttattggccatttttacccggcgtggggatgctacgctttgcgttgacttgttagttggttgcaaaggtgagtggatctttgttttagacttatgccactatgtgatttgtttgagtttaaaatgaggacagttgcatgagttcttcttccccactttcttattcaaggcaaagacgcaggcagataagaatattgatgaatggcaagttagcatgcaccagcgcacggtggatttgatgacagtgttcaccagattcccttttcggtatttggccctggcttactgtgcggcatggctcccacttagccgagtttgaacctcgagttgtggcgagctggcgcgatcttatggcaagccgttttattattaatttatatcaataaatcaattcttgttatcaagaaataactttatgttgtaaagcaatggtaattcttgataacaagaattcgatttcgtgatatta

SEQ ID NO: 2752 - DNA, 3182 bp, Oryza sativa
  unsure (1)..(3182): unsure at all n locations
tcctgcagcccgggtctggagaaaagactacgctcaatactcatgttcttccacaggaataagatgatggggtcttagttttgaagatttttaaaaagttttgaaataaccgggtctggaagaaaaactacgctctaaacctaaacccatgctttattaccgggtcttagtttggaagatgattgggtcttattnaatttttttttttttttttttttttttttttttttttaacttgggaataaccgggtctggaggaacgactaccctcgattctcatgttattccacaaaaaaaggattatggggtcttaaatttgaaaatttttttaattttttgaaataaccgggtctggagtaaaaactgcgctatacccatgctttattacagggttttagttttgaacaaattcgacaaaatatcacttcaaatttattacatttgggggtaaagtcattattacatttgggggcgattcaaaattattacatttgggggtgaaatcattacatttgggggtaaagggttattacatttgggggcgttattacatttgtgggtgtaacatcccctgtgtgtgactgggcctttaaggaagacaaatgtaattttcaaatacaaatggtataaacacttgaattcctagataggattttccaccaaaaagttaggaaccagtacacagacggcttcaacagggaaattatgttcacctttactttattgtggattcctaagtagaattcgatgcttaaaatgatgccaccgactgatttgtgaaaatctgtgcccacagttcccaaatcttatgttttaagggacccactattgtttgtatcgtgcatttgagaagaattttttaagctgaaaattaatgtttggtgtaaaatgtttggtgtgaaacccactatgaacaatacaatggtattaagacccacagaagacaaaaggaacagtcaaaagtactgctcttaactattttctgggggtttaaggagtacagtagatttccacttcagtataaaattacaagattacattgtggacattaggctttgatggccaaataggtctcacttacataaaattgtatttgaagagccaaaatgtattacatctgacaaagttatattttctttacaaagacatttataagtgtgttatagaaaaggtagttgttaatacttaatttaaccatattacattgtgctgaaccctttaatgatactcatggatacaaataactattcaccatgggtacctacgtaatccttccatcacaatgctttaggctgggccccacactaacttttttggaaggctgtccggatttcaatttttagagtatgaatgtaaaaacccatttaaaagttttaaatttgggggttccagactgaagtattgggcgtccatgtgtcttgggcgcgtgttagtgtcgagccctgcgtatggtccaatttcttgatgaaatcgtatatatgggcccaggcgcgtacgcaagggggtggttttgggggtcaacccccccctcaactttgttttatgtgtgtgtttcggaagaaacccccctcactttttttccagtgtaaaaaaaaaaaccgggggaaaaaacccgacgccactccccccccccccaccccccactgaacacaaaatcggtcggtataattgttcaatttccggaggaaaaaaatactctccccccttataacccccagaaaatagtttacagcagtcctcttgactgtttaaagtatctgatcctttaggacattttcgcgaagaatccaactatgtgtagtgccggcataatcatcaggtcatggttttgatttgtttcccttacaaattactattcattttcctctttaatgttctgctttcatattttctagtcttttgtttttccttcttcttttcttacaaagatctttctcaagttattccttgttattttttcttctccttcaaggagagtttcttcttcttcccatttggaacagtttaagaactgtatgagcttgactgaactttcatgccacatgtgtgtatagttccatagacacatttctgtgtgcaatgcatatgacttctagcatatcaagtccattcttatccattcaatgattataaaaccgcacagtatatgctggttcttatttacatgaacatgtattatataataaatctttcctaatggcttccacactgtttcttttataatgcattcacttgactgaacttaattttatcttgaaaagaatatatcccttacccctgtcaatggacctcttctttcttgtaggttcatccacgcattcaatctctgtgatcattgatacaaaatataaaaccggaattaaaatttcaatataaacaaaatatatatatatatatatatatataaacaataataataaataacatgtctgtatcaacaatttatacatttgaaggcaataaatcatataatggcaaactgaatatctaacattctttaaatttagatatcgtgatattgaatattttgatattatgcaggcctactataagaaaatattgtgatttcttgtatattcatgaagtctattactctttgtttagtttgctttcttattgttcctataaacaaacataaattactgtatgtacattctgtttttggtttaacaggggcctgctgtataaaaagcattcagagaggcaaagaaggcaaccaaagtgttaaaaatcaaaacagacaaacagatatacagtcatgcaattaaaaaagctatcagcacaattatcaaacagaacctcacttgtcctcttaccttcacgaatagcaacatccagacctgcgttggtaagtacagtcattccagaatccttatagtgattacaaaaataatgaattaaaaacaaatcacagtatctttatttttcatttttctatttgacatttgacaaagataaacattcaggtaaataaatgtcaattagtgtttacatccccctcctctccctccctctctttccctctctctctctctatgactatctatctatccaggcgcggatccaggatttcttaggggggggggccaaatttgaaattttgcgagccaaatattcgtacgtaaaggtgaccagcagtgacgtaatgcaggggggagggtgggtgcagggtgggggggggg

SEQ ID NO: 2753 - DNA, 1604 bp, Oryza sativa
cagttctcgactcctcgtctggatttagttgtaccgttctcgactcttaatccttgtcctaattcagtcccccccccccctcccgctcgaagcgcgaaacctttttacgtttcattaaatcattagagaaagaagacgattcgtatttccggtctcgactctaaatcctcgtctgaattcagtttctaccctcccgcacgaagcgcggaagcttttacgattcattacatcattaaaaaagaatacgattcgttgtacagttctcggctccttgtctggatttagtttccccccccccccctcccgagcgaagcgcggaagcttttacgtttcacttaatcattagagaaacaagacgattcgttgtacagttctcgattcttaatccttctctgaattcagtcccctcttccccctcctgcacaaagtgcggaagctttgacgtttcattaaattattatagaaagaagacgctgcgttgtaccgttctctactcataatccttttctgaattttaaagatgttctttgtctgctcctttatcttcctacgtcctcttcatgttctctcctctcttttttttttttttttgccgttgttttttgcgggacagcccccaccgcccccccccctggctacgcgcctgcggtcagataaacacattttgataccttgtccgaccccggaagctcaggggtttaaggcaatcaattgcggtcagataagaattcaggggcccgccttaggacccctggtcgagggtgttgagcccccggaagcttaggggttttaggcgtttaattacggtcagatgaacagtttttgttataccttattattttgtaacactggcaggacactatttggcgttgggtccagggggcggagaccccaaaatcagggttttaggcattcaattaccgtcagatgagaatctaagggcccgccttagggccctaggtggaatccatggggcagagcccccgaaagcttaggcgttttaggcatttaatcacggtcacctgagcatattttgatgcctcattatttgttgacactggcaacactattctttctttcttgctctctttcttttttatttctctttaatatactttttttttaagtgggggtggaggctcccgatccccgccgttcctcgggccctgacatgtaggaatctcaagaatcatatctcttgcgtggctgtaaattcaggaatttgtcattttccaacaaacgcataaaaagtataaagtgaggaaattatgtaatttcagcattatttgtaatccaccgttatggaattagaaataaaacacgtttgaatttgattttccccaagccccctcccccccccctaacagtacgccagtatctcctctttttatttttttctttccctttccttttttctctcttgtttttttgattggggggggggggggacacagcctgggaggcaaggccctttcggccctcgatctccttcttccccttttcttttcttcttcctcttctttctttccctttctctcctctttccctttcccttcttttcctttcttctctctttttttttttgcggggtggggggggggggg

SEQ ID NO: 2754 - DNA, 9015 bp, Oryza sativa
cccccacacacacacagtttttaaagtctttaaagtctttatagggttaaagacttaagacctgagttttatggcacctattaactgtaccttaaatcaaattttattagagtttccttcctttagaaaagaggaaaaagcatatggacaatctgaacacgcatgcatatgttgcctccttcattactgctttctttcgcacaatgtatattaccttgaaaatttgagcagtgttttgtccccctcctggtccgcatcctgtgtcatagctcctcatccaatcatacatctgtaaaaataatttccttttaaagcttacttttagataaaatacatgatttttgacatctaaacttgattttatttttttcttacaaactgtacgagcatttggcaagtaagggtgaaaatattgtgtatacatggcacctgtattttaagcattccacactgtatatagtagcactggcatacattcaacagatctctacaagttttgtaatacatgtaataataaataataatggtggcttcttataaagcgcaccagggacccgtttcacaaagcattttttcaatgacaaattacacaaatttgtgacaaatctgctgataaccaatcagaggcaaggattccattagcttataacaaaggctgtcatttgtcactggtgacaagttttgtgaaacggggcccaggtccgtcccgtcaagtttgacgctcatatggcgcttatgacgcgtgttaattgtttgccattcttgatttacatgtacatgtatgcatttaaaatgagcaaatcgtttgttcagagttagaaaggcatttttttagctctgttttgaaatataggagttaatgcccctctggctccaaacagacaaacatgtatcctttgtggaaataaatcctgaaaatgtggcggttggtgtgtatggcgcgacttcattttcgagaacacacattgctcactcgtatgcgtcatcaattataatccacaaagggtgattcacaattactacatctgtaataaaacaggcagggcaatgtctgccactgagaccaggaataattgaaagtttaaattcaaccacgcatgactattgaagaggtagttgttcttgtcattcatggaaattatatgaaagcacaacaatgttaaaaattagagcaaaggctaaaaaaaccaagggattttagttgcaggccttcgttacaagattccttagattcagaaaaaggattttggaaaaaaaaggtctatgagcacttatcatttaattacaagttaccccctaccagaaatattagcaataacactgaagaaaaaaaagttcaacattttgatgtttttttcctaaaggcccggtcacacagaggggacgcatgggggacgcacggccggcgcatggaaaatttgcgattttggccagtgcgttgtcgttcgctaggcgtgcgtcatcactcgttactcgttcgtcgagcgcgctggacccacgctatgcattcgtcgtcattcgctgtgtgcgtcgggatttttttagcatgctcaaaagtgtgcgcggagctcgacgcatgaatgtacacgccaaaggcacgccagacgtgcgttaagcgcgctagaccagcgccagacatacgcggagcacacgccctgtatacgcacagcgcgctagctacacgctgtgcattttgtgtcagctcgctagcttttccaaaatcatgacaaatgttaggcacacggcctttccgatttccaatgcgctggccgtgcgtcgtagaacagggctttgcaacttctcacaaaatctaaggctgacataaaaacttgcatgaagcttattggatgattgcactttctctgtgtaaaaagatgacaacattttatcttttttaaacttcacctttgttacttatttgaaatgatttgtactctaatctggttcaaagtcaaaagcttaagtctggcgagtttgagtctggtttggtttccaagctacatgtactgcaccggtttctgacatgtatgtctttatacattcaagctataaatcagtttatgaaatgatattaatctagactgacctttcgtttgcccattcggtccttgtttcttagcagatagacagctttgtcaacagctagaaggccaacataggagttgttaggtgcagtaacttctacccgtatctccccattgggttcataaacggtacgttcaggtcctacatgccttggaagaatctccagggaaacctgtaaatgttcattcaaaggaaaaccaagatggcttgatttgactttcgtattaatgtttacaaccacttagttcatgattaaagtagatgtgtcgtggtctagtgattaagtcgccggactgtgaaccacagggaacggggttcgaatccctgcaacagcactggtgtcctttggcaagaaattaatctacatttgccacactcgaccaatttacctcgacccgtgtgaggtaaatgggtatcttgcaggaattaattccttgaaatgctagagcatcacagccgccatgctaaagccggggtgatattgtggagcgtcaggatcgagtgtaaagtttgacagccatgagtgaaaaaagaacccattattatcattattattataatcatgatcattatttgtgtaactgatcaacagatatgttgataaagttttggcaatggaaaacaattattttatattttatatacatatactgtgagtcaaacctgcttcaacgataacctgtatagaaagaccacattttgtatttcccttatatgggtttctcattgaaacatgtactaaaggaacctgtatatagagaccacctgcctataacgaccacttttcttgtctcccttgggtggcctttatagacaggtttcactgtcaataaactcccatgtacatgcacatgtatatattgcatatatgttcctcatattccgtacatgaagctacagtacgtacatgtacatcgtatgttcacaggtagtcattttgtatttatactacagtttacactcatggctccagaattatcaagcacagttaaaattgaaatttgtcatgacgtagttaacaaggatatggtttgcttcactttacgttttttttgtttgttaatcttttgttttgtttttatggctctctcattggtaggcctacattatattaaaaatggggttagtttgaaaaaaatgaaacggtttctgaatacttgccaaatcaaagaagagagaaaaattctcaaaattggctctagagtcattaatcacaattatactataaatttatcctgatgaattgaaacatgaaaatgtatttattttaataatttttgtgtgaggctctctcactggtaatccttgatacaaggggatggtttgaaaaactgagacaataaaatgtttgcaaaaggttgtacatacttgttcatgtaaactaaactagaatttaattcgtcactttgacgaattaggtgagacgtagttatgctcatgtgtaacataatgaagaacgcattttcacgatttcatctttcgttataaaatacaactcccattatggtctatccatgagtcaagtttcaactgtgtagggcagagggagacagagcaatataataagagggaggcaagatagagagagggggaggggtgaaagagtagagagagagagggagagagagggggagagggtgaatgagtagagagagagatatagatagatgcagagacagaccaaaaagggagaggggcagaacatgagaggagaagggaaacagagcaagagagagatgcaattgagaacaatgctttccatatttctagcataaagctcttgtgaatactgatcttgaaagtgttgccgataataaaaaaaaaaattatgttcatgaatacgatgatgacgatattagaatgaaggccatgactgcaagtggcacagcgcccccttcaggttttgatagaagattaaactgtttacctatactaaacaagctcaaaacacttttttataaatattacaaaatgtacatagtgatttatttagttctgatttaatatagaatatgagtgagatattaatattttacccatccataacccatccatttgcccaaacaatgttgcaataactaagaaacggtaatataagtgtattgtataacataacgagaacagattgaggcaaagtatggcggagtttggtgatgacaccagtatttctagaccctatcttattaatatgagatatatgtgttttccaggataagtttcgtcaataagaatagacaagaacttggtattggcaacacgattatccagtcataacgtaacaaatcctttttgaaaacattaagagatgtatcattgataatacgagtattatatacagaaattttataaatagaaaactgtttttgtgttatttgaaatattggaaaattataagatatatcattataaaacaaacaagaagaaacattcaaatcaaagttatttgtaaatatattatcaatgagggatattgatctgtcagtctttctcaaaggcttatcaattaaaggaattttaaaaaaaatgtattgcgctcaagaaataacatacagcattgccagtaaatttcacgagatcaatgttaaaatctcccattatataaacctgtttatgttcagtataagttttgtgtaaaacattttcaaagagagggatgaaatcattgatatttgattgaggtttcctatatatgacacctacaataatattcttatgtcacgacaagttgctttcaataaacagtgattcataattgtatgatgggtataatataaatatatcattgcgtatttcatattcaaaattgtcagcgaccaatagactaacacttccactctttcctatacttggcgattagaatgtataaatgaataaccagacacattgaataatagtggcgtactgttattaatccaagtttcagagaaatctatacataaagtacagatgaaattggatatagcattaaaatgtatgtttaaaatgtaaaatactaaaatgatagtcaatgttactgaattcagtcgtaaaatcctcctcagtataatatttacagttcagaaacctactgaaattaaattatcttctttttcggataaatagtttaaatcattgatatcagtatgagtatttgtagtgttactaccaaatttgaatgaagttcgtcattattcaagtcttgaaaaggaaatgaagaatgattacagagtgggttattaatggagacaaatgctcatgtttcctataacgctcattttatgtattttatgtcttgaaagtaaaagggtttccttacataatttgaaaacgagaacactgctaacgtttaacccattgcttactggaacctggtggtccctgtgttaagcctatgggacctatataattcagtagtcaacgggttaagtttcacaaataggacatacgtgacatattcatcaattcaacattcaactgaaaattgtgacatgatcttatcatctgatcaaaaaactaaaacgttttgatagcccatggtctcagctataacataccaaaatctgggagaaaagaaagcacaaatgagcaagataaacggtgctcaaagatgaatgtcatgtagattcatgatgtgaacaaaattcaccttccattgacataacacgcaaatgaagaaaattctgacatgtggccttcaattgaattttgtactatgatgacgtcattaaaatgaaatttagttatattgatcttgtagacaattgcctcgactacaatatattagaatgtagaagaaaattggtgaatattgagagaaatacactaatttttccataaatataatgacgtcataatatgcaatttggtatatttgacttccaaggccattatgatgacgtcaagatgtacttaatggccgaatgagatatgaaatcatacctccgactcatactctatctaaatatgaaaaaaaaaatggcagtccttattcatcccaatggactttttataggcttgtttttgcccatatatgctatgtattgcaaaaatcgcgcgtacggacggttatcttgaacggacgctcatttcgttattaataataataataataataaatttatatagcgcagcttttatacaaaatatattcagctgcgctggttaagagctcctttttactaaattctacaaaataagatcactcagttgaacaaataagtttttaaattggatttaaaaacattgagtatggagtgcttcttatttctattggcaagctattccatagtttgggggcagcaatagcaaaagcacggtccccaagagttactttagttttgccatggggaatctgaaacaataatttatctgtggaactgcgcaggctacgactgtgtgattggactttgagttgtagtaattctttgatgtaactaggggcttgaccgctcaatgatttatagacgattaacaatattttgaatgagattctttgacggactggcaaccaatggagttctctcagaagaggtgcggttgaagtgaatttcgaccgacgatagacaagtcttgcacatgcattttgtactctttgtaacttagctatcagagaatcaggcattccaaacagcaacccgttacaataatcaagcttacttgtgataagagcgtgtacaaccaatttcatacttccttgatcaaaatatttgcggatacgtctgagattgtacagaagatagtatgttgatttgcatatatttttaacatgtgtttccatggttaaattagtatcaaagtatactcctaaattccttgctgtaacagagggtatcacattggaggatccaactcttacaccgtcaatgcttatttttgagatctgttgtggagttcctataaccaaaaattcactcttactatcgtttagcttaagattattgttaagcatccatctatgaataaaattaacacatttttccaacattgaaacacttgcatcttgagtactagtggatggtctaaaggataaaaataattgtgtgtcgtctgcataacagtgacaggagacttcaggaaaattatcctgagtgctcttgattagattacttgtgtataacataaaaagcaaagggccgagccgagagccctgtggcacaccaaagggcacctggaaagagtcagagacaatgccatcaattttaactttttgatgtcgatcagacaagtatgactcgatccagccgagagcaacaccgtcgacaccgcagcatatcttcaagatatctagtaatctggaatgctcaatagtgtcaaaggcactactcaagtcaagtaataacaggagagtgattttctgtctgtccattgcaatcagaatatcactcttgatcctgagtagtgccgtttctgtactatgaaactgtctatatgcagactgattggatggaaggagtgaattactgttaagaaactgtaaaatctgttgtgtggctgcaccttctaccaatttagaaatgtattgtaggttacttatgggtctaagattaccaaattcaacatcaagccctggttttttcaacaatggtgaaacaagtgagactttccattctttaggaaagtggcccgtagacaaggagacattgatcatggatgtgaacacaggtagtataacatcaatatattgcagagagcagcataagcatgtacatgctcgtgcgctcaacccaatcaatattaatagtgatgaagagataaacatggtttcaaattgttcggaaaagtatgaggaatattctgtcaaaagtttttgcggaggaattgtttttcgttcggccgtgacgaacgaaaacgtgcaaaaatgcgtgttttgcgtgatattttatgaaatgcttataatggcctaaaacgtatgcaaaacaaatttaagacgattttgagcaacttaaaattgtaagcgcacgcacatttttgcgcgcatttattgatcggaaattgaccggacaaatattgaccttgatcgtgataagtatgaaggagaaatggctttcttttatgaagatatggtcatgagttgattttcacaaaatggcgcctagatgacgtcatgatgatcttgattcactgaaaagtcacgcagttctaagttagactgggatctaccatcatagcaagtttcatgacaaaccggggtttattcattcttgagatttcttgcgaacaaattcgagtaagaataataataatttttggtgaataatacaaatcttgacgaaatctatagttgatacgtatacttcgtacgtatgacctaattaaaaaagaggaatatgctcaaaattggctctagagttagcaatcacagttaaactgttattgagttctatatgcaacttttttttaatagcagtcttacctcttggttttgtctgcactgttcttccacacctaaaaggagagagtcggcaataacgctgccatccatagtgacatagtagacaatcagtcgcattcgtggaaccatgttggatctgattgttatgggcaggtttgtaccaaatgcacttatgcgttgctgaactccctgcagaacaatcttgccacctgtaatgcactgcaaacaaacatttaagtttaagttgagttttagccatgcaactgcaatgtgaaaaaaaaaactgtggacgcaattggaaaggttgatcgtgtagcacaaaaatattgtgaggtttaggaataaataaaatgataattaattggtcacatgcaacaaatactataaagtgtatatgggactacacaaatatgtggcatgaatgatgtggtgtacattcttgagatcttatgggtcatatttcaaatatgagggggggggggggggggggtaagagcacatttttttttgggggggggtccaatttttgagagaaaattttacaaccacttagccggccg

SEQ ID NO: 2755 - DNA, 693 bp, Oryza sativa
atttaaaccatgccaatgcattctcagagcatcctatcatagaaagtttgttcagcaatacatcgtagttaacagaatcaaaggctttacgcatatcaataaacgctaccccacaaaatttactcctatcaacttcggttgcccagtcatcaaccatacacaatagagcactttcacatgaatgctttggtctaaagccaaattgactttcactgaagaaatcgctatttaataagtatgtctgtaaatgcttttgtacccatttctccaaaatttttgaaacaattgacaataaggatattggtcgataattttctatacataatcgatcaccgcccttaaaaatagggcgaattttggccaagcaccatgcttttggaaaatgcccttttgacaaagaaaggttgaaaatataaataagaccatctattacatttgtggcatatttcatcattttcaacattttaacagagatgtcatcaggccctgtcgctttttttacagaatggctatcaatttcttttacaacaaaatcgtaggtgattggaggagtatcaaaaatttgacgatcaacatgatcaaggtcctcacaattctcctgtggcaatggacaactgacaattacatctggaattgtggtttcactagctctccaacctgtttttcccaggagttctgaaacactatcaataa

SEQ ID NO: 2756 - DNA, 1772 bp, Oryza sativa
attcctgcagcccatctagagcattactcatcatagcagacattaaatcaaaataatcaactgaagagttcggtggacggtacataacacaaattaaaaatgatttcacgttccgtaccttggtttttatccaaatagtttctaagtttaacccaagatctttcacatgttgaaagtggagggtgttcttcaaataaatcatcacgcccccaccatgcctacttctatctttccttagtaaatcataaccatcaatatgcagttcgttgtcactaaccgtgttatcacaatgagtctcagtaaggccaatgatgtcgaagggagaatttcttaacaaataccttaggtcttcaagtttatttggtaaggaattaacattcaaatgacacatacgtaatcctcgttttgaaataactggtatacttccatcatcagaaagttcaagataggcttcttgattgctattactgtctgcattgtcactatttcgaactgaatcacttgatcgattgaagtcatcaatgtcttcatgactattgtctaatctatgtgactcttgaggagtctccgggctgtttgtagacaatctagccagtctcgtgggaaaacacggtcggacgctttcttgcggaatttcgctttgctcatcatctgaaaagacggagcatcaggatattgagattggagccgaggatattcgttatccaaactagccggaccagaaacataaacagtagttgatggaaactggtcacgatgaaacgcagggcgggatcctcgaagatatgcgatgatattctgtgccaatacacgtactccgtagccgtttaagtgtacgccatcagcggcgagatgtgtgtcaggagtgatgttttcattgtccacgactccccagctgcggcgattggctagaagtttcaacatttcattgacactgcgcactttctcgaaatcgcttgctgattctccgcgacgatggattattgtcgagacacttattttcttggctggtgtcagtttgacaatttgttctgccagggactcaataatgtagtccaaccaaccataatttgtatacgaattatttcgttaacttagtcagcatcatagctgtatattttaatgcaggcgcagagctaggatcttattttagggaggggcggtagtgagcaagcgaatcatctaaacagcgcgcaaagcacgctcattaaagtgacttggtaacattgtcgaaggttgatgaaaaaaattgcttaatttttgtatataatgttattccttttactgtactaaccctctgacaggcaaaaaatcctgaaaaaaaaattctcaaaccacgaagatatctatggttttctttgaaaaggtcgatgtatgacaccctctaacagtgattaacagtaaattctcccaaccatttttgaattttcccaaccgtttttccatgaaaaaaagacataaaacaggctataaaaaatctgtcaacacttaaatgtctggaatggaatgtaaagttattttattgctttgtgacgatttccattcacctaaaatgtaattaaattctaataatatagttgggagaattaagggatcaatcagatcatttttttcgctatttgtaccataaatattggtccgttttcaatcaaattttcagattatctttgattgcagatctggcattgaagaagtgacaaccttagcaccactatctctcaacttaacaatgttaccaagtccctttatagggtgtgtgggtaataggcctc

SEQ ID NO: 2757 - DNA, 13509 bp, Oryza sativa
taagtcctcaaccaaagctacattcttgaattcaaatttttcatttaccttaaccaaacctgtagcgagacggcatttgtagcagcatcaccaaagataatcgattcagtcttgcatgcctttttgagtgaggagaaccaatttttatcaccggtcatgtgccgcgaacaaccggaatccacgatccacacgttctccttccttaccaccaaagcctacacacaagcacaagtcgaagcctcagtactggggttagatgataataaaaattaatttaggaatccagtactgagacacatgaccagaagatccaataggcatatatccacgtgcaaaatcaatttttgaattttcagaaaaattcctccgaggccggtctgaccgaggtacagtggccggtctgaccgggggccggtctgaccgcctctgtaccgccgtctgaccggtgcccggtctgaccgacgctcagtagccggtttgaccggtcgccggtctgaccgcgggacccactgcggtctgaccggtttcttcgagggaaaaccatatttttgccattttgattttgcaaaagcaatctctctctcctttttctgtttatgagctaatctgaaacaaaaaccaacaatatgtccatctttgccacaaaaagaaaagtatatttctcacgatgattagacacattggtagaattagaagatttagcaacacaaataacaacatgagatttagcatgcacaacattggattttgaagaagatgcactcataatagacatgataccagtagatttaaacacagttttattagtatcaggtttaaccaaaatctcaccacttctagcaccaacacctaacacaataggaggatgtctagaattatgagcataaggattaaaacctaaaccacggttatgtgtgctaacctttgattgatccaaaatcatattgaggttctttttaccatcagaaaatcttagcaaagaatttttcaaataagaaaccactttttccaaattagcacaattttcacaatctaccatgacacctttgcttttacgacacttggagcaagaaagcacttcattgtttttcacaacatcttccatgtactcaacacgacctaaagcatatttcaatttcaacttattcaaattacatgttgagcaatccagaacatcatgaggttgttttaactttttagcagaaatcatgttaaacatcaaactagcatgaaaagcaatttgatatttttgcaacaactttttagttaaaaacaactcatccaaagtgcgtgtgtgcaaagcaaaactacaagcaagagaagatttatttttcaaatcatgtgcatcattaacatctctaatttttgaaatctcattcattaaaacctcacaattttcgcaatcatcatcattaggaataagagattttaatctagcaatttcagatttaagagattcaatgataaattcctattttctatacatcttctcacacttcttattcttttcactcaaaatattaatagcttcctcaaaatcacttacctcattttcttcatactctgtgtcagattcaccacgcgccatgaagcaaacattggagatgttctttcccttatcatcatctccacttagtggctcgaaggcggtgcaaacttgttgaaaagccttcctgagattctccagcttcctcctttgggatgaaccctttggcttgttgttgttggtcttctcaccatctttgtcttctcttttgcctgtcccattcttaggacaatgcgaacaaagatgatcaattgaaccacattcaaagcaacgatttggaccacctctttttgtcagggttatagataccacatacctaatagtagttggctaaatctcggcaggatccatcacataccatgtcttatacggaaactgacctcgagggagttccggataaggaaagacaaccagagttctacatggaaacgacaatgactactcggattgtatccatattggtttccctagttctacttggacaaggggacacctatgggtataaatacaagcccccctaggaggagaggggacacgagagaatcaacacccaccatggaggatcaacacccaacacaatcgacatagaagccacaacatagaagactacatacgccaagacacgccgccggatatcgacttcagggataagcacggctagtaccctacggtgtctccggatactgtcaggagagacgaaagcgccatctctgatctcgccgggcacggatttgaggaggaaggctaccctgttgtcgactacgagtcagatcgtcagaccgtcatgtcgacaacagttagataggctactccaaatattgtactggtgtgattatcatgaataagagcaataccggcttcggccaacaggatgtagggttattacctgacaattcaggggcccgaacctgtataaaatcctcgtctccatctattttacctcagtctcgcatatatcctagcactgacaatccacataccatgtaataccagaattgcgacatcaaacgccgacagtggcgcgccaggtagggggattttggtgcttcaggatttcgacaagatgggttcaaaagatggattctccgacaacgagctactcgacgacttcagctgagggggagatccaacctaaccagatcggagccatcatcgtcatcgacaacttggtctatcgagatcatccaagcctcaagctccgcggcgtaccaaaagatgtcagatcgcatgatatcgaacgagtacgcaacaaggtaattggtagattggttttttaaattgatctactaatttcgtaaatacatccggcatgtatctacaaaggtacgcaatattttatctgcaatttatcgtacctattcagatcatacagtattgtcagatctataatttattatgtttacccagagcatgttctttatacaataatatttgttgcgcgggtatccccgatgttaaatcgactacgatctaacgctgggggctcgctctgtctttttctgtataaatcatgcttgtttacggtttacataatgccctgacatttacatctgctcgttatatcctgataatactagaagatccatgcagtttttgagtacatactcgatattatctgctatatgtcttgtcttctagaaaatatttttcaggaacaattgagcactcgagtaggttgtggtcaagtacaccgcattatcgagaacgatctcaacaaatgcagagttgtcgcgcccaacctaccaacgaagaccgacgacctatctcatagcaccggccatggctggactactcgagaaaaggttgttaacggataattcctcgcgaacaccgtcgcttggtcacccgacatgattgcgaacggacatccagatatgctacaagttgggtgtgtgagtcatgctggccacatgagatgcacataacccaactctagcgcctccattggtgttcgagagataattctacatgttcgctggttctccaaccagcacgtagcaatctctcgcaccgcaacctccattgatgttcgagaaataactctactcgctcgctggtcctccaaccagcacagagcaatctctcgcaccgcaacctccattggtgctcgagagataactctacacgttcgctggttctcgaaccaatacgtagcattctctcgcaccgccaacctccattggtgtccgagagataactctactcgctcgctggttctccaaccagtacgttgcaatctctcacaccgcaacctccattggtgttcgagagataattctactcgctcgctggtcctcgaacctctcgcaccgcaacctcagatggtcgaggtatgactacagcaataacgtagcagtcctcgcaccacgacttcaaatgatcgagagacacctactcactggttctcaaccagtcaatcgtagcaatctctcgtacatttacttctagtggtcgagtttagactacatctagttctcgaccagcggtgtagcgattctcccactatttctacttctagtggtagagttgcgactaccacctggtcctcgaccagaggtgtggcgattcttccattacctctactccaacaaagttgacatcagatacacaatatcgccaagtgttttacccagagatcccttaccacaaaagacacatagcgttgaaacctatcctactgttcctttacgccgtcttgacaaggcctccgaggaacctaagggaactttggctggggacgcccagagccgataaggccttgtcggattcttcagagacgaaagaccatgtaagatctggtcgtgtaagagttctcgccgtgcgtattaaccaagccgtgtaatcggaaatggattttccaacttcatggctgggggctaggatcagtgcttgttcaaccgaggcaggtcaaaggtccaagagccttgtcatccgagaacgattctccgacgacaatgctgggggctagggagagtgtatgactctacaaactgactgatcggagtcggtaagagataagacactcatatacaaaacactggtctgtacattcaattcactagtctgtcatattataacatgttaccctttgagcgttcgctcgggggctatttctatctaatattcttttcttagtattgattttaggaaaattctattcgacattatcgaagatcgcatgtctctatggttctacaccaagatcaactaaggcgaatacgacaaatgttgacaaggctctgtcgcagactctacgcctactcgattactcgagaacggttcgtggatctcgacgaggaatacggaatgaagagatggtgtacccgccgagataaaatttcttgacttcaatccaaattctcgattgcagcaagacgggagacttagtcatacgctctgtactttctcggtcgacatcagagattgacttagacaaaccctttcggtgcccgcacgaggctgataaaggaagtctaacattatctctaaactcaccgagaacggtcacgtgagctcgataatagttcctccaaagtctgcggttgagaatatgaactcgttcatttgcatcgaagtcgggggctactgtcagggttatggataccacatacctaatagtagttgactaaatctcggcaggatccaccacataccatgttttatacggaaactgacctcgagggagttccggataaggaaagacaaccagagttctacatggaaacgacaatgactactcatattgtatccatattggttttcctagttctacttggacaaggggacacctatgggtataaatacaagccgccctaggaggagaggggacatgagagaatcaacacccaccatggaggatcaacacccaacacaatcgacatagaagccacaacatagaagcctacatacgccaagacacgccgccggatattgacttcagggataagcacggctagtaccctacggtgtctccggatactgtcaggagagacgaaagcgccatctctgatctcgccgggcacgaattcgaggaggaaggctaccctgttgtcgactacgagttagatcgtcagaccgccatgtcgacaacagttagataggctaccccaaatattgtactagtgtgattatcatgaataagagcaataccggcttcggccaacaggatgtagggttattacctgacaattcaaggcccgaacctgtataaaaattctcgtctccatctattttacctcagtctcgcatatatcctagcaccgatgatccccataccatgtaaatactagaattgcaacatcaaacgtcgacacttttcctgttcttggaattattcatagctcgagcaattctgttagcaaccaaagccaaatcctcctcctcgatttgttcgagttgatcatcggatgtggcattaaaaacagcaagaaaagaaggcttagatgaagaagcatcaacatccgaagaggaagacgaagaaaccaaagcactcgacttagaatcaacttttcgagaaagaacattcatctcatgtgttttcaattttgtgtaaagtgaatccaaagtcaaagtagacatgttaacagactcctgaatagatgtaactttcatcttccaaatagacatgtcaagatcattcaaaaagtgacgagaaatctcagattatggataattagcatcataagaagaatcaacagatctaagatcactcaaaattttattaaacctagaaagatagtcatctaaagcttctccaggtttcatctcaaatttaatgtactcctttttgaaaagatctcgacgaagttctttaatgttattagttccttgatgaaaattactcaaaacattccaaatctcatgagcagtttgaagatgagcaacacgatcataatctgaacgagaaatcccactcaaaagaatattgcgagctttgcatttttgttcaaacttagtttttaaagcagcagtattaatctcttcaggaatcacataaggacgagaaacttttctccaaatatcataaccttcagccataatataagattgcatcctactacaccaatgagaaaaatccgttccatcgaaaacatgaggcttagttgaaaacctagcgggagtagccatgacaaaaactctagatcgataaaaatccaaagaagaaaacaaggctctaataccacttgtaggatcgaaacacaagaactaagccaaccagagggggggtgaatggttggtatacccaaaaaccgaaaacttttagcggaaataaaagttaccctcgaaattgacggaagtcagtctgaccgagattgatcttccggtctgaccgaagcgtagccgccggtctgaccggtgttgatcttctggttggaccgccctggaatccctgtcgcgcctgttgtcgccgccggtctgaccgcaggtcacccgccggtctgaccgccgtaatgccgccggtctgaccaccggtgtgtcgccgattagaccgcaaaaacccagtgaaacacaaatcgaagaactctaaaagtggatgacgactttattgattctctctgtgtttacaaagtgcaccaacagcactccttatgaaaattttgactaaactcgaaatcctaactcaaaactcaactcaattgctctcaaaagcgataccgggaagcctcacgctccccctctatttatacatgaggtaggcagcctaaagccatgaaccaaactcatactaagagtcctaaacaccttaggaaaccctctagtacaagaaacaaactttacataaccaatcgtaccaaatttggactccttccaaattcgtctccgcatcccatacgcacacaatacctccatcgtatgtcatatggaatctccatcaaccacgtgcatcaactctagcctaagtatcccgcatgatctctaaccaccacggacgtcgtcttatccccaagccgactcccgatccatcaccgcaaatactctcccgaggcatcaagtcacctacacatgaaataaacaatgaaaccatattccgagaccaagctatctccaacttgactcattagtagcaaacaacagtattacatacgtatagtatccatctagaagtcataattatgaaataatcacggatatccaaacaaacaacccgaaactgaaaccgacacagcgtcggccggtcagaccgcgggctggcaggtctaaccgcgcgcataccgccggtctgaccggctatcagagcccgatctaaccaatcacataaaataatataatcctgcgatcacctgtgaatccaatcgtctccaaaaccacttcgtgaataaattccaaataacaaaaccaataatctccaatgtccaattgttcatcacagaataataatcaaaaacacctttgattttacaatatatcgtgttcttttctcctgaaaatgaagatgaagattaagattaagttttttacgcaaaatgatgtgatattaacatatcattgattgtgttttagttattacaaacttgataaatagattaatataatattttagagtaactttcatatagaaaatttttgcacgaaacacaccgtttagtagtttaaaaaagcgtgccacaagaatcttaatcttcatctaacttttgttggagaaaagaataggactactgcatgagctcgggctacttttaactattgctataagttccaaccatgatcaagaattcaagatatgtgcctatgagcatggaagaaatacgctagagaggataaggttacaatcaaagtaggagagaagctctcaggcgtggaagaaaatatctcattaatgtggggaggagaagtgcttgctgatgggaggtaacatggctctaagagcaagttgctgagatggaggagataagagaggagagagagaagaaacggactgtaaacttagaggcggtttagacacaagaaccaagaaactctgtaagagagacaagtgggtctatattaattgtaaataaccttatagccaacaaatcggctgtattactagccttgctttaatagttcagcgattctagaacgacttacgagaaataaggctacctagtctaataattacccccctccattttaaaatataaacataatattaaggttagaggaaagaattcagtggatgtgcacactccttaagaaataatttggctaaagaacaaaagcaagaaacttagctacaaaactaaaatcatctataccgaaaccttgcttttgatgtccctattggaaccttgatgctttgttatgctaaacttatatttaatactaattacataattacttactcttcgttccctaattgttttgggtaccgatgaccactctgaacaccctagctaggtccgccccaaaagaaaaaaaagatctcactttactcacctcaatggttaaaatttaaattttgaattacttgtactttcgtcctaagcacttgattgactaaatatttacggattttatgccctagaatcaacgcctcaaaaatatttatgttgtattatttattttcaaattaaaaaaataccatatcacgcgacttaaagtaataaaacctaccctaaaatgccattagaagaacaaagggccatcgacccatcgtagggagagaaaaaaaacagtttgctactcataatttgatactaacaaggatactttggccgagattagtttcaaaatttttcttcaaacttctaatttttttatcacatcaaaactttcttacacatataaacttttaaatttttcatcgcatcgtttcaatttcaaccgaactttcagttttagttttagtgtaaattaaacacaccctttttacttacgtgcggcctctattccctcccgctttatcgcacgtcctgtttcccggcctgcttcctcgcgcgcgcgcggtcggtgagcgaccagaagaggttttgatgccatggctgaaactgaaagcgtgacctgacctcccaccaactccccccaaggcggggctagtcgatcgagccatccgattcattcccatgacccacgcgcggcgacaagtcggccggtgatttcaccgtaccagctgcccccccttgtagtatcacgttcgaacggtgcgcccgccgatcgagcttgcgctcggtgcgccagcgcgcaagaaaatcgccgcgcgacgaggcggcacgcacgggatactgcgccgcgcgcggcttccgctcttccgcggtgggatccccaggcgtccgccgcccacaacgacaagttggcacggctgcgcgaaggaacgaccagcccagccggcaggcagcatagcagcagacacgggcggatttcgtctcggcccgcgtcagggcccggctgttcggcggatgtcgctggctggctcggtccatgcaaacaagtggaaagtggcctatatctggattgagcctggccttgtcaacaagataggccttgtcgctggctcggtccatattgggctttcgggtgtgacatggaagttcgattcttttcttcaagtagaactggtggcactgttaaaaagacaacatgtttttttattgatcatttgcttctacccctggggacagtgtatagcataggttgttcataccatacggttatatgggaaaatatataagtgtaaaccatatatataatgtaaacccgaaaactatcgtacaataaaaaaatggacgtctgaaattgtccacgttaccctgagtgaaaaaattattttcagatttaaccatagtaaaagttttaccatgacatggataagcattagatgcccatatttttatcctactatagtttttttttgtaacatatatgtgatttacaatacatattttccctcaattatataatgctatgaagaaatggtcatatgtctaaggatagcatcttcacggtggaaactgaactagagaaaatgaccgtttacgttctttatgaagaatataacatggcatgttcaagacaatatgtacattgtgtgaaccagcagtttactgtttatttttttagtgcaacgaaaaagggctataatcttttcagggtagggcaaatagagaataaataacatttttttccttgtgaattactcctatcaattactttacttcgttaaattcagaggaaacataaagttgataacattgagtatttaatacaaacacttcataaaccagagaaaagatcaaaattatggcatgaaggaatgaactttcagaagtcagaaactgtgagctatagatagactgatagagacattaaacaacaattaatttcatgccatctaaatttgagagactgttgccattacattacaactaagtgatagatatactcaagacaggacttggcatttgaaagtcaagagactggcatgcaaattagcaatgctcaagacagcatgtacatttgaaagtccaagaaactgaacatcactacatgctacttctagagacttttgcagattagcaatgagtaaatggagacaataactcagaccaaactgcaatattgagacctacaatgaaacaaacataacatgtattttacacgattgttacaaattcgttcgccccatgcttggcccagaaagtcttcaagtcaattggaatagcaaggttatacccctcaccacttcaccagtcaccggctagcttcctccttccagcaatacatgcaccccatgtttagttccaaagtttttttttccaaacttttaactttccatcacatcaaacttttcatacacacacaacttttctatcatcgtaccgattttaaccagacttccaaacttcagtgtgaactaaacacacttcagtgtgagtcattggtagtggatatgtcgaaatagaagttgtgcaacatgcaaactgccagccacctgcaccccaacgataccattgctggggggatcagtgcaagagctgctagcacacaggtgttgctatccttgaaagatccaaatcaataaccattaattaccatccccacagtcttctcgtggatgcatgcatgttatgtttgaagctttaccaaattttggtgtggtttttaaagagtgaaagtttctacaagattccaaaatttaggatgtattgatggttgaaatattttttgttcgctgataacgttgatttgggcaacaaattaaataggcacagtaaatactggagtatttgaacaactttgtggtaatccttgcacacaagtcataattcgtaatactccccttttctcaaaaaatagcaacttagaccgaagaagacatcacttagtagtataaatctgaacaaactatcagttatctactcacgtaaaggtgattatccagatttatagtattagataatgaaattgctatatatttatcgacaaattttctcttataaatttattaaatgtaaatacaatataattgtaattatattgtaacttttatgcaactatattctatcttttatgtaactgcaatgtaaattgaatgtaacttttatataattttaaacttgtatgtaagatatgtgtaagttagaaagaaaaaaattcgtagcgcgcgtgggagaggagattcggtctcgcaacctcctcttcatgaaaacagcgtgttaccataggagttttgaaagctgaatagaaattgtattatagtacaatataattgacaatattattatattataattatactgtatttatatctgataattttttatcgataaatgtcctagtctccattccaaaacaaattaacttctaaagattaatttgaataagcatttattcatttaagtttgtctcaaaagataaacaaagggcgtatattcagtaggtggagtacgccgatgttacggcagttcgggaatgtacccgcagcttctacaaccctccattctccccacgtataaggccgcgccccgcgatccaagcagcagcagccatagcccccgccagctcgccgccgccgccatgttcggcgtcgtcttcccggaccacagcttcccgctcgacgtcaccgccttcgcgcaggtggcgcccaactcctgggcgctcgacctttccacgctctccctcgccgccgccccgcgctccgccgtcgttttcctgctcccggccgccgccgccgcgctcccgccggggaaggccgtcgccgtctacttccagcccgccgccaaccgccctttcgcgttcctcggcgcgctcggcccgggccgcccctccgcgagcctcccgctcccggaggccggcgacgaaccggagccccccctcggccccgccaagctcggcgtcgccgtggaggacgcggcggcgctccctccgccccccgacgggcagcgcgccgagcgtgtcgcgctccgcgtcggcgagaacctgttcaacttcatgcagtcgttctgcggcgccgacggcggcaagctggtggtgcccacggacatcctcgaccggtggttccgcaagttccaggagcgggccaagaaggatccctcgtatctcaagacattcgacttttgagagcgaaggtacagaacagccttcccggtttgcatcgattcttcctgtaatcctgttttttttttctctttttgttcccctttggtaccaaatcgtcaattgctaatgtaattagtagttagtgttacgatgctacagtacaatgcttgtaactaatgctagtcttagtgcagtaggactaaaattagttttagatcatgatctcacattctcacagacggggacaatgttggagattttataagacaatgtagtggactagtggtgaacatggtatactttgggtatgcatgtaccggtgtatcctagaggcccaaattgaatccttgtgtaggccttgttcggttatacaaggattcaattcgggccgggaatgacaagtatagtaagaaatttatgatagatacaacgagagaccgggatttatt

SEQ ID NO: 2758 - DNA, 19343 bp, Oryza sativa
gaataaatcccggtctcttgttgtacctattataaatttcttgttatacctatcattcccggcccagaacgaatccttgtgtaaccgaacaaggccttagggggtgtttatacaaatgaagctgcattgaaccttatcttgttggtttttgaattgcctgtacatcttacatttctttactcatcatcgtgtgctatctgaattttaatcctgaaaatagcgacatcgctgttttgagaatggccaggacacgttagaattgcagttgttaatataggacttcagctgtaatgctttatatgatgggagaatccattcagtccataattgaacatgaatgtttttttgggttaagttctagatactctgtgtttatcatattatactgtttgtttatgtgctggtgattctgatttaatgtttacatatcagtttggcaatatcattttcacctttgaaactaccagcttctgctcgtattttgattcatctgttcatgatcttttcctacgtttttggatacagatatcagatgcaaactaagttcttaggtgtgatttttgtttcagttcttgtttgtgtcagaccaaagaatcaatgagtcaaaactaaattttgttttaactgtctttttttttttttggtggagccaatagatcagtagacattgaaaggtttagccttcgctggtgtgctgttgctccccttttcttgggtatgttttgcctgcctttagtttttgtaatagcttattatgggtttatgtagtcttttttgttgcaagaaatttgtcttctttgttgcccaaaacatacccaagcatgaagtactgtcaaggaaacaattttatgcggcgtttcgatttttacgttgtgatcaccgatcaagcattctcttattagttattacatcttcctgcgttgataagaggcaagccagtaattgagtactaaaaaaatcagtagcatggctgaaattcccagctggagttctagtttataaactgtttgttattgttgtctgaaagtagatggctttgaaagaactgtgtttgtgtttcggacagccatttcctagtataaatatgaagatgtgcaccactaaacacaaattacgaaccttaacagagatcgaaatattagtaccactgttctgcagaactattgcgacgagcaactagcctatgtcttctattttcttttgttaatggtctacttttgtgcataatgcacacgctaattaatttcgcatgggcatatctttttcaggttattttgcagttcattgcaaactgcatgtcggcagaaagggttggttagtagagttttgtatttgtagaccatctatcagttctgtatttctagacagaaattaacttgtcattcagggactggattcaatcatggttgccagttttttttttctttttttttctgtacttctagtactcctagagaagtggtaccaaaagccagaaccacaagaaggtacttgcgtcaaaagatgaaatcgtgttgccaaactgtacagtaatacaattgaactttgctactgcgtgtcaactttatcttggagttgccgtttcatgctaagaaaggggtaattctcaagttgtttactgttctgctgttcactggcgttttagctactacacaggcttgttctttacacatgtcaggcctccctatatctttggaagaccaaaatgcagcaagggtgttgtaaaatgtactccctccgtcagcaaaaggtaatttgcttctttctggtccaaaataggggtgctggccaaatatttcctcagttgaagactatcagagcttctatcgcaatgaaagattatcagagcttctatctcctctgctttttggaggatttggaatcacaaaaacaacgttatcttcaataatcaaccaccatcaggtgcgtgaattttacatcaaagaagcagatggaccggccctagatgggtggaaggctgtcttctcaattgctatttcttcgggctcctcccatgtttaattctgtttctttctctttattatgtactagtatgctccctccttgttttcttctttcctgtattttaattacccgttgtaagcgacttggttactccattaggaggagcttatatcaatataattcaatattcgcccaaatcttcagtccttgaccaacagttttgatcccacaattgcagcagcaattggtaacaagtccacttgcttctactgcattgcttagcccacttgttaggtttgtaacatatagttttatttcttaccgataatcaagtactccatccgtttcacaatgtaagactttctaacattatccacatacatatagataataaatctaaacacacatatgtctagattcattaacatctaaatgtatgtgggcaatattagaaagtcttacattgtgaaacgaagggagtagataagtatgaagtatgaactaaatggtagtaaaacatatgcgacctttgagttaccttcctgaatgaagtatgaactacgatttccatagcagtacagcacacaaatcaaaggcctcaggttgagtctgcaggatgaaattacacagcacctttggattgcaaatcaacaccaactccttttcacatgcaaaacaatgactaaatacaaaactcaaagaataccaagaaaacgaatataatgcacaacttaggcatgcttcctaaccaacccactgatcaatcgacgtaatttaggtacaacagcaccgcagatgttaggtcatatatctacaggcaaatcttatctaaatcctgtcacaacctgtcgtcactcattagcaatgtcaaccagttaacacacaatggcccaatgtcgtggatagtcttcactaccatccttcttgctgagaagtctctcatccctaaccagaaatgcagcatttggaaatcaggattatcagaacctcaaaagatcaactgtgacattctcgaaaatgtccaatcgaacgatgggatctcagtgcaaaaccaaaggagaatcaggttctgagccgctgatggaggaaaggatgacatactatcctccttcgaaaccgttgagaagttcagtggtgcagcagccagcctcctgttctctttgaagtaattattgtaccgtccagaatatgagcgtggagttagaagctcaggagtggcactgcctgcagaaactctacggggcaccggggtcatgaacccagctccatttccattcgggtgatggctgctcgtcctcctattaaagctgcttgtcttttttggactaggtttggagccgaaaatcaactctttctccttaagcaataagctttgcagtttcttctggtcctgtagtaagaattatcaacacatccaaatagtgaggagtcaactcttgtggtcgtaatgccaaaaggaacacatgatgcggtacaattcatacccggtgtcgtctcttgtcttcttccttttgtacccttctgagtttttgctcctccaaaatggcaacaagacgggccttcacatgcaaattcaatttatgtaattcaatggaacatagtgtactgtaatgatgataaatatggtagaccagctctacgacttactccatcatataaaaatggcacacttctttcatcctcccacgcaaatgttttagctatcaagttgtcaatcattgctgcacagaaagtatagcttctaatcattttatgtatcaaatatgcgagtgactatagatggatctatatcagaagcagcaagtagaccgagcttgtgaatcaggaaatgcttagtgattactgttaggagtacatcattgtctaataaggttatacctatatcagaaccattagcccagttcaaccaatattttagcagaatgcaacacagtgttcaactgacataccagcagacatggaaacaaaactcacatggtattttttgaacaagtatccttgccttctctgcacgcttgagatttatatgggcacccctaccagcactatacctgctactatcctgcacaaggacacacaaaaaaaaaacccttaaagatcttaactaaatcatagaagagatgtgaaatatatgttgtcaaccaaggcctatatgaatattcagaataattaaaacaaaaatgaatcgtacttggttatattcctcaagccaagtttcttcatcacaagctgatagccatctgtctactttctccatgatatctttcctggttagggactcctccctcgcttttgctatttgtgtttcaatgctggaaagaagttcacaaggatccactagacctgaatatgaaattattttagaacatttaagatattcctcagcagcaattttcaattgtaagcaagagagaatatcagtagtataccagaatcaatcaatgcggttatcttctcaggtgctgtgctcatatcaggctccatatgcgcattactgcagatatcttctagctctaaccttttcttaagaacaagctccttcattctacttgccttttgtttagttagtctctcaacttcctcttctgtctgtattcaaataattatgttaataagtccaaattacagcttgtaaagaaacaagtatctcacagatagtagccgaacctcctgaattgtctccagcgacaggacactagatgaagtgatctcttcctcagtagatccaagaacagcagctactctggtgaaatgtctcctctcttgttcagttgactccatcaaattccataacttgtggagctttccgacgatttcttgcaactgaacaaaatttccaaatagttagaaaagctataaaatgaaattgagacacctctgtactctgtagtttcctaagaggaatcaccttcgaaactctagtcctcttttctgctttgagcttaaggatggtctcagtaagaccttcaagagtgctatcactgatattcgttgaattttctgagttggccccatgtaaacttggatgcacatctttaactgtctttgcaaaatccatcccaagcacagagcataggcagtgcacttcatcgacgtatatgaagaccttctgaaggcgatcagactgaacaaggagggaatgaaaaagattattgctttcactaatacaacaatatggcatggcaaagttaggattttagataacaaaaatgaaataacctatcctttgaaatatataactaatcttgttctcagcatgttgaaagtgacagtttatggttgaaacaataggtaaacaaaaaaatggttgtagcacgtaaatgcttaaggcatacacatattttgatatccaccattcactttatcatcaatatctagtcatatgcgactttgtgtgaaaatatgtacattttgacaagatacatttgatttattttttattattattattttggtgcaactcatatccacatgatggctgaatgggttgaagcaagttgagcaaagaaccattttaagtcaagatcatagttaccttctctttctgtaaattgcgaagctccgcttgaagatcagaaagccttctggttgacaaatcatgattgtccttggaatgattgaccggaccattgtcatgctgattattgtgatccgaaatttgtgcttttatcttctcgatttgagattggacaagtgagaattgttttattctttcttctttctttgacctgagatcttccagtagaggcgtcactttggcaagttgctctttcaatgattgcttttcatccacctgtagacgaatatctcaaattactcagaaatggaatatacttatacagtgatgtcaaatatgtgacagagaacctttacgatataacaaagcataataattcacctttttttacttaactaatgtgaccctaaacatgccaaaagcaattaactgtggccaatgcatgtagaagttgggagtcaaaagaccaacacctttgctttttttttctttctaaatgccattaccaaatggaatttcaaacaaagttcaccgtacagcaaaccatgttgcatagtcaacctcatgtgtaaaagaaaagctaggcatcatccaggtatgcttaacttacaggaatcatatccagcgattcttcaaccaagtagatggtccacaattataattctggccaggaaagaaaatggtcctttgaaccaagttctacactaaactagtttctcaaatgtgcccatcagacatgactatgtaccaaccgagtgacccagctgtgcatgttgcagtgatatgatccccatcattatttgaacaaagatggccaacctgctgaatatggtatattctacgaggtgtagcatgacactaacaattatttcatacttgttgtacaagctacaagataacctaccaatatctgtagctacagacaaatcaaaccttatacgcataagacacacgataacataatcaaggtccctaggcacaaggcttggaacaagaggcaaaaatagaagtatgggctgagtataccttaaattttggggtaatttcacctattgaagccactaaaactttaagctctgcttctttggccatcaatgactgacggagctgggatctctcagcattggcactatcaacctttcgacggtacacacgcatgcactctgtttcaagttctaagaacatgcgatctttatcttcttcgcgctccccaatctcagtccatatttgctaaaatagaagttatgttagaatggaaacaattgcaagaattacatataagttcgtaatattcagagaaaataaaaatgtgcagccacctgagcagcattaatggtagctacatgtgacatttttatttatttatttatttatttttgcatatttgatgtttttattcatctaattgacacattggcaaaccggcaaatgataaattgttatagaccatgtaatttcatgccacaaggaacaaaaatctaatacgcaggcttttgatgaagcaagctgactgctcaaccacagacaacagagagagtaaatgaaactcaaaataggggtatagagcatacaaaatgtaatgttcataagagagctactaacttcccaaaatgtatataaatgtgtctttgcataccctaaccaggccccacttctctggacagcattagttagtggaatttaaattgtttttattttctttctgcagagtttttttttggtaaaaataaggggcatagcatttcttttgaaacagcagaggattgcactctcacttacaattcccaatttcgagtacgcctgatgctattaaacttatatcattatgtcactgacacattagctgagataaatactactcctaccaaacgtaatatttctgacccgtggtacatcaacagtggtataataagagcgctcctaactgaatttacacaagcagtactactccaagttcttcagctccaaattcagactttagtaaaaagaaaaagtaaagtaaatcgtcgcatctgctttgcttcccgagaaacatagtagagacccggaatttccataaaagaaaaacatagaaaccaagaagaagctcgtagtaaatcaaaagtgaaacctttaagaatgaaatctgcaaagctgtaggcagaagcaacaaactcctgctgttatctaaatcctagcatctgttcaaaagagcgaacttttttggtagagaaaacagtatgcttgcaattcaagaaaaccaaaggagttggaacttttgagcataatttggacatataatgtgtgctcatctcgaaaacaatacacagaatttacaaaaacaccagtccagcttggctcaaactgtgcaatttcatccaaaacaagcaacgaaatcctagtatttctacgatttaaacgagcaaacgaatcaagcaagaagtatcctctcctattccttccaaagaacaccttccatttctccttaaatccgtcgtattcttgcagagaaccaaatcaaatcaaatcaaggacgccatgaacaaagaaccgaattacgcacctcgagctcgcgcagcagcctgccgcacggcgtctcgaagctgacgctgctcctcaccgccttgtccatgccatacccggccaagaccatctcgcccatctactctcctttcctctcccactcctctctctctctcccccctccaggaaggagaaagagaaagcggctagaggcaaaggatgcacctatccagtgcctcttcctctctctcttccgtcttcttcccccctcctcctcctcttgtcttcttggtttcttggttcttggcccaacgacgacaacaatggcgcttctcgccggggctgcagccagcaaccctctctcctacgctttcctcgcagcaaccctcggctctagaggactagagagagaaagggagggtggagaccagagagatgggcagcggtagttgctggaccatatatggatctcactgagcacagttggtagcacaatggaaagaaaacgaggtgataagggtgaagaaaccgagaggtaggagacgaccagagggatctgtttgtaaaattcaagaaacttttggggtgatttggatgaaaaaggtagtaacaaacaaatctcccatttttgcggtttggggacaaatctgaagatcttggactcacacaagcttagtagaattttacagcatttgtttaccttttttatttcctgttttattacatagtagatcacaattatatactacataagaaaagtgtccccatcaacttgtttcttttacaatgtttcggtattctaagcgaagatttggcaaataaatactaaacacattatacaggaatttgagaattttttatgttccaaattagtcctttaggtcatttagaattaaaaatggctgggcttcataaatgaattgcccccaaagaaggacattccctgaagaaaactgataaatgacaggtacataattaaatgacagcattgttgcctgttctgaagcgcgccagattgtgtgaagcaagaaccacccggatttttgtgtgattaatgtacacataagtaggaaaggtaggtacagttaaccacaaggtttttcatgccatttactgcacaagtaaaaaattatagaagagatgaggcaaagatattctgctgatctactccagagtgaaaaaacaaaattatctaggaataacaaggtgatcttctctaagaattcacatctacaggaagttttggcacctcggatgttagcccttcaccaaatacaagaggttaggctaaaaaccatgtaaaatgcaccacagttagattccaccattttaattagatggggacttttgttgcgatgtagattgcaacaggtcactcttggacccaatcaatagtgtagatcatgtgtgttgcacaattataagatctaaaccgtacaattaaatcagtgcatcaccgcagtgtcgccatgatttaaatgcaggaattttctcagttcctgataagagcattagagttcaaaaaaaatattaggctgttttatttttattttatgcagaaactgacctgaatgtttatccccattgacagtttgtgccgaccattaggcaatatacagacagagttgactagaattatatggatgcttgtaaacgaaatgatcaaatgaatctgaagttctgaacctacatgcatcatccacatgtacagtgtgacgagacatgccccatgtgatgctgaggtcaacctcaatagattagcaaaagctatgggatttagaagtaagtagtgtgatctaaacaatgtactggatctaggctcacctgccctttctgtcctgatttaattggaggaagcttctctcaaactgtcggatttgagtgttacctgcaatgctttcttatgaagatcctgcacttcgcacatattgattgctctaatagctctggtctcagtactagtactgtactatgctacttcagattctagattttccttgtaatttttgtctctttttcgtccacttagctatgatgggtctatgagaagcatttgacagttgcatcttctctcagaatcaaaagttctctaacggcctaacttttaattaagattataagagttggaatctagatgatgaattagaagccataaattgattttttttcagcttcttcagattctcatcagttagattctcatcagctgcttcttataatctaaaactccctaaacaaatcctttattttcttcttaagaaaggattgccaatttggcatgtgttgtctacggcagagaggtgagcagtctctctgccaagaaggaattcagacatttcttctcatggtccattgcttcgacattaatctctgcaatggtacaccatcgctgtctcctctagtttggtcaaacaaacctacttcctctattctaaaatataacaatctaaaataagataagacacatcataaactataaatctggacataatagtggatctcatcccatactagattactatattttggaacggatgtagtaatgcagaactgatataggagtatccaagtgccactagtagtactatcctgtcacaactcacaattcacacatgcttatttcatgcagtttcccccttttttttaactttgctgtttctctggagctagtgttcgtctgtatcgcagactcccagtttgtgtttgactgcaaaaatccatgaacccccccaacttctcaacctctaggaaagagagagcagaatataaggtgtgttatgattgtttatgttgtgatcttgtgatctttcagttgtacagatggacaaggagcgaaaggacaaatgtatcatctgccgtgcttgatgctcccttgcgtcttcggttgagggagcaattagcaaataatacaataccttcagatagtgattaacacgcgtaggacaaaactgtactcctctgagcctgaagagttattccatggcaaacatgaacggtcattttgtacctttgagttaatctgtgtgtgtgtgtttgacgtcttcctgtccacctgtacattggtcggcacggcctgcaggaaaggttacgctgcactttcttgtgcacatacaattatacaaacttcataaatttcttttctttcagaaggaatttttcatgtctgaacatgaatgtgattttgtgtacatctaatcagggttctatatttcggaataaaatatatttcgggggttaacgatagaagaaaaatttcagaaatcatggaaatttcagacaaaaaaaattaaaatttgaataattttgtcttatttttgaaaatttcaaccaaaataatttcctatctggaacctaaattcctgaaaaatttccggaaattttggaaatcgcaaaatgaaatattgaagcctacatctgatcagttgatcaatctggaacattatatatattgccagagcatcaaacctttttgcacatatgtttgtgactattaataaatacacatcaatacattcatgccctcttcacttttggtacatgttgaagaaatggagcaagattgccatcgcctcaatcggttggtggtgcaacagaaaggatgaaacagatgacacgtatggttttccagtgaagtatctatgtggatgaagtgcaggggaaggcaaaattcagctccagcctacacatcattcggaagttggccaaaaatttgagtaacaaacaacccgctttggtttgtccccaattccaaccattttgagatcaggaaatgctatcattactggtgtaatctggggcccctcaggccaatcagtccaaattaaagtaaatcaaatacccccaatcatttgatttggttgcttaacaaatgatcatatcattatcttcccggggggcctatcatgtccacaattccaacctaattacctcaaaagtttttctttagttgtgggcttgtgggcatggaatatatatagctagcttttcttgcaaattttggagccaattatcttaagactgtagatgtcattttttttaggtcgcactcttagtagtgagtagaccttgtgtcactgtctgcatgctacttgccaaaatgcatgccacacattggtaatgcactaatactagtatatgcatgcagtttacgctaggagaaatacagatgagcagagaaaaagaaagaaatgtgaccctctaccagcttcagatacacctttcacatcgccagctgtagttagttcatggaattatcatcaagccaatgagaaagcactgaacaaaataccttctttttttaaaaaaaaaggaactggacaaaaatcaaatgtctacgtatgtaagtatctgtctgcacattgacaatgattagtacataatttggacagttcagatcaatttggatattgcagttacaatccttcctctctctttttttttgggtttgcatagtcaatcattagacaatcatttgtctgtgggtatgtgtatatatatagatggtgatcaattatttatttcaggtgtttaaagtaagaacctgaggctatctaacacatgcagaagcaattcatgttcatcagtaaataatatctgtttcttttcccaaatacatgcatgaaatgggtagttagttacaggctacgtatgtgggctaagttgcttgcattgcaatacatgcagcaagggagcatctcaacaccctagctatctacagaaccaaatatatgtagttgcaagcactttgcttaaaacaattaaagttccctttcctttaaaattttctcctctgtaactcaccattttccctaccttctacagaaaagaactgaatattgcaacaccacagagtagtacaccacccatactagaactgaagaggtgacagtgaaaaaattatgcctttttttgagaggaagaaaaaactctgcataactggtgagattaaaaatgctttttatccaaaaaagttcttaaccttcatattagttaaaaagaaaagttggggagggaataatacatgactaggaaaaggccatactgtgtaatatccctcgtcaaacgtaaaaatttgtttttttaaagaaaattgattaaaaccagtcctctacaccataaaatttcgataagtaagaaactaaagactccacaacggaagctaacaatatacaaggctctatcagaaacaatcaaatcatgggactcatgggattctgcttagtttaaaatgtacactagtcaatgcttcaaaagttaaacaatgtaacaagccaacaacttacaaaggcgacaaataatcccgccggtggtttagtttactttactgataccttccaagctaacatgaactgatttttggtcatcattaagcctatataaacatatcaaatcctacgcactaggtcgttaatcatgatggcttgctcttcctgtaaacataaaagggcactctaatattagaaaattgagtccacgaaatggaccagcctccaggcagacactaaacaaaaaactaaatcgtttcgtttgactaaaaatgagataaaaattggcatgaaaatcccatgtctgaaactgctctaattaaaaagatataagcacaaagtagagagggacgcaggagctacaaaagcatacacgtgtggcccatcttgccgagctgccggacttctgaattttcaggtgatacatcttaatctgacgacaagaatcgtcgctttggaagctctttttctcctcttttctagttcagagagattttctgacgaagtgccctggtttttccttctgtttttttagttcagagagatttctgacggagtgccctggttggtggtgatcctggtttaaggatgttgaagcatacgccatcacggaagctcccgtgcaatgatctgacaacgcaaaaatgacgtgattcagttggttgcagcataaatcaattcggtttgatgtaatagctgtaaaggcaaaaaagatgaagtttcaaatggggcatagagctatgaactaattttgttcatcccatttcaatatactttcttggtttctgtttgtctctgacaacatgaagcaagctccaaacatagtgttagttgaacaattgtaattagaaagcaagttgcatgcttggacactgacttcacaccagatgttcaatgatatatcccttaagccgtgtttcttcatcggccgtacagtacctggagccggaaaatgattggaaattgcttgagaatttcaatgtttatcgtctagctatggaccaatatatgcctgatttgatgatcaataaactcgaatacacgtttgcttgcttcttttctcctcaagagaatgttcgattatccaatggcttgttgtaggatgtagcaatactctctgatccttactgatcaacgactcttgggaccccttgtatgtgttttcattcgccaattatccatcggattttctttgaattaggaaatcaacaattatctttgatattatatctgatctcaaagagagttgacgggtcatctgtcccttgatgcgctgaacaaaatccatttgcgtaccgtcattgtcatcatcattataccatataccagtctagaattttttaaccatgcattatatatatcatacagtttcatatttttgacaagatattgcacatttcaaggctgaaaaccaaactcaagttttcgttgttaccacaaacaacaagtgaaaggaaattgatggtctcacatagacatgaggtgacgtccattcgtaatctcgaggtaccatcggcacagctgcatcattcacataagctgaaacatcagaagacaatacttctgtacatgtttacagaattatcagtgagcattattcatcaacatatggcattaaacgtatttacagaatcgattggtaaaataaggcactcataaatattagttacttcttaatatccaatcatgaatttcagttgaatcatcattacttcaattcccttgcatttctttaatctttgaaaagcaattcccttgcattttcaacattttagtctcaacaatgtgtcaatgtcggtcgtcgggcatagacgggctgcacaaccttgtacaaacatgtgtagcagtacttacagttacatgagaatagtgcttacaacggcaaaactgggactcatgctctacgcataaagaattcacaataaacctcagatattgaaatctctctcgcccttccctttcatttcatctggtttaagcacgtgcattagaatagtcagaacaaccttcatgatttcttcttcatcatatgatgtcgtaaacgtaactgccaagtgcagatattgaacaagttagaaacaaataacgctctttgctcaactagagaaggaaataacctaactaagcaacgtgcatcttctggaccatacaggcatacatacatagatagagtaaaatatgcggccaaagcttaccccaaggaaggattgggaactcccatctctgcttaggaactgatatggcatatgcagtaacctgaaaagaaatgagacatcatataaatcataattcagcagtctatacaaaatctcagtaacaaaatgctgcattaaataacatacaagagctgaagcagcaagttgacagggagagttaaaaagccatgaactatcttcagtctcataaagaatatccaaaatttccatgcaaacatccatatttaaaagatcacctattttggatatttccctggcaatagacaagaaattaagtgatatatcagtagaaactatatggttaagcttctcatagatcaggaagtcaagaaaaaaaagcaaaaactggtagtttaataatgctgtccggcgatggtaatactaatacaggtaaacaggattgctaaaacaaatgataccctggcaggacagtctttcaagggaaaggaagaccaatgggaagagtggatgaagaagcaaaagattctttttcttttgttttattattcgcttcctcagaacacaagtgaatcacaaaactagttttaaatatgatctgagatcatctatactaacatgacacatttaaacatttctagtgcaaaattttggcactaaaaagtaagaactgctataaggaactaggcatacactgattgtgcttggtgagtaaaataaatgcaacagattatagtgaccaatcagtacagctgtctgttgtgatatacatataatataattcacaaatacatagatgtggacagtggaagccataaatgtagacttagaagagaagatatgttcgtcaagtatttattagttccaaatattcaccctcaagttttataacttggccctgaggcctaaaaacgtggtgctactgctaactgtccattacaaacaataaaaaaaatattaaacaatccaaagaacctgaattgcacgagaagctcctctaggtatgtaaaagcaatgttcaaggacccaatgttgtattccactacctacagaacccacaacacgaacaagaaggagataatctttttagacaatggaagtacaagaaaataatagaagggggaaaaggaatataacaatgaaatggagcacgccatgtagttgtatatatttcgcattacctccatgaacaccagttcctgtggcattacagcaaacaccttttagccactacaagaaaactttcaaacaaggaacaacaatgcgtcgataactcacagcattggcgaaatcgcggcaagtgaaatgctggtcggcgatgatgcgatcaccaagcgccttgaggctcttcaccgacagcggcttcagctcgtgaatctaaacaggtaaccaaatgaaaaataaaaaggaatgtaattccacctctcatggcaataaatccacacgacgtttgctcaacaaatgctcacagaatcaccttgctggcgatccacacggcaacgagggcgaagagctccaggttgctgtccctcagaggctcgagcagccaggaggtcacagctcggccaccccgtgcgccacagaaccccatcttcctgcagcgacagcgagcaagttagtaaaacaataagaaaccaatttaacccccacaaaaaccaaggtctcaacttcgcggggtcacctccggagggagggcagtaggcggtcggcgaagaaggagagcgcggtgtacttgacgacgggacggaggtcgagccgctagaaaggaatcgcagcagaaggcggcatgcgaggtgaggtagctgtcgaggggaccatgccggaagctgagggggtggaggggagcccgtaccgtggaggcgtggaggaggaactcgatgaggcggcggcggcgggaggggccaggccacgcgcttgccgccgcctccaccgcgcggtcctcgtccatggtggtgcgcgccgcggtgcggcagcgaggagttgggacgccggctagattgccgaagaggtggggagaatggaggagcggctgctcaaccaggcctccagaattcttcaacggcccactaacctcatgctttcggcctgttcggctcttggtgttggaccctgtgaatagtgtgctgttctatatgaggaaaacggaaggggatcctctcacgtgaagtcagatgcctacatgtcagtgacatatcacgaagaagttcaagtcatgtatccctttccaaggaaaacgggtttggctatatgtttctttcgaagttgcattttcccgattttgcatttcaattagaaacatatgacctatttgagaattttttggtgactgcagttttttccaaaatctcagctcccaaaacaattcatattaccactcggattctgaattgaaaaacaaattagaagccggaaattaagaaatcagtttatttcatattttcaccggctggctattaataatctctctaaacagaattacctacattcaagcacaagaattatgcgttgtaaatttatatactttttaaaaagaaaaaacaatgtacatttaattgttacacaaaaaccaacatgacaactctagggatgataggatttgcttagttgatcaattgtcaaattctgaagagaaagaccgctcaaactctgcatccatgaggacgccggccatgacatggacaatgatatcccgctccttgacgatatccacgcactctgacggcacgccgttgacgaccagtgcaccgtccacgtccctcctccaggcggagatcctcagcccagacacggactccaggacaggcgccaccgccaccatctgctgccggtggcgcggcggtgccacgtccgcggcgcgcaggcggcgagggacggcggagaagccgagcacacgggagacgacggcgtaggtggcgtcatcatcggcgccattcccgttggtagcgctgtcgttggggcgttgcagcttgaggacgcggcgaaacgactccggcgagggcacgaagacggtgaaggcgaggttcttggggagcatggacaccatcatgtcgccgaactcccccaggctcgccgtcatgtcgtcgcagttgacagatggtggtggcgaggaagacgaggatcttcgtcctgatgacacgacgctgctgtcccgcaacgacggtggcgacgaggagggagctgaggtggagaggagaacgaggacgaggaagaggagcgtcgctgcgaaggcgccaccggcgacgccggcatggaggtgtcgttgccatagcagccgtggcctgaccaagaaaagtctcttccttctcttcggcagcatattcatcagtgtgtgtcctcgctacctgttgatttgctggtcaggttattggcacgaggagatcacgggaggggtcgaggcagccgcccggcgatgtgggcgcaggagcacagccgcacatgacggatccggctaccttgcctccaggggcggcccaggtttttcaacttggctattcgaaattgtaaaagatagaaaaatttttccaacccaagatctaatagttgtataatatgtaacggtataaacatgatttcataaagtcataaatggatagaattgaccataaattgaatgcgttaagcatattagagtacagtactaaactattaattgacaaaacatatcaaatttatagagcatacaaaactctttaaattaaccatgggacctttttttctcttcatgtttcaaacctacaaacaacaatatcaaagagcaattgagcaaagcagcactggttcctaaatcctaatctagatagtcattcacatttcacaagctatgaagctaaaataaccaatacacttcacacaatcacacaatcagtcaatcacactcatcaagcattcaagcaatatcctcattagtcagtttcagttcga

SEQ ID NO: 2759 - DNA, 4793 bp, Oryza sativa
  unsure (1)..(4793): unsure at all n locations
gtgcccagccgcgccactcaaaccggcgcgcctcccgttgcatcccgcgcgcgcgtgccgtggtggccgaccgcctggtcgccgccgccgtcaccctctgccgcgcctgcccgcgcctgtcgcccgtgtcgccgctccgctccaaaccgccccgccgtcatcgccgtcgtcatcacctcggccccgccactccgcgcgcaagccgccaagggacggaggcagagcccctcctccctctgccgcgacgcccccgctcccctcctccttttcccaaagaagcaaggggcgagccccctttctctccctccttttccccttttcctcccgccggcgtcatcctccctccgccctgtcgccgatttggccgcaagcgccgagcgccagctcgcgccttgaccgcccaaagtaggtttccaaaccgacattgccgccctttaaacccaggcgccctcccttcctctttcccccccaatcctccccgtttctcgtccgcgccattgccgccgccttccgagctctgtctcgcctccgccgttcatcgccaagcgccgggagagccggtgcgttcgtggacgcggaaggggactctgggcgctcgtcttcctcctcttccccggcccgaggccggagagattactcccgcgccgtcggcctctcgtcactgcgccccacctcgtctcggtaatgcctccctctgttcttcctcctcgctccatctccccccttagttttcggtagtagcacgagtagcctccccgtagctagccggcgccgccccgaccgttgccgccgctcgcagtgtgctcgccgccgtcgccgcccgtgctccgtagtacccgctcgtcgccgacctcgctcggcgtagctccgcccaatccgacgctagcaacggattcccgtagctgcgtagatgctctcaccgccgggaattggcccctcgtgacctcgtcgccgtttccccctttcctctccgccgggcgccgccgccgcaatccgccgccgacggactccctccggcgaatctaagccgttggctcgctccctctctttctccctcgtcatcccggtgtacgccccgtcgccccccatcgtcgcaaggcgtcccggagaaaccgccgccgcccgccgtccattcgcggccggcgccttcgtcttcctcccgccagcccgtgtggcagccacgtaggcgacacgtcggcgccagctcggccgagatcggatcgggccgaccccggtcagcccctctcgtgcgcgcgttccaccgtgagccgtgaggctgcgcgagggcccgccgcatccgttccaccgcgaaccacgcgcgtgcaccgcatcccttccccgcccgcgcgcgtgcgccgcgtgctcgctccgcacggtgaaccgtgtcatcgacaagcgggtcccacccgggaccacgtgtggtgagcccggtccaccggccctctgtctcctcccctcccgcgcgcgcgctttagtctattttccctccctcttttcttttcttttcttttctttttcaaaaaggatttaattaaatccttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttatttttgatgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatgttgcttgaaaaatattatgcattgataggatcgcacttaatctgttgtcccgtctgcaaggcagattggcggacctacctaatttgttgcatttgatccttcctttgttaattgatatatcatgtccccttgtaaccatctagttgcgtctcgatattcgtgcaccctgtgcgagtatcgacggacgccttcaaacttaaaatctgagtaacaacttgggtaaaactagggttttacaaaagacttggaaaacccgacacctgggtcggtgcttgcgaactaaatgaatttccaaaaccgcggaccggggaacgtaccgggtgtacggtttcccgctcttgcacttaaggaccgtttccttggaatttcatccaaacataagacaagtacgaccacatgggtgaaatgggacacccctggctgagtaactagcttatcaggggagccttgatgccgagagacatgtggattcgctggggtggtgtcggggaggaccactgggcttcctggcacagtagggtctgggacctaacctgttgttggtctgggacccctctcgtcggcatatggtaaacctgtgtcggctttggaaatgccttgtcatgaaagcttggaggtctcccgacgtggctgattcccacgggctgggtgatccgggttagtaatgtcgtgtgggtaaagtgtaccccccctctgcagaggttaacaaactgttcgaacagccgtgcccacggtcatgggcggatgtgaggtgattcctagcgtagttttgtttgactactgcttgtgaaattgctgttgtgaaaaggggttcgatgtttgaaaaatctgcagctgacgggatcagctaggcccgggtggccgtttgaaagttgttggcccgggtggccgtttgaaagttgttggccgggtgccaatcttgatcaattctaaagactgatacattgtacaaactccgaccggacgagacgcactgtctcatccgtgtcgtttgagaagcactcacttagttgttttcagaaaggagttcaaataaaatcaattgtaaaaacaacagcctttccttgaagcctgcattaaacacttatttcccatggcttgctgagtactcccgtactcacccttgctctatataaataatcccccccagttgctgaagaagatgaagtggatcctgctgatgaggagttcttccaggagcaagccggctacgatgagttttagggtttcggcctagttcccaagtcgcgcctgtgttgtttggtccaagtcctggcttccgcttcccttttgtaatgcagttgtgagctcgggatctgtccgcagcccaacatgactgtacctctactctataataaagagacatctgttgctgtgataatctgtcttcttgtgataccagcactgtgtcctgggactggtatcgattaacaggttaatttggagcgtcacgggctagttccggtcggtactagttcggggcgtgacaaagggctgcgccgcagtacgccgactcctgctccggtgccacgggggagctcgccctcatggaggacgcaatccaggagatggagtcggggggcttgacgccgaaggaggggacgacgtggacgcctgctccgcgcaacaaggcggcctccacttcttcgctcaccagcgaaagctttgctgcctctatctgagcacagggaggcgcctcgcgctccccgccgtggagctggggcgcatcctccagcgcggggccggggttgagtggcgagtggtggccggcgcaggtgaggggccccgtgtgcgggggaggcaagtcgccccgggcctggcgcttgggcaacggggatggcgagggaggcttggtcgccttgcgcatgggattgggcttgctgcgacggcggtaggtggtggtggtggcggctggtggcaagggattaggctccattttggtgtcatcggccggcaaaattatttatgtcagtccgccggcttctggccagccctcaccaccttcaaggtccgcaccgtggccttctccatcaagtatcagtcatcaaccctcgggggtatctcggggaatcacgactgatactcacaagtatcaggcctggtacccaggtatcaaggtctaatacctaggtaccagccggtacccaaggttttagaggagcgcacgtggaagctcacctatacagaggaaaggaaggggaggagtcacttaatatttagatcccacccgaaaattttataccttgtcacatcgtacgtttgaacacctgcataaagtaattgcacatattgtgactactttgtaagacgaatctttaagcctaattgctccatgatttgacaatgtggtgctatagtaaacatgtgctaatggtggattaattaggcttaataaatccgtctcgcggtttactaacggatactgtaattagtttttttattagtgtccgaacaccccatgcgataccctatataatacccgatatgacacgctaaaactttacaccactgaatctaaacaccccatattcattttttgcaatggcccaatggactgcatgtcagcacggttgaacccctggcgcccttgtcttatccttctactctactctccaccagaacacgcacttcccctgacaggaaagcatccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2760 - DNA, 17157 bp, Oryza sativa
  unsure (1)..(17157): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttagtatgcagtcctgcattggatccaatccaaatcttattctggaatctaataatcccttgtgtcaatgaatacccttgagaattaggagaatgcacagccaactcagctagtagctgctgagcttgaggatccactgtataagaattgatcatctcctgaatccagatcggttggaccacagaaaaagcacaaaattgagaggaggaaggcattctagataaagcatcagcaacaatattattaacccctctcttgtattgaaaagaatattgcaaacccatcaatttagtcattgccttttgctgtaattcagtccccaatatttgatcatccaaatgacacaagattttgtgatatgttttaatgataaatggacctctctgcagataacatctccacttatccacagccatcataatagctagaaactctttttcgtaaatggacaatttctgattaacagggcccaaagttttgctataataagcaatagggtgaccctgctgacttaaaacagcaccaagaccataagcacatgcatcagtctccaaagtaaaaggaagctgaaaattgggcaaagctaacattggagtgttactcatagctgtcttcaactgatcaaaagcaagctgagcagcatcagtccaaagaaaggccttcttcttcaacaagagtgtcaatggtcgtgctatgatactataaccctgaacaaattttctgtaatagcctgtcagtcccaaaaatcccctcaattcagtaacagaagtaggcacaggccaagccagcattgctgctgtcttctcaggatcagtactaactcctttgtcagaaatgatatgtcctaagtattccagttgagtgcaagcaaaagagcatttagacctcctagcaaacaactggtgctgcctcaaaataacaaaaacttgctgaagatgatgcaaatgactatcaaggtcagggctataaactaagatatcatccataaacaccaacacaaacttcctgataaatggtgcaaggactgagttcataaggcactgaaaggtggagggtgcattcgtgagaccaaatggcataaccctaaactgaaattgcccatgatgtgtcttaaaggctgtcttggcttcatcagtttccaccattcgaatttgatgatacccagctttcaagtccagtttagagaagaatttagtgcctgagagctcatccaataattcatcaacaaccggcataggaaacttacttttaatggtgagagcatttaatcttctgtaatccacacaaaaacgccaactaccatcctttttcttgacaagtaaaacaggtgatgcatagggactcatactaggtgtaattaaaccagcatcaatcatttctttcacctgtttctcaatctcgtctttttgtaacggagaatagcgataaggtctgcagttgacaggagctcaccttcctactgctattcgtttgagagcattggttcacagtaaagtcttgttacttttggtggattctggcagctctcacagctttattgattacaactttttcagtgtcaccattgccggtcatgacactgggataagagggtgagaacttctcaccatcattatttgatgggacatgtcaggctgcacgccgcctgacacaaaagcagcgcacaggcgcactagccagtcccatcggttattcgaccggtcacagaccggttgagtacactgcacgccgcacgaccgctcgggtcaccataaatgcgagtaggtgggcacctgtacgtggtgacctagagagggggtcgggggagcccgatccctagtcacgggaaggggccgccgccgcccgacctcgggctcgatcccccctcgggggagggccacatggcgcctggggcagccttctccctctagtcttggccagggagtggccgccaccccacctcaggcctgactccccttgggggagggccatgtggcattggggggcggcctcctccgactagtctttgggaaggagtggccgccaccccacctcgggcctgactccccttgggggagggccacatggcattgggggcagcctcctccgactagtctttgggaaggagtggccgccaccccagcctcctccctctaaacatgatacccccgggctcatatcaccgacagtagcccccggcgttagccctggccaaaacctttcccaggtgatcagggttgacaccaatctgctagtcagttgacatgcgggcccgatcttctgtcctatcattctgggagttgggcggtgggagtttagtcacgttcatacgtcgccttaacttcccactttcctcccggtctccgaggcactgcgggctcgggagtttagcccataccttaggtcgtgaacttatttcctgtatatactcagcaaatgttgttagactctctcgggccggtgaccttacgccgcgtaccttgcttgcccctgcctcttgttaacctctgttcgtgttatacttcatctattcaaaacgattatttttgcgtgagcgtggggactgaactttccatagtcaacaatctttacccgcgatcaagccaggctgggcgccgtagccagctggtggggccaaaactagctgctatggaagagccagcacaggggaccccaggcgtcgacggcgaccagagctcgacgcagggctaggatagagctaggaatcatagctcccacacttctagcaaagaatcgtttgaatggatgaggtgaatacaaactttttgttaccaagggaggcaagccagcgcgcgacacgtgggtaccgcgggaccgcgaggaagagatgggcgagagataaacataagcaataataattctatgcaaatgatcatctttgcgcgagtgcgaggactaaattttccatagccaacaatcttcacccacgatcaagccaagctgggcgctgtagccagccgacggggccaaaaccagccgctacggaagagccagcacagggggacccagacgtcgacggcgcccaaagctcgacgcagggctaggatagagctaggaatcgtagcccccatacttttagcaaagaatcgtttgtatgaatgaagcaaacacaaaccttgcttgcatgtcgcgacctttcaaacctttagcttgaagagggcctccctccatgggtccctaaccactttgggaagcctgcgaccacttagcaaacgaggttaggttcccacaagcctgtgtccccacgctacacattctgtttgatctttcctttcggtggcctcctttcaatatctcttccttctacacggacgactactttcgcccgtgtgtgagagccgaaaaactctagagccagcgatccccgtccacagttgagccaggccgggcaccgtagccaaccggtgggaccaaagctagccgctacggaagagccagcacagggggtcccgggcttcgacggcacccgacactcaacttaaggctagaatagggctagaaaacttagcccccacacctagcgaggaaacattcatgtagatgggagagaggttgggcttttaccaccgagggagcaaacaaatgcgcaacacgcgagcgtcatatggccatgagaaaagaacgggggaaaataaatataagacttcaagctgtattaagctgatgaattgaaaaaatgaaaatacttgaagcttgaaaggacgattagttgagccgggccgagcaccgtagccagccggcgggaccaaaactagccgctatggaagagccagcacagggggtcccgggcttcgacgacacccggagctcaactgcaagagtcctctcaggagtagaccgaggcaggtggcaggttcatgagcgatccccgcgcttggccatgaagggccatggggaagaaactcgccttgacccggtcgtcaccccacgccgcctctatgatcgtcgtgtggatctggagggactcggaggggttgatgctaccgtggtacctttcggtgaggctgggccgaaactttgggggtcatcggtcattccgaagactcgccataaagacctggccgccagccttatccggtgaagatgaggggggcctggccccctgcctggggtggtgcggcactcctgaggaagctgcgccttcccccgcattggcggcgcaacacttatcgcgccggcgctcgaaagaacctcaaaaatcacgaacgcgccccctacctggcgcgccagatgtcggagaatgaactcctccatcagggaaccgtgaggcccccctttgtgagttcggccgggggcagcgggtgagattcgagggcttggtgagcgaagctgtgtgatcttgagggcgttcaatccccaaagacgatgagacaaaagagatttatacaggttcgctccgctaagaagcgtaataccctactcctgtgtttggaattatggttgagtgttacaagggttcctaaactccggagagcattctcgctcttcttctcctagagttcaggcctactgagtgtcgtcgtcgtcgtcatcgtcccttttctcagtgggcaaggtcctccttttatagttcaaggggataccacataggcccaacaactaacttcctcgagaagtattaccatctttgcattaaatgcatgtcttgttccttaacttggaagccgcatccacgtcgcctcggtcgtggggcctaccacaccatgccgcctgacacgagggacgcccatgtcattcaccatttaatgggtgaagacttctgggctcctattacatcggggaacgggagcctagctttgaccagagcgggaggaccgactccggctgggataagaggatgagaacctctcaccatcattatttgatgggacatgtcaggctgcacgccgcctaacacacgagcagcgcacaggtgcactagccagttccatcggttattcgaccggtcacagaccggttgagtacactgcacgccggcgtggcgcgaccgctcgggtcgccataaatgcgggtaggtgggcacctgtacgtggtgacctagagaggtggtcgggggagcccgacccctagtcacgggaggtggccgccgccgcccgacctcgggctcgatcccccctcgggggagggccacgtggcgcctggggcagccttttccctctagtctcggccagggagtggccgccatcccacctcgggcctgactctccttgggggagggccacgtggcattggggggcggcctcctccgactagtatttgggaaggagtggccgccaccccacctcgggcctgactccccttgggggagggccatgtggcattttggggggggggcagcctcctccctctaaacatgataaccccgggcccatatcactgacaaagttttattgggaggaaatgattaaattttaaaacccatgataacttctttgcatatactcctctgcagtaaagctcaaggacatccaatcttctcgctaatttagtactatagggtgtttggaaaataggttaggagaggtggaattaggaaacggaaatgaatgaagcgataggatgaaatatggtgagaatgatggatagctaagattaagacttatcctttgaggtgtgggaaatcatatcccaaacctattttccaaacatgaccatagtactaatctctccacctaaataccatcctatataagccacgcgctgcgtgtgtcagtgtcaccgcgcacacgccttcaattattatttgccaatggctttctcggcttccatcttctccttttactccttcgccgtcgccgccgtcctcttggtaggcacggcggccgccaggccagccacgtccgccgtcgtggctcgtggcaccaatgccacggcggccgccgccaacgcaaccgtgatggcgcgccgcggccgctcctcgccgctatcgacggcgacgacggaggaggagcagcagtacatctgctacctctgccgcgggcgcaacacgctgatgatcagctggtgccccctcgacaaggacgagtgccacatcgcctgcctctcgtcgccgtcgtcggcgtcgcgctcctcctcctcgtctccgccgcgcgcgctgcctttttccgccgccgacgacgatggcggcgacaacggccggggcgggggccacgacgactgctacgtcatgaaggtgtaccctgacggcagctgggtcgtcgtcgacgtggtcagctgccaggcgtccgcgggatgctacctcgtgtgcagctacggcgacgcgctgccgtcgtcgtcgtcgtcgggcgccgcttccggcgagatcaccccggccgccatcggtagcccgctgccgcgcggcctgaccgagttcgagcggtgcggcgaccagcgctagccgtgcccgggtgccgccgtccgcgagcccatgtcgacaacgcgtacgtgccgtttgatgatccgatccgacgaatgtaacgttggacatagcactaaacctcgtgtcaatctgtgcataaatatataggcagtatggtagagagaaaaccaaaagaaattcaagcaagcaaaacaaataaaaataataatacgagtaacactttaggtttcacaattttttttcaggaagtagtagttaatgtggaagaatcaaccagctcatatttgcaaactacgatctgtctctgttaaccaaattacgagtgtgtgttcttgggataaattcacagccgtttaatttcttactgatcggatcgatcttgcggcttgcggcagcaacacgagaagtctcctcgttctatggctaaaaacgtcccaacctgccgtttcggtggtttgttttttggtaaatggctgcggcagcacaacacactttgcttgttgctcaccactttcaaacagaatccattgcttcctgggcttgctaattaaccgtgtccaccgctgacaaatagtaccatccaccgccggagcgcgtagttgctgaacagctgaattagtaaatcactattccactactgatttgcactacatttgtttgctgttcatagcgatatgcgtagtctacgtgcatgtactatgttttttttttgaaagggatatgtaccgggtattcatgagtatgaaccttgttagaaaatttgtacagaggaaaataggaaatgtataccctagacgtttgatctggaaaatgagtacagctagaaagctatttttcagatgaggatgaaatattaagttgatgcgcgtgaaacgagaaaactattagtgcatgattaattaaaatataattattacagcctttataaatgggtatctttaatattttaaagcaacctatatatagaaagtttttgcatgaaatataccgtttaatagtttaaaagcgtgctaacgaaacagagatacaatccgaatcttaattacaaaataacatatgtatgcaaccgatttttctggtttatcttgatgaagaaaaacatgtaacctctacatgggaagagataattagcagattgctcgattgaaatttgataccacccttcagaattcagatagcactcttacgcagaaacaggtaagcacttattctcgtatagtcaaattgtagtatccattcattgactgagattttgttggtctcccaacataatcataatttcatactactacgctcctgacgtcaaaatgcagctgcagccaaaatgacctataaatatccccgccataaaaaaaacccttataaatgagacaggctgcacgcatcatctctcatcaatttgtgatatgcctctctcagcagcttccatcaaccgtgcatcctaccaagttctcctcctcctcgccgccgccgccgtgtccaccacgggcggcgacggcaacacggcgcccggcaatgccaccgccacggcgacgactggcggcgacgacacggagatgtacatctgctacctctgcaccgggcgcaacccgatcctgatcaggaggtgccccatctactgggactactgccacctcaactgctttgacgacgcgccctccaccgccgccgccgccgacgacgtcgccgccgttcccgtggcctcgccggcggcgcctgcgcgacgggtgggcggcgtcccgcgcgagaccctcgaggacgaggagtgctacgtcatgaagctgtacgagaacggcagctacgtcatcgtgaccacgctgggctgctcccagaccgcctcgtgcctcctctcctgcggcggcggcgacctcgcagccgacggcgaagaagccctggcggcggcgcacccggccggcgccgtcggcgtctcgccgccggtgagagcgacggctccccgcggcatgccgccgccccgcgtcgccgatttccagcggtgcggctcacaggcgatgaccgctactccggcaacgagggccatcaccggcggcgtgtagcgaccgctttcggctccgatggacgacgttcgtgcacattaattcgtcttcacatgataaaaaaaaaaagaacagtgcagcaattgtaagatagacataagaatttgcaggaattccaaaggaatcatttcaaattatcgtttctcccgtgttaataataatagaaaagtaaattcaaacagggacgactaaggtgaagaacgtcaatgtaagctggcaaaatcaacatttgtataccacgaaatctatacatttccgtaggttttgatcgcaatttcacagaggtagattccgaatccggccagatgatgggcctggcccgtgtgtcctctcctatacaggctttctggttcgtttgcatatgttgtgggccgtgggcccgtggcccataagccatactgcttgcacgttccatccatcgatcacttgctgcgatccgcggcgcgtcgggactccatttttttttccccgtgagaaatttccaaaaaccaccactctccgccgcgaaccctagtggcgaatgtgggatacaaaattcggtttccctccagcagcgccgcccaccaccgccgccgcagcgcagaaaaatcccaagcggaggagagaggcggaggcggagggggaggtggcggcggagatgagggaggaggcggtggagcggctgcgcggggtggtgcgggacagcgtcgggaagcacctgtacgcgtccgccatcttcctcgccgacaaggtggccgcggccacgggggaccccgccgacgtctacatgctcgcgcaggcgctcttcttgggccgccacttccgccgcgcgctccacatcctcaactcctccaagctcctccgcgacctccgcttccgcttcctcgcagccaagtgcctcgtgagcttccccacccacgcccttgtttagtctgccattttgtcgaacatgttgggtgcatgctgtgtgtagatagaaggtttagtttcactgcccctgttaatgttccagtgcgtggctgcgcttgagcttccttatgaacagcttgtggttgtatggtggcctcaatgttctttcactctgggcattgtttggcagtttttttgacgatttgattctgtgtgtttgcaagcactcgataaaattttgcttgatcagcttttagctttagctgtatgagttgagatagggtcgtttacttcacacaaggtgcgcccaatggcttgcactgggggatttcatttttttggcttcaagtccaatgctctgctgatgcttcaaaataattaacatgatacacctgcattttctcgaccagaatatttttacttgggcattccatcaatgaacgggtgcttagcttggttcttaatagctggtctgatctgggagtttggttgattataatatgtgcttcctgcttcggacttttagataaatgagaattttgtttaagttctatatatgtcagatatataaactgcacatatgattttgactgcttattcaatcaatatccatgacactcgaaacaaaaatctggtttcttataggaaagatcaaaagaactgtataggattagtgatttttttaatgtacttctaagattttactttagaaaattgaaccataccagaaaatattatgattcagtatagatttttctgatttgtgctctggtgtacagtcctgtgtagtcctttattttatctaccgtctttccttttatcttagctactgtttcatcgttttgttttggtttgttaggaggagttgaaagaatggcatcagtgtttgatcatacttggagatgcaaaaatagatgagcatggaaacgttgttgatcaggatgatggcagtgacatttactttgataaggatgctgaagaccatgagatcaatgtgtgttgactcttctttctcttccccatgcctctctctctctctcttagtatggtgattgatagtaatatttgcttgccagatcaaagcggcaatatgttttttacgtggcaaggcatacgaagcactggacaactgtgaccttgctcgacaatggtaaagcatcatttcattttttgtctaattgagtgtattcagtggttctggtgaatgacgatgcagttattttgaagtctttcttctcttacaccttttactcaatatcttcactgagaatgttgggttattcgatactctttagaagatataaagaaaatgagtttttcttgtaaaacgaggacacactgctaatagttgaaataactgttgctacctggaagtactgctaattttctttgtttgaaattaagatttaagcaggattgtctaatcagtgtttttttttgggcatatctggccaaatagcttggttaagatggttttatggctttgttctgctgttatctcaggtacaaagctgcagtgaaggctgatcctttgtgctatgaggtgagaagaatcatgtgactctttagtacaataccttttcaattacatgaaccaccattattttgtatttttggttctactaaatatggaatttggcatccagatgctaacatggaattgggcctctgtggtaaccccagttagttcattcctaacttcttatgtctgtacatggcaggcccttgaatgccttgttgataactacatgttgacatgcgaggaaggtaagttttacaaaatcaatcttcccatctgtcatgtccatcctcttaggatatttcttttaaataatacaatgtttattgttattactggactagttttaagaagatatgcttaatgttggaccttcaatcctctctttgttcttggtacttattgttatgcaatgatatcagaatctgagctattgtcctctctaaaatttggaaaagaagatgggtggctctcagcattctactcttgtttgataaggaaggtacacgacttattaactgcattgctttgcaatttaataaacaatatgtgtatctgcattcacttatatttcttttgatcatggtttgttttgttttatggctttagcatgaaaaagaatatatagtggaagcaaagttcaaggaatttgaacgagaatcttgtagtatttcatctttgagttcaggactgacactgaaaaataatattgacgtgttggcttgcaaagctgaatactatcatcagagtggagagtaccaaaaatgtttcgaattcacatttgggtaagttggtaaatgattcattgtcggtacatatgtttccttgatcaatattggtttatcattcttgtgatgctatatgtgcctcaggttacttgaaagggacccttttcatttgaaatgcacgttagttcatttggcagctgcaatggagcttggccattcaaatgacctttatattttggcctgcaatctagtgaaggactatcctcagaagtgagtattcccactggcctgcccacattcagacccacataatatttgttatcctgctagatgggcttttccccctttcatttgcatgtaacaatcttagatataatgacagtgttgtgcacattattcatctttctgcaaactttaatgcaacttgtaaaatctagcctttaatagcatcgggattggggtaaaatatgttaactgacctttatttatgtgatgaacaagaagagattgacccccccccccccccttcatgttggttatatagactccaatagttggagggacataatactaaagtacacttgattgtttgtagtcagacatgagcaaacaaagtatattattttaatgtcagctgtggttccatctgtagagctctttcctggtttgctgttgggtgttattactactgtattaagaagtatgatcaagcacgcagatactttgggtaagcatattcttctcttaatttccactgtatatttttatttgaaccttcactatgcatttttgccttaggatagcttagaagataatcctgctgtgccttcgatgttgggatgtaaaataaaatagggtgtgattagtgaatatcctctgcactgcaaatcacaaccatgttcctgcgtaaggcaacacttttgtcatgaaaacatggcagacatggtataacatgtgtgctacaatagtgttaccatctgatggagagaacagtgtccataggtgccattgcctcctgaaatctacgcatatccaactgactgattgatttcttataacaaacaatatatttctttgttaaatatttttagttgtctggaatgatagaacaatgtgataaaaagacagaaatgagtaggttctactcatgtagtatcagtctgtcagatggtttgtaaggtgaaacatatctgtccaataattctccagagtccaagttcaaataaacaatatatattttcttaagacatgtgtctcagttataccagtccaaaggttgcaggttattttgtttcttatttgttcaatgctcattgttcattgaatttaatcatggatgggtttaaccctcttacaacttcttataccttgtattcttgttcaattttaagtagctgtaatatgttttgcactaatatatttcctatcagcaaagctacagggttagatgggacatttcctcctgcttggattggtactggtattgcttatgctgcacaggaggagggtgatcaagcaatggctgcatttcggacagcagctcggctatttcctgggtcagtaattcctttcgaagtaattgtttgtgtaaaaaaacttctttatttgttatgttattatgctgtgtacagtttagcaaaatattaattaaattaatttgattctttttacacttaagtcaactcaatattaacaccagagcatacttgtacttgtttgtctaaggagcaattatcttaacacaattagttgcattaattttcctttgtactatctttcaattgttttggccttttattctggaaattgatattcgtattttttttgggtgtgacaagcttttgtatctgctatgcattaccgattatgagcattgtggatcctttctactttctttcattttttggccttctgttctggaaactgctattcgtgttttttgggacactggcaagcttttgtatctactacacattactgattatgagcattgtggattgagttcctctctttgttttggagtgtagattcttgttgcacttcaattacttcacctctgttgttgtctgtccttcggctcactatttgttgaaattgttttctatttcagatgtcatctgccaactttatacatgggcatgcaatatttgcgaatgcacaatttcaaacttgcagagcaggtaataacttgagaaatcctaccgagactaattttcttatgaggcttccactctgataaagaaactatacttagagctgacttttttccctatattttctcattccatattttgtttttggcaaaaaaggaggtttaatgtggtaatagtagttggtcagatgctgaaaatacatcctgtatttgtaatattggatgggttatagaaaatgagatattatcatgcacaacttccttttacctagtgaatactgtttgttgtagctcacaatgagagcctatcatggagagtatgttatttgcaaagttttatttggcaaggcataatagttttgtcatcatttttttaaacccccttttctttctgctgtgatgcagttcttcacgcaagcaaaatctatctgcccatctgatccgcttatatataacgagatgggggttgtagcttataatatgaaagagtaagagtttctctgttctaaaggtttcttttgtctgcttatcctattattattggaaccagtgatgctccactttcccttgtaagatgctttgctctcatgaaagggaaagcattcctataagttctatatctgatattcctataggaaaaatgttatgctaacatggatgttttgaaagatgtccatgatatacaaggttgatttggtggttctgaaattttgaatagaatatggatgtagtatgcatagtattgtatggaaagctttttgaagtgggaatgatgtgaaccctagttcatgttaaggttagcatgtagaaactggctacaccggaggaactttgggataaaagaagaataaaagaaggggaatggctccaggataaataagaaaggataggctattatgatgaactttggggagaaaaaatgtttcatctttcttgattgatttgtaacggatgctttgctgttccctttgtatcgacaagatcttcacatagtattcagtgaagtaaacccaagtaagagagcaactaatttttttccccttagtttccaactaatgctgcaccagctgggccctgcattaacgcaatcacgataacaagtgtgttttatgcatttatagtatgatcattagagtttgaaacgtgtgattgatgtccatgatccatatacaagtttggtttttatttgcttttcaaattctcttcaacttataaaatttcatcccattagatttggttctctgctgaaaaaaatgtttgacacatccagttctagtggtttcagtaaaaagaactgtttgtgctgctattaaagtagttgagaatttgatattctgttttttttaaaaaaaatgtttaggtatcaaaaagcagttcagtggtttgagctaacactggagcatacttcatcctccttgaatgaaatgtgggaaccaacattggtgaatcttgggcatgcattgcggaaactcaagtaagggaaccatcgcatcacattgttacatttaatttcataagtctgttggcatatgacttttttatgttagtttagcaatagatttgtcaagttccaatcccatttatatgctcaatttatgatttttgttatacatgagagaatgggaaaggaagtgttgatttagttcagtcatctcagttgtgcagctgtggttgctttgtttgaagaccttttattacagactagaacaaaataaatcagcaatatgccagtgttattatttgggccagtgtgtgtgagggtaagttcgaacttgtggatttctttgtatccagagccagtcaagcctaaattgcatgaaactttaataagaaaatatgccttagattttgtgcctagcatatcctgacctgaatagcatttctttgcgatgaacagcagctttgctgttagttttgactgatggaataataattaaccgaattatactggttctctttctttttggttgttgtcatcagttgttaaaatatcattcttgagctaaccttttttttttgttgcaacaggaaatatcaaaaggcaatatcatattatgaaaaggcactcacctttcaaaccaaaagtttgagcgcgtttgctggtcttgcttatacttaccaccttatggtactcttctgttcctttcttatccactgctttgaatggtactatctctgttatgctgcactggcatgctgtaaaggcgatgtatcatgtgcatagggcagaagttctgcaaattctgacaaaagaacctggaagatgatacgtgttagatcatggtctttccacatagacttatatttaattatctattggatatctatatgatcagaagttcaaaactaagttttatgtaacctgctacttcaattacaacatcaattcatatatgtgtgctgagcgtttaccgttgaaacatcgggatacttggtatttgttagttcccataggcataagtgagaaacaactagacaaggcatagagatgccattggaagaatcgagaacagagtaatgagagggtgatttaagttctagtagtagtgttttcaggaaaaaaaatttcggtcagagattccttgctaatttacatgaaaatcacgaaggacaattgacctttaagcttaagttgcatttgtagaagcaatattttttagttttaagaatgagacctgatatgcttgattcattgtttcagtttgacacttccacagttactttctgagtatatctgaattttactaatatcatcttttcataacacaggataaattcgaggctgcgataacttactaccacaaggtgacgctctatgatcatttgtacttagctgtcatgtttagaatacatctttctaatcaaacaccttcggcctgtttggttggagggagtttttagaagggattgggagtttagagggatgaggctattaagtgttttgtttggttgggagatatgggaattttggtgggatggggatggggaattgaggaaggaactccctccttttcaatacctgggtaggggcaggtaattgggagggaattcctcctttactttgtctaagcaaatctcagccatccgtttttattaatgacctaatctccaactaaactccctatcaatttccatcacctctaccaaacaagatattgggattaaaaatcaaatttccatcttaatctcatcat

SEQ ID NO: 2761 - DNA, 40146 bp, Oryza sativa
cgagtccagctgtcaaatcactgctcggacaagatagcataggtgcaatcgctgttcgcaaactgcaacaggtgatgttgtatcttaggagtgttgtatcaattcggatcatctgtagccagtcttgtaaagttagtgtttaatatataattgctcaagctcattcgccgtatcatcaagattttgttaccttcgtactgatgtaaataccgtccattccttgtcatcacgactaatgatgcccaagattattctgcatgtttagaaaggttaaggtcagccgcaattgtgaggtagttttattacattcttatgataactgaggtatttgctgtaaatttgaatggaatcttgatccttttcttacgaagtgtctatgcctgactcctaagatttgtggatttctttttttttttctagcggtttcattcgattattattcttaaatactattaaatagatgaaagtaatatgtgcaatgttgtacgctctctttcttatctgagcaattagttgcccagaactcgttatctgtcgtctgttggttccacacgatttctcgcggttatcccccaaatcgatggagcatatccatttctcgtggcctcaccaaattcaactgccgaattgacttgactgtatggaggaagcaaaggttgcctcagttgaatttaatgctaacttgtgttttaagctaatttaagtttgttgaatgagagattattttacttagatacatgagtacaaaaccgtagtgattccaaagtttgtgcaaaatttccatcacgcagaaaatcacgccggggatacaatcattcatggagtaaacattaagaattcttcagcaatcatctggaaagaggcatggcccctccaaataagtaaagcattaagccgatgccttcggaaaaggtaagatttttagggaagaaaataacgctagcaattagcttattgcagtgtcttggaagggtttttttttttcccgataactagtgtgttgctccgtctgttcaaaaaaaaatcggaagtacctatacatctttcgaaagatttttatgatggtatcgcacagatttttaatctttggattaaaatccgatagatataataaaaagcaaaaagtaattaagaaacaccataatggacactaaattaccatatcctcaagaaaaagaccaaatccaatacaaaatttaaaatttacatgcgaagattcaaaaattacagtgtaacttacaaaagttaccgtgtaagtttcataaattacactgtaacttacaagaaaatgcactgtaaatttgagtgagaaaatcgagtgagagataagaaaaaaatctttcgagtgagatatagcaaaatcgaaaaaaatctattattaaatgatatatttttatacaacaaatccgaacatactcctgtccaattttattgtattaggaaatattatatctaatattaggtttgttttttttttcttttgatggagggagtagaaatgagaaccacctcgctgtggctgccgcctgcggatggttcttttttgactgaaacttatcagttctctcaacggttcccatttattcatgagaaattgtcagggaaatgagctgcatactccatacatcacatgcagagagctaagaggtgtcattgtcgaccgacagagttagttcctaccagcacttgaagtcagcatgcgtatgtagaggaaacctgatgacagcgtaactgcaggaaaggattatgaaactaggggaagtgaagctcactgaattggtggcatttgcatggcgctagtgagggcaggtgaaaagcaaaggttgcgttgtggtattcttttctttcagcatttgcatagccctgctaagttggtaactgctgcagatggtattactgcataagctcactttggtagtacatggcccgttgccattcttgcggtactgtcaactctcatgatgtttgtgattttcatctctataggcagtgaccttcttagcagcataaaactgaatattacactcctgcagtagtcactattgtagattctttgaatgacctagcaattttttctaccttaaaaaaaatcaagcatgtgcttcgcttccatccttccagggatggccagtgagcttatgcagtaatgcttctcttccagcaatgtactccatccagcccgattcgtttctgagttcaagtttggctgaagcatatgtccatccagcaatgttgtaccaaacttgaacaaagtttggctgaagcatatgtccatccagcaatgttgtaccaaattcctgccctcattcctcccttgttcaagtttctacaacattgttacatggacatatgctatacactaaactttgattttcttgagagcagggaagccctactgcccgttctttttggattaaaatgtatgtagtctacttcagttttcattatcacgctttttaaaccgttaaacaatatgtttcatgtgaaaaatttatacataaaagttactataaactatcaaataaatccattttcaactttataataagttaaaacctaatcaatcatacgctaatgactttcccgttttccgtaccattacttaatcttcatcttattagttttccgtactactttcactattcactactggagctaaccgataatatttgacaaaaaaaaatcagaatgtgactaggccaaaaagtggaaagaaaacttgcgctggactcaaccccgacccccggggagcgagagagcgctctgatttggatcgtgtcaaaccgaccgacgcaccaaaatgtgggctactactagcctttagcttagctgaccccattatactagtactacaatattagggccacagtacgcctccaccttcctcccccccacccaaccctgaaaacgccaccctctccagatctcccctccgcctcgtctcgtctcgtctcggtctctctctctattaaggagcaagcaaagcggccactccggctcagatctccgcgcgtgcatcccaccacccccaaaccctcgcgcgcgcgctctctctcctcgtcaacgcgcgcgcccccgcccccgccccgacgagagcgatggcctcgccggcagcggcggcccccgcggcgctgctcgtccttctcgccgcggccctcgcggcgaccggcgtcgtcgccgacggctccgaccaccgctacaaggccaacgagctcgtcccgctctacgccaacaaggtcggccccttccacaaccccaggtgaggctctctctctctcctcccccgctcagatcccatcgtcggatccgttagattcgtgggtgtgggttgggttagttgttcccgccccccgatctcgcctcgaggtgtgtgtgggctgagtcgtcgtgggtttaggtttgtctggtcaaacgcagagaggctagtttcggagatccgagagatgacgttcgtagtgatttggacgggataacgatcgatcactgcactgttgactgcccagatcttcgcgtcgggctctgttttcgtttcagttttagcaagtataggtgttcggagagcggattctagacttgctgggaatcggatctatttgtaaagtagattttttattcttaaaggcgataatgtcacgcgaatgccgttgtcatgatattttcctttttccttgcagtgagacgtatcggtactttgacctgcctttctgctctccaggttagttagtcacagattcatgcttcctcttcattgctgaagaatcccagttagttgtttgctaataaatggtgttaattacagagaaagtgaaggagaagagcgaggcactcggtgaggtcctcaatggggaccggttggttgatgcaccttacaagcttgatttccgtgtggattatgactccaagccggtttgctcgaagaagctcaccaaggaggaggtggccaagtttcggaatgcggtagcaaaggactactacttccagatgtactacgatgacctcccactgtggggattcattggtaaggtggagaagggaggcaagacagatccgaaagagtggaagtattacctgtacaggcacatcatctttgacatcctctacaacaatgaccgggttattgagatcaatgtgcacactgaccagagtgcactagttgacctgactgaggacaaggaagctgatgttcaattcctttactcagtcaagtggaaggagacacccacaccatttgagaagaggatggagaagtattccagttcctccaacctcccacaccatttggaggtccattggttctctatcataaactcttgtgttacagtcctccttttgactggattcttggcgaccatcctcatgcgagtactgaagaacgattttgtcaagtaaggatctatacattacgtatttacattaagtattaaagatattttggaagatactccatgcatgtcacgatatttgcctgagcccactatgcacatgtgctagttaagcactaaaagaaaagaaatgtaatgagcagtgacagtaaagacagatgccagcccatagaacatggaaaattgcagcatataaattatttttatttcctatggagatgcattttgacaattgacatgactgtcgaaactcactccaaacagtggtttctattctactaaacgagcatctattcttcctcttgccatgttcttcagttgagagtaaactaatgcatgatgcatagagcaaatattttggtctgaaatggatattaaattattaacttgctaaaggaagcgcataaagcagatctactatgtcaacggtgttcagattatatgtcctttgtagtgtaatgcttatgaatttattacttgaaggttgatcttctctttgatttatgagcttgatgacttgactacatttcatctcgtagtttttagtttaaccctttttcatttgaaggtatgcccatgatgaggaagcagctgatgaccaagaagagtctggatggaagtatatccatggggatgtcttccggttccccaagaacaagtcctttttttcggctgctctcggcaccggaactcaactgtttgccctgtaagttttgatgggccttttcttgccacatatattatggttttattttgcttaactggaattcttcctcctgttgttcctttttagacatgcagatagctaacaatctttatttggcacattgcagcacaacctttatattccttcttgcacttgttggagtattctacccgtacaatcgtggtgctctttttactgcattggttgtcatctatgctctcacttcaggaattgctgggtatattgcaacctctttctactgtcagctagagggaacaaactgggtatgtgttacatgtatacataatacatccctagacacttctacaatgctaagactgcaaatttaaaagcatcgattataattcttttattactaatgctatcgttttatacttctcaggtgaggaacttgctgttgacaggatgcctgttctgtggacccctattcctgactttctgcttcctaaacactgttgctattgcttatagtgcaacagcagctttgcccttcggcactatctgtgtcattgtgctcatctggaccttagttacatttccccttctagttttgggaggcattgctggtaaaaacagcaagactgaattccaagctccctgccgtaccaccaaatatcctagggagattcctccacttccgtggtaccggcaaacaatcccgcagatggctatggctgggtttttacctttcagtgccatctatattgagctctactacatctttgctagtgtttggggccacaggatttacacaatttacagcattctcttcatagtcttcatcatcctccttattgttactgccttcattactgttgcactgacgtactttcagcttgctgctgaagaccatgaatggtggtggaggtacattcatttccctttatgttttttaaacaagtactggcatgggaatgcatcatatatttcattttatacactgaaactgatattttgggtatttgcttttatttattgagctctgagatcaatcaggtggctgtcaattttctgcagttattttttcgtttgtttgacatcttattcatatgtatttcctgggcacccttctgttgttttcccatagttacaattggagttgctgattagcaaagtattatcgtagtgaaattttgagtacaatgcaataaccaattatgtatcatctcaatggattctagagggactagttcttgaaatctgttgcaactctacatttttttgtcatgagcaaggtatacaatgctgagcagtgagcaccacccatttatggatattctaccaatccttatgttctctcatccatctatttattatctaggaactccagtttaatgctgttcttttgtactaaatgctgaacaacaatatgattttttttctgccctttctcttatacaggtcattcctatgtggaggatcaactggattttttgtctatgggtattgtctgtactactattatgcacgatcagatatgtctggatttatgcagacatcattcttcttcggctacatggcttgcatctgctatgctttcttcctgatgctgggcatgatcggtttccgtgccgcattgttctttgtccgtcacatatacaaatccatcaagtgtgagtaatactgttgtcaaaggctggagagcagcggagttgtactcctttttggtgccactaagaagtcccagtatagaaaaggttagctctcgcacaacaggagcagctagagattgccatgtttcaggttaggccattattcataggaacaggtaatgaacctataaatttgttctccttttgtgcgactgctgtgataaatcgtcttttctttggtcatgtaattctccctgtgatgtctagacattttcacgttgttgatgcatgacctacctgagcatctctggaagatcatgtcatgtcttatttcctatagcagaataactgaagtgtagagatgatgcctctagagcggcttgtctatttatacgtgtacccaccgctggttatgtattgtcaaatattgaaatactgaaccattctttttttttcacttttgagaatcatgatcattttgattgatagtgcgaagcagcttccaatgtgcaactaggcttgacacgttatatttgttgatgtgattcgttcttcataatccagcgaagcttgttctgcttttggactgcattttctgaaaagttacatcttttctattgctaatgagacagaaaaacctattccatctgtactaagataactttattttaacatctaacatttgtcccaaaacaaattctatgctcttacctatcattcagtctaaaattaagtttttatcatttcagtatctcttatctacccatccattaatataacatttctattaattagtgccacttttttctgtgctaatttgaacccttatgtctgaagttattttgagcccttatgcctgaagttattttgggacagatgtaagtacataaaataattcttaaaattgtactataattaagcttcggggtataatttagatagtacgaagaagtttcaaccctctcttaattgtagaaaatgactagcatgatagccatcgatatggatgtattagaacgccacttggattatcacttgctctgatccacatcgcatcgacactccgagaagtcactactagcggtgaccgttaagattaatctgtgatgtaacgcaaagaaccaagcctatgactgcatgagcttggccggtctcgctatgctacaaaaccaggatggcgtgatatgggccgcctccccttctccttagatcagcataggcttgagtaacggctctccttttcccgtcaaatcgcaaatgaacttccgttacgatccaaaaacaaatccgagaggaaaacgagaacgatcaggcgcgatgcgcgcctcaaaatatccaccttttcctcctcttttttgagaaaattctgcgaaagcatcgaatagttttgtactggtcaccgacgacaaccaaataaccaaccggtgtcacggcgaattccgtcaacaccgcacccaagtcgtcgtgtttatatatgctttgccaatttgccataaaaacccccacgaaatcctccaatccattgccgcagtccgtccaagagagggggacactctgcctccagccatgagcgacggcggcgcaggcgccaagggcgcgggcttcggcatgccgcgcgtcggcatgggcacggcggtgcaggggccgaggccggagcccatccggcgcgccgtgctcaaggccatcgaggccgggtaccgccactttgacaccgcggcgcactacgagaccgaggcgcccatcggcgaggccgccgccgaggccgtgcggtccggggccattgcctcccgcggtgacctttttatcacgtccaagctttggtgcagcgacgcgcaccgcgacagggtgctccccgcgctcaggcagacgctatggtatgtatgcccccccccccccccccccttctctttgcccccgtataagattccggcggaatcaagtgaagaattgtgattttagtagtggattattacgagttgtttggagtaatcggttgggccaggcctataagaaaaacaaaggcattatcttaaataaaggaaaatttattgtggaattaggatatgtgatagggaccacctatacatttgtcgacaaattttctcctaaaaatttgatagatgtaattataatacaattgtagtgtaattacactgtaacttgcatataactatataactatagtgtaacttgtacgtaagtttcacgtaattttgaattgttagatctattataagatttgttttgatgaggaagaaaaaaaatcacagcacacacacatgtgaaatagtttgttcccacaacctctattttaccaaaataacatgttacggagagatttttaaaagttacatagaagttacattatagttacagtgtaattacatgcatgttacagtgtaattacactatgattgtactgtaattacatctgtcaaatttttgggggaaaatttatcgacaaatatatagcaaaattgtatgtgatattattctttaatcttaacaagacaaattataaaaagtcttactctttggttgtcgtgctgatgctcatctttgagtataggaatgccttgagtatatcacgtgccgaccactcctatgccttgagtatagggatgccttgagtatctagttggtaactagtttctaataatttaaaaaagctagaaaacctaatttctaatttctagtttattttttgaattttgaatgtagttgaaaaaccaaactgtttgagtgcttttaattttggaagatactgcattagccacgagacaaattctttcattaccatcttggctgccacctccaaacagatattagtccctcattaactgcagtgcatttaatttctatctgaggcaccatgcgactaatcaactgattatgaaaggttaagactcaccttaattaacagaaagcacatgctcatcccacacgtatatatgcaggaaccttcagatggagtacgtggacttgtacctggtgcactggcctgtgtccatgaagccgggccggtacaaggcccccttcaccgccgacgacttcgtgccgttcgacatgcgggccgtctgggaggccatggaggagtgccaccgcctgggcctcgccaaggccatcggcgtctgcaacttctcctgcaaaaagctcgacaccctgctctccttcgccaccatccctcccgccgtcaaccaggttggtttgcacaattcacaatgctgcaacaaccaaaaatgttataacctttttttaatggttgatttgcttattgtgttgggtttgcgttgcgtttggtttgtcacggtacgtacgtacgtgcaggtggaggtgaacccggtgtggcagcagaggaagctgagggagctgtgcagggagaagggcgtccagatctgcgcctactcgccgctgggcgccagcggcacgcactggggcagcgactccgtcatggcctccgccgtgctccgcgacatcgcccaatccaagggcaagaccgtagcccaggcacgtcacgtctacatttgcacgcgtgtgttcgtgtcgcgccgtcgtctcagcagcaactgacgtgtgtgtgttgatttggcaggtgtgcctgaggtgggtgtacgagcaaggggactgcctgatcgtgaagagcttcgacgaggcgcggatgcgggagaacctggacatcgtcggatgggagctgacggaggaggagaggcagaggatcgccggcatcccgcagcggaagatcaaccgtgccctccgcttcgtctccgaccacgggccctacaagtcgctcgacgacctctgggacggcgagatatgagcactcgccggcgaccgcttcgtgtttccaggcgccggccgacgtgcgtgctgctctgaggaacgtaacaacaaaaactgcggctcttgacgatcgtgttgaataaagcaaagtgtgacgatttcatcggctctgattgcataattccggagtgcacacgctagcacgtgcgagagagagagatataggtacatcgagcgtgtcaaatcgatcaaaattgttatagacgaggccgagccgagccaaggaaaagcttccattagagcatttacagtgcttcttactcgcatgccaagtctcacatgtcagttggctcaagaccagtattagacactcgtgtcacaatactgtagccttaagtggggtctacaaaaatacagaagtcccttctctcctcttttttcccctctatcatgccttccactctctctctctctctctttctctctctctttccctctcacgctcgagcggcgacttgcacgctctcctcttctccttccactgtggcggggcggccgggcggagcagcagcctaagcggcaatagcgtcaggagaagcggtggtccgagcagtgatggcgctaggcggggcggccatatccgatctgggctcgctagatctggccttgggcgatggcagcggctcgtcggatctcccctctcccctcagcttgctagtgccaaatctcatctcccctcctcgtcggcgcccgttgtccaaggcgacgacgacgagcggcggcgtggcctataccctctcctcggtggcgccttccgtcctcttctccgtccggcagccctcctcccttggccgtcgtgggctatccagacgaatccctgacaaatctgacgagaaacatgcgactcatttaggctccattttcttcacttggtaacggaaacatccgacgtggcgtggaatcttggctggggctgcctaaggttgaatgccagttatacgcattgtgaacgccggccgtgccatctgccaccggcacgtacgaaccgaacgtcgctagcttttgcgtcgtcgcgtcgtcctcgtcgatctcggcggaatcaaccgcccaaccaaccgaaccgcgcctcgtctcgtcacgagccgccgtgacagcgtcgtgccggtgcaggggcccctggcagagcgtgcttacgccgatacgtgcgaccaaaaagcggctcgcatcgatcacgtcttgagaaaagagaagaatcaaacaaaaaggaagaagaaagaaagcgtactaggggcaaagctttgcaagagtgtattacatatatcgatcatctcatggcatctcacctcacctcacagcttttatggaatcacatgttggtcgccaatgcaagcttgtcaagttgccaccatagctaagctaggagtactaggtagggcggtgtctagctaaggaaccagtagtagtcatcggaggagcatttgctttgcaaatgctttgcaagcggctagagtaggtcaaactacattgtcacaatctattcgaccgggagctccaacgttggagcactctgtagtctgtagtactccatcgatgattatttacccaagagcgtgctctgacacattggcattgcccccttgcaaaacaattctgaacatttcgaccgtacaaacaaaatccttgcaaaacttgtatactgtactagcactgtacctcgccggatggtcgtacgatgtggccaagtcacaggcacacagtggcacgacacatttgactgacaacgccatcgaagagatcgaatgcaactggcaaaacgactcgagtacccttctggtaaaagtcaccgcgacgtcgccaggtttgtttcagatgaggcaaagtttttactaccgaacaggccatgtggtgaagcccaagaacacacgtccccacagaccggcccagccatgtataaaatcagggcatattccctcatctcgctgtgcaggaggactgggcgaaaaaaaagaaaggaaaaaagcgaaggtaatcgagcgtttttactgcggcagagttcacggggaattcagagcgcactgggtgacgaaatggattgcgcgctgcagttgctcgcagctgcgccgaccgggaagggggggctctgcgcctggatcgtgcggttaaaagcaggatgagtaaaggcgttttttggttccttttgcgaaaggaacggcatcctctgaatcctcctcctgacgccgctgcagcctcttttcagtgacgcactgatgctgtaaactactggctcagattgattattactccaggctgagtccagctcgatgtaaacgagtcgaatactcgaacgatgtgcatcatgcaatggcatccctgttgccacaactactgtatttgtttgctcactaataagagtctaagatgagtactgtatatgcattgaggtatggttaaagagatcgtttcatctacgtacctagaatattgtactactacgtctttgatagcggctttgtccaaacgctgtaatttgatattttgtgtgtgtgtgtgtgtgtgtgtgtgttagagctctaatacaatcgcaacacaaatatggctatatatttcttaagtaaatccaagagacattactccctcatcccatgatataaatattttttattcgtgtttatccagatatatatgtagccagaaatccttttattttgagatacaatgctacttcgtccgtcaataaatatgttcacttctagcaattgggatttctcaattcatgaagcaaaggtacgtaggtagggaaatagaaattaatatattttagtatagagaaaatacaacgaaattaaatcaatccgcatgtgactattagaaatatcctactatttttttatccacggtaatactataatatattttgttttcagcaatgagtaacggatcccatatatacatatttgagtgtgctcacactatcttaaaataattgttggctatgttcccgaatagtaaaaaattggtacattttgggatggagatataaaaaaaatgcataatcattttaagaaaagaaaatgtttgacttgcccccctaaacgtttggtgtagcatgcttcccctaatcccccctgactctcgtggcaacgttgtatcaggtggcactcaatcatccaggtgggataatcaacttatatatatataaagaaagaaatatctatacctatatgtcgtttgcttcatattcttttctacttgcgctcctctctagggtcaacctatatatctacgccacccgtgccaaggagggaagagaggagtatgcacaggtgccggaggaaggaggggagcagagaggatgaaagccggtgacggagaagctaaaggtggagcccgcaattcagcctgcaaatggggcggggcaggtaggcccgttccctataccctctgacccatttgcttttgggcaccagttgaaaccagagacaaacattggcccgcccctctctggtggcactggtcgccccgttaggttcctactccagacaacataacagtgcacttgtccaagcagcgacatgcaaagatagcagagttcagtagttgataagcatcaaataaaatgcagccggacaagatgataatataaattgacaaatcatggttaaacaattcagaatagaagcaaaagaaaaacaaattgaattggattcagaaaattcaatctagaaattttaaagaaacagatataactccattaactttcctagatgttccattcagaatttgtgattcctttgcacaaatcttcgcattctaaaacacaaacatcactactagcaaccagtagtacttcatcaagcaaatgacacccaatctaacaacatgctcttctgcccaagacgcaataacaaagaacactcacactccatgctcataatcctgatgatcgccggcgtcgtcgctgctgaagctgcagcctgaagcaaggttgggctaaatcaataatggacagcgggagcgcatcgccgcctagcttgtaagcttggagccgctgctaccgtctcgatccagccgggccggagcccgggactgcgtcgccccgaacccgaagccgccgccgccgccgctccagccgggacgcgtcgccccaacctgaagtcgtcgtcgccgttgccgccgccgccgctgccgcctcgagccctcgatccagcctggggcgcgtcgccccaacctgaagccgccgccgccgcctcgatctagctgaggagtgcgtcgcccctacgcagtgctgtgataagccgattacgggtcgacccagggtgcactggttcctggactcgtttgaccctaaaattatatgggtcgacccataaaccttctggagccgaattttgagggtcgggccagcggtccaacgggccgacccgccccatttgcaggctgacccgcaatggtgatgggggtgatgtacacaactgaaccaacataggcaaggtctgacgctaccaaattaacaaaaggggcaaccaggtagacgtggcaacaggtaggaacttgtcaacgccaccaccttgtggccgcttaaattcccttccacaattacttcttcccggtgatgagggggcatattccttctcgccccaagatggcaaactacgcctcttcttcccttcctgagatttgcccctatcgccccctccattctctgtggcactgtgaatttggggtgcaatccacgtgcctttagctgccagtcgccatgggagaggatggaagaaaggggaaggaaagggaagccaaggcatcatggcatcctacagctctatgagagagagagagagagagagtacggagggaggaggaatgggaggacatcttcaggctaacccaaccatagagatgcttcaggatggagagatcaagaagagaggatgctagagaggtaaacaagcagcaacagcaacactaataggtcggcctcaccaattttttttattttattttgttaattggattatcacatcagttaaattattgcctacacatgttacgtgaaaccaaaaccgcattggattgagtgagagagtacttcattcggattgaaaagtttagagttaaaaatgtctaattttgcggtttatggggtaaaccggactaggccaaaagttcagtgtaagtcagacatttccgtttcaaaacagcggtttattgatgccgcgatacaccattaatttattttatagtgattgaagtatcatttacagattgatgccgcgatacaccattaatttattttatagtgattgaagtatcatttacagattgatgccgcgatacaccattaatttattttatagtgattgaagtatcatttacagattgatgcagcgatacaccattaagtagtaacctagaaccattaccagtccagattaaaggagcaacttttccagtaaaaaaaaaagagcaactttttagcaccctaaaaactactccctttgtttcgaaatgtttgacgccgttgactttttagcacatgtttgaccattcgtcttattcaaaaaatttaaataattattaattcttttcctatcatttgattcattgttaaatatatttttatgtaggcatataattttacatatttcacaaaagtttttgaataaggcgaacggtcaaacatatgctaaaaagtcaacggtgttaaatatttcgatacggagggagtataatggtgccagggtgcattcatgcaaaagttgcaaataccacctttgataattttcccaacaatgacatcgatcgaccgaagctcgaaacgacctacgaaactacgtacacttcatcaatttgcggctaaaaaaaaagatgaattacaccgtcgtcacccaaccccccttgctttacatacatacgcgtgcacgtacacacgtgaacgtacaagttgtacatgtgcatgcatgtacatatcagctagatgccggcgccgacgccgccgcccctcaggtgctcgcgcgccaccgccgacgcgccgtggccgtcgatggcggccatggacatcacggcgagcgagcgctgccggcacgcgtggcaggtcacctgcgcgatcaggcgcgccgcgtggtcccgcagcgcgagcgccttctcgagctccccgcgcgcccggtggcgcgcgcggcgggcgtcctccagcgcgcgctccgccgccgcggcctcctcgcgcgcccgctcccgcgccgcgtccgccgcggtcttctcctccagcgcgcgcctcacctcttcccgctgctgctcctcctcccctcctgccgccgcggcgcaggcgccgccgccgccggacgccgcggcgacgacggcggcggggccgattgagagctgcagcttcgtcgttgtcatcgtcgtcgcgtgttgctcgtgggaggaggagccggtggtcgtggagttggacgagaacgcggcggccaacggcgccgtggtggacgccgggaggagctgcagctcaggcggcggcggcggcggatgatggtgatgatgccgcagcgccgcgggacggatgaccggcagcgtcgtggccacgggcacgacctcaccgcgcacacgtccagagttacacgcatcctggtgctctatgaagctctccactctgcaaccaacacacacaaccaccgccattagcacacactaatcataccacttaaccaccatcttatcaccaaacacaacaaaaacacggcgatcgatctgatcgactgattgatcatctgtacatgtagatcgatcgaaagcaacgcatcgatctcgaacaagacacacactgacagatcgatgagagcatgagacaaccagatgaaacccatgggatggaccaccatatgccatcgttaaacccatcaaggaagctagctacgttccattgctgactaaatggccacgcgcgaccagtccgtccaagggaccaaccaacagcagcactgtacacatatactacacacacagctagctagtgatggcgcctgcacttacgccattattgatcgagctagaaaaccagtcgtcgacgacgacgacgacatatggaagaagcaacgatcatatcggtatctgcaggggaaaacatgctgcatatgctgctgatgctgctgctcgtccggtatatttatgggctggtcagtgacaagagagtgtggcttagctactgccaattattaaagcgatcgcctagtgggaagctcttgtcctggagagaaaaaaacagaggaggagatgatgctgttgtgtgtgcatggatgatggatgggtgcacatggtggcctgtgtatagcttagctccgggcgatctggtgatgtgccccgtccgcgcgtggttgtactttggtggtggatccaggggtccgaggaatggagcagcttgtctttacctacctagcgacctctgcttcgtcaccttgcaccttgcctcgtccacatcatctcactccctaggacatctacatgtagtactagtgtccgttctattacgggatcaaacacacattctaattctattactgtaaatctaggcaggtcaggattatcctatcacgtacttgattgctatatttgatagagatattatatacttcattcttaaataattggctatgtcactatacaggtttaaacttctggtaatttttctggaaaaaaataaatactacttaaaaatatgttatattaccgaagtgtacatcatcattaatataaccacacaagttttcttaattataatgttctccctccgtttcaggttataaatcgttttgactttgatcaaaatcaaactgctttaaatttgactaagtttatagataaatatagtaatatttacaacaccaaattagtttcatcaaatcaataattgaatatattttcgtaacaaatttgttttgggttgaaaatgttactactttttcctataaacttggttagatttgaagaagtttgactttgacaaaacaactgataatatggattggaggaagtaattatttaaaagtaatttgtggttaaagttacgtgacgatagcagttactacagccacctgataagttttcacagaattaagatccataaatagctgctagtaactcgcatgctaaaatgctactcctacaagctattaatggctgattagctctggcaggcattatgtttgcacatgaacaaacagtggcgctcatgttttacttactttgagttaggactacaacaaccagccatcttatcagcgtaactggccggaagctggagctatcgctgctactactacacttagcttagctgttgggtgaaatgcgcagagacagtttttggtcgatatgcggtcgctttcctgtaggaattttcggtcctaccgcaacccgccaccgaaacgatcatatgccaggcgtctgccctgctttttcatctcttccatgatctcatcgatctcctctgatttaattttttctctccctttttcagtctagctagaaaatagttttcgattaatctcgatggatatatgcgtactactggaccctagctacctagcaggatgtatgtatgtaagtgatcagcatgcatcaacagcaagaacctgaagtagtagtaatagtcccgatccaattagtccgtacataaatatgctctttctttggtcagctagctagccagttaaacaacggatcgatcagatcaaactatagctagtcaattggtgtcggctacaaaaacacacatccttttaattttctttttttcttttttctctctccgagtggcgatatcatatctacagcccagtggcaggttttaaaccctgaaacgtaccatagcttttgtcttatctccatgcaaccctgtctcccaccaaaaacaattcgaaattcatctctttaaatctaaatactccaagatctaattacgtatgcacataatcatgatatatatccaaccacccaaacgtcatcgtatcaatcgctaatcatggatggttagcgttcgtacgtagtagtagtagtgcatgcgtcgccggccgccatgaacgctacgtaggtttgaggaggaggagagggggtggtgtacgtaccgggagaagacgcggccgcagtcgcaggagtggccgcgggtgccgcaggtcttgaggtgggccttgtagtcggactggacggcgtagcccttggcgcagcgggcacacacccactgccgccggccgccgtgcttgcgccggaagtgcttcttgatgccgacgaggtcgcccagcgcgtgtgccgggtcgtggtggaggcagctcggctccgggcacacgaacacgcgcttccgcgcccctccgccgcccgcgccgccgccggcgccgccgccgccacccgcggcgccgccgtcctccgccgccgtcgccgccgcggggcgcttgaccagccgccacggcaccttgtgccggcgccggtgcatctgcaggttctgctcccgctggaacccctgcccgcagatctcgcacacgtacctgtccgactccagcagcgtcctcggcgacagcgccaccacctccgcatctgggtctacgtacacacgggctccatgatcgaacaccatgcatgcatgatggtatcaatgtctccaacacatacgtatatacgtacctggcgtgccgggagggcgcctcttgcgcttggcgggggagggctggtcggcggcggcggcggcgaggctggaggagttcgacgccggcggtggaggctgctgctgctgggaggagggtgaggaggacgaggtggaagaagaggccaacatttggtggtggctcttgaccagtgccataactgcaaggagcttttcttctttttaagggagaggatcactaataagcttaagcttaagcttatcaccacaataccacttctagagctagagctaccaccacaagaggctagatcacagcagctacttctactactactactactgcctctgcagcagctgccttggtttggttctctttttgctccttagtgggataggggtgccaagggaggctttatggggtggaaaggtgaaggtgcattgtgtgtgtatgtgtttgtgttgtagaaagggctggggcatgaggggatcatatatagcttaagccagggagagagaggggttgtgtgtgtgtgtgtgtgtgtgtgtgtgcaaggtgagatgaaaaaaagggctttgtcaatatctctttgcttttgtgcctgcatcggtgtgtgggtgttggccccctttttttgaagggggaatgtgtctcatatactcattggatgggcagcttttatcaaggctttgtttgtttgttttgggggtttattaagatgggatcatgagggggctagtctctgccaaatcgatctcgccaacgcaattaatggagcactgtccattaccttcatcataacttgattagcaagctgatgaccctctttgattagtctctgcgtacgttttaatttcctctcgacccccctctttgccttcttttctgttgtcctgacaggagtttggcagctagatggaaattcagttcacgcattcttctttatttatctagaaatacatatatatacacactaaaaaaaatctactccaaaacgccacgtatatacgaatgcaaatatatatatatatatatatatatatatatatatatatatatatatatatatatagttgttgatgccgtggtagatagctgaccggagatgaaattaaagctagtgtttttgccaatgataaactatgcagacgaacagctcatccttgtcaccgaagtgattgctttgctgaaaaaacgccccaactgttagtgatcagcaatgggggtggtgatgggggagaagattcttcacacatgcaggcgatcatttttctcccacaagtgcccccggcccttgccttgatcctatctaggatctcccttttctctctctcgctaaataaactagcctcgcaatgagatggcattgacatctttctctcctcaaacaactaaagtttatttgtctcttggcttttcctccctttcgactttctgctaagatggccgcatgtgtagctcattaacaaaattttagaagtaagttgcacacacatgtcttttttaatactaccatgcatcatccggctactgctactcgatctttacaatattcagaagttgtccttttggcgaagctgcatgcagtagtacgcatagattcgatgaggaggaggagaaaaagatggcatctttttttggaggaaactaaacgatgggccggcgaacaatccatcttcttttgaacagaattttggcaattacttttggactttgattgaaactaacaaatactagtactgtactttgcacaatagctgctagtatagtagactagtagcagctgattttcatgacgaacagaggactggccctactgaattcttctatctttgttattgatctcaatgctagaaaacgtcatataaaattaatagaacgcatggccagattgtttggtagtatttgttttgatctcctgtatgaaaatagtgtattcattgcatatataaatttaaggggaaaatgacaaaatgtcataaactataggtgtctggcattcctttcctcatacatacgcatgcatgcaaacaggactgaagaaactgtactatattctgaagtgttaattcgatgatgagtgccatcttgttctctctctctggctggttagcactaagcatcatcatcaacaagtagactaccgtatattaacatgcgactttgtgtcgtcgtacgtttattgattttatatagcaaaaagaaggtgttattaataagaggttatcaagaacatatcgtttcgagcagtacctttctccctcctcgttcgcctgtttcatcatttaggtctccatgctatgcaacatgctcgccaaagtttgcaaaggtagagagctgcttttatctctgggttgctctcagttatcgcaatcatcatgctatagcatttgcaagttcgtgcatgccaatatatattgccaatgccaatgccaatgccaatgtgtgtacatgtatatgcgtagtagtagtagatcaataggatgtcctcgtgctctcgaatcccaaccaggttaccaacatgaactagtgcctacggccatgtgtgtcgatctataattattctcgtgctttttcagactttcaggcttcagagtccatgccgccatccttcagaaagataaattttcactgtgcaagtatactggggagctcgctttcaaacataaatttcagttcagcaacagtgtgtttgtcatgtcatcagctaaacacatcttgcatttcagagtttcttttcagctaaagacactggtgatcaccgatatatcgggtacctttgtaaaaagtagggagaccattttaattgctaattgtggatttcacaagggcattacacaaagtgagtttccttctctgaaagagagaacaacggtcgtttgtaacttgtataacataacctttgtcagtttattagcataggacatagattagatatagcatgctagctacatgtcctcattttttaaagagtagaatacagagcctgtacttaaaacttgaaataggctaaatgttggtttataaacctgtaaaatatgtatttgtatcccttatattggtttggtgtatcgccgaggtccaaagtgcatatgatgcaactcgggcactgacgtagccatccatagaccatagttgtgagaattttacatttacatcctcaattagagtatgccctaaaattgactcctaccacttccaaaccgactctcaccatgcccatgggagacgaggggaagaaacaacgattaggatagttgtgatcatcggcaattgaaggtctagggagacgaattgaaatagatgacacgatcgggagaataaggtgatcatgcaaatccggtgtagcgttattgtcaccatgatcctcacgcattctaggtccaccatctgccttcacgacgacaatcacgtcgcatcgggttcgtgggatcatcctcaccctaccttctatctccgtctcttcacctcctctttcataggtatgtttttttttgcggggtcataggtatgttttgttaagagtgtcgcgagtcaatttgagagtatattgtagtggaagggcctaaatgcaaagttcttagcatcgtgaaaaccgtgtggttaccctaaggtataacgtggtttcaaaaactgaaaaggttatcgcacgtgatcatcgcgataactacacggttttgtaaacagcagccgcagcagcagctagccgtaggaattccctggttacgaattccggagcactaccatcgctagacaaaatcatttagaccaaatcaaatcacccccaaattcctctccccaaaagagaaatttggaacctcttttgatcactcctccatgcatcatcccattcccatgcagtgctagtagccgtagccaccgatttacaattaggccatgcatgcatagctgtcgcagtaactttctttctttcccctctctctttctctgtgtattccagggccgtcgtctctctccagtccggtgtccaaccccgcacaggcagccgcacctgagcgcgtagctcgcctttctctctggccgatgcaatcatgcagctccccctgaaatgacctatcaatccggcgcggcgcgcaattcttcgctgggagagaagcatcaacgacaccctgctcctgctcccccccccccccctcacactccacagtccacactcacccagctcgatcactatcagtgtcggtaaaaaaacacattcccaatcccaagctaccatttctcgagcgaagaaacggccactgtgcgacgcaacgcaaagtttgcaagaccatggcgaaaagaagaaagaaaaaggcacctggccgaagcatggaatgcaatcagtcctatgctgccgctgcagctgcagctgcatgcagcaaccgagagcgagagctagcgtaggagtagtagtaccaggtaaggctgtgcctggctgctcgctgcggcatgatctgcaattcctggcaatacgcaggaaagagtgagagagaaaggaaggaagagagagagagagagatgcgtgtgtccaaggaattgccgactaattgagcttttctgcaacgcggtaaaaaaagaagggaaaaggaaagctaagcgcacgcagggatgctgcagcagcagggagaggggggggggggggggggggtaaccacgctcgtgatgattatactcgctcgcctggtgcagtagaaaaaagacgggcgagctgtgatgctgtgtgttcatcagaatcggcgcccgtttcctgcgccgcatcattctgcctttcggatcttttttcactcacaatctttgctccatttcgtgctacagtagctgttactactaccctcctgttggctgttaggctgtgtttagtttcaccggcaaaaaatttgccgggtcgcatcagatatacggacacacatttgaagtattaaacgtagactaataacaaaacaaattacataatatgtatgtaagttgcgagacaaatttattaaacgtaattaatccgtcattaacaaatgtttactgtagtcccacattgtccgatcatagcataattagacttaaaagattcgtctcgtaatttacacgtaaattatgtaattagttttttttaatatttaatactccgtaaatgtgttcaaacgttcgatgtgatggggaaataaaatttgctgatggccccccttgtaaaatcaaaggtgtttttgattattattctgtgatgaacaattgggcatcgtagattattggttttgttatttggaatctattcacgaagtggttttggagatgattggatttcacatgtgatcgcaggattcgtcattttatgtgaccggtcagaccgggctgtgtatgccggtcagaccggcggtgatcgagcggtcgaaccggccagcccgcggtttgaccggccgacactgtgtcggtttcggtttcgggttgtttgtttggatatccgtgattatttcatgattatgacttctagatggatactatacgtatgtaatactgttgtttgctactaatgagttaagttggagatagcttggtatcggaatatggtttctttgtttatttcatgtgtatgtgactcgatgcctcgggacagtatttgcggtgatggaccgggagtcggcttgggaataagacgacgtccgtggtggtcagagatcatgcgggatacttaggctagagttgatgcacgttgttgatggagatttcatatggcatacgatggaggtattgtgtgcgtatgggatgcggagtcaaatttggaaggagtccaaatttggtacgattggttatgtaaagtttctttcttgtactagagggtttcctaaagtgtttaggacttctagtatgagtttggttcgtggctttaggctgcctacctcgggtataaatagagggggagcgtgaggcttcccggtatcgctttagagagcaattgagttgagttttgagttaggatttcgagtttagtcgaaattttcgtaaggagtgctgttggtgcactttgtaaacacagagagaatcaataaagtcgtcatccactttaagagttcttcgatttgtgtttaccgggtttcggcggtctaaccggcgatctaccggcggtcagaccggcggcatacgggcggtcagaccggcggcggcgacaggcgcggcaggcaacttcggcggttagaccggagattcaacaccggttagaccggcggcatccactcggtcagaccggtagattaatctcggttagaccgacttgcgtcgatttcgagggtaacttttatttccgctaaaagttttcggtttttggatataccaaccattcacccccctctggttggcttaattcttgtgattcgatcctataccccatagtaatatttttctctaaggtgtgaagtcatggtcaaagggccctttttttcagctatactgtgtcactgttcttaggtaatttgtctctgcagaagaggactgtagcatgatgtgtttgggcacatgcctgcatggtgcacttgtgtggatttggcaagttccaagaatacccttttgtccttttcagtattttgcatatccatgggcaattgggcactctgaggtgggggtaatgcccattagtgcagtagttaattaattagtatgtatgcatatattcagggagaagcaatatatgttggccggttattcataaaaatagaaagattatcactgtatatgactgttgaacgaggtttttatatagaatatgtatgtcggtctatctgtgtatcagtatgctaatttgtcattacaaatgagctgcaacgttaataaaatttaagaatcaatcatcgtattatcattgtcgtggaacatattaaaatatgtgttaaataaaatatgtcattgaaaataccattgactcgtttgttttagtaaaataaatatttcttaaattcacaattaataattatgaaattgtagcgatcttgcaacttaatttattattataattattattaatttaattctaaaatataaattattaattacattttctagaaaaaaatagcaatttctaacaagttgtaatcggcataacttttctgttaatctaagggtacaattgaaaactatgccaatatattattacatgattgcaaagtaagcgtaactcaacttgttaagttttttgtggtggaaccagttcacctgggttcaagtcctatgattgacaggagtgctcgtatttacggctaaatattctttcagcggtaaacggcatatttgtcaacagcgagacatatgtaataacttcgtcaatctcaagacatgtcgatccagtccttgagggtgctcatattggtagggtgtgtgtgcgtgttcatagggatgagtatgtgcacgttgtggacgcctacgtttgtactctgtttctaaaagagtaaatttcataaaactacatatactttgcacattctatcacaaaactacatatttaagaatttattttacaaaactacagatttagtgtctatgtttatcacaaaactacaggtactttgcacaatacatcacacaactacagatttagaaacttgtttcacaaaattacagatttaatatcttcatttatcataaaactacaagtttagtgtcttcattatcacaaaactacatgttttagcattgttaaaacttgtagttttgtaataatggagacactaaacctgtagttttgtgataaaagaagacactaaatgtgtagttctgggataaacgaatacactaaatctatagttttgtgaaacaagttcttaaatatgtagttttgtgataaattatacaaagtacctgtagttttgtgataaaagtagacactaaatctgtagttttgtaaaacaagctcttaaatatgtagttttgtgatagattgtgcaaaataactgtagttttgtgaaatttactctttctaaaaaaagtatagtagcatatatgattaatttttaatatatataataaatagagtctatgcaatggcgtggtaactaattggtttaatttctacaggaattaggaaaccttacattttactttttttaaaaaagggctgagcatatcaatcgatgaaacctttcaagtggaatatcaacagaaaataaaataaaaaacactggagagctgaagaagatgaagggggagctttgccaagagaagggggtgtcactattgggcctggtccccaagtctgtcctctcggcccgtttgaacttagcaaggtggcccacgaatccgatggttgagatctgagacggcaaggcgggcccaccctgtgcttccttgcacacgtagactggcctcccccctggacccacccattcttgcttaaccatcaatgatgactacgaggcaagcaggatacttggcccagctaaagagctaaccatcattgtgtctctctctaattgtacttgcacatttcgtaatctcaactacatatatgtgttcaaatgtagtagacgagcttagcttaattttaggatgacagtgagatagggataaaatgtgttaaatcttctgtagaataaaagggagagaagactgcagcgtatactgtaactgatgaatagccgggtgataaattgacaaaaggcagcatgttaggcacagggaagaagcacccaagtggctctgtgttgataggcatcaagaacagctattcccattaattagctggccttggtgtaaactcatgttaacccaacagtcacaactcatcataacttacatgcaacacagggcatgacaagcacttgagcttagtttttcagcgcgcccatgtctccatctgtcgggggtggctttcagacctcttattgctgcttaataattaataacttcaacttaatctgatcagtatgaaattatgaatgattgggctagcagcttctaactaactaagctagatctagtgtaccggccgggttggttctaattaagggggaaaactctgatgttgtagtttaatcattatgcttagctagcaggaatcgatatatgcctaactgaaagagttcagagaattaacaatacattagtgcaacgaaatatatatcaattgtggtaattaaggttaaattgtgcaggctaatctctgaagaactgatataccaacctaatgatttccggcttggtaacgaggtttagggtactcctacgattttgctagttagctagttgcacttgaaaaaggtaggcatgcaacagaactagttttggtatccttcgattgaactaatctgccgacgacgtacgcagatatatacggatggagtacggtggccaatgcaacgacaaggacatgctgtacagtagtgttcaagttgttatgatcctgatcgatccaagttataatatggtacggttttggagagcttataatctggtacggttttggagagcttaaaaaatttgagaagtagctggctatggttggtaagggcaagttttatagtagaggtggatgtcacatctaatttgaaccatgtcatcttctcattaattaagaggtaacacatacaaaatatcacatctaatacacaaaccccaatattagtctactctcacatcatctttcacttttcttggagattgtgtagatgttgccccttgcatgagggatggctcattctctctctcctaacttctctcttccacctcattatctaatcttatgtggtaaatttaggggcgcaatatgtagaggcttatagtacttgccctaaccactttctaagaatctagagaagttaagaagaattctagtttattttttagattctgtaaccatatgttcataaaatctgaataaaaactgaatttaataaagcctttaattataggagaagttaccgttgtcaaaagtttttctaaataggcccttgacaatgtttgcaatgtcccctccccccctccctctaccacatagtatgaaattatggcgattttttattttttgtgaatttggttaaaatctatttaaatttagccataaccgggcagaatttaaaaacaaaaatcgctaaacgaactccaaaacatctgaaatctcggaagttctgttgcccagcataaatgttcaaaacacctagtcatagtaatatcttacgagttacgataccatggtcctatcaaacggcacgatgatcttgatcctaccataaatatgttatagtatcatgttcccacataagagtattaattgattccataagatcggtggacgatcttacctgggatcccgataatatgattaattatgctattgttcaaaactaaggtggattttttttaaaaaaaatgaataactctactcaagtttacacaatttaacaaaactgatattattgtattaatttttttacaatgtattataacatttatataaaactatgcactttatgaaaatatgacaggatcatgatcctacgtccgattctacgattcaatattgttagaagaaaacgatcttacctaatattatattatcgatcctgcagatagctttgatgtgttcattgtcacttgtcactgctgcctgaaagtttcgagagatcgccaagtcagttaaagccaaacgcttggtgttgaaatgccggccggtgcgtgtgcctacgcacgtggacgagccaaaaaccacgtagtacacacacccactagctagctcttgttctgatatatatattctccttgcctgagctctagtcgtcctcagccaggtcggctcatcgtcccgtcgaccgacgatccatcgatccatccatcgacagatcgagggtcccttcaagctcttaattaatccatacatgtaaatatgtaattcgaacaataattaatcttgactcggcgctcttctcggtctctatggttttggagtctattctctcggagagtcatgtgtgatctttcgctggcgtagttgtttttggggttttttttagtgtagtgtggctccatcttcaccatctcgttgattgaagtagcttttatccgtaatagtttctctttcttttacctagttgtagcttttgttttttcttttcttcccacccctgatataggtttatccgattgcgttgtgtaatagaaactatcagtctgtctatctgcagctagttgcatacacaattacatgtaggctacagccacttcgatctcgatatctccaaagaacctgatcactaataaacgatgctaatatatattcccctcgatcaccatccgatcgatgcccgaaacgtacaactagtcaactaggtagctagcgcatgcctagttgcatagttgcgttgcatcacatgcatatatacaatgcatgcatccatgcacccgattaatcacagatagctagctgcgtccgtcaccgatcggcagctagcaagtagcacggggtacagtcgcaatgctcatgctgtgccactgtcgggcgtacgtacacacaaaaacacgaacacgcaccagtcacttcttggacgatgcaattaatcacagtccatgcaaattaaagcacggcatgtgattgatcatcaagaggccgatcgatcgagatcgatcaccactgtgtacgccgtgcatgcacgcaccgatctcatctcatcgatctcatctgatcgatcgatctagcagctaagctatcagcaggtggaattggaggaggagcggagggaataaaacggtggcaggtcgggtacaaacgcaaggcaccgcgagatcgccgtggcaaaggaccctccgggtgcgcggcgacaaggggatgcgaccagccgcgcgcggcggctgctctctcgatcgatcgatcgatcgaccgagagccctgtggcgaaagcaaagggttgtagctagccagtacacatgtagctatggctagcttcaattagcttaattagccgtgcatggtcgattggccggccacccagcgagtcgccactgtgctgcagccggccgtgcatgcatggctagctagagctggcccaatgcagagcacgatcgctcgcgggcgagaggaatgaacagtgcagctgcctgttcatgtcctactgattaaagccgttgattcccagcactttggtcactgttcgacgctagctcgacatgtgtacaatgggattgaaaggggacagagaacgatcgcgacagtacgtacttgccgtcgtcgccgtcgtcgtcgtcctgtgccttttttgtggacagggaatggccttgcttggcctcgatcgatgatgcatagcatagatagcatcctctagagccaagccagcgaaattatatatgtctatatatgcacatgtacgctttatataatctgcatatatgcaagtatgattatatagtgcatttagttatcaacacattagctaccactggtacaataacaatttttccgtgcagtcagaatcggttttcgcgtgcggatcttccacccgtctggaacgagatgtctgcgaaaatctgattttttttcgtacgggtgcaggcacttaagccgcccgcatggaaaaataaaaaaaattaaaaaaacaaatcaaaagcggaaccctaatccagcggctgccgccgccgccgtcaccactgtcatcgtcgctgccaccaccgttgttgtcaccgccttgcccgaggcccgatgctgtcatccccgcggttgctggcgatgaatccagcctccccgcgatggccggcgacgaatcaggcctccccatggtggttggcgacgggtccggcctcctcgcgatcgccggcgacgaatccggcctccctgcggtggccagcgatggatccgctccaccgccgccaacctagccgttgccgtcgcctccattgtcgtctccgggatcaggagatgggaggagggtgaggaggagagggagatgggaggagtgggaggagttgagagtgatatgggagtgagtgggatgggcggcaactgcgggattaaaaatgtaggtgggctatttccgtgtgcgggttatttaacaggtccgcacgcgaaaataagcttattttcacgtgcggacatgttaagtggtccgtctgcaaaaattaattttaccgtacagtcattttaaagagctgcacgtaaaaatagagcacgattttttacagacgcgaccggttacggtcccgtctgcaatctaaaattagtcccgtccagaaaaattattccggtactagtgtacaatctgcatgcagattgcagagtactgtgccatagtgcgtgtcgtcagttttggaagaagaaattaacaggataagctagtgggttcattaatattttggtaggagcatatactctctccgtaaaaaaaaactcaacctaagactgaaatatgagataatctagtacaacaaatatggacataagttatactagattatgtgcttgtttagttcccaactttttttttcaaactttcaacttttccatcacatccaaactttcctacacacataaacttccaacgtttttctttaaacttttaattttagtcaaacttttaattttggtgtgaaactaaacacaacctatgtcacatcccaattctcggttgagttttttttggacggagggattacatttcttttgcttcgttacacacgttcgagtccatgcacatatgaccaagcaaggcagggcacagcctatagctaggtacgtgtacgtctcccctggataattaagctctcagtagtgtggtactacactactacacttatgaacactgctagggatagcagaattcagtggtcgctgtcgtggcacagcgttgcgcatcattgcacacgagagaccaaaggtgtacaaacaaaaagcgtcaagggggggagaacagcacaagtcacacccaattggagaaggatttggatcaaggggcttgtcacgtagcagcaaagagccatgagacaagggtgaaagggacaaactagagtttgtaccgccaactctttcccgggagcccccagatgccatcgccttatctttgccctccaatctttggacatggctaatccaaatcattgaggtagccctgctgctcaacagagccatcgagcgaattaacttaacaaacccccccccccaccccccctcgatcgatcttgcaaaagctaggcaacagtcggagaacacgccatgtggaactaaattaactttgtgtaaatgcataatggaatcttaggtttgcctacatgcctcctagttgtagatagagtcatagagagggatatttatgacctcgttggtaaaaaaaaattgctaacatattgttggaaaagaaatgacggatgttaagcaagtgtttctgtgaattcttctgttcctctccccttctgagggttacatttatatatttatacttagtggctccccttctcagcatgctccgtattcggtctgactccagattatcggagccacgagctcctcctcacgctaagggggaaaccgctctattcctcctgagccatcgcctccttagggtcgacgtgcttgttgcctgaaggacaactcaacctccgacggatgaccttcccaacggaggccctccctctgattacctagaaaggggcgcgagggtcggagcccttccccaacacatataatatattttaattttttaacttagcaagatttgaaggtgatgatcactttattaacctaccaggttttagctttatcaaaatttggcaagctaccaaagtttgataattctaggatcgtcttctcacaaaatcttgacaaatgtggcaaaccaaatacaacttacacatctcaaccttaattaattactaaatattggtaatgctaaaatttgccaatatcaatatttgatcaagttgatttaggaatcaaagtgaactcccctataaatagagttatattgttaataattcatacttttgttttctataaacaaatagcgctagtagatttagtaatgtgttagaaaaaaatggtaaaaaacccgtagatgcacttcttacaattgtatttacatgcagttattagcctacatcacgatcgagaacgattaacgtgctcccatcgagtggtcttctgacaaaaatcaaggacgaggccaagatatgggccttagcagacgcgcatcatctgagaaattggcttgttccttagttgactagggccaaaggtcctgattttttttctttccctttacactgtacagttttctccttctatatttaatgaaattggcggttcgccgattcaataaaaaaataaataaagaacgattaacgtggaagtttctaaaccctaagtacacgtgcgcagagcacacggaacgtggctctttttcctccaaatataggcgttgtaatgttccaaggttattttccgttacgaatgtgtcgatgacaaatttatcaacgtactacgcctttaattatatgacctcacacctaacaatacactgacaatagcagaaaggaatttgacaaacaccaagcattatatattctcttgagcgtacaaaatgccagccttcaaccgcaacttgcaagtgatcgatcactgcatattttgcaatcctaattaattgtggaaaagggaacattctcattgttgtctccctgtcgtgggttgtcgctttcaaggggtgatcaaacatcagtgtctcttatcagaaccagatcagctagctagctggcctggagatcaagcctgacaattaagagagggcgaaaagaaaaaaggaaaaatcattattgtactttgggtcagaatttgttacctaagtctgcacattatattgtactttgggtcagaatttgttacctaagtttgcacattaatataattgcattatatcttagttccttctttaaatatatatcagcgtatatcttatctctttccatcatttagtttaattggacgagttttatttcattttattgcactttcaaccaggtagatctatccttaccacacttgcggaccagccacctcctcctttattcatcgctgctataccatttcctcattaacacttcctcatcatctctactatatatgtaggattgaaacataagaactaagccaaccagaggagagagggtaaatggttggtataccaaaaaaccgaaaacttttagcggaaataaaagttaccctcgaaatcgatggaagtcagtctgaccgagattgatcttccggtctgaccgaagcgtagccgccggtctgaccggtgttgatcttccggttggaccgccctggaatccctgccgcgcctgttgtcgccgctggtctgaccgcaggttacccgccggtttgaccgccgtgatgccgccggtctgaccgtcggtgtgtcgccagttagaccgccgaaacccggtgaaacacaaatcaaaaaactctaaaagtggatgacgactttattgattctctctgtgtttacaaagtgcaccaacagcactccttacaaaaatttcgactaaactcgaaaccctaactcaaaactcaactcaattgctctcaaaagcgataccgggaagcctcatgctccccctctatttatacatgaggtaggcagcctaaagccacgaaccaaactcatactaagagtcctaaacaccttaggaaaccatctagtacaagaaacaaactttacataaccaatcataccaaatttggactccttccaaattcgactctgcatcccatacgcacacaataccttcatcgtatgccatatgaaatctccatcaaccacgtgcatcaactctagcctaaatatcccgcatgatctctgaccaccacggacgttgtcttatccccaagccgactcccggtccatcaccgcaaatactctcccgaggcatcgagtcacctacatatgaaataaacaaataaaccatattccgagaccaagctatctccaacttgactcattagtagcaaacaacagtattatatacgtatagtatccatctagaagtcataatcatgaaataatcacggatatccaaacaaacaacccgaaaccgacacagcgtcgccggtcagaccgcgggctggccggtctgaccacgcgcataccgccggtctgaccggtcacataaaatgatagaatcctgcgatcacctgtgaatccaatcatctccaaaaccacttcgtgaataaattccaaataacaaaaccaataatctccaatgtccaattgttcatcacagaataataatcaaaaacacctttgattttacaatctcccccttgatgaacacattggcaaactcatcaaaaatgttttggtgtttggaaaaataaaaacaaaagtggtaaaaagcacacttcgtacaaatgtacacatcgtgctcaaaaatcaaaaagaaaacttatcccccttattaaaagaaagaaattccctcatgaaccaaaaacatgctcttctcaacaactccgaaaatacaccttgcttctccaaaattccaaaaataaatttcacattacttctcccccttttgacaatgatttcatcaagcataggaattatgttcattaatgttcaagagcttagcatacatatagcatatcaagtcatgtgttgcaataaaaagaagataaacccatctataacagaacaagcatgcattaaagtataaccatgaaccaaagattttacaattaagcttgaatcaacaatcaaaattcatgatttcatacgatttgtaatgcaacatcttaacaagcacataggttgaataataaacactaaagacatatacctattgcatttatcactctttctcaaataacctttagcacaaaataaccaagagaactttttataacttttctttttcttgagcctttttgctcatatttttctcttttattccgggtacgtccctgtcgtcaagattgtttccagggattcggcacccattattttgctcacatcgaatacgtccttgtcgtcaagactatttccaaggattcggtattcatttttttcatattttttattctccttttcacaatgagcaattaaagctatttgaggaataacaattcaacaaagcatatatatagagcatttatagatcaaaccatatgctagcatcaacgttgcatattttcttaattcaattatagaatttaagtgtcatgcatcatctcccttaaaagcaaaatctaaatctcatgaaaagactagaatgcatacaagctatgttagagacaaataaaccttcaaagtattgctagcatgcacaagaaaataccatatgcataaacaaagctctcttttctcaattttctcattgtcatattattgcttgataaaaccatgaggtacaaactccccctcaaaccatgccaaaaggatgaattatgcccaattcaccatgaagaaaagcaaagcgattagaatccaaaggtttagtgaaaatatcagtaatttgcaacttggtgtccaaaaactacaattcaacatctcccttttcaacatgatccctcaaaaagtgaaaacaaatatcaatgtgctttgtgtgtgagtgttgaacaggattcttagcaatgttaatagcactagtattatcataaaagagaggtaagtaagaccataatctttcaaagtagataaaagtcaaagaatctgtgaacaacaactagcagcagcaacatattcagattcagcagttgattgagcaacactagattgtttcctagaagaccatgcaatcaatgacgtaccaagaaaatgacatgttccactagtactttttctatcaattctacaaccaccgaaatcagcatcggaatatccacttaagcatatagaagatgaagtagaataccaaattccaaactcaagtgtatgattcaaatacctcattatttgcttgaccgcttgacgacgtgaagcacgaggagaagcttgaaaacgtgcacacaaacacagagcaaactgtatgtctggcctagaagcagttagatacaataacgatccaatcatacttctatattccttttgatcaacagcttcaccatcttcatcaggatccaacacagctgtagaaccaattggtgttgaaattggcttgcaattctctaccttgaaccgtctcaaaagatccttcgtatacttcgtttgatgcacaaaagcaccttgaggtgtttgcttaatttgcaatcccaaaaagtacgataactcacccatcatgctcatctcaaattccctgcgcatagtctcagcaaaatctacaaccaaggcgtgagtcgaacaaacaaaaatgatatcatccacataaatctgaacgaaaagttgattataaccatgcttaagaacaaaaagagttttgtcaacctttcgcattgtaaaacctttcgcaagcaaaaagttcttaagcctatcataccatgccctaggagcttatttcaaaccatacaaagctttagacaatttaaaaacatggttgggaaaaatcaggattttcaaaacctgatggttatttgacataaacttcctcttgtataaaaccatttagaaaagcacttttcacatccatttgatacaatttaaaacctttgaagcagcaaaagctaacaaaagtctaattgcttcaattctagcaacaggagcaaaagtttcatcaaaatccaaaccctcaatttgagtaaaaccttgagcaacaagtctagctttatttctcacaatcaaaccatcctcattttgtttatttttgaaaacccacttggttccaataatattatgtccagaaggtggttcaactaaagtccaaactttgtttctctcaaaattttcaagttcttcatgcatggcgttaatccatgattcatcagttaatgcacgtgacacatctttggtttcaaaagaagcaacaaatgcagattttgcacaaacatcatgaatcgttcccttagaccttgtagtccgctcacctatattaccaataatttgttctggcggatgtcatcgtggaatgtgcaaaggagccccgacttttga

SEQ ID NO: 2762 - DNA, 2946 bp, Oryza sativa
  unsure (1)..(2946): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgctcatcggagactcgggcgtcgggaagtcttgcctgcttctgaggtttgcggtgaggatcgcttccttaccctgtattgagatttctttttttttctttttagattataatttaaggttttgtttatttgaatgcatctcgtatggcaagtccccgggcaaagtggccagaagcctgtgaactttcaagacaccaatttagttcattggaaagataagaggatacttaaaatttgactagagagtatcacctaattggttttattcaaggcatatgtatgatgcatgtttgcgaataatgacttggcatcggcaacggtgacaaagtagacattgattgctttattgcttggggtatgttcattgatccaagataaaaacaatgccgtgggagatttgtaatggacttgaatttgcatgacaagttcctccgtagggtgccctgataatgttatttgctgtttggccaatgataaaatcttacgtagaatcatagaaataatcataagagtttatctgaattttgttctgctttgggtagtttccgtgaacaatttggaaaaaagattgaggtgttttggtcattttgtcaaggtctgtggcatctcaagttactatactttcgggacaagcttgtcgatactgatttagttagtagtagtgactcgcctaaaacgagttaagatctggagagtttctgttttcaatgtcctcattttccaacattacatctgacagaaatgcaaccagtaatgatgatcaagtgggagagcgtttacttctagaatcatgtgctatggcagctgtattcatagtctgcatcatatttttgtttggtagctcctcctggccttgattaaaggatctatcttctcatttcttttgcaggacgattcatatctggagagctatatcagtaccatcggtgttgattttgtaagttcaatttttccatgtgcataagtttgcacaaatgagccttttttttttctccttaatagccttttcactccatgtttgacctgctagaaaatccgcactgttgagcaagatgggaagacaataaagctgcaaattgtaagtaaaccattctagtgaaggctgtaacatttttccagactgctaagaaacttcagctctgatatgtcaacttgttctccttcagtgggatactgctggccaagagcgatttaggaccattacaagcagctactaccgtggtgcccacgggatcattgtgagcactcttcacatatgtcactatccatctcccatggattaatattaccccgtgcttgctaattatgtaatgtatgttatgtaggttgtttatgatgtgactgatcaggagagcttcaacaatgtcaagcagtggctgaatgaaattgataggtatgctagtgaaaatgtgaacaagctcttggtggggaacaagtgtgatctagctgagaacagagtggtttcttatgaggctggcaaggtatttttttgctttgtgtttccattaccctcgcataaatatcttttgacttccttgtggattataccttgttcaactggcatacatatgttttaatcattgacaggcccttgctgatgagattggaataccattcctggagaccagtgcgaaggatgcaacaaatgtggagaaggcattcatgaccatggcaggagagataaagaacaggtgacattccctctagatatttgaaggcttattctaggaaattgctattttgtgcttaatcatcatgacctcctgatatatagttacataaggaaagaattcatagaaatgaacatactattgctggaccatcattattggtattagcattcacttgcattacctgacaccttgttctttgtttgaataggatggcaagccaaccggctacaaatgcaagcaagcctgcaaccgtgcaaatgcgaggccaacctgttgcccagcaaagcagctgctgctcttgattatcaatctagatcacaatagtgtgcttgtttgtgcaccaagcaacacttaattggttgctctatccctgtaaattaagtctattagtactatcaaaaagcttgatgtgttctgtgtcggatattattggaaaaagtctgtcccctaactgtaacgaagcggcagatgctgtgggcctgttttaactgcctgttcatatttctatgtttcaagtggcatcgatgttcgactttattcgattaatggttccacttgcaaactgtgctacgaaatgctgacggagtgcaatcttgtcataccaggcgcgcactgcctccgtagtaagatattttactgtagaaatttatgtggaattatccgatgttttacgtcctttagaaatttgcgtgcaattgggacgacgttttgcattgaatttgttgatactaacaccaaactcaaattatgacgtttctacgggatcaaaatgtgattagcctaacatgctagttctactcgagttctggccgcaggatgtacaagcagaaccacatttttgtttgcaagagcaagacggtacatcgacacaatgcatactcctggatgctcaaaactttcacagcttgtttccagcaacaaacctgaagcatgaactacccttcacagcatatatgagcaaaaagaacactcaggccgcgttaccacgatcggatgcaatcagtatattcaaggtgcttattttcctccca

SEQ ID NO: 2763 - DNA, 5615 bp, Oryza sativa
tggccaatattgaacgcttccttttgttgccgaatgaactgcggatcaccttttatcccattggtaccagacaagctataaccaaagcttgcactctcaagaagtggtagatcccggtgcccatttaggacgtatgaactgtgtttctttgatccaatctccgtaaggtctctcatacgttgggatccttgaactgtgtcatcctcaaaatcatttgatgccttatgtttcttccttgatgatgaagcatacctagtgcttgaagaggacacattctgtggctgtttatataatgttaaggcctgagacaaacctttagctgactcctcttcaatatcatacagatcccttgcagtgcgagacgattttttattgagctcatttatgtttttggactttgcacaatagctgttttgggattcaaataataggccactagtatcatgttcatcagtatcatcttcatttggaaagcgagccctttcaagttcaagagcatgcatgatagcatcttccctgcggacatactttccttcattgtaggccctcttatgctggcgagcttgagcctttgctttttctatacattcctcatactctccacatcgaaatggcttcacacgcttagacttctcaagattataccagtcactgttgcaaagttaattaaaaatagtgggtaagattaaaaaaacaatagtcagatttagggtacagaaaatacatcacatacacaattcatgctaaacaaaactatagttaaatatagtgaatagaaataaaacatctcttctgaagtaacacattcagaaaaggcacataatagcattagtttatggacatgctgaacagttagaagaaaatccatctaaacctactagaagtgatgacatccatacaacctaaagtcatcgattcatcatacaacctaaaaacattgattccccatataaatgaatcttcgctcttaagtccaaagcaagcttcaggaaaaaaagaaaaaatcaggggaagattcacagacttcataccatatctgtaagatataaaaataccatcaagagagcacaagaattcaatcgaaaatttacctcctaattttcaagagaagcatgacacaagttgtctttggtgtatactgataaaagctataatcgtgtcacactaatcgatatgtccattacctcgcccaattcccatatctcatcatgcagaaaaacaggggctgagcaaaaataaaataaaatccattgacgattatagtctagaatacactacaccaccgtagataacaacaactaccgctaactgcaaacacaccaaacatcccatggcactagcagccttgctgagcttaaggcatatactaaaaattcagaaagccacccaggacaagcacaatacactatcttccagttcttcccaaatcaagaaccacatcacagtgttctttgcccaaattcagagtgggacacgaaacagaggtaggtctaaatggccataagaccaagaacagactacagcatggatcatctaagcatgcaggaactcttaacaaagagaaaggaacagaagcaaagcaatcagaagaaaaagagacaggggattggaggacgacgaaggagggaggaggtgtgtgtgtacggacatgctgccgtcggggcggccgaggagcttgatgggcgtgccggaggagcgcggcgggacgacgcagttctccgggagctcgtcggcgctgaggatctggccgggccaccaggatccgttgcggcggcgcacccacacgagcgccccgacctccgcgtcccgccccgtcacgccgtcgggccactcgctgtccgccgctcccgcgccgcagctccccatccccgccgcctcctctcctctctctccccaacccccctcctcccacctcctccactgatcaatccaagaacgcccccttttcccggtccaagaactcaaaaccacacaaccccccggaatgaatcgggagacagcgcgagattctccctcctccccgaccccgaccgcgagcgcctgcggcggctgctgctcctcctccgccgaggcgggaggtctccgtgcttgtgtggaggaggggggggagtgggggaggaggaagtggaaaagggcaaaggaggaggaggaggaggtggaggtggaagaaggtagaagggtgggggtttgggggcgtgcgtgtgtgttgattgggccgcttcctcggctgggcccaaaagcccattagggtagctttgctctgccgcggttgagagatgtggagattatcctggccgtccgattagttatggacgtcttccctgtaattctggatgttccttctaaaggagagacatggcgaattaggtatctgacaaacgcgctccgacgcataatgataagggccaggttagggtttattctaagcactttggttagcgatgtaacagattatcctggccgtccgattagttttatggacgttttccccggaatcctggatgttccttctataggaaagatatggcgaattaggtatctggaaaacgtgctccaacgcacaatgataagggccaggttagggtttattctaagcactttggttagtgaagtaactatgttctccgatcaatagaactagtcgactagcattcccttaaaaaaaaggccaagttagggttagggttaaggttcggggatggggttgggaaggagggtggcgctgtggagggaagtggggagggatggtctaggagggttgtgggtgggtggtgaggtggcagtggcgtcgtcggtgccacggggttaggaggtgacagtgggccaatattggtggcatgggacaagtgaggagaaatggagggaggaggctgacggggcagggacactgggacacgctagcatgttgatgcctttcggtgccagtgagaccgagcggtttcacggtgggggtgatggtggagacaattattgacttggtggtgaagcttgctggagggaggctgctcgtccaagacttctcgcgtcgtcgtgtttacggatggacaaagctgttgagagcgagagaaagaagataagatagagagagaggaagatatggggaggaggctaatatgctgttgggttgtcgaaaagcgttcacgggctgcgaacgctaacccattagcctacataacaatgggttttacgcacggattgattcatccagtcagttttctcttaacttatggtttgttgactgagatatgccattattttgagaaaggcgtaagataaaggcctatttggcaaggttcaaacttctcaatctaactccaggagcaaattctgaagtggagctgttgagcaacccaaaacccgcttcacctttatagttcattttttcatatcactctaaccaacttcactcccattttggtggagctgaaaccatttgtttctgagttggagttgaagccctaccaaataggctctaaatatttatagaaaatatgtagtataaaccatatatgtagtgcaaacttgaaaactaaggtaagatccaaaatgcagtaatctaggagtaaaagttttattcatgttgaagtggataaatctcagacgttaattttggatattgtagtagttttcaggtatgcactgtctatgtggtttgcactatatattgtaagatttgcttttatgtttgtttggtttagtcttagacatattcaacaacctcataatataattttttttgttgaaatgagtgcgtgtatttcaaatgttgttacaacaagagttttatgaagaacaagacaacattcacgttacaaatggaacatgagttagaaaactagtagtacacaaacacatcaatggttagtaaaataggataacatcccactagtcctcacacataagaacaggtaatgttgaagtcataaaaaaaaactacatatgtttagactttcgactccaaccataaatcatcagctgataacatcggcaaccatctcgattttctcggtttttcaaaaaaaaattttgcctcctcggaataggtgactcgtatttttattctgcacagaagctcctcgattgggcaggttaaccgacgatgttaggtttctcaatcatcgggactgttcatggatgcttgcgccatgcctagtgtccggtttagttgactagatgtggatagccccagcgtgcatgcgtgccatagagagctttgcattttttttcatatatgcgcgtgatacaatgaaatagcaaagcaatgctcccaccacttgcactttgtcgtaatgtttacaagataactctaatttgtgcgtgaaatgtaatgtgaacaacagaaaattcgatttataaggacaatgttgtaatcataacgatatgagggcattctcaaaataaaaaaaaaccgtccaatcatatccttagccggttgcctactcatccacgcaacaccttcattccatctgccactcgatgtcctcctcctgtccccaccaccgccctccttcctcctcctcctcccccctatcaaggcttgtcggccgagccgcccccatgcacatgacgctaatcggtagatcgggccaatggggaaagatctggtattttcaataaggctcagaggaggatcaaggcgtggtgatgtcccaacttgtggcgaaggagaggcgccgcggctgacactctctctccgaaagaggaggaacacgggtaacggggaggtggtaggtggaggaagcacggaaggaaatgaggtcgacaatgggatgctctagccgaatgaagggggcgccgccaccattgccatcactgtgctgttgctgcggcttctggctctcatgtgtattatgtcatcgcgactcctttggtctcccttatgctagtggcaaagccataaatttttaaagaactagttgataccccgcactttgttgtgggatatatatagataaatgcatgttatatatattatataaatggtatatgtatatgtttaaataatgtagataatgatttgacaatgcttgcatattgagttcttaaaatacaacaaaattgtaaatgacatatcatgtttgtgtgatatttaaaatactctagataattattgctagtgggtgatgatgccgcacacttacatgtgatttttttttgagggagcaggcagggagttccagcaattcattatagaagaagagaattgatctagtttataagggaaaccgaacccaaaaaccttacaacgacatggttaatttgtggaaaaccggcgaaaacaacaagctaaaactaaaaactaagtatatctgtccatcaaggaaaaaactcctaaaacgatgccttcaagaaggacatgccgaccgaacggcgacatcacccgatcatacgaatctaggttttcacccggagaaaccccttgatgtggagataaggagggctccagtagcaacgccttcaagaaggtgaacgacgcccgagagcgttgtcattgctagcattggcaagccgggcaaggatttcacctcggagtctcatccaaacaaagcaaccgcaatggaagccaccaaatgccacctacacaccaaaggtacctgttatagggggatccactg

SEQ ID NO: 2764 - DNA, 11519 bp, Oryza sativa
ggagccgctagagaggcgccggatctgggcttatgtggccagatccggctgtccccgcgcagccctcgccaccggaccgagacgaggaggccgccgatgccaggtggggaggaggcaggacactggatgccccagatctggaggaaaggagggatggagagaagagagggatgaagaaggggagaggaagagggagggaggcgccggcgccaccggcaccgccttcgctggtggcggcaacaagagcggaacgcgattggggagccccgcgcactcaggcagtcgcctccgtgtcgcccaaggcaagcggcacgggagtcacgggaggaggaaaagcccatgtgatttaaaatactctagataataattgctagtgtgtgatgacgtgacacacttgcatgttgatctttagaagttggtggtcatcatctttatagtaagatcggatagggttaagataggattcaactattgaaatgtcagttttctataaaatttgcatggtgatttaacaaaatgtaaacaagaattttgaggcagtcctagggctcaagcaccagctatcctaggcatgcctccttctcttgtcttattttagtaaattataaggtttcttccaactaaaatatttagaggatcatgtccatttattatgtggtctaggattttgtttatgaggttctcaataaagatcagggattgtatctatatcaaattgccaaagatccaattggtcactaaagattttgggcctaggatgctcaactatttggtggtgatgttttagtagtttgatagagaaatgatgtcggagaggctcttcggacctcctattatatttgagatatgaagtgaataattcaagtcatcaaacaaacataatgaaatatccgacgcctcgagagaagaatattagagacattgctaggcatttagcctgccagtcaacttcagcgtgggatgtgcccgtcaaaccactcgaaggcggcgaccagatgtgtcacacattcaggagacttgacaaaaaatggctacagatctacaacatctcaaatattcttaactcatactcatatgaatctagttcccaggatgtgcactagattcacactttcatcttaagcatggatatacatagcaaaatacatctaaaacaaataaaatttagattacaactacttaatagatacatgggccgaccggccaaatatagctatattagagaacagcggaagcttgactacccaatcctcaagcacaccgactaggggtttacctattaagtttaaatcctagaagaagcagtcgaagcccgcatcactcaaattaaactaagtctattcctgtaaaacataaattagacaaaacatggcaagactcagtacattaatcaaattaatgtactggcaagagcactataaaacctacatacatgaaagctctatgtcaaaggaaggctatttgtagtctcaattttcagcataaagccaattttagttcacaaaccatttacaacgtaatttaagcaaaacattttagcaatatgtaaagcatattaatcatagcatgatttcaacataaatagatagacatcattcccttaaaacacaacgagaagtaaggcaatcatatcacatataccaatctcatcatcatctcaaaacatttagtttcaaaagcatttagaaatcacaaaattatgcccatagcacatcatcatgtcgctcatgaccgtgagcacgatacgtgttcctccatcctaaaccatacacgttatatgacctagaaccgttaagtggcgggcccacgccttaaacttaacgccgtggtggcggacacaacgggaacccaccacgtggtacaatatcgttgtattggacacacttagacacccatgccatgagcagaatagtacactcgtcccctcacggaaatcacacatgtagggaatttatcatcctatgatcacacacacacatgggtagttcctctaggcagcccacaatacactcatggcctctacctatactacaacggcctcccgaatgcaagattagataagtgcttaacttaataggataaggtccccccataaagacacatgtggatgtatggtaaacatagtgggtgatatgatgttcggtccttaatcgactcaagtgaacactccccctatcggtatgcaactactaccatatgcatatcacttgccgcctaagtctaaaatcacattttatttcacaaataatcggagaatcacctctgaacataatgtttaaaaaggagttccaaatagtatatcaagtgactcataaccatgttttatttatcactaagcaaggctaagcatttgcactttataaaagcatagtatagtcatatgagcacaattaaagtactctaagtaaccctaaggttcaaaacagcaaggggtgattttcaaaaggggattcatgcatcttttaaaggtacaactacaatctatagttttgaaagtaccgatacttagaaatacacgtgcaactttacaatcaaaacatttagcccgaaaacataggattcaatatgttcaaaggaagggcaacacttgccttggttgatataaaacctccttgagatcagctataagaccaatcacctcaccgataacgaattcaccgtctaaaagaaataacagtaacgataaataccaaaacatgtaaaaatctaaaatgctcaagaatgcatgagtttactagtgtggttaggtactggtctaagatgaatttagatgaaagaatttatattttatcactttgcatttgagagttattaattttcaaagattaatactagcactagattaattaagctctaatagtccttaggtgcagtttaggtccatgatttatgaattgttgacttgctgcagtgaaggggatgttctcaggagttcaacaaagttggtttcacaatttttaaagttagcatgattttcctatgagttttatagtttgcttgtttcattatagaccatattagttatttaaaattttagaaatgttttagttatggtttcacctagagattagtctatagatcgaaagtgcatacctctgtgaaactaacaaaattttagttttgcccatttagagttaaaatgaattacttatggattttatagtctctagtttgcactatagtagtaaattttattaaataaacatttggtgacatatttattacagagagtgctaagttttagttcatgacaaatgagagtatgattttgtgaacattctggaacttaattcacttcaaaaagagttcaggtgaattttctataaattttataatttggaggttgctctatgttcattgtttattatatgaatttttagagctatttcttccactgtaagtgccaagttttatgtttctaaattaaagtcataagtttgtgagttcacagaaatttgattcatccagattggagttaaaatggattttatatgcattttacaagttttgggcaagttttcaattgtaaaacttggcacttacagccaattgttttgatcctattatatcaaaacatgcatatattcgaatcttttgacatatttctaacaaatttgacatatgtttcacatttgacataactttgatagatttggcttcaattgataaatttgaatcaatttaatagaattttgataaaataaaatgaacaaaatttgacacaaatttggtacaccaattttgctcttgtggtggtaagaaagcagaaccaacaaatcagaagaggaagccgagaacaacaccaccattgtctctctccccacgcttatcctgctaatccctccatgccgccacctccctccctccacacgtcggcgccatcgtcgctgcctccaaccctccgcacgcctgcgccgccccctcctccctccgtgggccggtgccagtgctgccgtccccgtctctccgcatgtcgatagctccactggcccttcctccctcagcacgtaggcgtcgtcaccgcccctcccccctctgtgcgctaaatccagccccaccgcccctccctacaccgctgttcacgccgagagaggagagagagagagagataagagttgggcaggaggtaggagatggataagattgaaggaagggtatttggttagcgtgaataataaatgtattttttcttttttctaaatgaaaccctaacggtgtagtttaaatagggtgaaacgataggttcgattcagaaaaacagggtcaattaagcaaactagaaaaaattaaggtctgattgataattagccttcgaaacatagtaaaataagcaattatcccaaagttttttaacattttaataaaaattgtttaaaaaattatcgttattcgcttgtaaccgatcagtaattatggcgttgtaggtatttgacaaaacatgttttcttggtaactagatgattccccgtaagttgctgcgtgaattgctatagaacttatgtttgcaaatttgatgataagaaatttagaatgtattgggtatatataaaaatgctagctataacttaagtcaaaatacaaatacaaaacattatacaaccccatcgtttggctgataagaggaaaaagcgaaacggcatatttgcaaatgaaaaataatttgtgaataaaacctttatatacatgttcttaactagctaaaagcaaacgctaaaagataaactatgaatcctaaaatcaactccaaatttaaagttgaaaactcaaattttggctgataagtataattataagtgaaaagatgaggttgataatttttagaaaaaacttaacatataagaaaaaaagatattatgataatatgttgataccgtgaatgatcgattattgaactgccttatgatcaaaacagaacatgtcatatagttcatttttctttaatgtaatttagagacacaactataaatgtataggctatcctatatagtatgtgatatgttcattatgctattcacaaaattaaaaagaagaccgtttaggttcattcatagcatttggtggcctattgtttgcttgattaattgaaggttgcatggttgtgcatgatgagaagaagtaaatacatgaataaaacatgagaaatccgagagaaacaaaataaagtgactttgggatgatcttagacattaagtgtaaatccaatggacgtaaataattaacgtaatgtgaaagcaccacatgagagaagatacttaataactaaactaagggtgtgtttgcatacgctggttcccaaccctaccacggaaaacggagcagtgcattagcatatgattaattaagtatttgcttttttttcaaaaatggattaatatgatttttaagcaattttttatagaaactttttgcaaaaaaatacaccgtttaatagtttgaaaagcgtgcgcgcggaaaacgaggaagatgtgttgggaaaaaggggtgccaaacacaccctaagagcaggtgcaatagcaggctataaaccggctataaacatattttgaagaggtaaaggaagagagagaagagcagcgggctacagatctgtagctagctgcagcacggactttaagacgtaatatgtatatgacaggtgggaccaggtattaatagtatagtaactaactactgtatgaattggctattacattggttatagatgatttggggctagtagtgggctatactattaaacttgctctaagtgggatttattgtataggttactagaaaaatgtccgtgcgttgcgatgggtgaatgctattttaatcatattattgttaattttttttctaaaaagtacatcctccatttcaaaattatgacgcctttgacttttcgcacaacgtttgaccatttatcttattaaaaaaattatataaatatcataaattttgttgtgaattgttgtatcatcaaataaaatataatctgaacatatactttttcatatttatattaattttttaaataagacgaatggtcaaacattgtgggaatagacaacggcgttatacattttgatagtattgatatctagtttgaaacttttattaggatgatggtcatatcttgtgtgttgctttcttatgacttggcaagagttctgaagcaattaggagtctaactcttctcctaagttaacatgcgagttttttaaaatgatttcttatatcactttttatgtatttctaaaagcaaacgaacttgaaaaccgagtcaaatacaaatgacgcaccaaaatatcggcggaaacatcttcaatttttatgtttgacatagataaattaaaatcgggaagagtgctactactaatggtgtatattttttcttttttattaatgtggtataataattcctagtctttggagtgaacatgctggtttttagctatatttgtaacaacgtttgttatattttagcacgaaggagttttttttaattgcaatctgaaataaataacacgctcaaatatttttttagttaaacagagaaaactttttggcagcaactgaaaaattactctcgcaatatgtatgtatgcatgtatatgtgttgacaccaaggctgactcggttttcgtcaaggtgttctgtaattgcaatgcatattgatactgagactgactcggttttcgtcaaggtgttctgtaattgccgtgacaaacgtgaaaaaaccctgtagctagcttcatatgtttgagttaaatacaaatagtgtttcgtgataccataacttattccataaatctatatctttataaaaccaactcaaatacgggtaacgtaccaaaatcttaacgaaaatatattcaatttttataatagtagtgatagagatatacaggggagataaaaaaaaaaggttttcgtgaccacatcagtacatcacacacgcgttatttggggttccggcccaatacgtggcccaatccatcggcatcggatcgaactcccccctctacctcctcctcgtcttccggcgacgcacgccgccgccgccgccgccgccgcctgccctccctactgacgtctcgtctcctcctccagagcagagcaggagagctgagccaggaagccaccgatcatggctggtacgaaccccaaatcctcgacctcctcctcctcctccgccgcgcgcgcttttcctcgtttttgtatgattgctcacctcgtcgtgtgtctgtgtgcccctgcgtatggcggcggcggtggcgccggagaagattacgagcaggagcaggagatggaggtggaggccctgcaggccatcctcatggacgacatcaagggttctctctctttttctttttctttttttaatcttccccctgcacaatactagttctttgcttgctctatagcttgttgcttgcggaatttaacctgggaattgggaatttgatgatgatgatgatgatgatgatgcagagatcgaccccagcgagagcgggctcagcaccacggctcgctgcttccagatcgtgctctcccctcaggtttgtgccggggatcctaccatatgtatcacttcctcgattcttcattcagttatgacctaaagtatagttggcaataggaactcttggaattgaagagatgttgcagtttcgtcagttgtcttatgattagtttggtgaaattaacgatcttttccttttcacttggttaggatgatgatttcgatgagtcggcttatgtgccaggtaaagaataattttatcataatcaatattatattaaaataagagaaaaggaacatttagatgttctgtatttcttgatttattcaattattattgtaattgtgtcatccatccttgctttgcagtccaactggctctgatttttgcacacaccgaaaaatatccggatgagcctccgcttttgaatgtcaaaaggttctgttttttaacttggtgatccagcattggttggaagcaagcttagcgccattaaatttcatggtatctttatgcaagatgtgtgcttatatgctttccaactcttacagttgaattgcaaaacttccatgcagtgtacgaggaatgaaatcagaagatcttgcatccttgaaagaaaagcttgagcaagaggtatgcaagtacttggctcaagtttgttgtcaatctaactgtcaactgtgtgcaaaacaacttacttcctctgtccctaaaagagtgtagttttagcttaagaatttatccctaaaagagtgtagttttagcttaagaatttatccctaaaagagtgtaattttagagtggtccattagacctcttaaatattacatccttttcttctcgttctaaccattgaatcaatagtactccgtcctcctcgttttttcccccttctcgttttctccacatattttgaaggacgtggtagtcttttaaactctttttgggacggagggagtatgcgctaagttcatctgaagataaaagtttcagaatgagtcaaataaacttgggcagttattgtattttttttactatttactactacaaactacttttattacctgcttctactgccactgtcatgcctgtatataggatttgtaaaatgctcactgtggcttcacgaatattcattcagatattatgttgatattgaatatattgtgcttaaattgaatagacgatgttcggagtctattcttgtctatcaggtatattcattaaaaatcacctgatatgccttgtcatgctctgtttattatccccatggtttaggcaactgaaaatctcggcatggctatggtctatactcttgtcacatcggcacaagattggttaagtgagaaatatggacagaatgctggagatggggaatctgaagaaaatgaggcagaagaagaggaggtatagctaacttattccctttggcaagtttaatggtttcttttttgtgaccatctgtgataagaagatgaaatgaatatttggccaagcttcagactgacttatttgcacatgattaattattttccaattaagagtacatatatttcatcacacactggagctagtctaggatgcatttctcagagcggtagttatgcttgtcgtactgactgctgagccacttcatgatcaaattccacggttactgttattttctgtattatataatctaagatcgttagccatttattattctgcccctctgcagtatgtatctttcccatgcaatgtactttataatggaacatttataggtcattgtgccccatggtgaagctgttactgtagagagctttctggcttggagagatcgttttgaagctgaattggcgctacagcgtgccaagtaagattctttatttagctttcccttgatgtcatcatggagtcatcttcacaaatggcaggctttcttatagcatttgatcttgaaatttcaagtgccaaaacatgttctcataaacaaattttttttcatgtgcaggcttatgccagagtcagctcttacagctccgaaggaaaagaaactctcaggaagacagtattttgaaagtggaaggcatacaatggtacttaatcctactccctctgtccctaaatataagggattttggttggatggtctagattcgtagtactaagatacgtcacatccaaccaaaatcctttatatttaggaacggagggagtatattagattttttaaatactgtatgtattgcatgttttccccttttccagttaagggcatgcatagccaccagtatattttgtttatattatttttgttatgatctttgaatctttgtacgattgtaagtctcacatatttgaaattttctttccagaaaggagcaagtaccactgctgacgaagaggaggaagaagaggaagacatcgactttgatgaagacttcgatggtaaattttcacttacttcgaggatattctttcttgcctacaacaatttgtgtagtttggaagcgaaacttaccttacaataacctggtttcataatctgtacagatgacgaagaggacatgcttgagcattacttagcagaacagtcaggcaagtcggccgcttaaggcttcaaaaccatagaagagagcaaaaatgttttagggaagcacaatgtggttatataatattataggtgaagcctaccattttgtgcgttttcccatgaattggtttgcctgctgatgaataccttcgagaggttatcatcaatctgatttgagtgtattaaagatgaacatacagcggctgcgtaatttacttcgttatgtaatctattgtgtttttggtcggtttgaacccacatttaccttcttgctgtgaatgctgcatcattaagcaagtctgcaaatttgacgctcgagttcaaacaaaacaaaagcatgtagaagtttggtttgcttttatcttgaggatgattggtttatagctcgtgaagcaaccagagttctgctgatccattcaaggcatagatatgtttgtgtatgattaactcctgataaattactttcattcagatgacaccatctagatacaaaaagaattgcttctatttcctcctcccattggcattgatgttggtaagagtgggcaatacatagttcaaaaagaaaaaaaaaagaaagaatggataatacatcggtgatctacgagactacatacaacaacaaagggctcttctatattgttctacgatgggcccaagcttcgcttcctaccaggggaaagctttcaacactaaattgatttgagggcatgtataaacaaaaacctatgctcccgtgagatcatgcctgcaggactgcaacaatcgccatttctgcttattgagcagcctcactagacacatccttgatcagtcatggcttgtgcaatattaagaaacgcacatatgtttgcaccatgcaccaacgacctgcatagagagatcgatcagcttctgggttgaaaccaggcggaaacaaaggaagacatcctcagagcacaagaagaaaactaactctgggttctctttcatgattccataatcttgagcagctttgatagatctgtcatatgtttgtttcaccgcatcctgtttatttttttaaaaagaagactttcagcaggtcttctagttagtaaatacgagtagcttgccaacaagcaggagcagcagattatacctgtattttgttctcaaaatcctccactgaccactgcatcaaactgaactcagggttcagttcgagttctccaactgctacctgtcatacgagagaaacaaaggcatgatcaaaagagggaccatgaccaagctcagctggaatatacatcaatctaacttagaaagcagtgcgcccaaattaatttataacagcagaaaaacgagcaacacaattcatctaggatcatgtagttttgaccacagaaggattgataagaacatttgcattaccccaccagcggcagttgcctttgcgggagcaacaactacttttgctg

SEQ ID NO: 2765 - DNA, 12710 bp, Oryza sativa
gcaacatgatatacaatagtttctgctcacaggaaatgttaaggcaccactttaccagtccgtatccagtagcttctgttcggaaactagaaccagaccagaagattttaggccctgtaaaattcccctgcacaagcatagcaatgaaatctacagaataagagaaaagactgacaaaaaaatataaagcaaactgcaaaccaatagccttaaagtagggctgcgttctgcagctggtgaacaagagaagatttctctcgttctctgtgcgcacgcttcccgaactactaaatggtgtattttaccaagaatgaagagaaatgtccagatacaggacagatgaaccaagctataacaaactattgagcaataccaccttttggttcctcaatccctgtagtatgatctgaacttgactacattcagatatcatggaactaatatttgattccacagttgcacagcatgataatatagcactacccagtaggacgtcatgatgaacatgaaaagaagtttaagataatgttataatgctctctaactagggaaggttagtcactaatttccctttggttaatggtccttagttttcaattagtcagaatcagaatacccaaaataaaaggcaacggcagaagatgacaaacagtatttcgaataacatatcattgcagaacaactattatacctgaaaatgaccagaaaggcgtctatactgcccaaaaagataacccatttctcttggacccacaccaacatcttcagcaggaaaatcctgcagtaagattttaagcaaaatcatctgatttagatcaaaacaatttgattccatttttctaatatagaaaaatgtcataatctaaaaaaaatgatattatatctgataggaatacctgatcaggccccaaatatctatacagctcatccatgaaactttgacaaaaacgcattatctgaaatagaacattttcagatttatgtgcagtaaaatactattttccaaaggaaacaaaatgtgacacaaatacctcactttcacttttacccttgggatcaaaatcactccctccagcagctcctccaagtttatattgtgacaaagcattttttagagtctgtatcaaaggaaataagtttataatgctttataaaagcttcatgccggtttctaatttccacatcaatttaaagcactctactttcaattatagtgctcaataatgaaatcctaaataaacatatagcacagcaagcatcctaattttatataactttgtttgattgtgttctattggaaaaaaaaagatacaattttgggcagaagttcacagacaaaaaaaagaaacagtgcagatcccccaagtatcaaaagaaaaaaaatgtaaggctatcatgagtaaaatcatgccactggattaggaatccaatgtggaatgatggaaagtaaaaaaaaaaacattacaatatgacagtatctacttaggttcaggtagttgcatttctcagttcttgagtcgtgtttgtgtgcatggcatccaccatggtattcatttaatcaaatggagtgtaatgcggaaacagaaaaactgaaatttcatacaaaaagcacaaatgacatacatgatgaaaagacaggtagcagcagcagactatttgcatgataatatatttgaaccaagtaatatattacctgctcaaaagctagaaattttgctacgctcaaagtcatggaagggtggaaacgaagaccacctctgcatggacctaacgcttgactgaactgcacacggaagcctcgatttacatgtgcttcacctctatcatcaacccatggcactctgaagataaagcatctctcaggttccaacaaacgctccaaaatttggacatgtctgaaacatcacaatcagaaatcatgttatacttgagtcttaggcaaactgtttctcagggaggggaggagggaaggagagttactgggagttcttcaccaaaactggttccaaggaatgaaccacctcttggatagactgtataaactcagcttcatgagggtccttctttaggatagattcaagtatagaggctgcagttttcgacagagctgaaaaatgtagatgccacaattcagatataaccttgaaagttaaggtaagtacttttataaatatatggttaacttcttccaaattaatagaaaatggagtgcattcgctgataaaggagttaaaatgcaagggaatgccaagcatcttcagtttagtggagaactggaaattgcttcaacttattatttacactatattccttttcttgcacggagcacagacacactttacctccatgaactgtcaggatgggatgaagtgacgaatatcaaagtcatagataaatgtaacaacatatgcccaaactatgcatcaaaagtcatgttatctatttcacccagtacatttttcactgttaaaatcagtaaaatgacattttgccaaacaactaaacaccaccatagtactaattgtaagcacggatttggtacacatcccctattcttatagaagaccacaggcgaactcgcagcataatcacagggcttgaggcaacaacaccaacctttgacatataccggcctctcgatctcagggggctgcgcgttctccttggacgccgtctgcaaccgcagcgcctccttgtgcagcaagctgttgttgtgctcctccagcgcgctcatctgcatgttcctgctcccctcgttcccgtagggattccggcggtgcttccgcccgtactccttgcacacggtgcagaagatcctgctggtgttgtcgtgcacggcgacgtaggcccacttgtaggtgtccgcccactcctccctccatttcttcaccaccttcttcttcttcttggtttgccccggcagccgtagcagcccgtcgtgctcctccacctgcggcggcgtcggctgcggctgcccctcggcgacgggctgcgagcacgggatgaggaggctcttgtggtcgtccgcggggtcgtgcgcgccgggggtgacgccgacgagggccgcgccggggaaggaggggtcgtcgcccgggccgatctcgaggtcgatctcctcgccgaggccgcgcaccaccaggtggtgctggtgctggtgctggtgctgccgcaataggttgagctcgtccatggcctggtggcccgagctcacccgcacgtgcgccgccgcgccatgagggggaccacgccctggaggagactcgcaccagcccgcggcggcgcaaatccccgccctccggatttgggctctagggtttggttgggtggggaatcaggcaccgcgcgccacctccgcggctgcgccggctaaggtcttcgatcgagcaaggcctcgatctgggggggcgcagagaacggcgtggggagggacctccccggcggcggcggcggcggcggcggcgaggtggccggcgacggcgagggggaatcaactagcgcggcagccggagattgtgtcgcggaggggtagtgaagaaatggaggcagtttccgacaaggcagaagaacggtcaatacggagacagagagatggagataattggagccgttgattttgatctcacggagctgtaagcacgaatcataaagcgttcgttttatactgaacggacccgattatttgttgatcctaaaccacaactcacaaactgtagaccaatttggcagaagtacacttgatgttataaaccgccacatcatcctacattcctattattatggggcgccatttttaatgatgacatattggagataacaatatcgaagccttggtatgacgtaaagacttagaattggcatatctataacttcgttgggcatatatatactgtatcggaagtagcacgcctcactcaaggacaacggacaacgaggatggggggagaaattgcaacgacgacaagagattgtgtggcggaggggctaatgcttttccaacaaagcaaaaacaaataatcacgatataaacaagttccacctaataggagtcattgtacatggacaatttagattgcatgaaactgtactgatgaatcatcctgtgcctgtttgtttcaaacaaaaccaaccatttgcaatagatacatattcgttgacctaaaaaatagatagttggatatggggtgaaccgtggacccatgatcaaacttggatgttgaaaatcgcttactctacccagcattcgtactatttgggagcctcacttttgacaatggcacatcgaaaacaacaatactagatatgacgtaaggacttaatattgtgtatccacaacttcattgaccacgttcatgctaccctagaagtagtgcttcctattctatgatggtggccaagctggagcttgtgtcttggaggggctagtattcttctaatacaatagaaataaacggtcaggacatagacaagatattgatcaagctaatcagagtagttggttttacttgaacaattgggatcacatggagacgtactagcgaatagagaatcaatttatattgaacaaacccaatcatttgcaatagatacgtgttcatttattctaaaccacaatccacaagttaaacacttggacatgggtgaaccatgtacccccatagtcaacttggatgttggagacctcttacatcatccaatattcctactattacacaacttcgcttttgatgatggtgcaacagggaagggaacatctaggtctaggtaggaaataaggacaacatcggtgtatgaacaacttcgttggccatgccttgttgcactggaagtagtgctccttactctatgctgacgaccaacaatggtgattggtgagggggaaactgctacgatagctagagcttgtgtctcggaggggccaatgctcttctaacatagtggaaacaaatggtcacaatgatcgaactaatcagagtcgttgattttactcgaacgattaggatcgcatggagccatgcggagtgtcaacttatattgaacaaactcgatcattcataatagatacatgttcattaattgcttctaaaccacggctcacaagttggacaattggacatgggttgaaccgtggaccccatggtcaacttggatattggagacccttacgtcatctggtattcctactattacatgactttgcttttgacgatggtgcatcggagatagacggaaaagtctagggatagacggaaaagtctaggtaggacataaggacccaacacctgtgtatgaacaacttcaccggtcaccactgtgttgcaccagaaggagtgctcctcactatgcactgcttgatcaagggtgcaagggtgaggggaaattgccacaacggtcgaagcttgtgtcgtggaggggctaccgctctttcaacaagtcagaaccattgattttactcggacaattgagatcatatagagcgatattacaaatcataaatcatccatttacattagacggcctggatcattctcaaccatagagatcaccaccgttcattctgttcaggacaatctacatattaaaccacatctacgagggacatgggaatcaaccatggtcaacttggaaggtggactgcttacgtggtatgacattgctatcacatatacggttcataattcttatgttttgaacaagattaatgttaaacttttgtaatttcgactattttaacttcaaaaatatttactttaaagaaattagaccaacgtatatagatttgtttttttaaaagtacgataataaaagtaaacatatattttatttattttatattataatagaaaataaggttaaaaatctattttgtaaaccgtgtcgatatccaaaacgaattatgaaaccacaggagtacatcacttttgataatggcgcatcagacatggaagaatatgtagcgtttggagcgatcaaattgccatggccctgtttagataatggtgcatgcctaaacaatcgaagagaactaaaaaatatatatggctctgtttatatttcatgtcacttttcttgtccctcgaatgtaattttagtggctcttatcatttctctcattctctaggggaaaacacaattacacaatggattattctaacttaaaatgaaacaaattagtaattaaaaaaacaaaatcacatatgcgagtattcaaactagatacaaccgtgcaagtgtaaaaatctagctgctgcttcgtcttgaaggaagcacaacatgagtcacacgagtattattcaacaccaaaatgtttgatgtttccgtggatggcgcagagacatgacacatcaccggtcaacacaccgttccgtccagagtccagactctaaacataatatcacttccaaatacgccatccgttttatatcataagtttaagtttaattaaatttatagaaaaaagaataacaatatgtacgatatcaaattggtttcgttaaatttaacattaaatatattttgataatatgtttattttatacggaatgaaaatacgaaatgaaggtataattatatttttttataaacttatttaaactttaaaaagtttgactaaaaaaatcaaataacttataaaatcatacagagggactatatatgcagccactgattctcgtttctccttatcaccaaggtaaaggtcagcagcaaagaactcaaaaccaacgtgcgtgatcggtgtacgtgtactcgttggactgcaggtgaagagatcaccgatcgatggctgccgccggagatggagcaggaggcggcggcgagcagctgacggtgctcggcgcgtgggggagcccgttcctggtccgggtgcgcctggcgctcaacctcaaggggctcagctacgagtacgtggaggtggacctcgccggcaagagcgacctcctcctcgccgccaaccccgtccacgccaaggtccccgtcctcctccacgccgggaggcccgtctgcgagtccatgctcatcgtcgagtacctcgacgaggccttcccttcctcctcctcctccgccgccgcggccaccacgatcctccccgccgccgacgacccctacgcccgcgccgtcgcccgcttctgggccgccttcgtcgacggcgagctgctgagcgggtggatggggatctacgacggcgggaagaccggggaggagagggcggcggcgctggcgcggacgcgcgcggcgctggacgcgctggagggcgcgctccgggagcgcgcgggcgggcggtggttcggcggcgagcgcgtggggctcgtcgacgtggcgctcggcgggttcgtgccggcgatgctggcgtcggagccgacgaccggggtcaggatcgtggacgcggacaggacgccgctgctggcggcgtgggtggagcggttctgcgcgctggaggaggccaaggcggcgatgccgccgctcgaacgcctcatcgcggcgggcaagaagaggtacgccgatctgcaggcggcggcggcggcgagcgagtgaggtggccggccatgtgtccgtcgctgctctgtttagctgaagaaaagtctggcatatataaacaataaattccgtagaaactgctatgaaaataatgttatttgttggtttatctacatattttagttttgtaactacgtatgtactgggtgtttcgttggatctttggtacggcgtccgtatcttaatctgattctgtctaaaagttacatagtgctcctccaccgatttcggttcgtctcctcattttagtcggtttcgcacgtgttgggcctgtgtaggtcgctctcccgcgcgtgtgacattggatcgatacgctcttccgcgtgcgtgacattggaccgacacttgctgcgtccgtttccaattggtccatttccaacgcatcgctccatgtttaaccggacacgaccgcatcaacagctacttccttggtcctatcaagcaacgattacatagtcccaaggcaaattattctattcaatacactttagttctaaataaataataataatatcataaaaaccattatatatcgcgctggacacaagtcgctaactacgggccctgcttgcgcgcggtggggtggtggcttggttcttggcggcttgatggccgtcgtgccgctaagggcaggatccactagtagctgcctgaggaagctccggatctgatggtgtttgttcatgtaggtgtggtggtgcccagcgaggctcacttgtatctggagagtgacacggcagtggtgatgctgatggtggtggcgacaatgaccagtagcggacggccaagcggtgccagcggcgtctgataatggtttgccggtgcgatagtggtgatggcaccggtggtgcccgttggtgttctgaacactgacatcgtgcgccctcactgccatcgcaccttcgttgcacataactggagcgctaggccgacctgcaacaaccgcctccactgccacctccctttgtggtggcggcgagtagcggtggtgttgggtagtggttatgggataagtcctttgtcccttcctctattcaccggtggtgagggttggtggccacggacagtggttggggctagccctccctcgtgacagcgggtcagttgatgtgcacggcaacagtggtggatgcttggttcgtgcacgacagtttgtgacaacggcgatggaggctctcggtagcggcgtcttagggcagcgatgacttggcgagctccgtcacccggttctgaccatggccaagtgaggacagggaaggtggtcgtcggtgatggtgagatgattgtcagcttgcctgatgtagataaggacgatgactgtgaacactcttcgatggtagtaccctagaggtggtagctacccagtgagcgtcggcaccaaggtctagctgcggatagatatcgacgattgtggagcatctccggcaagctcatgacagtaaaggtaggtacatgtcatgctggacagctccgtgatgaccacgaacaacaagcagccgatggtggttgtgttccatagagacgaagatggtggttgtgataacaggcagtttggactagtttcgattctcatcttctcctctcatgctgcgttggaaagagtaagtcattgataaaggttaaagctaagtcttctagttttttttttgtgtgtgtttgtgtattcctctgtgtgaggtttgtagttaaaggactcgtgtaggttttggttgtgtatatgctatgtgaatatagaggccagattaataaaagatccaatatctaaaaaattgaatcctaaagcgattcaatgttctggaatttataagatatgtaaggtgatttttatgtaaaatactactccctccgtttcacaatgaatgtggggaatgctagaatgacttacattgtgaaacggaggaagtatataggcagtccttttgtttttctacctacttgaaacggcaccacattcgtgcgttctaatctcttcttttataagactaatacccactaataatctaaagctcaacatgcaagcatagtatttaactatttattagcactcctaaaacctacatgcaaatatgtcacatgaactaattaagcacacaaagttcaacatacaacatgcaagtatatactccctccttccctaaatatttgacgccgttgacttttttaaacatgtttggctgttcgtcttattcaaaaacttttgtgaaatatgtaagaactatatgtatacattaaagtatatttaacaatgaatcaaatgataggaaaagaattaataattacttcaaatttttgaataagacgaacggtctaacatgtctaaaaaagtcaacggcgtcaaaaattttgggatggagggagtagtaattatatctacaatttatttcattctaaaattaaacatacacatggtaaatcatcattctcaaattatttttataatatttgaattcaaatcatttgatcatttcttcaacatttcttcaatatctctagtgcttatgaggacaattgcccctcttctgcttcccttacaaattaggaaaaagtacaccgaaggtcccttaacttgtcatcgagttataaaatcattccccaaccacaaaaccagatatccggcatcacttaactaatcaaatccggtcacaataggtccttcggtggttttgacaccggttttgtactacgtggcggctgaatcagcatgagacccacgtggccccacatgtcaggatgccacgtcatctctcttacccctcctctccattactcctctctcttctcttctcttctctcggacgcgaatggcgtctgcgtcgccgccgctagtgaagcggccctacgcgggtgggcgccgcggcattgggcacgcaggcggaggcggggccgggcaccacggcggtggccgcagaggtagaggcgggagtccggcggtcggcgacgggcgatgaggcggcggttgggggaggaggccggtggggcaaagcgggagaggaagcggttgggatgatgccgatggcgccgcggttgatgaggtcgacgacgggctctagcttccacaagtcctcgccgccccacttgtcggtggaagctcgccaagcatgcggttatggcacagtgccccggtgcggcgggcgtggcggagcggtggatggcgccgtcctcgatgtggcactagtctgggcttgcctctgagttgcggtggcggcctccgccgcggccagcatcctcgcgctcctcggcgcacccctcccctgcacctgcgctcgcccccacctcccctgcctcctcgacttcctctccgactacccctcctctaccctctcccgtctcgtcgagtattgttggtatttcttaacgacattactagaaatatattttccagcaatggcgcagaaatacttctggtatattatggttacagagttcatccccaatcgcacggatataccattgtagcatttcacccgagagtattccaaggatatcgtatttattttatcccgtgggaagatcatgtatagagaactcaactaataatttatatattacttgtgataaccatattctaagcagtggttaagataatccaagggtagagtgacacacaagcatttaactactcatcctcataatatatcatctaagctaaatcgaaagaaaagagaaaggaaatctattcatatacttctagtatacatagtatatatacattctagttaactgatatactagctaataccctctattcgatgccctcctggtacttcgagaagccacccctgactgccgagttccttacgacagcccgtcatgaccatataaccggggctaaatacggaggaatatcctccccaggaaattaacttaggattatatataggcgcggaggaatacacgtagtgagctgtcaccatcagcagcccacctctcattcgcaatatataaccccaaataatgatatcccgtaatctagacactacgtctaaactaccagatactaccctaatatcatcgtcacgacatagagcaattgcataagcaaacattatacccgcaccaaagcatctgctagataagctagccgtatattcagtataacatgaacataatgtaaaataggtgaaagtatttcaataccataaatgtatatagaagagtattctaataaaagtacaaagcttacaaaagaggagaaaagctactacagccatacccgaactcttccgaaggcttccggactcctgactcctattctaattctattccactagctagatactactaaactaaacttgagagaaatgagagagctattgcttaaggtgtgtgttgaagtgaagagagtgagctccttatatagaggtagttatgatggttgtggaaggggaattatccgaagtgccctccaaccattattgggatgcaatcctggacgtccatgccaaaacctggattcaacggcgccaggattgggttcggccgaacctggggctggcccaatccagcccaatttcggctggtggcctcctctattgctctattccgtagacttgtgaattttggcccaattcatcgtgtcaattctgagttcttggcctattcacacacaagtcaagtctggttctcgatttcgtccgattgatttatcgtctgagttgatgtcgattctcctctactttatgatcattctctgcaaaaggttagtaaacctaatactagtggaatattattattctaacatacttatgcattgcaagcatcactagttctctcctattttagtaatattgacggttgaaactgatcgataacgaccgtcaacaagtatgagtgcaaggccagccatgggcaagtacatgcgccaagccaaggtggtggccgccgcagtcatggagctcgccgccgttgcccccgcgccgctcggggtgcgcacccgcacccgctccctcgcgctgcagaagaggcaaggaggagagtacctcgagctcaggagccgcaggctcgagaagcttcctcctcccccgccgccgccgccgaggaggagggcaccggttacgacccctgatgcgccggcggcggagagcgcggaggcggagggttcattcgggggggggggagaacgtcctcgagctggaggccatggaaaggtggggatttttttcctctctctttctgtt

SEQ ID NO: 2766 - DNA, 4304 bp, Oryza sativa
tgatcggggaatcgcatgattagggttcagggtttaagcgccgtacgggagttcttggggttcgatgtttctatccagtttttgcatcgaaaatttttgggggattttttggtgctattgtggcggcgtgcaggtccagtcctgtctggcggatcaagcgcccggcatcaccggtggcgtgcttgatccgccggcggcgaagcacgccaccggcactgttgcggacaggaggccgccgcttcacaaggacaagccaaccggtggcgccaagaaaccccacacctccagcggcggcggcaggatgtgcgggagcgtcaactcctgcattgggtaccggcaccaagtgagctgccaccgcgccgacgccaaattcaccacgcccgccgtgcctttcggcgacatcctcctcacctgccggctggcttgccaaggaggagagaagtgagagagagagagaggaggaagggggaagaggggaaagagagaatgtgatgacgtggcatcctgacatgtgggacccacataaggtcccacgctgattcagccgccacgtcagataaaacctgggtcaaacccactgagggatctaaagtgaacgttttgtaagatgagacacgttatatatctggttctgcggttggaggactattttgtatctcaatgacaagttgagggaccatcggtgtactttttcctacaaattacaatcgtctagatgcaggcccaagtataatgatgtgcagagagagcactaagttcctcggaccttgaggtttctgcaggctgcagcccagcctcgccctggcctagcgatgttagcacggcccaagtggtgcccttggctgcagcagatcggagcaaacatatacagaaacttaaggaaagagctgcatagcttagaaaatagaatggacattagcgggaagaatcgaacccatgttttgtttagtatatacttcctccgttcctccgtttcacaatgtaagtcattctagcattttccacatttatattaatgttaatgaatctagatagatatatatgttgtctagattcattaacatcaatataaatatgagaaatgctagaatgacttacattgtaaaacggagagagtacgagttacatatactacttataatactagttataatgtactttacatttgactcaaatttttaaaagttgtatagatacaccctaaatatttggtgatttatttgcccgaaagtgaatatcatctccttccatgcatgcatctactttcatggatgcaatgttctgtctaacgtaaaatctaaagcgagaggcctctcgtttcagttgtatcgcgcgacgcgcctacctgagtgaggatatatgatatatatgatatggtttaattactgatgattgggtaaagaatattaaggatcttcatataacatggtctgttagtagaaactcatttactagtatgatctttattttagataacattaataaatcaccatataggaacttctttcggtactgttatatgatccctgtctagaaactctatatatgacatgaacaacaagaaaacgctgtttagataattaatcatatggtaaatttagccagaaatgcattggttaagtgcagcaagaaaatggtgttgggactgcgcaaaaaacacttttagtgtgcaaactacaattcaccaaccggcaaacatatttcacacaatcaacccttcatcttggcatgaactttgaggatagtttcaactggcaaatcagtagcggaataacaataaacacatgcacacaagacacagtgatttacgtggaaaaacctcctcggtgtgaggagtaaaaaaccacgggaccaacggtccactccaagcttccactataatcaacaataggtacaaatgtagtcttctctataatatctaaagacacatcacaacagctacaacatcaagttacatggcattatcaacatctcaaccatcaaagctaacaagaggtatatcaactaacaagtagagaaatagcagattctgtccttttcggttctcagctgagatctccaaaccacagttgcacgaaacttggcagaaatgatggtctatgattcccttccaagctgtcaaaaaacagcctaatcggacaccgtttgaccccctaaaccgacactttattaactattgcacaatctgtaatttagtgactcgagctgacaaaccaccactcaaatccgacgctctactcaactaatcctcatccaaactgaccagattgaagtgctcaaagtgagaaacaaactcaccaagtttggtgccaatccaaccacgtttgagcctccaatcgttgacttgatgaagatcgggtaagagcccccaagctgaacaagttgcacttcttctccactctcctctccctctctcttgtgtttgctggttgtttcttcacctcaaagactgctgctcgctctccctccaatggaggctagggtttttcttcccattcctaaaggatgaggtaatctcaaccgttgatcaacacttggatcaatggctcacatttgttggactttttgggctgcaaatgggctgagaacaaaaggtccatgtggagggaatttagccaacaaatggtatggtaccataaattttatagattatgattacatgaataactgattccattaattcagtaaatggatagagctggattggacagggagggaggatggctgaaaatgaatcggaaacgaatggaaactagctctaccatatccgttttcatatttttacggaatcaaaattaaaatcaaaaaccacggatataaaagtggaatcgaatataggtacaaaacgaatacgaaacggaacaaatgaataacaaatatttgatacaaataaaacccctcaaattaagcttccccatcaacgaggagatacacactggcactgccaagttctagtaacgatgcggcttcgatacgtaatgagacctgtgtccagccatagtattttccgcatcgtcgctactaaaaacgatttttctttcatgcggttgaaaaggggtttttacgtgcggatctcctatccgtccgcatcgaagggtctgcaaaattccggtgctagtcaattaagaacaagaaaactgatcaaaacgagccttaccgtccagataatgtacacatgcatgtatatagtactcgatccgtgtcgtcaatcatatcctatatgaatgctgctaatcatgcattattagttattgcgaaaaatccacgagataatatctggatgacctacgcaaattaactaacaaactgactcctgtcgtgatcgtgatcgatcgaggggatgatcagtaggccagccacaaactggtcgatattccggccggatcatcaaagatccgatcttacctcgaatgcttgatgatgcatggtcggtttaattattagcttgatgctgaaatgcacagtactgtagaaaaacactttggtaccgattgaaaaacctacatataggtaccggatttcacagtcaacaccaactcaatgacactgatgactctagattattaatgtcaattttacaaccggcaccattgacacgcacaagaggcaaaaaaaaaagaagaagaagaagaaggcttaatgcattggctcgatataattcgaaccaatgcgttgagttgctctccacagccccaaattacaattgaacaaaaacaaactcctgctcatgctataacttatgtacaggctgaatcacaaattcaataaaaaaaatgaactgctatcacaactaaatcacaaatccaaaaagatgaacttctcgctattgaagagttggggcggcaatgacgaggaaagaaaaaaggaacacaacgaggtatccgaatctgacgatcgtcgagcttgagacggcgccgtcacatcaccctagccctagggaggagggggggagggggggcgtgcctacttgctgtacacggcgaggtacccagatcttaacgatggccctacaacagcaccctcgccgatggtagcatatgcttctccttccccttctcctcttcctcccacccctcaccttccacttcccgcacggtgagcgacgcaaacgccgtggcactgtgcccacgatccgcataggggctgtcaggagtcatggcggacacgcacaccacaatgtccactcgcaagtttaggtttgagtcatgagagaaagagcatgcgtgaagggaggagaaggtgagatcgacatggctcaacagttcactgctggagaaagggactttagtcccggtttgcaaccg

SEQ ID NO: 2767 - DNA, 12792 bp, Oryza sativa
atatatatatatatatatatatatatatatatatatatatatatatattcgtctaaaaatataaacacttttagcataataccaagtcaaatattcgtaactttgactattaatagcaaaaaaaaattaaaaagatcaatcatgtaaaattgatattactagatttatcattaaataaactatcataatatataactctttttatttaaaacattttacttttatatatatcgttggtcaaagtaacatctcgaagactatgtcgaagtctaaaaatacttactccctccgtttcacaatgtaagtcattctagtatttcccacatttatattaatgttaatgaatttagatagatatatatgtctagattcattaacatcaatataaatatagaaaatgctaaaatgacttatattgtgaatcggaggagatatattttaggacggagggagtactgtatacatgcatgcagctaataagctacaggactagctagctggctaacacaagtatacaaccactttgcattggtgtgcacggatcgactaattaattccttaatcagaaaagaacaaatcgttaataattaacgatggcctaatatcaagcaaaatgacagatgacacttagggtctttttggaggagtttctaacagcaggagattcttctagaagctattaccgctagaaactcagtccagaattttacttagattatgaaaaatagtagttgtagaattcagaaaataaattaaaagctcttctccagattgttaccagctgttttttaaatctttaaacttcctaaacatagccttagttgcctggcaggcaggcatgcatatatgtctggtagagatcgatcggatcggctaacgggattatgttcttgacgctgaaatgcgaccacccatatatacatacacacacaacacacatgcatgcatatgcaagaatgcatgccgcgcgtattgcttctttaaattctttctgctcacaccgttaatttggtagcgaattcgaatctcacgtggtgaatttcaaaaaaaaaaaaaggaacttcaaaaaaagagaatctcacgtggtgcccatgcatgcttctataagtttgtttttcgccaagcctaaaccattcacacatatatatgtgctcgtggctgtgctgtctgcctgtgtctatcttggaaatctttttatttgttccctgttgatggttggtgctcacacttgaaaaaattattgaaatgagaaattattatatatggcatatataatatatacaaactatgatatgaaccagagagtagcataatatatatgtgttggaccaaactcatcacttaacataatcacatcagctgaactgctttgcaatggctgtacactattttataacttagttatgacatgtactccctccgttccaaaataagtactccctccgtactcttaaagaaaatcgtttaggacagcgacacagtctccaaaacacaactttgacttcttgtttctataaaaatatttattgaaaagtgatatatgtatacttttatgaaagtatttttcaagacaaatctattcatataatttttacatttttaaactcaacaacttaaaagttattcatgatttatattcccaaggtttgacttaaacattgttctaaacgacttcttttataagtacggaggggtatagttttatattgttcttatccgacatttgaccgtttatcttatttactttttttataattagtatttttgttgttattagatgataaaatatgaataatactttatgtgtgattattatttttaatttcttcacaaatttttcaaataagacggacggtcaaacgatatgtatacccacggctgcactaattttaggacggaggtagtattaattagttaatcaagtcgtactagggaccacacattaattatgtgaccgttgatatcccatactctagttcaagttgtgtgtaagcaacaaacagagagaagctgaacactacaataactagctgcctgcatcaattattgggtcaagatattagacgactcgcactttgggtacggcgtggtcgtacagacaaatgtatttttgatgatctgatgttggatgctctggcaaagtggggcaacttacaaaaggaacaaaataatggcaggctacagtacttagatatatagagtacaaactagttatttaatatacaattcacatattatcgtctgtataatctttcaggagatatatatatatatataaatgcacatcttattctatgttttgccattaacaaatatcaactatagaaaaatatcatcatacaaacaaatttatctaagaaataccatcgccatcagttaaccctatccattttttctaaatacccaaagtgccctcacataacaaaccaaatcacaaacttgggccgatggacagtggccttgtggttgcagttggttccgtagccagcagcgtccttggccatctcaaggcagagggaacgaaggagctattgggctagagatcacattgccgacttcccgtgtagatgggcggcaacagagctcatcagaacctggtgaagcttcggaaggaggagaagggcccttcctaggatagcgactactctcctaggttatgcagtgacacaactacaaaagttgtggcatagattcgatagttgaaatcttgcagctgcgacatcgaggtctcacggtgatggtggatctagcaccatcagcggtggtatcgcagcagtgtaaatgaacaagacagcgaagtggagagagagaaggaaatgtcattgctactgtgccactgccatgttcaagcaggccaaggggcagaggacctgagtggcatcgctcatgctcgacggctgcaggcgggctccatcgatgtcatggtgagctttatccccaagcattgcactccagcacttcgccttgcagccaaagccatagcacgccggccccatcatctctaggccaccgttgttgtggatcggtcggcaacctcctctccgccacaccaaccatgtcatccctaggccattggcattgcctggtgaaagtgtatctagtctccgaagcgagttttggtgggctattgacaaaatggttaaggaaccaatgatttatcaagaagtgtgaagataattagtcctagggtgtttactcttacatggagtcaccctgtaaatagaatgcaaagcgtcgtgaggactcgaagtgttatttatttatttattttgtatcttttggtcttgagtttagaaaagtcgtactaccagaggataccaaatggtttcttgcatctatatcaaagttcccgaagttcaatccttctagatgagagatacagttgtgtcaacggattgtgtgggccagaagttcctagtggtttgggccggaacttccgagcccctatttttcagccaatgcctaagtgctaacaagttcttggcacttatggctagaactttggggcatatttcaagttcaattatgtgagtaacagctacattacataagggagtgggtatataatctcaccttcctctctagtgcaactttggccattccacttttgtttttctgtctcctagcttcttgtagggtttcttgagctctcaaggtgatttgagagtgcttgcatggatggtggtgaggatttatgtttctgagcgagctaggagaacttgagaacttggggatcatcatcggtcaactgctttgtgcttattgctcttggagactgacctcctagatgattaggaataatccgcgagcttcctcaaggtgtggattgcttcctcaaggtgtggattttctgtggcaagtttttgagggtggacctcatcttcaaaaggaaaagaggtaactttgaatgaatttcgaggtggttgctaggaagttatctttgtagagcaagcttcaccggtggttggaactcgttgttaaagctatgatcttggtggtcgcttaaaatcgagggaaacctaggtggttgcttggaggctaaatacttcttcctagttgtttgtcaagtgaggcaaggagttaattgagacctagctctctggagctgctcaatgagagtagatccctgtaatctgaatttcggaaaaaaaaatcattgtctccccatgtttttggtccatcttgtatgtgtgttgatttaaatgagctaaccgtggcctgcttctattcggtaactatcacaccatgaagtttccctttcctagccttaatgcatttaataaatcaccaaacgaaattgtttaagttaacctagaatgaatccctaattaaaaactctatctaataagtggaaatggcttggtgtgatttttcttgagtttcccttgccaaaatatattaactggttcttgccaataaccgaaaatattttttaatagttttgtataaacaaagaaaaccagatacatgccctaagttttataaacacatttagagacctctttaagattggaggaaatttgaaatatttgaaataaattatgctaaaatagttttttaaatttcctgcattcccaagaactgatggagccggcttccgggtaggtcggacgattgcccaggcggccaggctctaccgttgctgtcttcactactgacagcaatagatgccaataaaaattatttaaccgaaaatgcttgtcgaaacatgaattcggcaatgatagaacggggtagcgcacgagacctaaaagtggatggatgtggagacaaaggatttagacaggttcaggccctctcgatgagaggtaataccctactcctgtttggggatttgaatccgccgggtgtagtatagatctgacgatcaggttgtctcatgccccctagagggcctcctgcccaccttatatagggtgcggggcaggattacaagatagaaaccttaacctacgcggtatcggcttcctaaatctactttacaatattatcaaatcaggactttaggccgctccataatataaaaggaaacgtaatacccaagtcatgatctgttacatattccatacatatatgttatcccctattactagtcggataaccatgccgtgtgggtatggggtacccataatctccacagtagcccctgagaccttcacagtcagaaagataatcttctctcgaactagattactccaaagccgagtgcttcaatcatcttcgccatgatctcccgagtactttttctaaatcagaagactgtggagggctgaaaaaataaagtcaggtgcatcgactagatgcaccgagtggtttcgataattgtagtcaaccaagcgacttaatattaatatgtagcatatgcggtgtgaatccctgaataatatgatccaagtgatataccgactgctttgtaaaatatgatgagtgtaacctaaagttggctacatcattgaaaattcacatagcaaaatagctataaggaagcttgtatgttgtgaataaagaaatttccaaagtattgggcatacgccatgcgcacactgctttaacagatgtgcttaagtccctagaagacacatggttccaccacacctggaaatatatggcatatgtggtataaaatccgagtaaataaactcataaaggatttaccaaccgcctgaaaaatgatcacaatatataatcagcctaagccataatattggtcaataaaaatgcacacttacgtggcaaaaagcaatgatattgtatccaatcaattgcttaaaaacccaaacagcaccatgactatataaaaaagtcagcgggccagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctaaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactctaaaataaatataataattgaatcccgactggcgcaagtattcggttgatagcccttacggggaataataattggtccagtctttgagcatagaaaatagactcatgactttgaatccatgtgggatgtatccggaacaagtccaaattggagatataatcctcacgcttgagttgatgagcccctgagcatatagcttgtccttctgtcatagtcaaaattgtatattggcaatagctgacgcagtcggcatggagatgaaatgaccaacatgaagacgaaattgctcatcagaagtaacggaagatgtcagtggtagtaaaaacagtgacaccaatcaaaggtaatgaagttgcataaccatggaggcgaagaaaccagtcggcaacagtcaggtcagccagcaatgaagatgaaagcgcccagcgataaagttgtgtagccatggcagcgaaataatcagtcggtgacagacgatgcagttggtgaagaagatgaagatgcccattagtggcaacataataagccatccatgaaggcgaggataccggtcggtggtgacgaaagcaagccgacggtgaagatgtagacacgcatcaaaggcgatgacgaaatccaccaatcatgaagatgaagaaaatagtcggcggcgacaaacgcaaccgacatgatgaagaagacgatgtcggtgatccagccaatagcagtgtagcaaccaatgataatgacaaagacgctcatcagcatttgcatagtaggtcaaccgtgaaggtgaaataataagtcggcgaaaacataatcatccattagcaacagcggagatgtcaggggcgatgaagcaaaggtgctggtgatgatgtcagtgacaataatccatcaaattaatgttatagctgttgtagatgcttcacttggaggagagttgatgttgttgtccaactcgttcaaaccgaaatatttgaagtagaatgtctgttccgaagcaaagatgaagataatgactcctggagttgactcattggctgatgaattgatttcttcagcttgacataaaatttgtcaaattttgagccttatatttgtgtagcccccgactctttggttagttgggaaacaactgaacatagagtcgagaattatagcttcttgtcgtcgagtagtcattgcttgattgaagatataagtagaaatcctgaatattggagagcctcttgttgtagtaaaataacatggcatcgcatgccgagatgtcgaggctcacaaagacgtcgtggttggtgaagtagtaaaacttgcgaagtagcagcaatagagtttgccagtgccgaagataataaagatgaagttgctccaccatgatgacaaagttgcatcgccgtgatgaagtgaacacgagtcggcggcaacagaagcaaactggtagcgaagacgcgcagttgtgaagataaaagcactagtcggcggcggcataaccagtcggcaacggaagacgatgatgtccatcagtagtggtaactgtataaaccagacgtagaggtgagagcactagtcagcagcagacgagacgaccggcggtgaagaagataaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaaggtagcatcagttggcgttataacaggccagccgtgcaggcggtgacaccagtcagctgcggatgcggcggccggtcggtgaagacgtagacgcccaacaacggcagcataataagtctgccgtgcaggcggaagcaccaatcggtagcggcgaaggcaagccggtcggtgaagacgcgccccagccgtgcaggcggaaacaccagtcggcggcggcgaaggcgagccggtcggtgaagacgtaggcgcccaacagcggcggcataataggccagctgtgcaggcggaagcaccaatcggcagcggcgaaggcaagccggtcggtgaagacgtagacgcccaacaacggcggcataaaggccagccgtgcaggcgaggacaccagtcggcggcggcaaaggcgagccggtcggtgaagacgtaggcgcccaacagcggcggcataataggccagccgtgcaggcgtggacaccagtcggcggcgacgaaggcgagccggtcggtgaagacgtaggcgcccaacagcggcggcataataggccagccgtgcaggcgtggacaccagtcggcggcgaagtaggcgagccggtcggtgaagacgtaggcgcccaacaacggcggcataataggccagccgtgcaggcgaggacaccagtcggcggcggcaaaggcgagccggtcggtgaagacgtaggcgcccaacagcggcggcataataggccaaccgtgcaggcgagaacaccagtcggcggcggacgaggcggccggtggtgatgttctgactgatccattcctagagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactcattacgtttaaacgctctgcccaactagtcatagccaccaagcactgggagtcggcctaagcacttcccaaacatgcatatgagtgacatgagttcttcattaatggaacaaagtttcacggatcggagtttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagatgaatattataaaaaatatgatataacatctgtagcccccgactcactactcaatggaagaccaattggtgtagtgaggcagaggaaaaggaaaaatatcatataaagaataaaataaatgacgacttagctttgtaatattccccttggtgatggcagaagtagccaatgtgggaacgaagcagtccatcaatggtgacaaaaacaccagtcggcgccagtggaaccaagccagtggtgtagatgatgaagcccattaacagcggcgaagtccgtcaaccgtataggcaaaaacaccagtcggcagcggcgaaggccagccggtcggcgaagacgtggacgcccaacaacggcggcatgataggccagccgtgcaggcgaggacaccagtcggcggcgacgaaggcaagccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaaacaccagtcgacggcagcgaaggtgagccaacggtgaggatgtagacgcccaacagcggcggcataataggccagccgtgtaggcggaggcaccactcggcggcgacggaggcaggccggcggtgaagtcgtagacacccaacagcggcggcataataggccagccgtgtaggcggaggcaccactcggcggcgacggaggcgggccggcggtgaagtcatagacgcccaacagcggcggcataataggccagccgtgtaggcggaggcaccactcggcggcgacggaggcaggccggcggtgaagtcgtagacgcccaacagcggcggcataataggccagccgtgtaggcggaaacaccagtcggcggcgacggaggcaggccggcggtgaagtcgtagacgcccaacagcggcggcataataggccagccgtgtaggcggaaacaccagtcgacggcagcgaaggtgagccaacggtgaggatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcgaggacaccagtcggcggcgacggaggcaggccggcggtgtagatgacgatgcccatcaacggtggtgtgaccaaccgaccgtataggcgaggacaccagtcggcggcgacggaggcaggccggtggtgaagtcgtagacgcccaacggcggcggcataataggccagccgtgcaggcggaaacaccagtcggcggcggcgaaggccagccggtcggtgaagacatggacgcccatgaacggtggtgtgaccgaccaaccgtataggcgatgacaccggtcggcggcgacggaagcaggccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgcttgttgataggaaactcgacgcaacccctacctggcgcgccaactgtcgaaacatgaattcggcaataataaaacggggtagcgcacgagacctaaaagtggatggatgtggagacaaaggatttagacaggttcaggccctctcgatgagaggtaataccctactcctgtttggggatttgaatccgccgggtgtagtatagatctgacgatcaggttgtctcatgccccctagagggcctcctgcccaccttatatagggtggggggcaggattacaagatagaaaccttaaccaacacggtatcggcttcctaaatctactttacaatattatcaaatcaggactttaggccgctccataatataaaaggaaacgtaatacccaagtcatgatctgttacatattccatacatatatgttatcccctattactagtcggataaccatgccgtgtgggtatggggtacccataatctccacaatgctattatcacctctactcaacggcggtgctacctctgctactgccaagaagcccttaattaacgttgctgcgaaaacccatgattctaaaaattgtagggtcaacactgtagcgagctgctaagcctacgatgaagcaagtatatgcatggcatgtgcttttgttcagtggacactgatgatcgacctgcgttttgttgagatctggatatactgcaggaatggaatattttgtggaagcatccgtggatctatctgcgctgctggatcgtcagatcagaatttggcgaaatgtgtatttgcaaaaacattcccgaaaccactaatccaatgatgtatgtaacatactgatgaatatatatgtgtccagtcgagactatgcagctcggcaaaagacaccatttgtcagccttggagcacattaattggacggttcgacggttcgaaagggcgcgacacatgcagaaagccctactgatcagtaacagtatggatcattcatccgtggatcaagatctaggaacaatggaacatgcacatcgaaaatgaatgattgaatgattctctgatcacggagaaaacagagaaaaagaaaaatagttggcttataaactaaatttgcaagagagtaggaaaaacagttaactgaagaagtagcatttttctctccttaattgagaaacacgcaggggtcttccggctagcttaattaataagatggtgggctagctagcctggtttcgaagcctcatccattttatttatttgatattacatccttctctaatattcgtgtttttcccccttaattggactggctttctcgatgtaacaaggattagctatttgtcaatcacctgcctagctgtatatataggagacgacccaacacacactgatcgccttgctctgcccaactttggcgatggatgatgcatcgcaaagtatgcaaagaagtataaagtctattttgactaatttttagggtggtgatatcttagctaatataatttagcaagataatttagccgatacagcataaaccctaaaacgaatctcagctgatacaaaagtaaattaagatgctaaactagattaactaagatatatgataaatatgtatgcaagtataccaacca

SEQ ID NO: 2768 - DNA, 1337 bp, Oryza sativa
cttgaggaaaaaaaaataaaagagtggtgctatgaaaaatatattttttaaagtagtgtcacttataagggcgatccgtgcacactgctaaagccacagaaggaatgaattaatggtcgccacatctatctatatctctctacttgttcatgaaaatggccatccaaatcctactctatactacgtatgtgtgtacagcgtgattccacgcagccttagcttacccgtaccgtacgcccgagtatgcaagcatgcacatatacgacaatctgttgtggacagccatcacggtcaatcgacaccccatcctctaaccaatgataaatccccattctttcttgatttgactttcgttcgaggtttttaatagccgtagacgaaaaattgaccatttgattcatataattttgcatctctgtatataatgatggaattataaaaactatggcatgtgttttccgactcctaattaaacgatgtgattttcgcataaaaatatatacgacttagtaatattgttttttaatctatttttaaaatcttataatagttaatttattttatttgtactcgtacataaatagttatcataaaatcatttagctattcatgggaaaaaatattcccgtaagacaagctcaatcatagcttaagaatagacataattaaattttttttagataatgaaatataatatccggcctttactcaaaagcattgcattccaatcgagtaactggaaatgtggaaaagctatataccagctgggttacatgcgtgtagagtaattaagcgtacggtatgctgttgatcttcccagttactccctctagttttttttagataatggaatgtaacattccggcctttactctaagagttacagccaattattatggaactcacacagaaagttcacgatagcagaaacaaagctaagcaaactaatagacaccaacaaaagaaaaagatcccctaactactgaattctaatagagaacctccacccgaagttggcaaatagatgcataattgtcgtctcaagtttacgacattcatcatttattagcttgatatcttcatcatgcctttgcaactgagcccaaccccgaagccaatacgttgccctgaaaagcacctgcaaataggattttgatggtgttttatcaaaaaccatatcatttctactaagccaaagagcccaacatatagcggaagctccaacaagaataagttttttgatttttttactaacacccacaagccattcccaaacatatgagatatactatgtggaggataaagtccaaaagagaattgtagggctctccaaaaaa

SEQ ID NO: 2769 - DNA, 384 bp, Oryza sativa
gtcacgcgaaaaacgagagagatgttttaggaaacctgggggtaagaacacagcctgagggtgtacggtgcgaggaccggcgatgcgactgtatggtgtggcggtagcgactttgtagcgggtggctagcggtgtagcggtgaggactacatagtaggccaacacgatggcagcggccttgagggagagggtcacatgagtggactgtgacatggagcacagcagggagtgagcacgtgaggagcagcatcacgactaggtggtgcggcgggggtagcgcgctgcgtgaggagaggcggcagtgacctcacggtgggggtggctgcaacagtgatgatagcgtgactgcagcgaccttgctatgagacatgggtgcacagcgct

SEQ ID NO: 2770 - DNA, 811 bp, Oryza sativa
gttatgtaagattcagctgtggcagttccagcatatagccactgggatccttcagggcattcttctgcccagtactcaggaggcaaaatgtccaatgcatttgaaccaagtagggggaaatttggtttcccattggatgtaaataattattcatacagctcagggacctcaagtgtggaaactttattagatgcatcatgcgcaaatcatgatggtgttgccaaggtaattccagtaaaggaagcggaggtctcatgcatgcctgggtttctcaataatgactgctctgatggcgatgaatattttgataccccccttgttatggaggaagatgccctcgaagaaggtaaactcttaggattattttcctgattttagttgcgatatgattttaagcatgctgcactaagcaatgatgaccccatttcataggtcaggtaattagatttacaagaacaataattttggtcatgaagctctttgaacacttctctgtgcattttaattgagtagactatgggttttcagatgactcattgctaagtttcttgtacagcagagttcttatagatttctgacatacatatatcaatctataaaggttgtcaatttaatctgatagcagattattaattctttcattctcatccaaatgagtgtgtgcaattgatgtctctcactctttgaactatcatagggagcaattgtttaattcttgtcagctgtatctttttcagatcatctgcataaatatgaatcatgtgcatcagtcaagggccagatctcaaaacccaggaagcaaactgctgaa

SEQ ID NO: 2771 - DNA, 641 bp, Oryza sativa
tgggaagtgcttaggccgactcccagtgcttggtgctgagagatcccctcataatttccccaaagcgtaaccatgtgtgaataaatgttgagctagtagggttgcagccacgagtaagtcttcccttgttattgtgtagccagaatgccgcaaaacttccatgcctaagcgaactgttgagagtagcgtttcgatttctgactgtgttagcctggaagtgcttgtcccaacgcttgtttctgagtcagtgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagtgagttgctagaacccatggctcctttgccgacgctgagtagacggcaggtgacgggtggtgacaatgagtccgtgtcgagcgctgattttttcggcctttagagcgagattcatacaatagaatttggcatgagattggattgcttttagtcagcctcttatagcctaaaggctttgagtgactagat

SEQ ID NO: 2772 - DNA, 856 bp, Oryza sativa
atcagggatgaactcaatctggtcgtcgtcggacccatcttgtgtatccaaaacaaaattctcaccttcttccaataatggccagatattcgacagtaccacatgcctcgacgccgtttcttaccgcgcatctctctcatccgattcctatggcacacacttcaactctatctaactggcccctttgaatcaaaggaattatggaggaatttcataggattgaaatcctataggaaattttcctacgtagctctttgattcaaaggattaaagttttctaaatccaacaaaattcctatggaatggcttgttgcatatagattttggaggaaatttagcaagaggtctaatctcttggtaaaaatcctttgagtctatctctctcatccgattcctgtgtttttcatgtggtccaatcaaacgatcattcctgtgttttgtaatcctctgttttatacttgcattcctgtcagaatcctatgttttttctattccttcgtttttttcttcctacgattcaaaggagccctaaaagtttttattgtgtcaatattaccactaggaaaatcttggccgatctcgagttgtcgaccatggaattattaacaatgaacggtccagatttactctaaaccaatttaccgtaccaatctctgaaaaggatccgacggatcacataaaaaaaaacagccaaacgcaaagcgggcaaaaaaacaccaaatctcaccaaacgacattcgtgcggcgcaggtggagtggacggagcaaggccgaaacggaaggccgcaaacagcaagcagcgttgccggccttggcttggctggtggctgctgcgtgcggcgggaagcttcccgga

SEQ ID NO: 2773 - DNA, 676 bp, Oryza sativa
aatagtcttaatgaaaggagtttttttggaacagtgatgggttcaaggacccaaattatttctgatcttacaaaggaacaacaactagatttcattgctttatcggagactgttaagagagattttacatctagtgcccttaaaaatctttgtggcgggaaagattttttgtggcattgtaaacctcccagggggtgttctggtggtatgttattagggattaatttacaaacttttgatattggttcaattgatgagggcgatttttatattaagtttcatctttgtaacaaaattgagaagtttaaatgggctttagtcttggtgtatggacctgcacaaaatgatttaaaggaacattttctttctggattagttcatatgtgtagccatgaaaccttaccaattattgttggtggtgatttcaatattttacgaagcactatggaaaagaataatgacaattttgataatagatggccttttctttttaatgctatcatagacggtcttagcctcaaagaactctcaatgtctggaaagaattatacttgggctaataatctttcagtacctacttatgagaagttagacagagtattaatgtcgacggagtgggaacaaaaattcccactttccacgatatttgctcttaatcgagatatttctgatcata

SEQ ID NO: 2774 - DNA, 1012 bp, Oryza sativa
ctttgcattgaacccatacctttggcaacacatatttcacctcattactaactcccctttcaattatcttcatttctgcatcactaaccttagtatgtactattccccattctaccatgcgtttcagttccgcagcagaaggaaaaatagtacgaaaagtgttatctccattatcttccaccacccacttccaatttccaggaatcaatctctccaattcagaaacaacggtctgcaccgtcatttgtcctctagttactttaactagggcagccttagaatcatgttttattctctggccagctgaaagagggatatgaaaaaaaccaagaccatccactgcatacccacacaactcagctgagggtttattattagacctaaaaataggacacctggatcctatatggtcctcactttcacaaacctcacagtaaaatttagatgtacattcctgcaacgtatggcctttagtatagcatctataacaatatggattcttgttaatacctttgccacctacatgcacactcagctgattatccacctttgctttaccagagctcttgtcccccataattaaacctctacctgcattctcttgagtagatggcgtaacggttggttgtgaagtcccaaccatcgtctatactgcaaccactccagccgaggcaccagattctcctacagcggtcaaatgccgatcaccagctaccccgccaggaagatgcacattatcaccaaaaggagcaatcccagccagtacagaaccattgcctccagagttgctactagtctgtgcaccggcgcccgtcaacccggcaccatgttgagctgctgtcgatccctgcgcaacaccacccgcaatcatcccgccaccaaactgtgcagccgctcctccaaattgtgccaagccactgccggcagccaatagagatgcgtcgccaccaccagccggcaccggaggaaactgaccaaacgggcaacgggaccggctgcaatccaaagctaa

SEQ ID NO: 2775 - DNA, 1204 bp, Oryza sativa
gaatgcttagtaggagtacgacaagtacactgccacatctgtacaaaaggaatatttgaagcatccaattaatgttgggtgctactactagtatcaacactacagattggtgttatacacctaattcgagtgatatggcgccaaaacataagggcttaaaataatccaactggtctaatcaaattcaaaaactccatggatggtgctttgccgcccaagggtaccctccataatcctcaagcagcgaggcagctacaagccttttatcacttcatccatcatcctacaaaccaactccacacctacccatcacaatggctatagatctaaacatattagcagaagaagaggaagatggaggggctttacctgacctcaatgaagcacaagccaatctagaagaagaagttcctggaaggcatgttatctaggtagatgacattgctcgagttgcttgccatggaaatgatcaagttgtacattcttttgatctcaacttgggagcttttgatctcaacttggaagcaacagaagaacaagaacaactgcatccaggttttttacttcatctaatctttctcaatgcataaaatgggttctttctcagtacatgttgattgcattagtaaatctagctctaaaaacctatggtgttgtatgacatgcaacagcagattataccccctcatcagcacacatgctctatctctctctctctctctcacacacacacacacacacgatctgaaaagaacaaaaggttgctactgtgacagttttgcagagtttagttcttctagttccattatcatgtatcagaagacactttagaaactagacaacaggtgtagtaatcatagagagtaaaactcaagacatgtcactatggtttcaaatagattaaagcattggcaaacaaatagattagatttcagagcctagtatgaaattttagttcacatttaaccatttcttttcagaatcctagagcatctggactttacagaagatagagaaaacaaatgaactgtaaatagcacattgttacctaacatcgaattagggaggaagtaactttggtcatggccacagcatgttggaagaattaacaggcacaacctattggtgagcagaacgatgtcaatatttactaactgattttgttaattgctagtacaaagaaccaatttattgcccagaaccc

SEQ ID NO: 2776 - DNA, 15638 bp, Oryza sativa
ccccccccacccacgtcgccgtccccacgcaatcaaaccgccacggatcaatcaccccccgccccgtccgtacgtctgcgtctgcagccttccgtttcgttttcccattttccccctccctccctccctctgcgactctgccagtgcattgcctatctctatatatccatccacccatctcatcttttgtctctttctgctgctggagtagtattgttcatttatacatgcgataaatatcgagattaagcggaaactaaacatatataccctcgaatgaattaatgaactgaatccgtaaaatatgtatggtagatcggtagtacgtgtttgttccttttttttatataaaaaaaataatttgctggtgtttgatgatgcgaaggattgcattacattgatgatccaataattcgctcacgacgaaaccgcataattgcatttgtggttttgtttctcctcctcggctcctccctatatatgagctcgccactgctgccgcttctcctcgtcctgtacaaaactacacaccatcacgagaacctcctcgtggcggcgagctctcgcgactcgactctcgcgtcgcgcgcgcgcacggcgccatcaatcgattctcacatccatccatctgcctatctatctctcgcaattctggcggcgcgctgcgcgcatagggggggatcgaatttgatctagtggtgatggaggcggcggcggcgatggaggcggggcggaagctggcggcgcggcacccgcacgggcggagcaggacggcgcacaacatgtcgtcgtcgtcgctgcggaagaagtcggacgccgcgctggtgcggaaggtccccgtggcgccgctccgcccgctgctcgccaacctccaggaggtcttcctcgccaccaagctcgccgtcctcttccccgccgtcccgctcgccatcgccgcccagtgcttccgcttcgaccaggttaattcaattccccattccattccattccatgttcgctttgaccatcctcttgtctgcttggtgttcgttgcatctttttttttttcatcttttttttttcgagttcggcgtttgcaagcggcggtgaccaggtggcaggccgctgcggcgcctattttaagtttttttttaactagtataaaccgagatatagtactgtagctttttgctggtaaggccacatgggcaactgcacggctgcacgagggctgtgtccttgcactcctgtttcttttctctctctctctctctttgacacttttatttatggtgtaggattaattttcgtaactgtagtagaattagccatcaatgtctaaagtggtactagtaacagtgttaaaaagtatacatacaaaaaatgttgtcttgtaccactagtactagtgttaaactggccatggacgttccggtggacttcctgattccacttgaaaattaggcgctgttaggctaataggacatggaaattatttcccactcactagaatacatctttaaatcataaccattcattttcgctctttcatttaatcctaacccttcgttcatttccaaatctcaatcccacctcacatttctcattatctaaacacacccttagtacatacatttatggcctcttttaaagaagtcaataaattacagaaatttctcatacatcagttcaatttccacaaaattcctaggcttgatgacgcaataagcatccatgtctgccagatggcccagatgtaacctgaaatacaggcctaggagttaaaatgtggagcacttcattattcagtattttaattttctgttatgaactgttagcttgtgatttcctccctcctctgtgatagtagaatattcccccgcaaaacatattttgtggagtagtttgtattgcttgctggtggagcctattagctttgccagttagtttgcctcgtcgggacacaaatattctgccgtggagccctgagctttgaagaaaacccatctgtctccttgcagcaaaaactgaacttaatttgtcatcttgcaaattgcactcgattcctctttgatccgccaaattagcggcgtcatgccgttttgctgcttgctgagtagacgacaggattctgccggtacaagcggctgggacgatgacgaatccaacccatttaattctttgcctcttggttgagtgtacttctaccccagaaagtgatcaatctccgttgtgttttggagcttggtgaatcagggggtttgattgtgtgttgtgctaatagatttagcttgatttttagtttcgaaaggaaaacagatttagtttggtttggagataagttcacactctgctgcatgcatcatgcatggatgatgagtgaagctgcttcagtaaaggttggaagtgttggattttagtggttgaggccaacagtctgtcacatttcctgattagttggaagagacatgttttattcctgattagttggaagagacatgttttattccttccacgtggcatctaattatttaattgtgatgcaggtatttttgctgatccagtgctagtaaattagtgataaaataaaataatgcgttaccttacagtactttccctttttttttgtcgatatgtcttcatcttatacttttaactactattgcacattaatccaatatgtgttgacattgggaaacaaatatttatcttgacaggtgtgggtgttcgctcttagtttactgggcctcatccctctcgccgagagagtcagcttcctcacagagtaagctactcgttacagaagcaatttttatgtccagtttttaaaaattctgtttataattcgaatgctgaaattttgcattttgctactgaaattttgcaggcagattgcactctacaccggtcccaccggtaagtcacaacgatcagtcccaaactgaaagtaatttaagacttcatattattcgtggatggaatcatctttcttaacatcaaaaaatggcacttgtttctctattcgttgtagcaaatgtttttttaaaattataaaagatcagagaaaaatgtctcatattttgctagagaaaccaaaaataattaatgctacatttgtccacatgcaaaacggatggatctattagctcttgattaattaaatattaactaaaacaaacttaaaagatggattaatacgatttcttaaatcaatttttttcaaaattttttcagtttgaaaaaaatgagcacggagaagaaaaaaatgagctaccaaacacagcctaagcattgtatatgaagtaattgaacttgctgttgtggtgtgttgatgatggtgtatgcatggggggcagtgggcgggctgctgaacgcgacgtgcgggaacgcgacggagctgatcatcgcgctgttcgcgctgctcaaggggaagatcgaggtggtcaagtgctccctgctgggctccgtcctctccaacctcctcctcgtcctcggcacctccctcttctgcggcggcgtcgtcaacctcggcgcccgccagccctacgaccgcaaccagtccgacgtcagcaccgccctcctcttcctcgccgtcctctgccactccgccccgctcctcctccgctacgccgtcgccgctggcgagcactccgtctccgccacctcggccgcggcgtccctcgacctctcccgcgcctgcagcttcgtcatgctggcgtcctacgtcgcctacctcttcttccagctcaagacgcaccgccagctgttcgagccgcaggaggtggacggcggcgacgccggggacgacgacgaggagccggcgctcgggttcgccagcgcgctcttctggctcgccctcatgaccgccgtcatctccgtcctctccgagtacgtcgtcggcaccatcgagcccacctcgcagtcatggggcctctccgtcagcttcatcagcatcatcctcctccccatcgtcggcaacgccgccgagcacgccggcgccatcatcttcgcgctcaagaacaagctggtaattcaaacaaacaatgtgcatcccatgcaaacgatcagagtcgtctctcctgaaaacaaaatcaatgtttaacttgctaattaatgtaacataatctggtgtttgattcaggacatcactcttggggtagctctgggatcggccacccagatatccatgttcgtggtgagtgctgctgcttaacttacccagtacagatcctgtagttgttctgctctcatccggttgaacggattgccaaatcatgatggggttgcaggtgccactgagtgtgctcgtggcctggatcatgggggtccaaatggatcttgacttcaagctgctagagaccggctctctgttcatggcggtgctggtgacggccttcaccctgcaggtacactgtgactcatgcatttttactttgaacaggtggaaatggaatttagtcaccgaaaattactcagataacaggataacatcttaagtgacatgttgcaattcaatgtgtcaactaattaatgggcttgatttacaggatggaacatcacattacctgaaggggattctcctcctcctgtgctacattgtcatcggcgcatgttttttcgttgcaagacaacctgcaggtatgtttgcctttgtaaaaaaatagcatgtttttgcacttgattgtaagtcgtattcacaataatccttcgcatgataggccatgcaaacagcaatggagccttgctggatgtaccaaccggttccatgagtgttcaggccgcatgatgggtaagctagcataatcttgttctagctaatacaaagacatgtgatcatttaatatagaacattgatctttaattttgaagaaaatgatagaagatgacttaaaaaaaatcaatacgtatgtatagcttctggtactgccgtatctctctatgtggactaccatatatttgtcatgatttccagcatctggtgtgacagagtagctaatttgtcggactcttggaatgcttaagtatgcccgcatgtgtctgaacaagtcatcaaataatagcatgtagtcctgacaggatgcacaccaatccctttcattggtattaaactatatactaaccttttggaacagagtgtttttactcttggagagcagagctgtactgtagtgcaatagtacttaatttaagctaaccacctgtactctgcacaattcttaactatgtccagtcagttatcttcatatgagaacatggaggtttttgtccttcaaatgagcaagactattagtaataagatttccagctccataatgtgcatctgatgcatgggaaaaatttcagatcaagatgtctcctgaacaaaacatggaggacagcaagcaatgtaccttggctgtcaagtcacttgggagggtagctcttcatgtgccagcaagacagatcatcatgatcatcagagtttcctgaagggatgcattggaagttgcacggaatgcatgtcaaggtgttactaatccttataggataaggatgcaataaggatatccatatatatttgtgcccaatcctatacccagtgtacatgagcacatttgttccatctatgcagctctcaataagatagtatttgcggtacaaatctatgctctcctaagtcctaacagggtgatgatgtaagagcagatcatgtttatgtctgcaactctacttctctatttcatcttaaaactagaatgtttttcaccatgatccgataatgaagtgacaactgccgaggtttcaagcagcgtaacaaaaaagaagattaggacaaccaaaagaaacgcctaagaaaacccaccatttctatgaattgagactgaaaactcctgttttgttttctggcatctccttttatcaagatgaaaacattctgttcatttccttccatgttgatataaatgtacagttcgtaaggaacagaagaagttttttcttttaaaaacataatgcttaaataatgtttctttttcaaacatctgtccatgttcttgcctaggagttaaatgtgcctaatttgtaaggctcagaatagaactagttttcatttaccttgagaagcctgaacaaaacagaggatgctagagagcaagcaatcttctggcttcatgttgtgaaacaccacaatgatgatatcagagtcctgaatggtacccattgttgcacgaaatgcagcttcaggagtcaacttcattgccaattagccaaaccaagaaggaaacacgactcctatgtgatacctaatagcagaaacacgaactgtgcagcagatcatattaggaacaaaaacacaaggaacttcagcctaaatacttggacatattatgccaatcttttatctccttagcagtacttttgttgtactccctatatgttaatttatatacccggtacgagtaatgatcgactaaaacatgggtgagcactgaacaatcctgcataagattaactgtattttactcaatattatccctatctaattgaaaaggcaattcccctgccagaattttagaaaaaaagaagaaatgagacagcaagtgtaaactaaatctttgttcaatcgtagaactagaagtagtattttgttcaagtgtaaactgatgaggtggacctgatatcagaaacatagtgaagtgattttgagttagcctttccagtccaactgaactatgcgcatatactttgtgtttatataaaaaaaaagtaaaaaggataacaatgtataaaagagaagacagaaggacataagagtacacccatgcctaacttaagagagaaaaggcaccaagagatacatgataaagaaattaaaaatattattaggttattggctgcagtagtctacatggactggattccctaagttagtttcagcctgtcatattctgcatatttaaatgcatggttccatacaaccatccataaaaaacctgcgtttttttggatcaattcagagccctttcgagcagcacgattcataaggagaatgtaatatttttagtcaagaaagaaaagtgtgtgcaatgcttgaaataaacattcaccagacttgcagtatgacaatgggaaagcccataaacaaattggatgttataactggaaattcagttagcggatacgagatagagctctcactcctctcagttaatctgctctttccatgtttagatattctgtactgacaatgcattcaaaaccataagatattcttcttgatcgcacaaatgactaaaaccgacgattagcaatataccacctgtaaattgcacgatagattaaacattattgtcagctattgccaccttgcgaatcattagggtctccatggaggccgcacttgagatgccaatctgctagcacggcctgaagaacggaccatatcaccagtaggacgttggctgttcaccggccgtcctgcccgtcgctgctgatgcagtggagcacgctctctcggctgctcactgctgccacgcctcatgttagcagcctgcgatccccatgcccggccattactgatctgaggtccgctgtgctgctgctggagatggacaccaggaatgtagaagctcgtgtacggcacgacagcgtagaagaacccattcttgcacaccttggtgacacgcattgatctgagctcaagtgtgaagacacccgcatctgttctcaggaagatgatattggcaccctccacaaatccaattggtagcactggggtagagtgatcaagatttggtagcagactgtctagctcaatgaccctgcacttctcccaatttgccacaccatgtccatgatccaggctcacatccattgaccacacagagaggaggctgtgatcctccacggccgcgagcccaagcacgccatcgttgtccagcggcatgagcacgaagccatcgtcgagctcagccggcggatcgatgagggagaggcgatggcgcttcatgtcgaacttgacgactccgataccaaacacgagggcgaagtagagcgaatctccgatgagggtggcgggcttgccctcgacgcagaactcgggtcctcgggcgaggcgagcggaggtcggtgggctccactcgtcggactccgacgagtacacggtcgcccacgcctcgttgtcctcctcggtgcccaccacgacgacgcggaaggggccctcgtggcagtcgaggtggtcgcagccggcggcggcggcggcgcagagcaccgcggcgttgtagtacaagaggtacgggacgtcggggcggggaagccgccgcagcaggtggcccgtcatggggtgccacacgacgaggtcgatcctggaggggtaggcgtcgaggagggcgcagccatggcggcagtcgagggccatcccgcagtggagctcgggtggcggcggggggatcgggagggcggtggtggggacgaagcggtcggggtggtcggcgttgtcgaggttgtggaggaaacccagcaggggaggcggcgcgcggcgtcggcggcggaggaggaaggcccggtcggagaggaggcggcgccagcgcttgcagacggcggaggcgcgggcgaggcaggcgggctcgtcgggggggaggcggaggaggatctcgtcgacgaggtcgtccatcagctccggcggattcatccttctccggctcgccgcctcgccggcttctgcgtttggggttcagagtagaaatttgggattatctcaccagaaggaaatggaatttaccattctcaatcaacttaacagaatagtacattttctcctcctatcctaatacattattatatgattattttataaatatatttatagatccatgtttttctaaaagaataatcaaattgttttagactctaaattacctgccgttgtatagtgttatagttagacagtaaatttcaaaacttacgctataaaacaatatttgcattgtaatttttctaacacacaatgtacaaatgaattaggattgaaagtaatttactactaccttcctttcatgttataagattttctagcattcccacatttatatagatattaatgaatctaggcacacatatacatctagatttattaatatatatatatatgaatgtgggcaatgctagaaagtcttataatatgaaggaggaaatacatgcttggaagagaagatacgagatagaaacatacttgcataacatataagagagaatacccacgtaggaaaaacataactgaaattaagtaaaaaaaaaaaagacgatctacttgccatggcgatgatgacgaaaagatgccacatgacccacacctctctttttttcctacacaccttactctcactgtacttcacatcatcctaccctcaccgtacttttagagtatctccaacaacatctccatatcaaactctccaaacacccatataaccaactctccatctgatttagctagtcaaactagttactcgctccaacagcctctccatctaccatctccattataagtctatgacaaatgggacccatgtcagtctctgctaaccttcttccttctcttccaccacatttttccccacccatacatctctcttcttcctcatgtactgctgcctcctccccacgccctctacctcggacggcggtggtcgtggcagaggtcacggtgggcgacgtcaggagggcgacggtcacgaaggacggcgcggaggacagcggcggtcacggaggatggcggcggccgacggcgcgggggacaacggcggtcgtggaggacggtggtggtcgcggctggcgacgacgcctctctcctttgtggcgtcgttgatggcaggacgttagcgagagaggagccggagaggagatgggaggaggaatgtgcgaggggcccatggttggctagtggcttttggcttgccaaatttggctagtggattggagaggctgttggagcatgtttttttttggcatgaatggctaaattttggcttggaaagtataatggagaggctgttagagatgctcttatgtcgctaccactttcccttctctgagtccaaagaggataataaatggagtagagaggagttaggttagagataaacagcagaggagctaaatgcaaatatgttaccatgatgagtttcagaggggactacttattaaatttttaccaccattgacaactatcgacgtttgatgtcgcgattccggtatttgcatagtatggggatcgttggtactaggatatacgcgagactgaggtaaaagagacggagacaggggtttttatacaggttcgggcccctgaattgccaggtaataaccctacatcctgttggccaaagccggtattgctcttattcaccataatcacaccagtacaatgtttggggtagcctatctaactgttgtcgacatggcggtctgaagatctgactcgtagtcgacaacagggtagtcttcctcctcgagttcgtgcccggcgagatcagagatagcgctttcgtctctcctgatagtatccggagacaccgtaggggactagccgtgccaatccctgaagtcgatatccggcgtcttgtcttggcgtatgttggcttgtattggctcacagctttgtgacgtctatgttacccgtgtctgttgattgtgggtgtgtatcgtcgtctcccctctcctcctagggggccttgtatttatacccataggtgtccccttgttcaagtagaattagggaaaccaatatggatacaatccgagtagtctttgtcgtttccatatagaactctggttgtctttccttatctggaactcctcctatatccgcaggttgtttccgtataggacatggtatgtggtgggtcctgctgagatttagtcaactactattagttatgtggtatccataaccctgacaacaaccatgtcagcagcggagacctaccaaggtgtttttctcctattgtgatacattaaatcagcataactgatctaaaaatgcaattttacaatatttctcatataattatctcctctttttcttcctcttgcttgttatcatctcacccttctgtctctgactccaccacctcctcttgtgtctttgtcttttaaatctcttttttccagtttagctttcctagtctagcctgaacaatttccttgcttttagagtctctatattattttctctctttagaggtactacctaagtttaagttagaggcaatagtaatattattcaactcaatcgaatctaacaactgaaatatagcaaatggattaattagttgttgtagcttaatgctccaagttcttcttctaggtgagtatcttagttcttttggttattgggttagcagccatctccctttgtcttagattcatccttgaagtcactgcaagttctgttttcttagccctgttcttctttttgttagacacctcttggaaattgtcctcttcattatcttcttcctctctaagtctttcaatgtcagaatcagtgggaatctgacatctctcaaaatcatcatcagttggggaacattcatgcattaatagcttctcatttgtcatttcacctccctcatcttgagattgcatctcgaccggtgtcaccatctcctgagactcttgttctatgactagattttcctccttcttcccccagagcaccatagtagtacaacattctgtcttttctactttcttcagcaatgaatctttctttgatgccaatttcttcagggttttcccactatgagtcatctgtgttttccctatgtaagtaggaggtgcataatatgttccaaatctgctcccttgttggctcccttcacctctgagtttgtctccctcttggactatttttggttttgaactcatcatccatgttcatatcttcttcctgaccctcattgtccttgtcatccttacaatctccatcatcaaggggattttgcctattttcatatggtggatagccatctggttatcatatgatcatgtagcccaccttgttgatgtagatgtgtatggagaagtgtaattctctagggtccttacatacaactctcagtctcacacaggcttatctttcctcaagctagctccctcaatagcctcaaattccccaaccaattttataattgctttaactgaatcttctattctggctagtttgggtacaccataaattttcacccataaaactaccggttcatcttctgcctcttatgttatccttgtctcaaccacaattgccttgatcatagatgtctcaaagtcaaagcttttacatgttgagatcttactctcaccttatcagaagaaaaattaatgagaaattctttctcattaagttgtttcactttccactcccaattctaccccacaaacaggtgtttcaattcaataaccaccttcccacaactgtctccccatggattactgtcaaaattcctcttactagagccctagctaactctgtttctaacatatcaacttgcaggctatagaaaccttgccctaggattccaaatccacatagtttgatacctcttttcatcaaattcattgggcagtgtatagagatgtgctagtgttgcgacgtgaataacagagaaagagatttagacaagttgcctggttgtgaccttcgcggtacacttgaagaatttgatcttaggagctcccgcccctcgctctgcctccacccctagatggcgccttggtttgccctggggttttgggcaagcagttgccgccggagctcctcctcttcccttgcatcctgtccccccctcccaacctccaccgtgctccaccgtacaatgtttgttgacttgccaatccgaccgatttgccagttggcgctccatcaccacttgggcaaacgaaaacggtggtcgcacttcctctccaggaccttccaaatccggcgcgctgtgtcaccaaatcgccatatctcatcacctctcgccaggaaccctaggtgtggttgggtctcacctcgccttacctagatctactcttgcgaaacaatgggagagatattggggaaaatatcctccaatccaatcctcaccttagttttgtcatgactttccctcggttgctccgcttggggcttcgatctcactgtgggtgggcactgtagctagtggtcttgtgtcgccattgatgccgatctcgggccattcctctgtcgaaacttccttcacgggctgcagcttcgcgccacgagcctttgcttttgggccgcgtgccacttccgtgaggatatccgcatgggtaaaccccatgggacaccggttggtgaatggtgatcccctccggcaatcgccaacgcgaggacctcggtggtattgccatgttactcctgctctccctaaaccctaagctcaaagccatctttcctcaaaaggcaaataattgtcaacactggctgcttccgctattcatgatgcactaggctcaatcattcaatcgattcactatagtgagttagtgacctctgctcgtaattgtctgttcctcttgaaagcaatggctcctcttccggccgccggcgcggcggggcgcatcatcctggcgcacggcgcgtgccacggcgggtggtgctggtacaaggtcgccgcgctgctccgcgccgcggggcaccgcgtggacgcgccggacctcggcgcggccggtcagcgaggcctgggcgtgggcggcgcgccggcgtcgtcgttcgcggaccacgcgcgcccgctgctcgacgccgtccgcgcgctccccgacggcgagcgcgccgtgctggtgggccacagcttcggcggcatgagcgtcgcgctcgccgcggagacgttcccggacaaggtcgccgccgccgtgttcgtcgccgccttcctgccggactgcgccaacccaccctcccaccccatcgacacggtaataaactcataccatgatgacaaaattacgctttcttttcctcttattttcgccatgaatttctgccactgccagtatcaagaatcagattggatggacaccgtgatcgatccaagccacgtcccaccttccatcctgttcgggccggagttcctgaagaagaagctctaccagctaagctcaccggaagtgcgtctgctaaactgttaattaatcactaatcgcacaactcctgattaaattaaccatgatctaatcagttcataacctaatcagcacaggattacacgcttgcgaagagcttggttcgagcgagctccttgtacgtggatgagctgcggcggcgggcggcgttcagggaggacaggtacggcgccgtgagaaaggtgtatgtggtggtcgagaatgacatggccatcgtccaggagcaccagcggtggatggtcgccaacgccgaggtggcggaggtgagggtgatggacgccggcgaccacatggccatgctctccgcgccggaggagctggctgggcacctcgccgacgtcgccaacacatacatctaaaattaatgcgattgatggagaattagttaatttgttttcttttggatgacattatggtgaaacttgatttgggtataggattagtactaagtagggttaattggatccagccattataaatttgtctatttgaaaatatgacattacaaacacatattgtaaatatttacaatatttttaatatgtacaatagtttttttaaaaaaaataaatccattttcaatatttacaatagctaatatttaattgagagtaaactgtactttggacccctttttattaactaagttacatattgcactaggtaatatcatttcttttcatttacactatgttttagtattacccaaacttgcatattggactggtgactcacatgtaagtgagcaagattttcttcctcctcctcggtattccctgagcccgtgtggtgcatgtcactcaccagccttgttaatccccacggcagtcccctcttctcaccatgccgaagaaagatccatcctcttcttccccactccaccaaacgatgatgaggttgagcgcgctggatttgggatgaagtggtgaaggtggatgagcctgtgcagcacagtggttgagttcgcagatgaattggagctcgatctttagacgtggaaagtgctggagctcgagctcagggcaggatgtcctcttgttcttacccggcagcaagcaagcaagcagagcatggtgacctcttcacctctttctcattttttgctatcggcgaggagccagcttgagcttgtttggccctgttcatggcggcaactacaagctcagatttgcatgcctaaaggaaaggagtacagagatgacaagaacgggtataaggtgaaacgtttagcaaaaatctgattcagagtgaaaagggtaagttaatcctagtccaaattacaacatgataaaaagagacggttcaatataaaatttacactttaattaataactaaaaaagtagcccgcgcattgcatgtgtcataggttgcatctgcaatgtgtcataggttgcatctgcaaagtgtgatttctccgtaaattttctttgtcagaattgcctaggtaattttgttaacttttatactatgcaatatttaaaacacgggggatcca

SEQ ID NO: 2777 - DNA, 11887 bp, Oryza sativa
atttggttcacattgatgtgatttgttaaatacttagatatgaacaataaagacagggaaaaaatatatatcatagaactcacttccctatgatattggtgacctatggtgtttcttttttaaaaaaaacctagtcaacattagttttaaaacttaaatataaaaaaaaatacctagtcaacttaaatataatttttaaatcaattatgtactactaccttagtgtggcttatatatgcaataatatgtgaaaaaattcatgatgcatggcatatgatacagagaaggccattaatatataactacttaaaaataatgcaatggttatggcaaatgggtgtttcaatgtagatgagaattaagagccaaaaaactataaaattttctccaattggttcaatttagtccctattgacatttttttttctattttttgtttattttatactaatcttattttaagtcaactttgaaaaataatcaccaagttaagactgatataggttcctattgttaattaacagatggattgtgtgggatatgaggctacactaaatgtatgcatttgtagagtccaatgcgattggggaagtgtgggagacgatctattggaaatgtttaatgtggagtgtgcgaggctcaatgcatcctagctagtattaacatgatcagacgaataaatatagctgcacaaacatcactatttttgcaatgtgatgtattatgattgcttccataattttaatatttttctataaaatttatattttaatgctagaaatcatgtaactatgtatttctttttaatccagcctacacttggcatgaattaagtacatttatattatataatctttatgtgaagcctacaatgccaatccagttgcgataattatgttgcattccataaatttgtagaaagaccctagaattttttctaaataatttaagtgaaaccgatgatcatattttttttctcctcggatttctaatatgtttcctaacttttaagaaggggcaatgtgggtgcttatggttttccaaaaggtagatttagtggttgggaataataaaattgcaagacttatatatatggtctttagcatcacttatatggttagaattggaagactgatccatacttggagttgaaagtccttccacacatgctgagcaattggtctctcaaattactaatctctaattgcctgcacaaaccaatgatcaaatgttttacttttttaatttgaatttctaagttttttttctagttttaaaacaatgacacatggagacttaagagcattatagaggatgtttaatggttctttattacgtagaataatttaagatgacataaaacttatcatcattattttcaatgctttattgttatttggttgaggtgcaaaagataggggctatgttcaagattttcaataatttatataactatataaaaattaaaattagaatgttatttggtttccatgcaaaagaataggggtatatgttgaaacgacttatttgattttttttatatgagtaatataaatctcgagttatttagctatccatttgtaaaacagttcaaacaaattaaaaagcaaatataactataatttagctatgtaactattagattattttattattatgtcattagttcaaaattaggaggggtgaattaaatgggaggaggagaggaggggagagtggtgcggaaggagaaacatataaatgtaaagcagcagggggaggggaggatagtttgttttctttacatagatccaattggtcatccatttgagttgtctatttttaaaaatagatcttggttgtttttgccataggttcggatacaagatttattaaaaccgtgtatttctagtttcacaaatccatttatttatatccgcgattacattgatagcattcgaataaatcattttgttcctattttagatgaaacttaaattttttaaacaactataatttaacatgtaaatttcaaatctacaatggatcaaagatatagagctatgccaaacagatcctaatggttaaaataacatgcccaccattttaggaataaacgttaggtgttttttttctcatgatttctaagattttttatattaagttgttagttagaaaatagaatagcgaattaaatgggagaggagaagagtgaattaaataaatctgatgtggtgtttcaatttttaagtttcctgttttgattctgacattaatttatccatgtagtattatgtggatcatgcacaatctttaattttaattttgttggtttaataatctactccccccatctcgtataatcagactaatttaatgttgtagatgttgctatattttttttataaatttggttaaactttttaggtaacgaaacaaaatcaaagggtcgtacactatgaaatatgaaacggagggaggaataatctctcgagcatgcagtccttgattgttttggtgcattaatttgtggatcaagtgcagtcttgaattatctctcgatcatgcagttcttgattgggttaaaaattggagtccttttttttaaaaaaattagatctaatgtaaatcaacagttagatatttttcttttttatcagaattttaggatttattaaaacgccacgtggtggtttaggagcgtttatagtaagacacgtgtcgtttcaggagtgtttgtaaacaatttaataaatttttagtatataatagatagatagatttgttcttttttttaagccaccaaccggcgcagccaaatactatcctgctagttttatcagatatttttaagatgagcatgggttttaagaaggttgatggaaatgattgaagaaatattgcgatttatcgagaagagaaagtatatgagaaaattaaatggataatagtcgtgactaattgaaaaaattaaaggatatatatgaaaaaatagctccattttaagatatgatagctgctagaaatagataaatattttataactataagtaaacgtcccctaccaatagccacattatttgactggactataaatttttatatattttttttgtcgaatcttggaaaatgagtcacgctcatcatagggacaggatcctctacagttaaagtcatgtaactttgtcactgtcacgtgggtctaatgatccctagctcacatgttagtaacaaagaaaaagaaacttatccttgtcacagactcgcaacagcaggcagtgccagtggcggcccggcgcacctcccagcctcccctcccgttgcatcagccgtgacgcactacccgactcccgtggaactcatacccgcatgatgagcctatatcaatgccacattaattgccagtttgccacggtgcgctgaattactagattcgcacgagcaacagttagctagctatagccggcgccatcatgccctcgtcgacggccgtcgtcccggcagcggcggaggcgagcagccgcatcatcctggtgcacggcacgggccacggcgggtggtgctggtacagggtcgccacgctgctgcgcgccgcgggccaccgcgtccacgcgcccgacctcgccgcgtcgggcgccgacgcgcgccggctgcgcgacgacgacgcgcccacgttcgacgactactcgcgcccgctgctcgacgccgtccgcgcgctcccggacggcgagcgcgccgtgctcgtgggccacagcttcggcggcatgagcgtcgcgctcgccgcggacacgctcccggacaaggtcgccgccgccgtgttcgtcgccgcgctcatgccagactgcgccagcccgcgccccgacgtcatcgagaaggtaaaacacacatccaagaacactcctcctctgttctcactcgatcaagctgacgcaatcttcttcttcttcttcttcttcttcttcttcttcttcttcttcttcttcttcttctccggggaagcttccattgacggactgggtggactgcgcgacggacgaggagcacgcaccgccgtcggtgctgttcgggccggagttcatgcggcggaagctgtaccagctgagcccggaggaggacatcacgctgtcgcggagcctggtgcgggtgagctcctactacgtggacgacatgcgccgccagccgccgttcggcgaggaccggtacggcgcggtgcgcaaggtgtacgtggtctgcgggaaggaccaggccatcgtggaggcctaccagcggcggatgatcgccggctgccccgtagaggaggtgagggagatcgccggcgccgaccacatggccatgttctccgcgccggtggagctcgccgggcacctcgccgacgtcgccaacacctacacttgattttgattgtactagctgacaacacgtcgccagcataacataccaaggccgtgtttagttagatacccaatttttttttgacgtatacggacacacattttaagtattaaacatagactaataacaaaacaaattataaattccgtctatcaactgtgagacgaatttattaagcctaattaatccatcattagcaaatatttactgtatcaccatattgtcaaatcatagcgtaattaggctcaaaagattcgtctcacaatttacatgcaaactgtgcaattgttttttccgtccacatttaatgctccatgcatgtgtccaaataattgatgtgacggaatttttggatgtttgaagaaaaaagttgaatctaaacacagcccaaatcgggaagagtagacttcacgctctcacaacagttctagttggttgcccgtattcccctagcctagctcatctctctcatctaggttaagtttgacctggctaggaagatacatatacagctattggttgttgcattggtctagccacgctagcatgaggttttgtttggttacctatacgatagatacaattgagaagagattttgtttggttggttgcatggatgtaagtgtggttaccttctcatatagttaggtgaggttacctctacaatatatataaaataattgagcattttggattaacccatttttcacgtagaatcggtggtaagaaaagaaaaaagatatttttcttaagttattctctccttttcaataccaagcaccaagactgcgtcgtggtaccaatccattgctgaggaactaagcggaagcaacgactgagaccaaccttgctgcgaagaaaagggcgccgccgaggaagatgtcgccagcgtcgctgtgaaggaagatgtcgccggcgccgttgctgatgaagaggccgccgcagctgccgctgctgccgaggaagaggccgccgtaacttctgccaaggaagagctcgtcgctgaagatggcgctgttgcggaggaatgatgtcatgacgaggaggaggagcgcgcaaacatttttgctgtgagtgagcgagagtgagttgatcgcgattggaaatagaaattcactccccagaagtgaggtacgatatatctatatttgggaacctaatctattgaaagataggatagggattctcttggagacgatttttgacaaaaaattcctaaatttgatgataaggaataaaataagtaagatgttggtgatgctcttaattccccctccaatccaccaaaattcccatgtctacaaaccaaacaaagcagctaacaatctcatccctttacacttccaatcccttctaaggctgcgttcgttagcctacgttcctagcctgcacagtgctcatggaaaacagagcagtccattagcgtgtgattaattaagtatttgctaatattctttttcaaaaatggatcaacatgattttttaaagcaactttcgtatataaactttttgcaaaaaaacacaccatttaacagtttaaaaagcgtgcacgcggaaaacgaatatgggttgggaactaggagcattgaacacagccctgttcctggtttctatccggaaccgttcgcacggaaaacagagcggtccattagtgcgtgatgaattaagtaatagttaattttttaaaaaaaatggattaatttttttcaagcaaattttcgaatgaaaacttttgcgtgatgaattaagtaatagttatttttttttaaaaaaaaatagattatttttttcaagcaaatttttgaatgaaaacttttttataaaaaaaacaccgtttagccgtttgaaaagcgtgcacagccaaactccccagaccaaacgggtcctctacagctactgtgccaaagaggagaaagaaaaaaaataaaaacacagtatttattcgatccttctcctggaaggctcccaagtttgtgggaaaaaaattctgtgcagaccggctgcaaaccccgcaccgtgcatacccgatccagattggtgacgcgtggacgagagactgatccaacggcgtgtctgcatggctccatccgcaccaggagaaggcccagcttggctcgctcgcgtcggctcccgctcaagcgatcagccggcttcgcttcgaggcggcaccgcggcagggatgccgtacgcggactcggctctagcaaaagcgaaatctttttccggcttcgtcgtcttccttcgccagattggatcgccgccatgcgcaccgcagccgccaggattccggtactttcttcacccgccttagtgaacgacacatggccagacagccgtttgtctcacctgtgcatgcggacgacgtagtcgccggggattgtagagccgatgagaagcagaaaacatatgtatgctcgccttgttatttgatagtcatatttcttcatactggttgatctgtgaccatatatatgttatagattacacagaacttcgaggggatgaccatgatcatgcatgatgaagttgcacaacaggtcaatgataaagctgaacaagctttgatcgttctgttagatagatctctctccccttgagcccaacggctcaagggggccttgaccgcgccctgatcgggggcgcccagcccaatggctggtgggcccccgtcacactgcgccatataaaaggaaggtggaggccggcacggcacatggtacgagattcaccgccgccgccaactccaccccacaaaaccctaatccgatcgagagggggcgcagccagtgacgggaaacgccaccgccgcatccacgtcaagccgcgacgacaacgacgatgtccggcgcctcttcctccacgatctcctcaaccggtcggtatctaaaccctctccctttcatctacaatgtcgttcatcaaacccaaatagaaccacccgactagatctaacctaggtgatcctagtgcaaagtttaacaatggtatcagagcaaccctagtgtttagatcgtttcggggaaagaaatccaaagaaagaaaagcacaagatccgcacggatcaaaagaaccaaaaaccctaaccctaattcttacctcgtcgccggccgtcgttgacgccggcaacggagggggggaggggcaaagaggcgccgcctaggagccactcgacggccgcgcgcgcacctgcacgcgcgtgccggcgagggggcccgcggcggcgccgccatctccgtcgtcgccatctctctctcacacggtgggggttagagacggtggggggagcggagaagagaaaagaaaggagcgccggccatggcgcggcggcgcgaaggtcgccggcgatggcgacgccgtccacgcggtcgcgtgagagagagaagagaagagaagctagggttttcggcggccggccgggagaggggggtttttgatcctccgatctcggcgcccggccgtccgatcgaaaccctagctgatcggacggccggcggcggccggaccgaaatcggcccaagtggggagcgcgcggcggcggctttcccggcccaggcccaggttgcggcctgggggaggggagggggcgctcgcccgcgcgcaaagtggccataggccgaccggcaaaggccggaaaagttcaatttaggtccctcggggccgaaaatgaataaaagagaacagtagcaatttttccattttattttgtcgatttttcatgcaaatttcaatagaattttgaatagatttttgcatgttttacctctgtttaaatttgaaccaacgggagaattttcacagagagagaattacagagattttgctactgttcatatgattttatatagtcttccgctgcaaatagatgaaattgatgaaaattagtgtttctaaaattaaatttcgaaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttaatgttaattttgttctcaccgcacatgattatttcaggtggctactccttgatgggttgcattaaagatattccgaccctaaaaggagataactacgcagaatggaaaagaaaactcgaccttgcttttatcttgggagaggtggactgggtattgactaccccatgtcctatagaacctgctgaccttgtcagaggtgaaaatgagtcagatgctgactggcaaaagagacagagggacaatgctcctctcgtcatgtcgtatgacattgaacaaaagaaatggtccttagccaacaagaaatgtttggctgtggtaaagaatacgattgagcctaccatattgggctcgatcccagagtgtgacgctgtctcagagtaccttgaaagaataaagagtcagtttactggctcttcaaagacttatgctacacagctgatcaagcagcttgtgacagaaaggtacaatggaggtggtgttagagaccacatacttagaatgagcaacatggcttccaagttgaagccaatggatttgggcataacagatgactttctggtccatctggttatggcctcattgccaaagcagtttgacaattttattgtcaactacaacataagtccagagaaatggaactttgagaagctcattgctaattgtgtgcaagaggaggagagaatcaaagaatcaaatggtggttcaataaactatgttaaagataagaaaaagaaccacaagtctcccacctcaaaaggtaaacagtctcagcatctgcctcagcaacaacagttcgctgttgagaaagatcaatgtctccactgcaagaagacaggacactacaagaaagattgtcctgattttttgaaaatgatcatggcaaagaaaggtgagaacattattacatttgtaaatgaatctcattatgttggttactctagatccacatggtggattgattctggagcaactattcatgcttgtaattgtttaaaggcattccgttcgacgaggactacgcaaagaagagaaagcaccattagagttgccaatggagttgaagaaaaagttgaagctgttggagatcttcctctagagctctcgaatggcttcatacttttacttcgagatgtcttttatgttccttctttgcaaaggaacttaataagtgtatcaaagttggattttgatggatatgattgccgctttggaaatggcaaatgtgaactatggcataataatgcatgtattggtcttgctgtgttgcgagacgagctttatttgttatctctttctgagaatgtgaatgttgtgtcctcgttgacaaaagaaaacaagaaaagaaagcgaactcccgatgtctcatcgaaattatggcactgtcgtttgggccatatttcgagggggagaattgagagactagttaagaatgaaattcttcctccattggagttctcagacttagaacaatgcatagaatgcattaaaggaaaatttgtaaagagcatcaaaaagggtgcaaaacgaagcgcaggaattttagagatcattcatacagatatttgtggtccatttcctgtgaaaagtgtggatggctatgactcgttcataacattcacagatgattactcccgctatggttatatttatccaattaaagagcgatcagaagcattggataaatttaagatattcaaagctgaagttgaaaatcagcatgatataaagattaaagtagtaagatctgaccgtgggggggagtactatggtcgacatacgccttatgggcaagtccctggaccttttgcaaggttcttgctagagaatggaatagtagcccagtattcaacaccgggcgaacctcaacagaatggggtagctgaaaggcgcaaccgtacccttatggatatggtgcgcagcatgatgagctactccacactaccactcggtttatggatggaggcgttaaaaaccgccattcatattctcaacagagttccaagcaaatcggtgcccaaaacaccgtatgagctatggacagggagagtaccctcgctaactcacctccgtgtgtgggggagtcctgcagaggccaaagtatttaacccaaatattgggaagttggaccccaaaacagtcagttgccattttattggctatcctgaaagatcaaaaggctatcgtttctactgtccaaacagttatacaaagtttgtagaaacgagacacgccgtcttcttggaagacgaaatgattagggggagctcggtagttcgagaaattgatcttgaggagaggcgggtgtctgtacccgctccgtcgactcaggaacctttcttctctctacctgctgatgttgtgcctgcaatgcctgtcattgaggtaccagcacctgttgttacccctcctgtggcaacaatgaatgagagtgaggaacctgttatacaggattcaacagaaatggttgccacgccagaggaggagctacaacagcctcaaatagataatgtgccagtacaggagactcatcaagagcctcaggtacaggatgtgccaaatgtgcaggcccctagaaggtctgaaagagtcagaagatcggctatccgtgatgactataaagtttataatatagaagagtcgcatatggaggatgatcccacctcatatgaagaggccatgagaagcgctcgctcatctgaatggttggaagccatgaaagatgaaatgaaatcaatgaaactaaacgatgtttgggatttagaagaaattcctaaaggagccaaaacagtaggctgtaaatgggtctacaaaaccaaatatgactccagagggaatatagaaaagtttaaagcgcgacttgtggcaaaaggcttcacgcaacgagaagggattgattacaatgagacattttctccagtctcttgtaaagattccttcaggattataatggcactagtagcacattatgatttggaattacatcagatggatgtaaaaacggcatttctaaatggagatttggaggaaaaagtatacatggcgcaaccgaaaggttttgtcatgaaaggaaacgaaaatatgggatgtcgtctaaagagatccatttatggattaaagcaagcttcgagacagtggtacttgaagtttgatgggacaataaagaaatttgggtttcaagagaatgtcgaggacaactgtatttattcaaagtttaagaatgggagatttattttcctaattctgtatgtggatgacattctactggctagtagtgatgtcagtctactgcaggaaacaaagaaattcttgtcctcaaactttgacatgaaagacctcggtgaggcttcatatgttttgggcatagagattcaccgagatagaacaaagtatgcattgggactttctcaaaagacatatatagaaaaggtgttgaagaaatacaacatgtacagatgca

SEQ ID NO: 2778 - DNA, 1407 bp, Oryza sativa
ttgcaaggaacaaaaggcctcatgctgtcttacagaagatcagaatcactccagatagtggggtactcagattctgactttgcaaaagataatacaaagtcaacatcgggatacgtgtttaccctggcaggaggagctatttcatggaaaagctcaaaacagactatcactgcagggtctactatgtatgccgagtttatagcatgctatgaggcaacggggcaggtgaactggctaaagaagttcatacccggtttaaaggtggttgacagtattgagaaaccactaaagttatactgcgacaacgaacccgcagtaatgtacactcacaacaatcagtcaagtggtgctgccaaacacattgacataaagtactatgttgtgaaggacaaagtccgggatcaaacaatcagtctcgagcacattaaaacagaaaggatgctcgcggatccgctcacgaaaggcctaccacccaacgtgttcaaggaacatgtagccggcatgggtttaagggaagccttatgaatcctggactacagggcccaaaagtaaagtatctgtttctgaatagagatgtgtatagtggctgtcgaatccatcggcgattgaccgtgacgatgaaacatgctctatttacaaatctgtgatggaatagaaaaagctaaaagaaaaagtgagatcaagggggagaatgttagatagatctctctccccttgagcccaacggctcaagggggccttgaccgcgccctgatcgggggcgcccagcccaatggctggtgggcccccgtcacactgcgccatataaaaggggggtggagaccggcacggcacatggtacgagattcaccgccgccgccaactccaccccacaaaaccctaatccgatcgagagggggcgcagccagtgacgggaaacgccaccgccgcatccacgtcaagccgcgacgacaacgacgatgtccggcgcctcttcctccacgatctcctcaaccggtcggtatctaaaccctctccctttcatctacaatgtcgttcatcaaacccaaatagaaccacccgactagatctaacctaggtgatcctagtgcaaagtttaacacgttcctcaagttggaatggatttcgattttattccatttactatgttacttaactatactattttactatgttacagtactatgttttacttccatttgcagtgtgttacacttatgatcagctatatgttgtttgagaacgactggtctctggacatcatatttcagatttgacattcaagatttcagattacacaattttccggttttcatttttaaaggaaccagacagacaaaccacaatcttgtttacacattgatccatcacattctagattttggaatacccagtcgtaagcctttg

SEQ ID NO: 2779 - DNA, 7039 bp, Oryza sativa
catggtggaggcgtaccacagggaagggtggtggccgggcgtggtgtccgcggcatggccggctcgcgggcggaaggcggcggcggcgatgtacaccgtgtcgttcccgtcgtgccgggaagaggcgaagctcccggcctcgctcgtccggcggcggcgggcgttcgtgcgcgggcgctggatggacgcgcgcgacgtggtgagtcaattctgctgaacggattgttgtactccgtattttcccccttttgtgctggtggtggacaggagaaaccctcttcggtgcgttattcgtggctggattattgaggcgtaaacctgacatttgacatgggatttaatgctcaattggacaagatggaatgttcataattttaatcggtggtgatgtcgcatgtacatgttagaggaactttaggtagtgtttggtaatttgttatttctaacaaaaaaaccactgaagatatagaagaacttcgttttttttttttacctgtaggtgagtggtgacttgaactgatgacctcaacgacaacaatcaatgaattcatgtgctgttctaacactaggcgagactaggtgctttgtattgtagatatgagtgtcccctctagtttgctactagttcagaatctgagatatcaagataagaccaagtgatgacaaatgccatacttgtttgacctaattatcgtgtgctgagtttctatttacatgtgggggattttattgaattcaacaaagcagtaagtcattcttcgtccactggttagtatatgtatgctaagctattggttgcatccttgactacacattatgatggattggagaatgcaaattagtgttaatgagttccagtgagaaggcaaatacaaaagaattgtgcttccaaaacagtagcagttgaaaaattggttgtacaaacaaaaagaattgccatctagaatttaaaacaatgtcaaacaagcaagaactcctgctaaattttatgctaactgaatgaattttatcgtattctgaattgtcaaaagaataaaatggaagactaaatgtgtactccctccggttccatattaattgacgttttagacaaggttgatgtcaaacttttataactttgaccatcaataactttaaaaatatttagtttaaaggaactagaataacatatatagatttgtctttcaaagcactataataaaagtaaacatgcatttatttattatatatattataatagaaaaataaggtcaaaaatatattttgtagaccgtgtcgttgtccaaaacgtcaattaaaatgaaactggagggagtaggcaaaaggaactccgttttttcctgcatgaacacgaggcaaaacaaactccatgaaacctgatatccttggtgtaagcttcactgagagagaatgagacacggcaacacaatatttactttgtataactaatgtttgtgcttttgttattttgagtgcaggttccaagggtgccgcagtatgacgaagggagcaatgtggaagtcatgttggatacaggaaagcaccgtgcagcctgggtaactgctactgtcattaagatggttagcagtaaaaactatgttgttaggcttaaaaataaggaaggctcagttaacatcgtagattactgctatattcgaccacaacctacctttgacagaaagaagtttgagtatgaactggagccctctgcagaggttgaagtgaatctgggtggtgcctggtcgctaggcgtcatctcagatgttggaagctgtggatatggggtaaggctaaaaggacatgatagctcagaggaagaggactacatgcttgtgttgcgtgctttactcagaccctactgcaaacaggatgatcaggaattgatgccttgtacagcaaaggtatttctccaactagtcatgttgttacttgtgatttgggtattttctcctcttctttcttggtactaccagtctactgcagtgttcatttttctgctgtgaataaaagtttacaatgttttcttgccgtgcttgtatgccttcttggaatatgtggtgtttgtcattttaatgtcagtatgccagcttagttgtccctgtgctctggacaagcaggtaacaaagttgaacaagctagagaacaagaacataaaagggaaggcgcgcatgctagtttcaaggaaactgcctaacctaggctgcacacggagtggtggtaaacaaagacacagcatgaaaaaggttgtcctgactccgttcttcttaaattgcaaacttaaattgtgtcttaaattgcaaatttccgcgcattcatacagaaaagcccgcttggcgctttcacaggtcatagtgcttttatcaatatatattttgaccatcaaatattgtgcttcagcatcttatgctaatgacatcatgtttttggtatacgctttcttcctccaagcaatgacattatcttatgctaatgacatcatcttatgctaatgatttagttctctcctaaactgtgttgtcatttggataattgttgttcaggaatttgcttgtacaagtttggatcttccatgtatctctgcacctaaagatgctgttgaaatcaagggcaaatctagttatgtcgatgtagtcgaaatcagtgacaactctggctatgatgttattcatatcagcgatgattcgagctgtaaccctagaagaaagagaaggcgacagaatctcctagaggaataactccattcccggcatacttcctatccgattcaagaatcacaatccaggctgaatatgtcaccagcacgaagtcctttgaactgtgacccgttgctagatgtaatgaggcatcctaaagtagagtcgtgcaaccatgtgttatcacaatcttgtcgccattggaaacaccacaggctcatttcaacaacaatgctgggcagctaattcctctgccaagttatccggtattagagaagttgccagttaaagtgcttcctgaaatgaatgaaatgaaagaaacaaatcatgctcatttacaagctgagttcttggcacctgatgattgtacagccggagaccaaaactatgctctgcctataaaagttgaggtacatacgtctgttatctttatttgagatgaaaattaatcccttcttgattgtctatctgttgctaactcacctcaacttaggtggagagctgggtcgctgatatccgcaagaaagaagcaggtaccggtctgactacctcaaacaactgtgagtacttgttataacgactttgtgttacattcaattgtaaaacctgtcttaactagaacgaaaatatcaccagcaatgcagacaattactgatagtggtgaagacaattcaagaaggccacgatcaggagattctgagataccaaattccagtaaattagaaccatattcatctgagcaacaaaggtttgaggccgatctgccatgcatgccagtgcctaacaatgttactattaatactcttcctcttgttaccagacatacgtttcaatttgtttctcggaacaaactggaagtgccagtgagacataagaaggcccctgatgctgtaagaccatctacgttttcccccctgttttatcttctgtttaaatgtatgtgtatttcccatccatgcttgatcatcttgatgctatttgtacagctggagatgaataccaattcggttgtcttctctcccaaggagcaaacacactgtaatttggagatctttagtccaaactgtaagtcttgccacaactttaagatagtaatttttgatgcattgatacttaatactggtctggctgatctgaatattatttttctgcagccaagaagatcattgatgcgtcacactatgaaagttatgcgtcattacagcagcatcctttgggccaatgtcaagttccaaattattggagtgctgcagggcaatcttcatttgtgcatccgagcataacaatgaacctattcacaatattgccagcacctaacagtcatccaactacttttgcctcaagcttgttgatggggccttgtgagaaaatagaggtttttgagaatctgccacaattaccacatttcggaaagttgattggttgccctcctgagctccgcgaaggaaaggctctggggctaatggcatccttcgcaaatatagcagagagcatacaaaacatgtgaattcaggacgaagaaaacgtctttgaggagaaactgaggtgcctctcggaattggaagaggacggatttgatgttagggccctgaaggagcggcttgaaaacctcgtgagcataaagaatcaccagacagaactcaagaagaaaagagcaagattggatcagttcatgcttgagagagaggtggacaatgcctctgtagagcaaagccagaagctgctcgacataatgatcaaggagcttgagctgaaacttttagagtaccgagagaagaaggcatcactcgtggagaagaaagcagcgaactgttcggaaattgcaaagctccaaggcgacatggatcaaattgaggagtcattcctttctgccgagtatgatttccacaccaccgctgctgcgccgtggtaaacattgatgacagtaagtactgctttcttgcttgctcatttgtgcactgcaaccaagtccatttggatggtgttaactgatgtgaaacaatgcaggcagagagctctgttcacagttcacctagacatatcacatacgcatatggttcactgatgtgatgtgatccaatgcattaggggaatgaggcagctagttctcttttgcctagacttgaaatgctgaacttaattaagtttgtatgtataatggttgtcacttgaatttggtagatcatctcattcaatcaggcttgcccccctgacattgatatgcgctgtttggcctttaaccccccccttagtgttggccaatcaagcagctgtaattttctttgtattctcttggttgtaacccctgtactccgttttttttttctactctaatgttaaattctagcagatctcctgccgatgttctccttaaaaaaaaaaaacaggcttgccccatcttcaatgctagctctgttcactgatgtatgtgaaccaatgcattattaggggagtgaggcagctagctctatttgcctagacttgaaatgtcgaacttaattaagtttgtatgtataaatggttgccacttgaatttggtagatcgtttcactcttgccccatcttcaatgtgagcaaggtctccaacgtctagaatcacctgacctggttaatagttttctgctggaaaaatatgatgctcctcacagtcctctggttgttggggaaaagtgaaaacctctttcggggatattcccaatctcaacaatgagaactgaaaagcgatcttattaacttaatctcagacgttcttagtttcagcagtatgataacctggagtgaacactgaactgaccttggttcttacatcagggctgcacgcgcactgaatctagaaaagcctctggagtagtactaattaattaactaacgatatatagccaatgactactggtgcaaaccttatacattataggagtgtgtaattaattaactgtgtgtgtgtgtgatgagttctatagctagcatttctcgtcggcgtcggcgacggcggtgtgctgctgctgctgctcccgcgaggtggcggcggcggtggcggcccacttggcgcagacgaggtaggcggcgaggttgaggacgctgaggacggcgaggagccagtagaagtagtcgaggcggctgcggtcgatggtgtcgccgagccaggtggtggcgcccttgacgagcgacacgagcacgctgctgaagaagaagccgagcgagagcgtcgtcaggaagagccccgtgctcatcgtcttcatccccttgggcgacctcgtgatgaagaagtccagctgccccgtgtagatgaacgcctcgccggcgcccaccagcaggaactgcggcgtcagcaggaacacgctgatcggcgtggagttcccggtggtggcggcgacggcgacggcgaggcgcttcttctcgcagagcgcggcggcggccatgccgaggatggagagggcgaggccgatgccgatcttctccaggttggtgaagccttgcttgccggtgagtacgcggcagagcgggatgaagacgcggtcgtagacggcgagggtgagcatgatggcgccgacgaagaagacggtgagcgaggcggccgggatctcgaagccggcgccgacgcggcggtccatggtggtggcctgctccacggagaaggtgatcatctgcgcgtagatggtccagaagaggatcgtcgtcgcccacaccggcatcagcctcgccaccatcttcacctcctccacgcgcgacaccgagcagagcttccacgggttgggcgccgccggcccgcccggcccggccacctcgttgtcctcttcgccggccaccaccgccgccatgtccaggcacgggaactgcgcggtgtgcgcgatccgggcgtgctcggggcggtcgtcctcgtagagctccgccgcggtgggcgggcgcttgacgaccccgcgcttccgcgccgcggcgacgagcacctggaggatgtggacgatggggctcccggagctccgcttgtagcggtacctcctggtcccggagaggaagacggcgatggcggcgagcatggcggcggagcagatgccgtaggcccagctccggccgacgtggtcctggacgtagacgagcacggtgacggcgagcagcgtgccgaggctgatgaagaagaagaagcggttgaagaagaggcccatggcggcgcgctcccggccgtcgcggtcgtcgaactggtcggtgccgaagccggagacgctggacttgaggccgccggtgccgagggcgatgaggtagaggcaggcgtagagcacggccatctgcaccggcgtcggctgctccccgggcggcgggcggaggtgggtgacgagggtggaggcggcgag

SEQ ID NO: 2780 - DNA, 2375 bp, Oryza sativa
gccgacctgtccgccgggcatccccggtagtccaccgcgtcccgcaccatgttccccccgccgccgccgccgccgctccacgccgacgtcttcttctccacctcctgcacgcatgcacacaaatatccatgtcttttactaaccatgcataacatattgcatgcgacaacatgacagagtacgcagttgctaatgaaattaattaactaggaaactaatttgtataacctacatgtatatatatatgaaatgattgaacaagaaattaatatttgtatctcacacgaaccattaattctacgatatatttctgtccactcctggtctcctgtaagctgggaggtcggtcgagtgaaagccttggttgctcgacgacctcgtggacttgcgatctcacccttttataggcgccaagacgggggcatgcacaaacaccatcaaattaacttaaccactcatcattaattagcgtcgaaagggacttgcactacgttctaatccctgtttatgcaggatgtttctgctgcacacatgcaaatggtggtgggggcaggaaatgggtacaataatgcaaacctatgcatataacaatcctaattatatatattcagactatatgatcgatctgtcagtcataagggcacacacaagaaagtgatcagatcagatcagcaggtaggagcacttaattaagctaagctaacccggcctccatgcgttgtcgttggacggtcacaaaggggtcagaggagagaagagaaactgcgacgtggaaactaagaaaagtgagcagcatcaactgggggagataaagtgtagtactagtatgagatgagatgagattggtgaggaattgaagttggggtttcccctctctagtggggaatgttccaggagcttcagctactacggcagctgcattctgtttgtgtacatatgcatgggccctctcatctcatgcccactagtgatctcacaataatgcaaaactagatatataaatactgatagacagaggcaggggatcactggttgatcttgttgttctgtccaacttttccaatttttcacatgcacttgctaggtgcagatcattagcagatacaattagtatacgtttgttgtattattgagcaatgctgtcgatcagttgtggctctaaaaagagagaaatcagaagaaggctattataacttaataagaaaaaaaagtccattttgctctttctaactttttcccttggagcacttaaccccttagacaatttctcgactcatttaattttgacacccccacactattaaaaatggttcacaccttactctctaacaatatttgtctttttcgtttctctctctatataggtcatattttgcaatgaaatttgataggattgatatatgcattataacttacctctcaatattttttgagtttttaaatcgctgcttatataggttagaagcactgagactaatttaagaacagaggttttaaatttcaagcaaaaagtcatgaaaaatttttaaactattttggaacttcgataatggtgtcatatatgactttacaaaatttaagcttaaaatatgacttgtataaagagaaataaagaagataaatgtaattaaccagtcaattgaactatttttaacatttcaagagctaaaataagcttaaaaatagtttagggggttaagtgataaaatgaaatagttagggggagtaaattatttttttttctgttaaattcacatcgctaactgaattttgaataaggactagctaggtagtgtcctcccacttcctagatatgagagtttcaccatgatatacatattttaaagttttttgaacttttgagttttttgttttattagatgttctggttatctacatttgacacccttcttcctaccaaactcgttttgcacaattgcccttcgagaaggtggcagggttctaacttctaaggtgattcttcctgttatcattttttttcataccattatctcattaactatattttattatttagttattctagttttatcatttgtgttgtttgatcattattctttagaaattcaacatgtttcttgtaagaattctgttatttatgtccattcgcacgccctaatcatttgtaaacacctctattaactaaatggtaacataagtcactgtataatgcattttttagataatggaaacgatttacacactgtatagagcgtgcatggaaaattaaacaacttaatttggccacatattggtaaacaaagtatatattcatatgtacatggaatagatgatatatatgcatataccgggatattatattccattatctaaaaaaatatatgcatatagat

SEQ ID NO: 2781 - DNA, 4266 bp, Oryza sativa
aaaaacagtgataagcctttgctaggtagcatggtgcatatgatcaagataagcaccttcttagccaatggccacatctaggaaaacgaccttgctttgcaaagagaaccattaattggtatcttcatgcacaccatgaacagtacctatacactactgcacatggaagcatatattgtgtccatatatttcagttagttggatcgatctgatcaatcagctaatgttgagatcctagatagatgcatgatggatcatatcgtcttcctcctctggctgccatccctccatcttttggagagagagagagagagagatcccacaccataagcatggagaaaaaaggcagcctccctttgaatctcctcctctaattccatgacctcccacaccttttgcacaggggcctcttcttttccccttcttacaccaggtcctccattttgttgattttttatgtacacatctcgatgaaattatatatatatgggtctctgttccaacctttatatacgtatcgcgcgaaaaagatcgacaagtatatatttttttgtcaaaattcagtaatattgtagctggctagggtatctaccctgatgatcgatcaaaacgatggtgacaagttgtcaaatggaagccttccaatctgaatcctaaatcctagccatgcatgtacatatcacagtagccaaaaaccacacattttcatagtatgcactctatatatttctttctctatcaccccaaattcccagaagccaccaggtgttgataatttaagtatggaatattttgtatgaccaattaacgacaattgtttctttgctaatactagcagaacatatatatatgcttgtaattctagtattaagctagctagatctagctagatagtacaaaaaaatgttgaattagttaatccatcggacatatatatgcatgttaactccatatatattttaaacttaactaggaagataacccacgcattcacgtaggcatgcttattagtttgtttgaaaatagttctaacaaaataagttgaaattaaagtaaggtgatttctatttttaattgagtgttcatcgtatctttttttctgaagaaatctcgataaacttttattggtaataaatgtatttttttaccaccctgcaagccctctctttaaaaattcatatacatgcaattcgttatgcatgtgaatcaataaagatggaaaagttcttttaaaaatatttattatattttaaatttagtgatcgagttattctaatttcaaatctgtattcaaatcaaactattgttttattctaaattgtcattttagtgatttaaattatacttaatattgtatcgtttagtatttggactcatctttttaatagttattttattatttcaaatttaatatatttataactcatacttttatatgaactcttgatattttatattctacatgaaatcttcttattttttttatagttttaatattttttttactttttgaatgtgtatttaatcaaattgcttgttttatttttaattctgaatttagttataaactccttgtagttgatttgcctatcaccatcggcctcacggattatttcgtggatctcctcatcaatgagcctctcctgatgcattggacatgatatggcgtggctcggcggtagagctggagccgttttctagtccttgtcgaagacgtggaacgtctctctccgcccctcttctcaatccttgtccttcatctaatcatctagcgcactattaggcgcaggaactcgtggaagtcgaagctgccgctactgccgtcggtgtccacctcaccaataatgtcttgcagttccgcctccgtcgggttcaggcctagaatatgcatcatggttctaagctccttggtggtgattgaacctgaactttagactcacatatttgaattctttcatcgttttcaaagtgcaaattttgttcaaatatttgtaattagaacggctgcattatctaatttttatatagtaaatatgagaaatatggatcttgaattatgtactcccttcatccaaaagtccaagacaaaggagcaactaactcattcatcatgtgacaaaaccaataaacatacaaccaataaatactaaaatgacttattggttccgattaataatttaatttagcacatagtgactacaaataggactagatttttagagaaaaccaaataatagaatgggtcttagacttttggatggagggagtatttaattataaataacacaacaaatcaaataaattaagaaaagtatgtgtaacttgagaatcacgatcattttgctatctaactattatctttttatatattatgtgttagctagaaaataggggaggagagtggggggggatacctgatttttttggagatttaagggtgaaaattattggctctacctatttaaaggaatatcaatcgttaggttttctttaccataaattttagaaattttcttctcgtttattaagcactgtatgacgtcttaggagcgttaatttgtagaacgccatgtgacagcttgagagcttttatagagaattcaatggacttttagttagtatataatagatattcaaaatggaatggttgtgctagtacgtagctaactggagcaaagcatgcagtcatgcatatagagtggaagctggcgcaacttggtggccgtgatgaaattgtcggtagctagccctatttcatttcgggacccaagaataacatacagttgcacttacctgtatttgcttaccttccaattgccaaaataaaagggggttatgataggttattggacttggacctaacttataaaggagctcaagaatgaaaatacatgtagaagcttggagaatggaagacttgagaggaataatgtaatgttgatatattgtttgcacaatattgaacttatcatgcatacattgcatagtgttcaggcttaacagaaatgcactatggttgggcggattgactatagggtatcactgcgtcgagatcctatatgcagctcactgtagaacacatatcagtaaagtttactacgactgtacatgcagtactgcagagaatctgtatccgggtatcactattatatgctttattttcctcgagagggtgagatgtgctaattgaagtggctttataaaaggggtggatgtctgttgagtaagaggcggcgactagaggaggggagtggaaggaaaggcaagggtaaagaatgcaaagtatttacgtattattttggagaagggatctaaacgatagatatgagatatacatccggtcacctttgttcaaaattaattggggccatagccaaattgataaatataatatagggtgtgtatgcatggtaagatattatctatatccatgcaccccattttgatccttcagttttaaatcccaagcatgatttcaatatttatttaatatttatatatatgcaaaagatactactaatgaactgaagcactggattgcaatttaattattatctctaagaacatgttatggccattgagaatatccaaagtacaatatttatgagtaaataaaaatcataataatacaaatatacttttgttataaagctgtacatgtgattaattatcatgaatccaatctaaaatgacttggggacgtatgtctatttttttttaattagcagtaccatttttatctctactatttaaaaaatgtagtcgtcttccttcctgttgacagaaaacacgaggcctgggagatctgcttaactccagtgcaggtccaaagctcgcctacgggtgtgctagcgtgccagttgatttgatcatgtaaccaacaagaagtagaagcaaagaaatcgcggttaaatctataaatgatagccgatcggctaagtgccgatgacatatcatttatctctgagccgatgtaatatgtgtatcgatcggcaatcttgaataagtaagaaagaactaaatctacttgatcggctgtagatgttaacgatatatactccttatatcgatatatacttaaatcaagtgattgggatagatcggtcgccatgccgagacagtataaaccacttagaccgaaatatatattaataacaggactatatatgtttatagcataaccgatcagatagatctagcatgaatcggctaatactccgatactactttatatcaggatattaaaacaggtatagaatatcaggc

SEQ ID NO: 2782 - DNA, 2441 bp, Oryza sativa
aagcaaaaaggtgacgatgcgcattgtattgaacgtgtgttaaaagttacatagggctcgggtctatttatacccgagaattacaagatatgtctataacggacacgactactatctctaacaaactctaagatactataagtctttgcggcagacttttgcccaatcatatctctaaggaaattacataaaacatcctaattaatagatacaattgcctcctcaggactctatccatttgcggcaatcaccttgaagcacctcaatccaacccaacatcacatatcaagttgtattgctaggatcggctacatcggcttacctaatccgactcagactcagccgatcttatcgtagccgatctggactccagccgatccctgctctgtttcagaactcgatctccacctccgacttcgcttcaatctaatcttctttcccaatgccgatattaccaaatttggttgttaacacttccgtccctttctcattgcgtgcttttttatgtgtgcatagccataatagcattttcaattcaatccacgcatccaacccatcctgaattatataggcctagaacgtgttttatcctcaatccactcatcaaaccaatcacaaaatcatatgggtttgacctgttataaagcacaaacatattactagtatatgagataatctgacatttcactctagatgccactccaagatatgtgttggaccatgctagaaataaaaaaaaaagagtttaaagcgaaatggtagatttgcatgtcttctgaatgacattaaagcattatatttttgagtggtaggtaaaccggccttacctcttataagagtggtgtatgtcaaattttctcctaataaatattatcttgatttcttttcatctattggttctctgacctctccggaggcataacacgtgtgaccacactagccttgccacatgttgagtcctcatgcaccaacagcaataagcctcttgaaaagctaaaaagctccaacatccaacaagcactcggaactcatctgcatttcctcgtgaaggacacgcgatttagctaaaccacacggaatgaaaaattatgtcaccatatagcaagccatacagacatacaaacacatcctaccaaaaattaattgaccaaatataatacactgattgtttgtgaaagttacaaaccttgtaaggcatacaaacgtttaccttctaatgtgacatataataatgtgtttgcattctatgatcaagctcaagtttaaacgtcttttttttggaataatatgtgtgtgctctagttgatataaattaattaatatgaaaaaaaaatatgctagcaatgttaacttgtaggaccaccactgtgtgtaatgaagttgagctatatttaaagttcttacaggtactccctcccatttgataattcctaccactttggataaggaaacatctaaaacatatctttgactataatttttcttttaatatatataataaataaatatttagctttgttaaagtactaagggtgagttcttttgtagtagttgggaactcctaccttctgtacgaataatgaagcatcggattaacgtatgattaattgagtattagctatttaaaaaatgaattaatatgattttttaaagtaactttcctataaaacttttttttaaaaaatgcaacgtttagcagtttaggaaaagcgtgcacggaaaacgaggaaagtggagttaggaactcacactaaagaacacaacctaaataaatatttattgctttcgaatgtttagttcccttagcaaaatttttcaccctgtcacatcgaatgtttaggcacatgcatggagtattaaatataaacgaaaaaataactaattacacatattgcatgtaaattgcgagacgaatcttttaagcctaattgctccatgatctgacaatgtggtgctacaataaacatttgctaatgacggattaattaggcttaataaatttgtctcgcagtttacacgtggattctgtaatttgttttgttattagtttacgtttaatacttcaaatgtgtgtccgtactccgatgtaacacgccaaaacttgtattccgatgtgacacgccaaaactttacacccctggatctaaacacagcctaaatatcctaaagtttctgatagcgaaagttctgatagtttgatcacaaccttatccaaaacaacgagaattatgcaacttgaggaagtatgataaattataattgaaacactacctcacagtattttctaagctaaaagggaacttgtaaattgctagctaggaaccaaccggctagtgcagctttcatgttgttgaattttccattcttttgcatcgacttcttcctatattttccaaaaagagaaaattaacaactcctttccttgtagcatctccaaaatc

SEQ ID NO: 2783 - DNA, 856 bp, Oryza sativa
gtgaaaatggcttacacatagtattttagctctcagaagcatcagataaacctaactagagggagtaaagggcttaccttggctccgggctgggctgcagcatcaacaccaacaaagacgccatctgatgctttgtccaaagaggatcgagatgcaaaggtccggttcaagctggcacagatggtggagctggcggcttctactgcttcaaggccgatggctagtcatccccggttgcagttggcggcgaggacgcagctggaaacttcgtcaggttctcgtttttcagttttgtagggtgtttctgaagatgaagatcatttacacttggagccggctacgaagccttggagtggtcctcttcctgcgcctcgtcgatcgccgccaagaacgattggaggtattatcaaagcagcgattcagggtaaagtttttttgtcgtttccttctacaattcagagtaatagatgttctccggtagtctcttccgttccggcgagatctcggtctcctccggcggtgagtccggttcctcgatccgatttggatgcgtttccaaaactttcgggtgattcatctatttcgaattgtgaggttttggatgagtttttgccgcaattgccacataggcccagtattccttttaggcccacacctggtcttgtctctctattcgcaaaaacggggacagtgcgccagaaggttaggtttacggatcgatctgtgccgcctccttcgtacgccgctgtagttcgtcgttcaatggagagaaagaaccagcgtcctgttcatggagggggaggacaaggcagctttgctgctcgtgcaaactttcatccaggtcatggcgagggag

SEQ ID NO: 2784 - DNA, 1169 bp, Oryza sativa
tactcccgaatacaaactcatcttctgtatgtaatagtcaatataactttaaatttgagttaggttggctgttaagggatggttttgttgatatggtaaaggaaatttggttaagtgttgatgaaggaaatacttctctagagaggtggcaagcaaagattcgcagactaagacaatttttaagaggttgggctaaacaaactagtggtacctataaaaaggagaagaaagccctgttagaaaaacttgatttacttgataaaaaagctgaatcaaccttgttaactcaggaagagcttaatgctaaacattatatgaggaataggttagcttgtttgcttagagaagaggaaattaaatggtatcagcgggctaagaccaaagatattttggaaggtgactcaaatactaagtattttcatttggtagcaaatggtaagcataggaaaacaagaatttatcaattacaagatggtgaccacatcataaatggtgatgcaaacttaaaagcacatattaccacatattataaaggtctatttggtccacctgatgagtcttctttaactttggatgaaagtcttataggtgatattccccaggtgtcttctctagaaaataatcgttagttgatgaatttactgagaaagaaattaaagatgcagtttttcagatggaacataataaagctccgggtccggatggatttccggttgagttttaccaagtgttctgggacgtaattaaaacagacctggttgagttatttaaagattttcatagtggaagcttaaatctttactctcttaactttggtactattattttgctgcctaagtgcaaagaggctataaagattcaacaatataggcctatttgtttacttaatgtcagttttaaaatttttactaaagttgctacaaatagaatcactggggtagctcagaaagtaattagtcccacacagacagcttttatacctgggaggaatattatggagggggttgtcattcttcatgaaactattcatgagttgcatcggaaaaaaaatgagtggtgtcatttttaagattgattttgagaaagcttatgataaagttaaatggtcttttgttcaacaatccttgagaatgaagggcttttcccaaaaatggtgtgattggattgct

SEQ ID NO: 2785 - DNA, 972 bp, Oryza sativa
ccagctaaatgagcagcagatgctttgcataataatttttgtcagaatgcagtaaaccatctgaatatccctaatttagcactgctgctatggaagcctgtgactcagtttgtgatattctcaccaacagcctactcagtgtgagagataaatcgcatcacttttagcaaaggctaatgaactaatctggttaaactatagaaaaaccaaccagcaccctagctagcattttgacgaaagacagaaagacacgggcaaatgatcagacgtagcaactacaaaattacaaaatacatgtcacttccaggatttttcttcattgcttgaatggtgctccacttgcattgactttcggcggcgcgttgcagatcctggttcttccactgccttttggcttttgctcgccctcgccaacccagccgctgcggcctccaccaaaggcgtccgatgcccgtggtcaggagggacgaggaggggaacacggctcgtgctcgccttagccaacccagccatcgccgccgccgtcaccgatggcgctcgtggccagggcccaggtgggaggccgtgacggcggtagcaggcgagagaagtggccgcatcagttgttgaacggaggggattgtgggctaagccgatggcgccaaggaaaggcaatcccgacagatggaggcaagatggggaaggagatcgcggcggcggtggaaagggaagtggggatcgccgcagcagaaagaaaatgacgcgagtgagccgcggagccagtccatgcgcttctagttctggttgtgggagtcgacgcgagcaagccgagctgggccttctcctggtgcagatggagccgtgtgggcacgctgtcggatcactcgctcgtccacgcgtcgccaatctgaatcgggtgtgcacggtgcggggtttgcagccggtctgcacagaatttttttccaagtttgtgtcctttcttcttccaacggt

SEQ ID NO: 2786 - DNA, 537 bp, Oryza sativa
tgtaagtttccatagttattaaataatatatcttcaattttttatgcaaagttgactcaaataaattaatagcacacaccttgctctgctcgctgatattggaggactccaccacgaagtgcttgctcggttcagcactgtggttggccattgtcccctgccacaggtcacctccctgcggataagaagcattcgacgaaaaggaggccttggtaatggtagaactgggtcgtcccatgccataagtcacattggagctcatcagcttgccaattttaccgcctcgcttcttctccatttcaacaccatcgtgaatctttttcttgggcacaacgtcaatgaaccaatcttcaaatacgaagtcgcctccttcatcatccaaatcaggccagaactcatactcatccatatcgggcccatcctgggtatcaaagatcacgttcttgccttcttctaaacatcggccagattcacgatgaaaccacttgcctcgaacccgctgcccgcaccacatctgggcaggctgtttgcattcat

SEQ ID NO: 2787 - DNA, 2725 bp, Oryza sativa
  unsure (1)..(2725): unsure at all n locations
nnnnnnnnnnnnnnnnnnnnnnnnnnnnnnnnnagcaagtgtgagttctggttgcccgaagtcaaattcttggggcatgtgatatctgctaagggagttgctgtggaccccgaaacagtgaccgccgtcaccgattggaagcaacccaagacagttactcaagtccgcagtttcttaggtttggcaggatactaccggagattcatcgagaacttctccaaaatcgctcgacccatgacacagttgttgaagaaagaagagaaatttgtgtggagcccgcaatgcgagaaggcgttccagactctcaaagaaaagctggtttcctcgccggtgttaatcttgccggatactcgcaaggatttcatggtgtactgtgatgcttcgcgccaaggattcgggtgcgtgctcatgcaggatggtcatgtggtggcctatgcctcacgccagctacggcctcatgaaggcaactatcctacccatgatttggagttagccgcggtggtgcatgctctaaaaatctggcggcactatctcattgggaatcgctgtgaaatatatactgatcataagagtttgaaatacatcttcactcagtcggacctgaatcttcggcaaaggagatggttagaactcatcaaggattatgatgtgggaattcactatcatcctggtaaggccaacgtggttgccgacgctctaagtcggaaaagccattgcaacactcttaacgtccgtgacatcccacccgaacttaatcaacagatggaagccctgaacctaagcatagttggtcgtggattcttggctgcgttggaagccaagcctaccttgctcgaccaaatccgcgaggctcagaagaatgatccggacatgcatggactcctcaagatatgagacagggtaaagccgctggtttcacggaggatgaacacggaaccctatggaacggaaagcgggtatgcgttccagatagcagagaacttaaacagttgatacttcaggaagctcacgaaagtccttattccattcacccgggcagtacgaagatgtacctagacttgaaggagaaatactggtgggttagcatgaagcgggaaattgcagagttcgtggctctatgtgatgtgtgccagcgtgtcaaggcagaacaccaacgaccggccggacttctccaacctctccaagtaccagaatggaaatgggatgaaattgggatggatttcatcaccggacttccaaaaacccaaggtggatatgattctatatgggtaattgtggatcgactaacaaaggtagctcgatttattcctgtgaagaccacctatggagggaacaaactagcggaactctacttcgctaggatcgtgagtctccatggtatccccaagaaaatcgtatctgataggggaagccaattcacctctcacttttggaagaagctccaagaagagctgggtacccgtttaaatttcagcaccgcctatcacccgcagacagatggacagaccgagcgtctaaatcagatcctagaagatatgcttcgcgcgtgtgtcctagattttgggaagacttgggataagagtctcccctatgccgagttctcctacaacaacagctatcaagccagcatacaaatggcaccttatgaagcgttgtacgggcgcaaatgccggacaccgctattgtgggaccaagtcggagaaagccaagtgttcggaactgatatcctgagggaagctgaagctaaagtcagaatcattcgggataatctaaaggtggcacagtcccggcagaaaagttatgcagataaccgacgccgtgacctggaattcgcagtggacgattttgtgtaccttcgggtcacgccattgcgaggggtacacaggtttcagacaaaagggaagctcgcacctcggtatgtgggtcccttccgtatcatcgctcgacgcggagaagtcgcttatcagctagagttgcccgcctccttgggtaacgtgcacgatgtgttccatgtgtcgcaactcaagagatgtcttcgagtgccatccgagcaggccgactcagagcaaattgaagttcgcgaagatttgacctacgtggagaggccagtgaaaatcctggacaccagggagcgcaggaccaggaaccgggtaatccgtttttgcaaggtccagtggagcaaccatgccgaagaagaagctacttgggagcgtgaagacgagctgaaggcagcccatcccgacctcttcgccagttcttccgaatctcggggtcgagattccgtttaaggggggtaggtttgtcgcgtcccaaaacgaccctaaaattcatcctcaaaattgtgctgagaataattaaaatcaatgtgaaagccttcaacaattaaaatgtgcacagataaaagtcaaatgaggcttggaggatttttgtatatttcctaaaagcctaaaacgtgtaaataaattttagtggaattttcagagcacaaataataattgaaaagaaataaacatagttaaaaaggtttataaaaagaaaatcttaacagaagttcttttccccccccccttttctcttcttgggccggctcggcccaatccctccctctctctctctcttcccccgcggcccatcggctcctccccgcgcgcgcgccgctgacgggcgggcccgcccgcctgccctcgctgacgggtggggcccacccgtcgtcttcctcctcccg

SEQ ID NO: 2788 - DNA, 624 bp, Oryza sativa
aggcgaaggcgaaggcccatggctgccggcgacgaggaaggaaagctcgggcttgaaggaaagaggccgatccgaatcgaactcgattccacgaacttccaaaacgaattagccgatgattccaaaggagaaaaggtagaggagatcccggagagtgtttcccctctattgatttggccggaaacggaaaggggcggccagattggaaggaaacagcggcggtggctcggcggcggcgcgctagggtttcggcccgaggaagacgacgggcctgacaggtgggacccacctgtcagcgtccaaacgcgcgcgcgcgcgggcggctgcggactgggccgacttgggccggggagagagagagaaggttttgggccgactttcggcccaaagccaaaagaagactttttaaaaactttttcaatttaaattatttcttaaatgcaattccatttattaaaaatactttcttagctcaaataaatcccagaaaaatctaggaattatagaattaagcaaagtatttaatgaaattttatctggccccattttatattggaatttattaattaaaattagattttcttttcaagacttttaaaataaattctagaaattccatttaaa

SEQ ID NO: 2789 - DNA, 812 bp, Oryza sativa
agatttgcgggggcaaatccacccgtttgaacgcaagagagagagggaaaaatggggggaaagggagaggggatcacggggagtatttccccccactttattgcacgcggggacggcgggatgcggcggatttggcggcggcggcgtcgcttggcgcgggcggagcggcgggagtggcgggaggacggggatgatgggtgggccccacccgtcagcgagggtggcgggtgggcccgcccgtcagcggcgcgcgcgcggggagggaggccgaatgggccgcgggggagaggagagagagaggggggagagagatgggccgggccggcccaaggaagggaagggggacttttagggtttttctttttataaaactttttcaactttgtttatttcttaataattattatttgtgctctgaaaattccactaaaatttatttacgcattttaggcttttaggaaatatacaaaaatcctctaagccttgtttgacttttactttgcacattttattttttggaggctttcacacggattttaattattctaggcgtaatttaaaggatatattttagggtcgttttgggcgtgacacaccacaagtggcagcaatgttccgaagagggggaggaagttctcctctgtacccgggacccgccggaaggcgatgagcccagcggtaagcttctctttcgtccttgagtacgtagtcagaacgacttaacctcacatcatattatcttactcaggacttgggtgcgtctccaccgcctcagcgaaagcagaggttggtgacggtcggcgagaagtaag

SEQ ID NO: 2790 - DNA, 1334 bp, Oryza sativa
tagaccgtaattccgctgctgttttcttttcttttgtaagtatgtaacgttattattatgatggatttgtatattaaattgtcagtttgtgtacctcggctgattcctggacgaggattttatgcacaaataagttcggaaattactagtgaatttctgggcgtgacatgtggtcagtgtggctctggtacaagcatccgaagtgggccataagctagtgtattttgtgtccgaagcactacaaggggcgaagaccatgcttgagactagatgacggtggttgtcaaaggggccttcgccgttgtggctgttcaaaccgcggcatgtgaggtcgaagccactgccttggacggtactggtacggttggggccgcggcggggctgaaggctggacagcctgcatcgccctcggtggcggtacgccaccgtcttaggcggtcaaaagctctactccctcttcacccgccatctcctcttcgccttcgcccccctttcgcctaggcacaactctctctttcacggtcttttttggtggcatctgtggttttgctctgggttccccacggacggcgccaggtgttgtcgaatgacaactgcttcacgtcgaaggacgcggtaaacttgatgtgtggttggaatagtaaagcaatgtattaattgataaaaatttttgggattccccattacatggccctagggggctatttataatccttgtataggctcatactctctagggtttggttagtataggggaatttacatggttacccttatgatagggacattataataggtatacagtgtcttttgtattcatggaccttgaggcggcccccttaggccggcccattagctagcgaagggcctctatgggctgctgggcctcctaagcctttagccgaaggcatttgctactttgggcgatggctttgtgcttcgacttacagccttcgcccgtggtggatctttggttgatcaatgagcctagagccgaacccttcggtcttcattccatggcttcacccagtcatgatggtgaaacccccttggtcttcgtcattctgcttcgcccaaggactttgccccttggcttcgccaatggcacacgtctgggatttagccgatgtttgctattttggatggtttcggcaggtcggccgaaggcccttatgacatacctccaacatagaacatatgtacctttggttgattaatacataaggtattcatggttatatctaagctagttgtgtcctcatcatcctcatcgtcctcgatttcgccttgtcatggagcgtattgaacttatctttatctatcacaacatctgg

SEQ ID NO: 2791 - DNA, 5202 bp, Oryza sativa
  unsure (1)..(5202): unsure at all n locations
nnnnnnnnnnnnnnnnnnnnnnnnnnnnnnnnnnnnnnnnnnnnnnnnnnnnnnnnnnnnnnnnnnnnnnnnataaggaggaacttggattgatccatgacaagccatccgataagaccacaatgcttcggctaaacgagtatgccattgccgaggataatcagaaatcttccttttaatcaacttgatcaaacttttgttagatgcctcggcttgcccattagcttgtgcataatacggtgaagaattcaacaactttatacccatactatcggcaaactgaacaaacttatcagacacaaagattgaaccttgatcaatcgtaatagtctgaggagtaccaaatcggtagattatatgttcttggacaaactgtattgcatccccagaatcagccttcttcaaaggaatcgcctctacccatttgatgaaataatcagttgccaccaatataaacttatgtcctttactcgatggtggattaatcatgccgatcatatcaattccccatcctctgaatggccatggtttaatgatgggattcatagccgacgccggcgctcgctgaattgctccaaatttctgacaatcttgacaacctttgtaatatctgaaacaatcttctaacatcgtcggccaaaaataccccgcacgccgaagtaaccacttcatcttatgagccgattgatgagtaccacaaattccttcatgaacttcgccgattgcaactttagcctgataagcactcagacacttaagcaatactccatcaatcgttcgataataaagctcatcatccaataaagtatatttcaacgctttatatcttaacttcctataagccgactgggatggattttgtaaatattgatgcacatcatatctccaatcatcggccgtcatggcagcaacttcaatctgaacatccttgatcatcggcttatatcccgatgccccttgagctaaatcatagacctcaatattctgctctcgagatacatgcttcaaagttactagccgaaactccttcatcagtttttggcacttctcattataaactatcaacgtatcattcttacactcatattctcatgccaactgactgattactaacaaagaatcccccatgatttcaacagcatcggcttcaacctccttgagcaattgcaaccctttaagtactgcctcatactcagccttattattagtcgcataaggtttgatagtataagcaaactcaaaacatgccccccgaggcgaaattatcctttgtgtagacgttcgaatcctccacgacgccctcaaaataatagcttgggttctccatcttcaattggctgtatatcagaatcggatacttttaaaaaatctccatcccaaacttttccagataaacaatcaaggccatccatctcccaaagagctaaatcggcacaagcaacattgactgacctgtcggctggtacgatctctatcttgttgccttgccattgaatcaagcattggtgcatggtcgaaggaatacaacaattagcatgaatccaatcccttccaagcaacaagctataagaacccttcccatcgatgacaaagaatgttgtagggatggttttactgccgactgtcaactccacgttcagaacccctttggtttctgatggattgccaccaaagtctttaagcaccatgtttgtcttgatgaggttttcggcgttcctacccaatttcttgaatgtagcataaggcatcaagtttactgcagccccaccatctaccatcatcttaggcatcggcttcccattgacataaccgtttatatacaatggtttaagatgccgattctctgtcccctcaggtttctcgaacactgcttgttctggtgacaaccaacttagccgattcctcttccaccttgtctacatcggcttgatcaatcccaaattcggctggcaatgtaaaaaccatgttaattggtgccactacaacactcttcccttttgccaacctctttgcctcatcggctacaacatcatcggctataggaatctgattcttaacacgcaattcctgtcttggttttgctttcttcagccgatggttaatttcttgttcaacctcctgaaggcgctccctgttcctcaatctttgaacccttctcttctgattcttcatgaaaatactagaaggacaccattgatttgtcctgactacgtcatcctcctggccacgaccttgattcactgggcccaatctttgacgaacagacactctttcctgcctcagccgattactcctattatatgactgacttgagctctcaatgatatcattgcacccaaggtagttttcgatagacggcaacctcatcccttcattccagcagaatctaaagaactcacaaccccaatgaggatcaaaaccatcatcgtgttcttcataatgcttctcctgctgcttctcatacttcctctgatatttgttgattatcttagccgaattcacttgaaaaccctttgcacggacgctatcggctgattggccagctgtatgtaccatattaacaggaaaaggattaccatcgaccttcattggcctcttcgaatcatcaaacttgatttttcctccctcaatatccgtttggatctgctgcctgaagaccttgcagtcattagtcgtatgagacccagaattatgccacttacaatacctctttttgcccaactcttcagccgatggaattgtatgtccagcaggaagttgaatctgtttttctcgaactagcaaatcaaatatcttatcagccttagttatgtcaaagtcatacctctcctcttttcctgagtttttcacccattggtaaggtataacctttttgctcctaacccactcagctgcagctatttcagaatcatcatcctcaccatccgatccatacatataaggataaacatgattaatcttcctagagttcttcctagcttccgcgaacctttgttcatgcaaacctaccttctgtgtaaggtacgacaagctttcggaatcttcagatgagaatttttccttgatcggagcaatcatcccttaaaaagccaaatcggctaactgggcatcagtcaagctcaagctgtaacacttattcctcatttccctgaacctttgaatatactcatgtaccggctcatcatgcttttgcttgattgacatgagatcagacagtttcatctcgtgaatcctactatagaaataactatgaaactgcttttctaaatcggcccaactgttaatcgacccatgtggcagcgaagaaaaccaagtaaaagccaacccagccaatgacaaccggaataacctaaccctcaaagcatctacagccgatgcctcaccacactgagctaaaaatcggctaatgtgctcataagtcgatgtagtgtcttgtcctgaaaactttgagaaatcaggtactttgaaccagttaggtaaaggaactctttcaaaccattcaggatatggttgtcggtacaaatttccagtctcctttggtttaagcccaaattgctccctcattacatcacctatcacatcagcccatggtcgctgctgaggtgttgcttgagattgttgtggtgtgggctcatgtcacgaccggaaataacccaacgggtgttccttacgtgcgtgtattattccttgtcccaggaggcaaggtacaccaaaagttaatacaattcagagtttaacaagcggaagcgtaaatagttaatttattacatgggcagcgaaggcccagcacacacagagacaaacgagaaacagcggaagactaggacgacgaccacaggcgcttgacggcaggcacgagctagacaccaaagccttcatcttctaggggctcctcttctggggttgggaaaaattgagcaagactgagtacaaccaccgtactcaacaagacacacccacaagtgcagaataaatgcaagggagtacaaaggagttatactataaagggttagggtttgcagtaaacagcatttaaaggtacttagttgctcaaagctattttgtaaacacgattctagaactataccatattatttatcatggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgcgaccacgtgccacataccaccacggtatacagacggaagacgtgacatagtttccaacccatcctagccatagacaagagtaccgacccaatcccacctatggccggaacccccgggacaggtaggcaggattgagcccctagcagcaggacaccagccctgtgccgtgacatctcgactaccgggccgcagctcgtgtagccttcatttatccttgagatgtccatcgacccccgacttcgtccatctccatccgtgtacttttgtttattaccaggctgagccacaaactaagccttacccactagacatgtggaagtacggtagtgctttgcaacagaggcccgaagaccggtccttatatggccgaggtgctactatcaaaaccatgcaccccgagcccagcctaaaaccatcttggggattttgaatagaaggagcggtgtgaatccaattccacaataatccaacaattccaaagtgtccagatgatatgaagattcccaaagtctagagttggaaaaccacctaatgttacctaattaaatagcgaagcatctacctaaaatcatactagtgataccatgagtagggtgtccactagttggggttttgtttattctagggtgaacaaggaaataataacaataacaatattaaggtcataacaaaggtaaataggcatggctaaataaagcagtgataacgcgggaatttaaataaagtgataatgcaataatttaaatcaacataattttacaaaataggattcaatatgttcaaagatgatgtgacttgccttgctcgctttcccaaacgccggcttcaacttc

SEQ ID NO: 2792 - DNA, 17459 bp, Oryza sativa
  unsure (1)..(17459): unsure at all n locations
cacccgcgggcgcgggcggctgacggccgggccccacctggcagccgcggggcgcgcccgaaggcggcctcgccggcacggccgacgggaggcggcgcgcccgcgccccgatggtcaccgccggcgaccaccggcgcggcggggtggcgcccgagagagaggagagaagagggaagcgaagcggcggtcctcggctcaccccgggtcgacggcggcgacaaaaacggcgaccgaagcggcgagaggcggcggtgcggttcggatcgacgaggacggcggcgctccgacggtcggcaggcgaaacgaaggggtggacgaggttgacggggacgcggcgaagccgaaggaggtgacgccgagacgggaggagatccggggcgacgacggcggcgaatcggagctcggcggcgacggcggagagagaggacaacggcgcgagctcgaatccgacggggagagagtgcggcgagtggcggaaacggaggagcgaagcacgaggaacgattatatagcgtcgggagcgagagagggcggccggagaggaaggaaaccggcgcggcgatctcggctccatcaatgacgccggcgaggatttcgggaataaatccgagcgaatccgagggagagagagaggggaaagtggggggaaagagggagggaatcacggggagtgatttccccctctttatggcgcgcggggaaggcgggatgcggcggattcggcggcggcggcggcgctagggcacgggcgggcggcgggcgcggcgcgaggaaggggatgacaggtgggccccacccgtcagcgagggtggcgggcgggcccgcctgtcagcggcgcgcgcgcggggaggaggccgatgggccgcggggagaggagagagagggagggaattgggccgagccggcccaagaggggaaaagggggggaaagaagacttttagggatttttctttttataaaacctttttaactttgtttatttcttctcaattattatttgtgctctgaaaattccactaaaatttatttacgcattttaggcttttaggaaatatacaaaaatcctccaagccttatttgacttttaaatttgcacattttaattgttggaggctttcacatgaattttaattattctcggcataattttgaggatgtattttagagtcgttttgggacgcgacattgtttatatagggttgggagggggagagagcggccggatgtgggggaatcggccgcggaagatccggccgccattgatgcgccggcgaggtttagggggaaagatttcgaacgaatccgagggagagagagagggaaaaacgggggggaaagagggagggaatcacggggaatatttcccccctcttgattgcgcgcgggacggacgggagcggcgggattcgcggcggcggcggcgctagcgcacgggcgaggcggcgggggcggcagaaggtaggggatgacgggtgggccccacccgtcagcgatggtggcgggcgggcccgcccgtcagcggcacgcgcgaggggaggaggccgattgggccgcgggggagaggagagagagggagggaggtgggccgagccggcccaagagggggagggggaaaaaggactttttagggtttttctttttataaaaccattttaactttgtttatttcttcttaattattatttgtgctctgaaaattccactaatatttacttacgcattttaggcttttaggaaatatacaaaaatcctccaagccttattcgacttttaactttgcacattttaattgttggaggctttcacatggattttacttattctatgcataattttgaggatgtattttagagtcgttttgggacgcgacaaacctaccccccttaaacggaatctcgaccccgagattcggaagaactggcgaagagatcgggatgggctgccttcagctcgtcttcacgctcccaagtagcttcttcctcggcgtggttgctccactggaccttgcaaaaacggattacccggttcctggtcctgcgttccatggtgtccaggattttcactggcctctccacgtaggtcaagtcttcgcgaacttcaatttgctctgagtcggcctgctcggatggcactcgaaggcatttcttgagttgcgacacatggaacacatcatgcacgttgcccaaagaggcgggcagctccagctggtaagcgacttctccgcgccgagcaatgatacggaaaggacccacgaaccgaggtgcgagcttcccttttgtctgaaacctgtgtacacctcgcaatggcgtgacccgaagatacacaaagtcatccattgcgaattccaggtcacggcgacggttatatgcataacttttctgccgggactgtgccaccttaagattatcccgaatggttctgaccttcgcttcagcttctctcaagatatcagtcccgaacacttggctttccccaacttggtcccacaagagcggtgtccggcatttgcgcccatacaacgcttcataaggtgccatttgtatactggcttggtagctgttattgtaggagaactcggcgtaggggagactcttatcccaggtcttcccgaaatctaggacacatgcgcgaagcatatcttctaggatctgatttagacactcggtctgtccatccgtctgcgggtgatatgcggtgctgaaatttaatcgggtacccagctcttcttggagcttcttccaaaagtgagaggtgaattggcttccccaatcagatacgattttcttgggaacgccatggagactcacgatcctagcgaagtagagctcggctaatttgttccctccataggtggtcttcacaggaataaatcgagctaccttggttaaccgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactgacccaccagtatttctccttcaagtctaagtacatcttcgtactgccagggtggatggaataaggactttcgtgggcttcctgaagtatcagctgtttaagttctctgttatctggaacgcatacccgatttccgttccatagggttccatgttcatcctctgtgaaaccagcggctttaccctgtttcatattcttgaggagtccatgcatgtccggatcattcttctgagcctcgcggatttgatcgagcaaggtaggcttggcttccaacgcagccaagaatccacggctaactatgcttagtttcagggctgccatctgttgattaagttcgggtggaatgccacggatgttaagagtgttgcaatggctttttcggcttagagcgttggcaaccacgttagccctaccaggatgatagtgaattcccacatcataatccttgatgagttctaaccatctcctctgccgaagattcagatccgactgggtgaagatgtatttcaaactcttatgatcagtatatatttcacagcgattcccaatgagatagtgccgccagatttttagagcatgaaccaccgcggctaactccaaatcatgggtagggtagttgccttcatggggccgtaactggcgtgaggcataggctaccacatgtccttcctgcatgagcacgcacctcagtccttggcgcgaagcgtcacaatacaccatgaaatccttacgagtatctggcaagactaacactggcgaggaaaccagcatttccttgagagtttgaaacgccttctcgcattgcgggctccacacaaatttctcttctttcttcaacaactgtgtcatgggtcgagcgatttgggagaagttctcgatgaacctccgatagtatcctgccaaacctaagaaactgcgaatttgagtgacggtcttgggttgcttccaatcagtgacggcggtcactgtttcggggtccacagcagctcctttagcagatatcatgtgccctaagaatttgacttcggacaaccagaactcacaattgctaagtttggcatacaattaatgttcccgcaactttcccaacaccagacggagatggtgctgatggtcttcctctgattgtgagtataccaaaatgtcatcaatgaaaaccacaacaaacttatccaagtattccatgaacactttgttcattaagttcatgaagaaggcaggtgcattggttaaaccaaacgacatcaccgtgaattcatacagtccgtatcgtgtggtgaatgcggtcttcggaatatcttcttcacgaatacgtaattggtgatatccggaacgaagatcaatcttggagaatacagtggcacctttaagctgatcgaacagatcatcgatccggggaagagggtacttgtttttgatggtgacttcattgagagttctgtagtcaacgcacatcctcttcgtcttgtctttcttctccacaaaaatcacaggagcacccctgggggaagtactcggacgtatatacccctttcctttcaactcttccaactgtttcttgacttcagccagttcatttgctgccatacggtagggtcgcttgtacagaggagtggttcctggagcaagatctatccggaactcaatctctcgcttgggtggcataccgagtagttcttccggaaacacgtctccgaactctctgacgatggggatttctgacagtcctatctgatgaagttctgaactactgacagaggttgggggcgcaaagaaaacaaccggttgttccggccctcggtacagagtgacagtgcgtctcgcgcaatccactactccttggaattgagccaaccaattcatcccaaggatcacatccaagttcttggtgtctagcagaataagatccgagggaaaaggaatcccctgaatttctatagggacggcagggctataatactttgctgtcataaccactccaggggtggtgatgagcagagggttcctaagcctttctacccccaactgatttctccccacgaatggcacagatataaacgagtgggaagctccagagtcgaacaaaatggtagcagggatggaatgaatgaggaacgtaccaacgatgacgtctggagttgtcagcacgttctcggccgtcacgtggttcacacgaccccgaatgacatcgttaccaccattgttggagcggggaggcgctttgccttgctggcgcctcggctttgggcatttatccgcaaagtgcccgggctcgtagcagttgaagcacagacgctgcggaccttgagcgtccctgcggccttgaccaggctgcacagttggcgtaggaggacggggcgcacgagtcccttgttgattctgctgctgctgcggctgtgggacgcgcaccacgaattgaggtcgaggcgcggagcgaggttgctgctgctgttgttgctgctgcgaggaggatccccctggatagggattggtgtagcggaccctttggttagcaccctgttgattgcggaaattcgccaagcggcgcttgtgcgactccagttccttgtgcttggcttccaagcggatgctcttgtccaccagacgttggaaatccggatagtccccggagactagacggacggacagctcagggtccattcctgccaagaacttctcttgcttctcctcatcttcccgcacatcctccggggcgtaacgggccaggttgttgaactcatgcaaatactccatcacggagcggttgccttgcttcaactctcggaattctcttttcttaagggccacgactccggcgggcacatgggtcctccggaaatcggcggtgaaacgggcccaagtaataggctgcctctctggctgcgtagcctgcaaatggtcccaccatagagatgcgggcccctgcagctggtgggcggcgaagacgactttctcctcatcgctgcactgcacagtgtctagctttttccccacggcatgcaaccaatccaacgcatccacggggttgttggagctggagaaggtaggtgggcggatgcggaggaactcagcgagttttgagtgttggggaggtggtggtggagcattatgttgtggcggattttggaggtggtggaggaaagcagtcatcatgttggcctgctgggcgaggatttgggtgagaatagcgttggtatctggtggtggtggtggaggcggaggaggaggtgggggtgggctgccatggttgttgtggttgctgccctcaggttggttgccatcaccggtattagcacttctcctggtcatcaccatctgaaaaccccacacagaaccagcaaacagagagagagctgacaattaaagctaaccacccacgactaccttaattcttaaatttattactgctattaaattggttcattaaagttcaaattgcttagacaaataaaataaagacaggctccgacacagttatgccatacaccggcataaccatgccccacacaactccaacaagaagacaaacgagaaagaacacacgcgcaagcctactaactgctcgtctatcgctgcgacgggccaggacggaaggtgagcaacagcgcatcctccgtgctaccaacgccggaggcttccccctcctggggaaccacgggcgcgggctcggcacgaggggtctccacgaagcaggtccacgccagggactgacgaacaagctcgggcctggaggtgctcttgcgggcggtgatcttctggctgcggcagacgcggcggcgcttgggacgacagacctcaccctgggcgaccttaagctgacacagctgcgcctccaacgcgtgtaggtccttcttcagctgcagattctcctgacgcagctccaggatcttcatgttgttctcgaccatcccacggcgcaccatctgttggaagtcgatacgagccgcgtcgtacgcctccaccatgcgcgccaggtgcacgatggtagcgtcatcctccgagctagcatcccggaaggtggcgaagtcgcgggctcctccgcagcgagggtggtagcggtagggcgagtgctgcaactcgtccgggtagcgctggtgaagagtgccgatggcgaggagagcggcgttctggcaagcggcggggaaggaatctccacccgcggtgactgccagcgaagtccgctcgggagagccagtgaggatcactgcagtaacctcccacgcagcgtggggctctgcatcgtcaccctcctgctccggaagcggcctggcctggtagtccactccaggcggataccccaggacaacgcacatgccccgtagctccaagacgaagccagtcatgtccaaaccacgacggctgacgctgccggccatctacaaacaaaaacaaaaaggaaaacaacattttaaaggtcagattttggcgataaatgaagcagcaagacagagagagactagaggattttcacaaatacaaaggatttttattattgaagatattgctaaggcttgggatctacggctcgtcctagggtcaagggtggctctgataccaacttgtcacgaccggaaataacccaacgggcgttccttacgtgcgtgtattattccttgtcccaggaggcaaggtacaccaaaagttgatacaattcagagtttaacaagcggaagcgtaaatagttaatttattacatgggcagcgaaggcccagcacacacagagacaaacgagaaacagcggaagactagggcgactaccacaggcgcttgacggcaggcacgagctagacaccaaagccttcatcttctaggggctcctcttctggggttgggaaaaattgagcaagactgagtacaaccaccgtactcaacaagacacacccacaagtgtagaataaatgcaagggagtacaaaggagttatactataaagggttagggtttgcagtaaacagcatttaaaggtacttagttgctcaaagctattttgtaaacacgattctagaactataccatattatttatcaaggccgtgaacccacacgaacctgccttaacccaaggcctcaataccaccacggtacctcggaaaggagttatgacaatacacctcatacaacacaatccactgcagcgcaccttcctggatcataatcacccccttataaacaaggcatggactccccagcgacccccgtgggcttatctccgccacttctcagtctagtgccccgcaatgaaccatgctatacaaaagataaagccgttgcccatgctagcttgtggttggcacgataaatgtttcacaaccgaaactcgtgaaccggtccttaattgtcatgagcacgaccatcaaaaccatgtgctcacaacccaccattaccaggttttagttggcacattaattaattaactaatcacgattgaccatcgtgaactatcattaagccatcatgaaataatagtgaatcataagttatcccaatagtgagctaatgtttctaagcagggctaagcaattatatctaatatctagttgaaccaataaataaagctcaactagtcaagttataataacccaaggtatcaaggaataaagtaatcaagaacaaaagggctataacaaacaataggttaaatccacccaatgacattcgaaaataaatgcaatatttgaatagaaacaatagctttaaataggatcaatatgctcaaagggttgtttgggatctgtgtgacttgccttgctggccttggaactcttcaaactcttctccggcgaaaacggactctccggaaacgacggaatctaagcaaaaagaagcaaaatcaccaaaacagcacataaacaagcatgaacagtacatgtggatatttttaatgtgtagatctcaattttagaaaaatttagagacttgaaccaactaaattggagctaagatgaattagttatgaatttttaaagattaaatcagattaaaacacttaaatcggtttaaattgaattatgacgcaataatgaattatttttgaaaagaaaaaggggatttattgcgtcagcgggctagggtttcggtggaccgggcgcacgggcggcggttcacgcgaacggacggccgagattcgatccaatccaaacggacggccgagatcgatcgggtccacggcggttcacggcggacgaccttgatgacgtcagcaatgacgtcaccgacggcggcggcggctcggcggagcggacggctcgggcggcgcacgctcgccggcgaacggcggcgctaggacacaaacgaagggcaccaacgggtagcggacagcacggcgaactcaccgacgaccaaaacgacggcggagaagcaacggacggcgccggcgacgaagaggaaacggcggagttcttcggcttgacgacggcgacgatgctccggcggtctccgacgatggcgaagcggcggacgaggacggcgacgacttggcgaccacgatgacgtccttcccgagcgacggcgacggctgaatcgacggcggcacacggctggagcggcggcggcggcagcggcgcaaggttgcacggcgctagagcgactctgacgacgagaggcgaaggcgagggtggcggcgggtggaggagacactggggaggcttttaaaggggctcggaggcgaaggcgaaggcccatggctgccggcgacgaggaaggaaagctcgggcttgaaggaaagaggccgatccgaatcgaactcgattccacgaacttccaaaacgaattagccgatgattccaaaggagaaaaggtagaggagatcccggagagtgtttcccctctattgatttggccggaaacggaaaggggcggccagattggaaggaaacagcggcggcggctcggtggcggcgcgctagggtttcggcccgaggaagacgatgggcctgacaggtgggacccacctgtcagcgtccaaacgcgcgcgcgcgcgggcggctgcggactgggccgacttgggccggggagagagagagaaggttttgggccgactttcagcccaaagccaaaagaagactttttaaaacctttttcaatttaaattatttcttaaatgcaattccatttattaaaaatactttcttagctcaattaaaccccggaaaaatctaggaattataaaattaagcaaagtatttaatgaaattttatctggccccattttatattggaatttattaattaaaattatattttcttttcaagacttttaaaataaattctagaaattccatttaaacaacaatttatatttttttgaatttttagggtgtgacaaacctaccccccttaaacagaatctcgtcctcgagattcggaagaactggcgaacagatacggatgagctgacttcaattcatcttctcgttcccaagttgactcttcttccgagtgattactccactggactttgcaaaaacggataactcgattcctggtttttctctcatttgtttccaagatacggattggtttctccacataggtcagatcctcttggacttctatctgttcaagattagcttcttcggtaggtacccttaaacactttttcaattgcgacacatggaacacattatggactcctgccaaagattgaggtaactctaactgataagcaacctctcctcttctactgacaatcttataaggtcccacaaaacgcagtgccaattttcctttggtatgaaaacgatgaactccccgtagaggcgtgacacgaagatacacataatctccttcttcaaaactcaaatctctgcggcgattgtcggcataactcttatgacgcgactgagccacacgcaatctttcttgaatgatctttaccttttcttctgcttcccttacgatatccgtcccgaaaacctgacgttctcccgtttgatcccacaaaagcggagtgcggcacttccgaccatacagtgcttcgtaaggagccatctgaagactagcttgataactgttgttgtatgaaaattctgcataaggtagattcttatcccaacttccaccgaaatctaaagcacaagctctcaacatgtcttccaaaatctgattcaccctttcagtttgtccgtctgtctgcggatgataagcagtactaaagttcagcttagaacccatctcttcctgaagtttcttccaaaaatttgaagtaaattgactacctcgatcagacactatcttcttaggaacgccatgcaaacacacaatccttgccatatacaattccgctaagcgacttccggaataagttgtctttaccggaatgaagtgtgccactttagtaagtctatcgactatcacccaaatagagtcctggcctaatgacgttctgggcaaaccagtgataaaatccataccgatttcttcccatttccattcaggaatctttgaaggctgcaacaaaccggcgggtttctgatgttctgccttgactcgctgacaaacatcacatactgctacgtattctgcgatttcacgcttcatacttgcccaccaaaacctttccttgagatcctagtacatcttagtactaccagggtgtatggagtataaagtatcatgagcttctttcagaattgcatcttttaaatctttgttgtcggggacacagattctttcacccaaccatacagttccgtgctcatcctccaagaaaccaatagcttttcctcttctcatattcttcttaatttcttggatatcaggatcattagtttgagcttctctaacttgatcaattagagtgggcttcgcttctaaggctgcaacgaaacctatactgacaattcccaaattcaatctttcaaattccttgcataattccaatggcaactgtcgtccttccgtagcattgcaatagcctttcctgctaagagcgtctgctactacattagcctttcccgggtgataatgaattcccatgtcataatccttaattaattccaaccatctcctttgtctcatgttcagatccgactgagtaaagatatactttaagctcttgtgatcgatatatacctctgtacgagtaccgaaaagataatgacgccaaatcttcaacgcatgaactactgcagccaattcaagatcatgagtagggtagtttttctcatgcggacgtaactgacgagatgcataggcaaccaccttcccatcttgcatcagaacacaacgtaaccccagtttggatgcatcgcaatacagttggccaccctcatttggatcaggcaaaatcaaaataggagctgatatcaagcgacttttcaactcttgaaaactctgctcacattcttctgaccacttgtacttcacatctttctgaagcagtcgtgtcatgggcttagcaatcttggaaaaattctctataaacctccgataatatcctgccgaggcctaggaaactgcggatctctgaaactgtctttggttgtttccagttggttacggattccacattactaggatcaacggcaactcctcctgctgagatgacgtgaccaaggaacttcacttcagacaaccaaaattcacacttgctaaacttagcatacagttgatgttctcataacttttccaatgcaaggcgaagatgttcttcatgctcttctttggtcttagagtagataagaatgtcatcaataaagaccaccacaaacttgtctaggtattccataaacactttattcatcaagttcatgaagaaagcgggggcattggtaagtccaaaagacataacagtacattcgaacaacctgtacctagtggtaaaagctgtcttaggtatatcttcctctttgatcctcaactggtgataccctgatcgaagatctatcttggagaaaacggtggcacctttaagctgatcaaacaaatcatcaattctgggtagcgggtacttattcttaatagtcacatcatttaatgcacgatagtccacacacatcctctgggtatgatctttcttttccacaaaaaataaccggagctccccatggagatgaactcggtctgatgtatcctttctgaagcaaatcatctacttgcctcttgacttctgccaactcattggctaccattctataaggtctcttatggatcggagttgttccaggtaccaaatctattctgaactctatatcccttttaggcggcataccaggtaaatcatctgggaacacatcaggatactcccggactataggaatctcttccaaagttatctggttcagtcttgaccttaaaaactcagaagacaatgcatgaacagttacaactcgaccatcattgctggtgagagttacttttctgttagcacagtctatcacacctttatgtctagctaaccagtccatccctagaatgacatcaaggtctttggattctaacaatataagattggccagaaatggtaccccttgaatttctattctgacataggggctacgttgcaaagagagtgcttgattgcttggggtactaaccatcaaaggacgtctaagatcttctacttccatcccatgatttcccgcaaaactcatagatagaaatgaatgtgtagcaccagaatcgaaaagtactgttgcaggaactgagttaacaaggaacgtacccaaaatcacatctggagcatcttgagcttctgcagctgcaacatgattgacacgggcctttgatgctggtacagcagagttgctctgggcagggacaaccttcacgcgtcggggcttcggacacttgtcagcataatgtcctgggtctccacagttgaagcataccataggcttgctgccttgctccctcttggcaggttgttgctgtgtcgaagctgcaacaggacgtggagcttgattgcggatgttattgccagcattgttgttgaagaactaacgctgcggacgaacaacagacgaagaacctccttgtggcatggactggggtcctaaannnnnnnnnnnnnnnnnnnnactcccctgttgtgccttgaagtgagcaatccggcgtttcttctgctccatgcggttatacttgtcctcctgacgaatagccttatccactaacttctggaaatcatgataatctccagtcatgagtgggtaagaaagctcatcattaagtccttccaagaacttctcttgacgctcttcatcattgcgtacatcttccggagcataacgagctagacgattgaactcgtgcaaatactccgtaacagagcgagatccttgagtgagcgacctgaactccttcttcttgagagacaccactcccgatggtatatgtgtcttccggaaagcagcggtgaattcaagccaagtgataggttcagcagtagtcctattcaggcggaagtgatcccaccattcagaggcagggccatgcaactgatgtgatgcaaatgagaccttctcctgatcagtgcactgaagcaaatccaacttcttctctatggcatgcaaccaatcgccagcttcaacaggattagtggtactagagaaaacaggcggccttacacgaagaaattctgctaacttattctgagggggtgcatggttatttccttggttctgctggttctgaagttgctgcatcatcatgttcataagctgagtctgttgagcaagaacttgagcaagggttggattctctccattgttattgttattggggttgttgagattgggaccattcctgttgctgcgagtgttcaccatctggcatggatagggcacaagaagagaaaccgggggaaaactacttaggacagagaattactttaacttttattgatcttaactgagtttcattattacaaactgaagactctcacaccactaaactcaccaacttcctaacactcaaaaagcaaacaaacgcatgtacttatatcccaccactgatgtaaatcacatgcaagacccacacacacacaagcaagcttaaaagaagcaaactaacacaacgatctaagacaacgacttaacaagctactcttgttcttccgagcatcgaaggtcgattgaaggctcgttcggctcgtcttcatcatcttgagttgctacccactcaatcttggaatggttgcgcttggattcttcttcttcatcactacttatgatgatgatcggaggatctgctggggcaacttctttctccaccacacggacctttggcgccaattgatagcgagggacaaatagagctctcttccttgcggtaagacgaatcctggccttctgcggcggtgcttctcccttcaatgcggctagttccttctccaaacgatccaccttgtcttctagctcgcaaatcttaccacgattccgatcttcacgatcttgagctgctaacacagtctccgcacgactttcatccatagcccatagcatctcaaccaaatgtcttgtggtagcatcattctcaattccttcagtctcaaggtaactgccacggtcacttccctgcggttgacgaggatggtaacgatactcagtgtcggccaactgatcactgtagcgatcacggagctctcctatggcgatccttgccacttcctgacatgcatggatgtagttccttcctccagcttcgaacatcactgatgggatatcttcactgttactgttcaaggtaactttgactcggcacttctcttcatgacgatcatgacgaatctaggcataaaaaggggcagtcccaaatccaatgacaaaggacatagtacgcaactcctggacaaaaccctcaacaccaaacaagtactcaggcttgtagcgcggcatctaaagacaagtgaaaggagggagttaaaacatttatccaattaatagcacaagtttttggattaattttgaataaagtttgaaaatcaaagcaaaaggtaagtaaataaagtaaaccaaacttgcaagatgagttgaaatagttgaaaatgaggtcacaagttttgtacttttgaataacaagtttcaaaagaaataaaagaaagttataaaatcaacttgctaaatttattttattgcagtaagattaaatgaaacatcattgtaaaacttttgctggaaaatgagccattagtacagtaatagatgtacagtactaataacactggaataaattttgaatgagaaccattaaaagagattatgaagtgcatgtgccattagtttggtttaattaaaagagaaagagaggagaacagttctacttttccaatatttttagaaggcttctatgggtaaccatttggcataacctagggtcaaaggggctctgataccaacttgtcacgcctggaatttctatccaaaattccaaacgcttacatgtgtgtgaaccctcgtccaggaatcagccgaggcacacaataacaaattgataatagagtacagttattactctaattattaagcgtataaaatgtcattacggaggtagatagttcctctcaatcaataaagatctaagcagcagaaaataaaataaacggcgcagacggctccactccacaggcagcttgaccaaggctacacctaatcctccactccatcagcctcaatgaagaactcttcttctgatgaatgattgcaaggagagtatatgacatactcagcaagccacgcagcaaatatgcaagtgcacaggataacaaaggagggcataatagggtttcatttgcaaaggcagcatttagcaaacatttgagaatttaataaaacagttaagtaattaaacaatattaatccaacgctatacaacataccctgttgcataggcccaaccattctgaacaaccatcccggctgcacagttctatctccaaaccaggaatataccattccaaaccaggagctaatcaaattattaccaatttaagcatctcttactaaggtgagaagtgtgaaactaatcacgaaagacattgttcgacccgcccataaccgcgggcacggctattcgaatagttttactctgatcagagctgtaccactgtacccacaagacacaaccccacatcatgtcaccatgtgcctcaataccaccacggtacctcggaaaggagttatgacaatacccctcatacaacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccat

SEQ ID NO: 2793 - DNA, 9288 bp, Oryza sativa
aatgacggtgcgaactcgattccgacggggagagagagcggcgagtggcggaaacggcggagggaggcacggggagtgtttatatagggttgggagggggagagagcggccggatgtgggggaatcggccgcggaagatccggccgccaatgatgcgccggcgaggtttagggggaaagatttcgaacgaatccgagggagagagagagggaaaaacgggggggaaagagggagggaatcacggggaatatttcccccctcttgattgcgcgcgggacggacgggagcggcgggattcgcggcggcggcggcgctagggcacgggcgaggcggcgggggcggcggaaggtaggggatgacgggtgggccccacccgtcagcgagggtggcgggcgggcctgcccgtcagcggcacgcgcgcggggaggaggccgattgggccgcgggggagaggagagagagggagggaggtgggccgagccggcccaagaaggggagggggaaaaaggactttttagggtttttctttttataaaaccattttaactttgtttatttcttcttaattattatttgtgctctgaaaattccactaaaatttatttacgcattttaggcttttaggaaatatacaaaaatcctccaagccttattcgacttttaactttgcacattttaattgttggaggctttcacatggattttacttattctatgcataattttgaggatgtattttagagtcgttttgggacgcgacagctcaaactgattgtattgatgaacaaattgaggttgaaccgatcctgcctgttggtactgaacttgaggtgatggaggctgatattcataactcaaattgcccccctggtaattgtgaaggtttggctgagtaccacgcgccaaatgctcaggaataacttgaggtaccactgaaccatctggttgcacatgatgaaccaggtgttccgggacaacctgatttgtagtgtactgcacaggctgaccaccaggtgttgcaaatccaggcaacacattcattgagccttgctgctgaatcggctgaacgacctactgtctcaacggcgtctgctgaatcggctgtaaagccagtcgccttgctggcgtctgctgaactggttgcacgacctgctggattggagatgtttgttgaataggctgcacaacctgttgcctgggcggtgtttgctgaatcggctgctgctgagctgaattaacagcattctgaggaggtagaaacacctagatgcaatctggtcttgtgttagctgagtcacattcggtctaggatgctgagattgctctcttaccaataattgacgattgattaattggcctggagccgacgacggcgctgcaggtgctggagctgatgctggtgccatcggctgagctgatgatgcaacaggaggaattccctgagtaagtggatgaacatcggtgatcaaagttcaataatttggaaaagtacccccttgcaaataaactgggcctgcagcctgatgttcagctattgaaccatcggctaccgatttcattatatttgacaaggtattagtcaacactccagattgattaatcaaagcactatacacaacatagtcaactcgatcttgaaagttattgaaaaaatcttggaatgcattgtcattctgattaagatttcccccttgtggtccctgagtgccgtcaccttgaactccatgtactccatggaagtagtcaccctggttctcctgggtcgacccatctgtaacgcctttgtcactcggctgggctgatccgtctggaacttgtttcttttctccctctttagaagaaccgatcccaggatcctcaagaaccaccttcaccttgtacttctgaacaaatgtgcccttgcgagtctgcatgaatgaacttaaaaattgatcttgtgcttgttgcatcattgcattgaagtcttccttctgttcgggagtgaacttctctggatcaatgggcacaacgtttccttcatggacgtcagtcaaaccgagcttctggatcttttccttaacattactcaggctggccgacgacggtgacagtggtggtttgtcacgtcctgataaattcatcccgaaataaaaatcattttctaaaaggaataatagaattaattaaaattcgaaaagaaattggcaaacactaaaatacgtacaagaaaaattcaaatgtggcccggagaatttttgttaaattctccttggtctaaaaggagccctcaaattttagtggaattttcagagcacaaataataattaagaagaaataaaaaaagttaaaatgattttataaaaagaaaaaccctaaaaagtctttcccctcttgggctggctcggcccacctccctccctctctctcctctcccccgcggcccatccggcctcctccccgcgcgcgcgtgccgctgacggacgggcccgcccgccaccctcgctgacgggtggggcccacccgtcatccccttcctcccgccgctcccgccgcctcgcctgtgccctagcgccgccgccgctgcgaatcccgccgctcccgtccgccccgtgtgcaatcaagaggggggaaatattccccgtgattccctccctctttccccccacttttccctctctctctccctcggattcgttcgaaaacgtttccccctaaacctcgccggcgcatcaatggcggccggatcttccgcggccgattccccctcatccggccgctctctccccctcccaaccctatataaacactccccgtgcctccctctgccgtttccaccactcgccgctctctctctccgccggaatccagctcgcgccgtcgctctctctgttcgccgtcaccgccgagttccggtccgccgccgtcgtcgccccggaccttctcccgcttcggcgtcgccttcttcgggttcgccgcaacctcgccgaccccgtccacccctccgtttcgcccgccgaccgccggaacgccgccgtccccgtcgacccgagccacgccgccgccttcctccgctccgatcgctgttcccgtcgtcgccgtcgacccggggtgagccgtggaccgctgtttcgcttcccccttccctcccctctctcgggcgccgctccgccgcgccggtggtcgccggcggcgaccatcggggcgcgggtgcgccgcctcctgtcggttgtgccggcgtggccgccttcgggcgcgtcccgcggctgccatgtggggcccggccgtcagccgcccgcgccctcgggtgcggctgacgcgtgggaaccacggcgccggccggcgtacgccgcgtgcacccggtccaccgtggaccgtgaggctgccgcgtgggccccactcccgtggacccggtccgcgcgcccctcccctcggctgacgcaataaatccgattttaaattaaaaatttaaatgaagaaattcgcaaatattcatttaaagaacatataaacttcaaatggccataacttggtcatttgaactcggaattggaccgttcaagtctctaatttttccttaagaagtcaagaacccatttttgtgctttgtttctgcttgttatatggattttattagagtaaaagcctttttcttttccgttggtcgtgtagacgctgcagcttcggaagatccgctcttcgtggaagttgaagccgacgtttgggaaagcgagcaaggcaagtcacatcatctttgaacatattgaatcccagtttgtaaaattatgttgatttaaattattgcattaccgctttatttaaattcccgcgttatcactgttttatctagccatgcctatttacctttgttatgaccttattattattgttgttgttattattaccttgttcaccctagaataaacaaaaccccaactagtggacactctactcatagtaccactagtataattttaggtagatgcttcgcaatttaattaggtaacattaggcggttttacaactctagactttgggaatattcatatcacctggacactttggaatggtttggttattgtggaattggcttcacaccgctccttctattcaaaatccccaaaatggttttaggctgggctcggggtgcatggttttgatagtagcacctcggccatacaaggaccggtcttcgggcctctgttgcaaagcactaccgtacttccacatgtctagtgggtaaggcttagtttgtgagtcagtctggttataaacaaaagtacacggatggagatggaagaagtcgggggtcgatggacatctccagggcaaatgaaggctacacgagctgcggcccggtagtcgagatgtcatggcacagggccggtgtcctgctgctaggggctcagtcctacctgcctgtcccgggggttccggccataggtgggattgggtcggtactcttgtctatggctaggatgggttggaaactatgtcacgtcttccgtctgtataccgtggtggtatgtggcacgtggttgcacgtgaggaagatgtgtcttgtgggtaaagttgtacacctctgatcagagtataatctattcgaatagccgcgccctcggttatgggctagccgagcaatgtacccaagttagtgttttaattcttaaaaccttcttaacaactaaaatgtggaatggttggcctgggttggcttgggacgagctgggacccagggtcgggttgccagttcggtctgaatcatcataggccttgggttaaggcaggttcatgtgggttcacgaccttgattaataatactgtgtagctttaggatcgtgtttacaaaatagctttgggcaactaagtgacttttaaatgttgtttactgcaaaacttaacctctatattattatccccttgtaccccttgcattaattatgcatctccggtgtggcttgctgagtactgtggttgtactcattcttgctctatctttctccccccttcagtaagagaagctttggagaagaagtcttaggtggagtcttggcttataccccagttgagcgcctgtgaagatggacccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcattcgggaaaatgaaattttctcagtcgcgacaaggtttctcagccatgagggaagctgccttctgacttctaatcggtcccactgggcgtgccaaaagcgtgttgacagaaaacacgaggcctgggagatctacttaactccagtgcaggtccaaaactcgccttcagatgtgtgagcatgccagttgatttgatcctgcaatcaacaagaaacaaagacaaagaaaccgtaattaaatccataaatgatagccgatcggctaaatgccaataacatatcatttatctttgagccgatgtcatatgtaaatcgatcggcaagtgttaagtaaacaaatcagaactaaatctactcaatcggctgtagacatcaataatatataatccttatatcgatatatacttgaatcaagtgattgggatagatcggtcaccttgccgagacagtataaatcacttaaatcgaaatatatattattaatgagattatatatatatattcatagcatagccgatcaaatagatctagcatgtattgaaattctaagcacgacttaatagatcaaactcaactgatacagcattaagtatgaaaagaagaacaatatctagacaatcaagccgctggatgtttcatagagtggtggatatctcatataatctaagccaacgtcgttatttaacctaatcggctgccttctggtaacagatgttagccgattgtaggttagatgatgatatcgtcaaggattatgcaagatatatgataactcgacgaattacgtaaacaagactagagtatcataaggatggaagcactaatctcgagaacacaaaccgccataacaagttttaccttttgttgaagatcgaaacccatgcagctcaacccgaaagcaagaacttgtcgaaataaaactaaagcaaaaagggtggtgatgcgccaaaattgtattgaacgtgtgtgttatccattacatagggctcggggcctatttatacccaagaattataagatatgtccatattggacacgactcttatccctaacaaactctaagataccataagtctttgtggcagacttttgcccacatttatctctaaggaatttacataaaatatcctaattaatagatacaattgccttcccaggactctatccatgcgtggcaatcatcttgaagcacatcaattcgaacccgttgtcgtacgcaagtcgtattattggaatcggctacatcacttaacctagtctgactcagacttagccgatcccaatcgtagccgatccggactccagccgattcttactctgtttccgcaacaacccttatcttcgattccgcttcgatccatcttcatctccgatgctgatattaccaaagttggtcgttaacagcggtgagggtggtccggttgcgatcggctgcggcctcctcatggaggcggagggaggactccgcctcagccgccgttctctcgtgggcggccaaagtggtctcacgctggtctagcatgcacgcccgcttctccagtgcctgggtacgctcctctagcacccgagcatgctcctctagctcccgggcctgctacgcctgttcccggcggtgcccatcctgttcgcgctggttgcggtcaaggacctcgatccgtggatggaaaatggcggtatcaaccccaccatggcgaaggacaggaggtgcacggatcgctctgggtaccgcggccgcggttgcgactcccccaccctcacggcggcgtcctccggcatgatcttgcgggtgaggctaaggtacctctctgccgtgatgcgtaaagccgggagcacagcgtcaccagcgtcttggcccgtggtagccggcgggaaaacggcgaggagtatggtgtatggaacagcgtggagcgagagaagcgttagggcttgaggagcgagtatgcgggtgagcagtcggcgagaggaaggagacgaactctctccctccctgcccttttatccccagctccccgcctcgcccgcgctcgcctcctcgtttcacgcccttgcggctgccccctcgattcccgcgtctgcggttgccttctcgactctcgcgtccacccatcacaccaccccactgaacccgcgccccgcatttagtgcgcctgtcatcggcacactcggcgcggggcgtgcgatgttcacgggcgcggttaggcgggcccaccatcggtcccatcacgtgcctagcaggtgagggagtcgaggcggcgtgggtgacgattctggacgtggtctagccgaccccccgattttcgcgccctaggcacccccagcatcagcgtggttaatggtggtcaaatcaccattctggctaaagcgccagcctggccgctcgccgacaaccctctgaattccccgccgggcccacaaccacagcacgggaagtcgtgaggcgccacgtcagactgtcctttgggggccaatgttcgacgcggtaccgggggctactgtcggagatatggtcccgggggtatacaaagtgaggggaagttaccttcccatctagccgcgtggctctacagcttggccttactcccgcacctcgcgagtggcagaagcggccggggggcctcggggtgccacgtcatgcccctcgggccctcgcgctgcctcgccccgaggccctcgcccaaccgccatttggtggggggagcgagcggggaggcgacccaggctgaacagccatcaatgcgtgacgccccaactgtccctcaccgcgtttaatgcggtaggggcagacgtgcggtgccgcctgactaacccacgtcaatcaggcgggaccagtctgtgaccggcctattgccggtcacgtccgattggacgggtggccgtgcccccacgtcgcctctgtatccggcggagtggaggtaggtatgtcccgtcccatcggagtgtcattcggagttccctccgtgagaggacgaccaccacaagtcttcacccatttatgagggaatgacagggctgttccccgtgtcaggtggggggtggcgctgtgtcctgctcaaggacggactgctgcttagcctccaggcgaaggcacgggtcatgacccggtcaaggtaaagtgggtcgccctcccatggaagagtagagtagaggcggtgcatgtggtatccccttgaactataaaaggaggaccttgcctaccgagaaaggggacgacactcagtagacctgaactctaggaaagcgaagagcaagaacgctctccggagttaggatcccttgtaacattcaaccactagtcccacacacaggagtagggtattacgctcgatagcggcccgaacctgtgtaatcttggcgttcgcatgcgatttaggagcattcaaggcggatacgcaatctcgagaggcgagccctttcccccggccgaactcacaaaagggggatctcacgatctcccgctagagaggatcatctcctcgacacccgacgacttggctcctgcacgctccggctccgtaggctgtggtgggtgtgttggtggtgatattcgatgaccttaggtcctgcccagggggtccctgatataccgcgggtcagttgatctcttagtaggacttggagatatcggacccctcacaatatggtaaagacccagtcttgtccgagtagaactccttccatccgtagataccatccttatcacgtgatagatttccttaatgtatacttgtcacgaccggaaatcacccaacaggcgttcctgacgtgcgtgtattgttccttgtcccaggaggcaaggtacaccaaaagttgatacaattcagagtttaacaaacggaagcgtaaatataattattacacgggcagcgaaggcccaacacacaaagacaaacgagaaacagcggaagactagggcgacgaccacaggcacttgccggcaggcacgagctagacaccaaagccttcatcttccaggaactcctcatctgggcttgggaaaaattgagcaagactgagtacaaccaccgtactcaacaagacacacccgcagatgcagggctgcaggaatt

SEQ ID NO: 2794 - DNA, 593 bp, Oryza sativa
cgggcttctgttgcaaagcactaccgtacttccacatgtctagtgggtaaggcttagtttgtggctcagcctggtaataaacaaaagtacacggatggagatggacgaagtcgggggtcgatggacatctcaaggataaatgaaggctacacgagctgcggcccggtagtcgagatgtcacggcacagggctggtgtcctgctgctaggggctcaatcctgcctacctgtcccggaggttccggccataggtgggattgggtcggtactcttgtctatggctaggatgggttggaaactatgtcacgtcttccgtctgtataccgtggtggtatgtggcacgtggttgcacgtgaggaagatgtgtcttgtgggtaaagttgtacacctctgatcagagtataatctattcgaatagccgcgccctcggttatgggctagccgagcaatgtacccaagttagtgttttaattcttaaaaccttcttaacaactaaaatgtggaatggttggcctgggttggcttgggacgagctgggacccagggtcgggttgccagttcggtctgaatcatcataggcccttgggttaaggc

SEQ ID NO: 2795 - DNA, 22544 bp, Oryza sativa
  unsure (1)..(22544): unsure at all n locations
ccacccgtttgaacacgagagagagagggaaaaatggggggaaagggagaggggatcacggggagtatttccccccactttattgcacgcggggatggcgggattcggcggatttggcggcggcggcggcgcgcggggtgggaggccgaatgggccgcgggggagaggagagagagaggggggaaagagatgggccgggccggcccaagtgagggaaggggtacttttggggtttttctttttataaaactttttcaactttgtttatttcttaataattattatttgtgctctgaaaattccactaaaatttatttacgcattttaggcttttaggaaatatacaaaaatcctctaagccttgtttgacttttactttgcacattttaatttttggaggctttcacatggattttaattattctaggcataatttaaaggatatattttagggtcgttttgggacatgacaaacctaccccccttaaacggaatctcaaccccgagattcagaagaaccggcgaagagatcgggatggactgccttcagctcgtcttcacgctcccaagtagcttcttcctcagcgtggttgctccattggaccttgcaaaaacggattacccggttcctggtcctgcgctccatggtgtccaggattttcactagcctctccacgtaggtcaagtcttcgcgaacttcaatttactctgaatcggcctgctcggatggcactcgaaggcatttcttgagttgcgacacatggaacacatcttgcacgttgcccaaggatgcgggcagctccaactggtaagcgacttctccgcgtcgagcaatgatacggaaaggacccacgaaccgagttgcgagcttcccttttatctgaaacctgtgtacgcctcgcaatggcgtgacccgaaggtacacaaaatcatccactgcgaattccaggttacgacgtcggttgtctgcataactcttctgccgagactgtgccacctttagattatcccgaatggttctgactttagcttcagcttctctcagtatatcggtcccgaacacttggctttccccaacttggtcccacaatagcggtgtccggcatttgcggccatacaacgcgcttcatagggtgccatttgtatgctggcttggtagctgttattgtaggagaactcggcataagggagactcttaccccaggtcttcccaaaatctaggacacatgcgtgaagcatatcttcgaggatctggttcagacgctcggtctgtccatctgtctgcgggtgatacgcggtgctgaaatttaatcgggtacccaactcttcttggagtttcttccagaaatgagaggtgaactggcttccctgatcagatacaattttcttgggaacgccatggagactcacgatcctagcgaagtagagttcagctaatttgtttcctccataggtggtcttcataggaataaaccgagctaccttggttagtcggtccacgactacccacatagaatcatatccgccttgggtttttggaagtccggtgatgaaatccatcccaatttcatcccatttccattctggtacttggagaggttggagaagtccggccggtcgttggtgctctgccttgacatgctagcacacatcacaaagggccacgaactctgcaatttcccgcttcatactaacccaccagtatttttctttcaagtctaagtacatcttcgtactgccaggatggatggaataaggactttcgtgagcttcctgaagtatcaactgttttaagttccctgtcgtctggaacgcatacccgatttccgttccattgggttccatgttcatcctctgtgaaaccagtggctttaccttgtttcatattcttgaggagtccacgcatatccggatcattcttctgagcctcgtggatttgatcgagcaaggtaggcttggcttccagtgtagccaagaatccacgaccaactatgcttaggttcagggcttccatctgttgattaagtttcggtggaatgccacggacgccaagagtgttgcaatggctttttcgacttagagcgtcggcgaccacgttggccttactaggatgatagtggattcccacatcataatccttgatgagttctaaccatcttctctaccgaagattcagatccgactgagtgaggatgtatttcaaactcttatgatcaatatatatttcacagcgattcacaatgagatagtgccgccagatctttagagcatgaaccacagcggataactccaaatcatgggtagggtagttgccttcatggggccgtagctggcgtgaggcataggctaccacatgaccttcctgcattaatacgcaccccaatcctcggcgcgaagcgtcacagtacaccaggaagtccttacgagtatccggtaagattaacactggcgaggaaaccagcttttctttgagagtttggaatgctttctcgcattgcgggctccacacaaatttttcttccttcttcagcaactgcgtcacgggtctggcaattttggagaaattctcgatgaatcttcggtagtatcctgccatactcaaaaagctgcgaacctgagtaactgtcttgggttgcttccaattagtgacggcggtcaccgtttcggggtccacagcaactcctttagcggatatcacgtgccctaagaatttgacttcggacaaccagaactcacacttgctaagcttggcatacaattgatgttcccgcaactttcccaacaccagacggagatgctgctgatggtcttcctctgattgtgagtacatcaggatgtcgtcaataaagaccaccacaaacttatccaagttttccatgaacactttgtccattaagttcatgaagaaggcaggagcattggtcagaccgaacgacatcaccgtgaattcatacagtccataacgcgaggtgaatgcggtcttcggaatatcttcttcacggatacgcaattggtgatatccggaacgaagatcaattttagaaaagacagtggcacctttaagctgatcgaagagatcatcgatccggggaagagggtacttgtttttgatagtaacttcattgagagctctgtagtcaacgcacatccgctttgtcttgtctttcttctccacaaaaatcacgggagcactctagggggaagtgctcggccgtatataccccttttcttttaactcttccaactatttcttgacttcggccagttcatttgctgccatacggtagggtcgcttgtacagaggagtggttcctggagcaagatctatccggaactcaatctctcgcttgggcggcataccgagtagttcttccggaaacacgtctccgaactctctgacgatggggatttctgacagtcctatctgatgaagttctgaactactggcagaggttgggggcgcaaagaaaacaaccggttgttccggccctcggtacagagtgacagtgcgtcttgcgcaatccactactccttggaattgagccaaccatttcatcccaaggatcacatccaagttcttggtgtccagaagaatcaaatctgagggaaaaaggattccctggatttctataggaacggcagggctataatactttgctgtcataacccctccaggggtggtgatgagcagagggttcctaagcctttctacccccaactgatttctccccacgaatggcacagatataaacgagtgggaagctccagagtcgaacaaaatggtagcagggatggaatgaatgaggaacgtacccacgataacgcctggagttgtcagcatatcctcggcagtcacgtggttcacacgaccccgaatgacatccttaccaccgttgttggggcggggaggcgcttggccttgctggcgcctcggctttgggcatttatccgcaaagtgcccgggctcgaagtagttgaagcacagacgctgctgaccatgaacgtctctgcggccttgtccaggctgcacggctggcgtaggaggacggggcgcacgggtcccttgctggctctgctgttgctgcggctgtgggacgcgcaccacgaattgaggtcggagcgcggagcgtggttgctgctgctgctgctacgaggaggatccccctggatagggattggtgtagcggatcctttggttagccccctgttgattgcggaaatttgccaagcgacgcttgtgtgactccagttccttgtgcttggcttccaagcggatgctcttgtccgccaaacgctggaaatccggataatccccggagaccatatgcacggacagctcagggtccattcctgccaagaacttctcctgcttctcctcatcttcacgaacatcctccggggcgtaccgggccaggttgttaaactcatgcaaatactccatcacagagcagttgccttgcttcaactctcggaattcccttttcttaagggtcatgactccggcgggcacatgggtcctccggaaagcggcggtgaagcgggcccaagtaataggctgtccttctggctgcgtagcctagaagtggtcccaccatagagatgcgggcccctgcagttggtgagcggcaaagatgactttctcctcatcgttgcactgcacggtgtctaactttttccccacggcatgcaaccaatccaaagcatccacggggttattggagctagagaaggtaggcggacggatgcggaggaactcggcaagtttagaatgttgcgggggtggtggtggaggtggagcattatgctgtggcggattttggatgtgatggaggaaagcagccatcatgttggcctgctgggcgaggatttgggtgaggatagagttggtgtctggtggtggtggtggaggcgggtgaggaggtggaggtgggctgccatggttgttgtagttgctgccttcggggtgactgccttcaccggtagcagcacttctcctggttgtcaccatctgaaactcccacacagaaccggcaaacagagagagctgactattaacactaaccacccacgactaccataattcttgaatttatttctgctattaaattggtttattaaggttcaagttgcttaagcaaataaaataaagacaggccccgacacagttataccacacaccggtataaccatgccccacacgactctagcagaaaaacaaacgagaagaacacccgcgcaagcctactaactgctcgtctacttctgcgacgggccagcgcggaaggtgagcagcagtgcatcctccgtgctaccaacgccagaggctccctcatcctgagaaaccaagggcgcgggctcgtcacgaggggtctcgacgaagcaggtccatgccaaggactgacgaacaagctcgggcctggaggtactcttgcgggcggtgatcttcaggctgcggcagacgcggcagcgcttggggcgacagacctctccctaggcgatcttgagctgacacagctgcgcctcccctgcgtctaggtccttcttcagctgcagattctcctgacgtagctccaggatcttcatgttgttctcgaccaacccacggcgcaccatctgatggaagtcgatacgagccacatcgtacgcctccacgatgcgcgctaggtgcatgatggtagcgtcatcctccgagctagcatccctgaaggtggcgtagtcgcgggctcctccgcgacgagggtggtagcggtagggcgagtgctgcaactcatccgggtagcgctggtgaagagtgccgatggtgaggagtgcggcgttctggcaagcggcggagaaggaatctccacccgcggtgactgccaacgaagtcctctcgggtgagccagtgaggatcactgcagtgacctcccaagcagcgtggggctctgcatcgtcaccctcctgcttcgagagctgcttgccctggtagtccactccatgcggataccccaggacaacgcacatgccccgcagctccaaaacgaagccagtcaggtccaagccacgatggttgatgctgccggccatctacaaacaaaaacaaaagagaatagcaacattttaaagatcagattttgacgataaatgaagcagcgggacagagagagactagaggattttcacaaataagaaaggaattttatttcgaaaatattgctaaggcttgggatctaaagctcgtcctagggtcaagggggctctgataccaacttgtcacgaccagaaataacccaacgggcgttccttacgtgcgtgcattattccttgtcccaggaggcaaggtacaccaaaagttgatacaattcagagtttaataagcggaagcgtaaataattaatttattacatgggcggcgaaagcccaacacacacaaagacaaacgggaaacagcggaagactagggcgatgaccacaggcgcttgacggcaggcacgagctaaacaccaaagccttcatcatccaggggctcctcttctgggtttgggaaaaattgagcaagactgagtacaaccaccgtactcaacaagacacacccataagtgcagaataaatgcaagggagtacaagggggttataatataagggttaggatttgcagtaaacagcattaaaagacacttagttgctcaaagctattttataaatacgatcctagagctataccagattattaataagggccgtgaacccacacgaacctgccttaacccaaggcctacgatgattcagaccgaagtggcaacccgaccctgggtcccagctcgtcccaagccaacccaggccaaccattccacgttttagttgttaagcaggttttaagaattaaaacactaacttgggtacattgctcggcttgcccataaccgagggcgcggctattcgaacagattatactctgatcagaggtgtacatcacgtgtaaccatgtgccacataccaccacggtatacggacggaagacgtgacatagtttccaacccatcctagccatagacaagagtaccgacccaaccccacctacggccggaaccccccggacaggtaggcaggactgagcccctagcagcaggacaccagccctgtgccatgacatctcgactaccgggccgcagctcgtgtagccgtcatttgtcctagagatgtccatcgacccccgacttcgtccatctccatccatgtacttttgtttgtaaccagactgagccacaaactaagcattacccactagacatgtggaagtacggtagtgctttgcaacagaggcccgaagactgatccttatatggccgaggtgctactatcaaaaccagggaccccaagcccagcctaaaaccattttgaggattttgaatagaggggggggtgtgaatccaattccacaataatccaaccattccgtagtgtccaggtgatgagaatattcccatagtctagagttgtaaaaccacctaatgttgcctaattaaccagcgaagcatctacctaaattcatactagtggtaccatgagtagagtgtccactagttgaggttttgtttattctagggtgaacaaggtaataataacaataacaataataaggtcataacaaaggtaaataggcatggctagataaaacagtgataacgcgggaatttaaataaagcgataatacaataatttaaatcaaaataattttataaactaggattcaatatgttcaaggatgatgtgacttgccttgctcgctttcccaaacgtcggcttcaacctacacgaagagcggatcttccaaagctgcagcgtctacacaaccaacggaaaataaaagggcttttactctaataaactccatataacaagcagtaacaaagcactaaaatgggttcttgacttcttaaggaaaaattagagacttgaatggtccaattccgagttcaaatggccaagttatggccatttgaagtttatatgttctttaaataaatatttgcgattttctccatttaaaatttaatttaaaaagggtttattgcgtcagccgagggggaggggcgcgcggaccgggtccacgggagtggggcccacgcggtagcctcacggtccacggtggaccgggcgcacccgggctcgcaccggccggcgccgtgggccccacacgtcagccgcacctgagggcgcgggcggctgatggccgggctccacgcggcagccactcggcgcgcccgagggcggccacgccggcgcggtcggcgggaggcggcgcgcccgcgccccgatggtcgccggctgcggccatagatgctgcggagcggcggccgagagaggggagggaaggggaaaggaggcgacggtccacggctcaccccggggcgacggcggcgacggaggaggcggccggagcggaggtaggcggtggcgcggctcgggtcgacggggacggcggcgctccggctatcggcgaccgaaacagagaggtgaacgaggtcggcgaggatgcggtgaagccgaaggaggcggcgccgaggtgggaggcggtccggggcgacgacggtggtggaccggagctcggcggcgacggcggagagagagcgacgtcgcgagctcgaatccggcgaggaggaagggcggcgagaggtggaaccggacggaggaggtgcggggagggtttaaatagggttggaagggggagagagcggccagggaggaaggaaaccggcgtgggaggtcggccgccgtcaatggcgccagcgagatttgcgggggcaaatccacccgtttgaacacgagagagagagggaaaaatggggggaaagggagaggggatcacggggagtatttccccccactttattgcacgcggggatggcgggattcggcggatttggcggcggcggcggcgcgcggggtgggaggccgaatgggccgcgggggagaggagagagagaggggggaaagagatgggccgggccggcccaagtgagggaaggggtacttttggggtttttctttttataaaactttttcaactttgtttatttcttaataattattatttgtgctctgaaaattccactaaaatttatttacgcattttaggcttttaggaaatatacaaaaatcctctaagccttgtttgacttttactttgcacattttattttttggaggctttcacacggattttaattattctaggcgtaatttaaaggatatattttagggtcgttttgggcgtgacacaccacaagtggcagcaatgttccgaagagggggaggaagttctcctctgtacccgggacccgccggaaggcgatgagcccagcggtaagcttctctttcgtccttgagtacgtagtcagaacgacttaacctcacatcatattatcttactcaggacttgggtgcgtctccaccgcctcagcgaaagcagaggttggtgacggtcggcgagaagtaagtaaatgtttttgaggtttttttattctcaaagttttgatcacctagcctcatggagaaaaaatcttcgcaggatggcactggtgaaagcggcgcacagtggggctgatgctgcttctagtgcgccccctgtggcgacctcgacggaagtcatggccagtactaaggaccaggaggcggcgccatgtagtcctatcgctcgcctcgtgcccgtccggcctctgtccgccgacaccctcacctgggggcagctccaggctaagatggagtgcatccttcaagcgggcgcccgcggcgtgggccgcgagatcgaggaggccagtgcagcggcgtcgtcggcaaatcattgtgccgatcagctggcatgtgatctggcggagtcccgcgaggacctccaaaagatgaaggagctggtagctggcaacgagacgtagcggcgtggactcgagcaccgtatgtcggagctcgagggccatctgacagccatccgaggttcgctgcggacatcgttcaccggcgtgcaccaactcgccggggagttcggtgtcacaacttcgatcccagcgcatcccgacgagtggttgctgacatcgtcgctcacggaactggctaaggcgatggaggagatcccctccagccacacggctaggcttggtgaggagacgtctaacggtatttacactggggcgtgccatgtccttgcgtttatgaggctagcgcatcgcgacttagaccttaaagaggctttggatcggggggccgccgatgacgcgcgtaaggacacgatggaggaagtcagtgacttgggggagttcgtcctccccctttttcaagagtaggatttttattttcctctgtactcctttatctacatgttgtaaaactttctgtgggttcgaactgcttttatttaaacagttgtttcccttgtttccttagcatgtgatcccgagtacctttgtcattgtagatatgttgaagtcgaggatgtccagcagtgcgggcagcccgatacgtcagtagtcattccggcgctcacgcttgagcctcacgtgccggaggtggaaatcgatcaaagcccgtccgtggagacgaacatggtgatgacgtccttaggtttgtgtcttgatttccttcgctcctcgtgttcggattgacttaattagctgtgttctcgaaagagaagagtagcttgacttaatcttttctgtgttgggcaaatttcaagaacgtgttggcagaccgagatcgtcgaatccagtattggaagaccaaactcgaggtggccgaactcgaaaggaccatcgtggaggcgaagaaggaccaggccatggaaactctccgaggtcgcgaggtgtggttcaactcgtacctcaagggttgctgcacggccatggcggaagtttgcagggagctccgagttccccgcggagatcccatggagtccgctgctggttatatctcgtggatgaagggggcctacgcacagctctaagggattggcaagcgcatcgacgaggccctgaagcaggagtgtcgtcgagcgagccgctacgccgggggacatgtgctggcttgcatccaagataaccgctcgcagttgcacctcgagttccttcgtgaagggttctctcgttctcggaggacatccgtggagattgacggtcttgcgcagttgatggcgtcgcttgccgagaaggttttctgctccatgtattggcgttggccgtcctagtagcttttgtatcctgtagaaaaacatctcaaggaagcatgtaatatactaagttttcttattttgggtatgttgtgtatgagtgttttctcgttctgcgactttgattagtcatntgagccatacactctccctatcccccagccttgtcgtcggagaattgttctcgggggataaggctcttcgacccttgacctgccttggttgaaaaagcactgaccctagccctcagccgtgaagttggaaaactcaatttctgatcacacggcttggttaatacgcacggtgagaactcttacatgaccagatcttacatggtcgtttgtccctgcataatctgacaaggccttctccgctctgggcgtccccagccgaagttcacttaggttcctcagaggccttgccagggcggcgtaaagggacatgaggataggtttcaactctaggtgttgtcgtggtaagggatcgttgggaaggaacactttgacgatgttctttacctgaaatcaactttattgaagtcgtaagatatcttacaaatatgtatactattgatttatacataaaatttacgtaattgatcaatgttccaggagtttgttaactcgcgaccatcgccgtctgcaatcttgaatgcgcccagccgcaagactttaagtgatcgtgtatagttcttcccacttgggtgagagcttgttgtgccctgcttggctttgaacccgtcggaggacataatctccgatcgaaagtgtacgtgctctgatgcgcttctcgtgatattggagaagggcctactagtagctgcctgctctgacggcaactctttctcgatgttcctcgagtagattcacatcgtcacttcgctgctcctcctgctcctcgtcggagtacttctgcactcgtgtgctctgatgtcgtagctccgtggggagcatagcctctgagccgtacacgaggaagaagggtgtctcctcattggattagttaattcagtcatttgaaattaaattataaagataatcatttatgattcagctgacagaagcttgatattagctcaaatctagatgcatacagatttggcataatactgggaatcttgacagtatttaattaaatctagactagaccactggtattaagaatgctttgtattatttacaaggcaactttaagtaacatgcttatatttctaaaagtctatttggtctctaaagtttagagatatttggacacacttattttgtgagatgtgtggatatttataaagattattaagctaatttagattaagctatgtccacacataggggagcaataaccatggaaaaggtccaaaataatctcttattgcatagtcgacgatgcagttggattttgtagcatgttatgattcagtcatatgtttaagaaaatttccctgaactaagagtggtaaatagcgctcataaaccactcaaaattatactatgctataagttgtgcactaattaaacacagttttctattctagtaacaacatgtgttttcacatatggttgtgaaagatatgtcccagggtctaattattaagctgagcatttgctcatggctccatactctaaaggctagtaaaattaagtttaactaagatatgttctagctagcacatgtgtaaattagagccttattaagatcctggatgaggggaacttaattttcaatcaatacccactaagttaagcttgagtttatttgcgtaccatagtgttgtctcagtgacgcttgtgacacattgtcttggggaggtattttatttagtaaactcgtcagttagtctcaaaatcaaggggagaatgttggatgattttcttggctaatgccggttagctaggaagaataaaatcccactggttttcctatcctaacaagaaaccaaagaagagaaatctgttttgtgtgatcggtacaaaatagattcgaatttagcttgagaaaaaaccctgagccccaccgatgtcgctatataaagaaagagaaggagggaggcaaattaacaacctaactctatctaaccctaaaccctaagtcaatcgtccgatcgattaggcactggaaggggttcgtgaggcatctctagaagaagaagaaagcagaagaacaatggcttcatttttaggtcagtaaatcaattaatttccgcataagtagaaggtgatcatgtctaggctaagatttaaccaattaagtgttttaaactccaacacatttatcataaatgacatatttgcaatggcatggatcgaattaacccaaaaaagcattccaagttatttggctttggtgtatgtcaaaatatataactttaagtagaacaaaccaaacaagcaacccatcgttttgctcaggcttatgcttataagccaaattctaaattttaaagcttaattttagagttgattttgtgcccttttcatcatagtttatatatttatttttaaattgctaataacatgtacataaaaatttcacctacaaattaattttttagttaataatatgtggtacggataataagcataaaatgatggggccgaaaatcccagccgactcttaaattttttgtttggcaatgatcaattaatgccacaccaaaataattggcagtgggccggggccgaggccgggccaggccctagttctttcaccgtggaacggttctctagccagctggcaaggactccatgaccaagagtccaggagcaaagcaacgagcacgtcatggagtagactaaactcgtggcgtcgacaggtatccatggtggtggtggcagctggctggggctggcatccatggcaaagacagcggaacctccatgagccatggcaaggtaggtggataggtctgctcccgctcccacccttctgggccatacttgtgctggcccagcacgaacagacccatcaaaaagcaagcaacagcttcgactcaacaagcggcgaccatgaccctagaaggcatcgaccttgaagtgcaagccgaagccgagatggggacgatgcgtcagaacatgaacaagttacaagacatgcttcgccaaatgcaactgcagcatcaagcctatgaagcggcaaaacaagtcaagccagccccatcggccccccacccgacttcgacagcgatggtcaccacccaaggtttcggccatgctgcacaaccccatgctccgccggcttcggccatgtacggacaagtctatcaagctccgctgtacgttgccaaagccgctccgaccgttacagtgcaaccggccccttacaccttcacgatgcccgttcagccggcagtgacacaagtacaaccggcgaagcatgtcgaagcacagcacgccgccatagaagcatctttgaccttacaagctcagttccaagctttccttcaacagctcaatcaaccccacacaatttcgaaaccaaccccatcggcgaatgccgttggaagcaagtcaaggtgccccggtctggcagccgtcaattcggtgcaatgcaccaagcgaatcagtcaagccagggggctccgacctggcaaccgataagtcaattcggcgcggcaatcaatcaaccaagtcaagggacaatagcctggtagcaagcactgagcttcgaacagaacaccatgacccaagcatcaacaactgatgtttatgggataatcaccggtttcggctccacacagcaagcgaaccagtcgaatcagggcgtggcctggatccaagcaccacagttcgacctaggcatggtgacacaggtagtttcagccaacatgcaaggagcactgttcagaaccggaccctagccgaaagcgatggcccaaccacgggtgcaggcgatgacttcgccattcgccatcccataaccgagcttgaactcatctttccaaggtgcaacgatgagaggcgggggcgaaaagaggccaccgttaagttgggtgctcaagaatcatcccatcccaccccaattcaagtacccacccgttgcaatatactcgcgtgaatcagacccaagtgagttcttgtcaatctacgagtccgcaatcgaagtggctcacggcaatgacaataccaaggcgaaggtaatacatgttgcgcttgacgggatcgcccgctcttggtatttcaatttgctatctaatattatatactcatgggagcaactctgtgaagtctttgttcttaacttctgaggcacctatgaggagccgaaaacgcagcaagacctcttcggcatttgctagaagacggagaaacaacaaggagtacattcgacacttctcgcaagcacgctgccaagtgcaagacatcacagaggcgtccgtcatcaatgctgcttcggcagggctccttccaagcgacctcacaagaagaatagcaaggaaagagccccagaccatcgagcgcttgtttcgcatcatcgacggccatgcacgtggcgaagaggacacaaagcgaaggctggagatacaagccgactatgacaaggccgccgcttccgctgcagctgcgcaagcggtgatgcaagcagctgaagccatgccgctggcgaatcgccaagtgcagccgacgaagaaggtgctgcccccaagacccagccaagctcccatgacgtgtaaaaagaccagagccgaacgtggaaaggttgtgagtggcagtcgaagaggtgtagaccctccacaaggtgcttgacacacaccaggacaccaatcaccagcaaccctttcgcaagaaggccaagaaggatctctactgcatgttccacgggcgctctttgcactccaccgagcaatgccgaaacattcggcagcaaggcaaccaacaggagccaagaccacagcaagtgaaggccgaagaggtgccctgtgaacctgttcaggacataatccctcaggccgaacaacagcaagacatcccgcaaagtgttatccaagtgataacaagagcagatccaccctcacagctgtgaagctgcaaagaaaaacgcagcttcgggcggtgcacaacagagaaacgccgagggggtcttgttcctacaccaagacccgctgatcatttcggcagagatagctagatttaaagtacgtcgaatccttgtggatggcggcagttcggcatatgtcatcttcgccgaagcatacactaggatggggttcctgaccttggctctctctcaggcgctcactttgcttcacggctttgggggcgaagcggtgcaagtcctaggccaagttcacttagctccggcgttcggcgcgggtcccaacagacacgagcagatgattctcttcggtgtcattgatatttcgtacaactacaacgccatcttcggcaccgccacgttgaacaagtttgaagctatcgcgcaccacaactacctcaagctgaagatgcctggtccggccggggtaatcgtagtcaaggggctgcagtctttggccgtgctagggagcgaaacaacagtgataagtagagaagtagacaatgtacaagctgaagatggtgagcgagcaagaatcgtgccgaagccgtccccacatggcaaggtgatcaaggtccaagttgacgaggctgaaccaacaaaggtggtttccctaggcggcgatataagtgaagaagaaacgaataacatcttggccgtgctcaagaaaaacatcaacatcttcgtctggggatcaaacgaggttgtgggcgtttggcccgacctcatcatacaccatctagtagtaaagctatatgcaagccaaagaagtagaagctacgcaaaatgtcgatagaccgccaacaggcagtgaagacagaagtctaaaagctgctcaaggctggtgtgattcgggagatcaaccacccggagtggttggcgaacccagtgttagtcaagaagtccaatggcaagtggcggatgtgtgttgatttcacggatctgaacaaggcttgttcgaaagatgacttcccactcccaaggattgatcaattggttgattcgaccgtgggctgtgtacttatgagttttttggatgcctactccgggtatcatcaaatctttacgaacccagagacatactgaagacaactttcatcacactattcagcaccttctgccacattaggatgccttttggactgagaaatgctggggctactttctctaggctcatctgcaaagtcctttgttcacagttggggcggaatgttgaagcatatgtcgacgacatcatcgtaaaaagccgcaaggcattcgaccatgcgtctggccttcaagatacattcgacaacctgtgctcggtaggcatgaagacgaatccagataagtgtgtttttggcgttcgtgcgggtaagttgctgggatttttggtctccgaaagagggccatccgcgactccattacctgccctccactggatgtgcaggagaagaaaccggctgggtacgcatgtgtgagcgacagcagcgagtgcgtcaactccaccaacggtcccggatactactgcaagtgcaagcaaggttacgagggtaacccctacgacaaggaccaaggttgcaagggtaagattaatgttttattttattactcctagttaacagttctgctaaatagtgccaccattttattttttcctttcgagtaaattacgtctacggtacataaaggtaggtgggtgcgatctagcgcaaaaacttgagaaatgagcatataagtgcaataacttggctagtgcgtgcattttggacttttggttaaaaggtctatattctacaccatactttttacgccatataaaaaaagccgccactcaaaccatctcgaaaaggatctacaagtattatatgttgctttcaattggtaagttataataataaaataatctgtcaatttaaaaccgaaagatatatgattatcaaaagtaaatgcatgactaatcaacatattcattatcgcgggttatgaacatggtgaaacacgaaaataaatccatgagccagcggtctagcaaagcttataataccaggattaatcaaaggtatgtattaaaactgcttaaaaaaaggtacgtattagtgttttggcctaaaatgcacatgattgtcaagtttatgtaccagtctactcattattcaagtccttacactaaatcgcactcacctaccaagtttttataccatgggtgcaatttactctgacctttcgctgtgtgtgcaccaaccctgttggtgtttaaattcattaactaaattttttttaccaggtttgatttgatcttttcgctatttgatttaggcgcaaaaaaagggaaaaacgtattgtgtattttagtaagcgtctatatatacacggccgtgtgttgcaagtttcacaagttgcataattttgtgtgtgtgtgtgatatataggatttgaacgggaacatgttcttcaagtagcgtccttaccatctcgcctataaagaactttgtgcatgtgggagagaagcttattcttttgacttcgcccctctaaaacttgtaatatataaattgcactataaatgatatcaaaaggaaaatttatcaaccacaaacttgtagatcacatcgagctctacaatttcgatatagagcacagctccatctgagttcatttaaaaacataaaagtttgtttattcaacaatagatttgagattttgtaacgaatatcaggacccgtaaaaagtctcgaatgaaaaaacattcaactatatagttgtagagctctccaattttcataaaaagattttcatcatacgacttcatatatatcaagatactactcctttcctattgtagtagtgctattatttttaagggtggtattttcaagagaaccgcctcaaaaattaatttttgcgtgcctttccatatgagaatcgccaaaaatgacatttctgtaggaagcccatctgaaaaaacttgttattctttgaaaatgtctaaactttaaagatttatagaaagttcattttaagttcaaatgaggtgaaccaaagttatatatgacccttacaatatttttgtatttatatttcagttagtataattgtttacttatcatttacctctaaatgagttggtatgttatctaacgtgacattagtgaataaccattctaaaataaatgttctaagaaaaatattaactaagttttactataagaagtactagaacgatctcggagaactttagtttacctcaataggacttaaaatgaattatctataaatttcttaaattttgttttttaaagaactgcttatagaaaaatagatactagagcttataaagatatttactacaaagttgtagatctagttaagttctacaattttaatatagaatgtctttatccaacatcgttcgaaatactcaaaagttcattttcaaaaatagatctgagagtttgtaacgcatatatatatttagacatcgatctaaacgtattatctaaaatgatgaaaaaaaactttcaatgtagatttcgtgaagagcgacaaattttataggcggtttcctaagaattgccagttaaaaaataggatttcatacgtggtttataatcctggacagcctaagccatcttcacacaggtgattttcattttgagttgcctgtcaagagaaaagaaaaagaagcctaagcctacgatttttttttactagtgacagttgatctaacgactaatatatatgatcctttttatatgcacagacatcaacgagtgtgatgtgtccaacaagaagaaatatccctgctacggcgtctgcaacaacatcccaggggattatgagtgccactgccgtgtaggataccagtggagtggtgaaggccccaagaaacaagagtgcagcgcaaaattccctcttgcagcaaggcttgcccttggtacatatgcacctcagcatttttttaaaaaaatataaaataatatactatatatatgtcacattgagtttacaccaattcaatgatttcccatcgactatgtttttaattgtttctacaatataccattcaaccaaacaaagaatttcttataatgcctaaaaatataagggttgacagttaattgacaaaactaaaaaaaaaaatcaacaattttaaaaaattagcctcctagcacatgatataagaatataagtgtgtataagtttcatgcttttgcattttattattttttgtaaaataaaatatgtatgttatttacaaagactacttttctacatcgtttgtatttttatacaaatcatctttcatgtgctacacaaaatatttttgttctttttttttgtaggagatttctctctaatgccacatagaaagacttttcaaaaaaaaaaaacatgcaggaaattttgaaacataaacagaaaattatatgttgtgtaaggaaactgcactaaagattagttacagcgatatattgtgcatgccaatattaatataacattagttgttcacaataaaatttatcaaataaaatgagtcttcattcatactccctctaccaaaaatataaggcacaaccacttttttcccacgtctcatgatataaggcatgcatacattaaccatcacctcttggttcttcaaatttgttttattttgaatcatctaccattaaatcctccaatcacattgcttgcatgtatgtatgtgatccaatcaagaaggtgattaaattatttcttggtctttgtgttacgagtggtgagtcttatattttgggatagagggagtatttctattaaaaaataatactggaactcatatatggatttgttatgtttgctaataagtattttttttgcggggatgctaataagtttttttaactttcgtaggcatcactttgggattttccttcctaattgttgttgttcttttcacgctagtgatgcaccaaaagcgaaaaatgaatgaatatttcaaaaagaatggtggttcagtgctacagaaagtggacaatatcaagattttcaccaaagatgagctaaagaaaatcacaaagaataattcagaagttcttggtcaaggaagctttggtaaggtgtacaaagagactcttgaagacaatactacggttgcagtgaagacgtcaatcgaagtaaatgaagctcgaaaggatgatttcacaaatgaagtgatcatccaatcgcaaatgatgcataataacattatcaagcttttgggttgttgtcacagctagattttcgttttagggtttataaacaatttaatattaaaagaatttatattaaatgttcataaatttacaagtgaagttaaatgtgggaaataaaatttcctaaatttaaagcatggatggatttaatttttattaaattctccatgattaattatactctctgaaattttcccggatttttcggagctcaattcctaaatgatacaaagaacagttcagtaattaatcattaatgatctaataataattgttaagttcttttcttgtttaaaaatccttaaattataaattgttgtctaaaaggaattattagaaatgattttaaaagcctagaaaagaagatctaattttaatttgttaaattccaatataaaatggggccatataaaatttcattaaatactttgcttaattctataattcctagatttttctgggatttatttgagctaaggaagtatttttaataaatggaattgcatttaatgaataatttaaattcaaaaaggtttttaaaaatcctcctttggctttgggccgaaagtcggcccaatccctctctctctctccctcggcccaagccggcctgcagccaagccgcccgcgcacgcgcgtctgccactgataggtggggccctcatgccggggtcatcgtctacctcgcgccactgccggccgaaaccctagccaccgccgcttttcaaatccggtcgtccctttccgtttccggtgaaattgattgaggggaaaggatccctgtgatccactctaccttttcccttttggaaacatcgtctaaatcgctttggaaatcgccggatttgagttcgattcggatcgatttctctcctccgaaccctaaaccttcattcccgtcgccggtcgccgtgggccttcgccgccgctccctagctcctataaattgacccccaagctcccctctacccgcctccaccctcgtcttagtctctcgtagccggtagagctctagcgccgtgccgcctcgcgccgccgtcgtcgccaccgctccagccgtgcgccgccgtcgctccagacgtcgtcgtcgctcggggaggtcactg

SEQ ID NO: 2796 - DNA, 1683 bp, Oryza sativa
ccggtggtgacgtcaccgctgacgtcatcgtcgtcgttcaccgtggcccggtcgtggaccgatggatcttggccgtccgttttggatagatgaatctcggccgttcgttttcgtgaactatcgccattaacccggtcctccgtgaaccctagccgatgatgcaataattcccttttccttttcaaaaataattcattattgcgtcataattcaattaaaatccataaaaatgctttaatccggtttaatctttaaaaattcataactaattctttgtaactcagtttaatgtggttcaatttgcaaaagttgtataaaataaagatctacatattaaaattatccataaattgaattaaatttatttaatcctttttaaataggctttaattagatttaatcttgtaaaattcgtaataaattcatatgaagtccgaataaggccgttcaagtctcataattcatctaaaattatgatctacatgtttgtttactttttatgtattgtctatttggtttttattagtctttttcctcgttttgcgtgatagcttgtcgtttccgtcgttgcgaaggttcgtgagtgcgccggaagtattaagaagattaattgaagaccgaatattgcaaggcaagtcacacagatcccaaacaaccctttgagcatgttgatcccgtttaaagctattgtttctattcaattattgcatttattttcgaatgtcattgggtggaattaacctattgtttgttatagccctttcgttcttgattactttattccttgataccttgggttattataacttgactagttgagctttatatattggttcagctagatagtagatatgattgcttagccatgcttagaaatattagcacactattgggataacttatgattcactattatttaatgatggcttaatgatagttcacgatggtcaatcgtgattggttaattaattaaattgccaactaaaacttgataatggtgggttgtgagcacatggttttgagactcgtgctcatgacaattaaggaccggtttacgattttcggttgtgaaacattaaccgtgccaactacaagccagcgtgggcaacggctttaccttttgtatagcatggttcattgcggagcaccagactgagaagtggcggagataagcccacgggggtcgctggggagtccatgccttgttttataagggggtgattatgatccaggaacggtgcactgtggaggattgtgttgtgcgaggggtactgtcacagctcctttccgaggtaccgtggtggtattgaggcacatggtgacatgttgtggggctgtgtcttatgggtacagtggtacacctctggccagagtaaaactattcgaatagttgtgcccgcggttatgggcaggtctaacaatgtctttcgtgattagtctcacacttctcaccataataaatgatgttataactcgtaataatttgattagctcctggtttggagatagatctgtacagccgggtatggctgttcaggatggttggacctgtgcagcatgggtgtgttgttcagtgttgattaatattgatgattaattactctattgttttataattctcaaatgtttgctaaatgctgcttttacaaatgagccctatattatgccatcctttggtatcca

SEQ ID NO: 2797 - DNA, 1604 bp, Oryza sativa
ctaaaatctttgtagtcgaaaaaccacaacactcatcttcttgcaaaccaacctgtagctcatttagacaactagaggaactagatagagaattacttatacgcatgcggtcctctagacaatacatttcatcatgaaaaggaggtatagtcaaattcgaacaaacatatacttcatgcacattatattctcctttactatcataattgccaataacatgaaaaatcacatcagaagggcatggcaattcaaatctagcaaataatttcttctgtaagcagttgagtggacaaacatcatcaaattgaatatagccccaagtatttaaagaagatagcaatttaagctctttattctcgctagcaatgtgaataacatgtttgaactcaacacatggtggctctactatagaactaacatgttcattcactagttgtggcatggatagaagtgaaacatcacacaactattctttatcacaagaaacatcaagcaaattgttttatgacaaaggtatttcaacaattgtttccactatgcgttgctctaatgtagcataagtagtggacatagttggtgttgatatttcttaacgacattactagaaatcttcattcccagcaatggcgccagaaatagtcatggtatatgtatggttacaaaactaatccgcaagcgcacggatataccattgtagcattttacccggaagtattccaaggtatcgcatttttaataccaagagaagataataagagtgaacctcgctaatgcactttatacatatactacttataattgtcaaagcctaaacaatggttaaatgtaatatagcggtagagtgacacgaagcaaagctattcaatcctcataataggtaagtctaactaagtggaagaagaaatataaagcactcaattcctatgcttctaatatacactcaaatcctagtttacatccactaatatacaatcatgtggttatgtcacgccctaaaaatcttaaatatataaattgttgtttaattggaattttttagaaattatttttaaaagcctacaagctaaaccctaattttctaggaaaattttcaacataaaaatgagctagataaaattttattaaatactatgcttgctcctctattttctagaattttctgggaattatttgagcaagggaggtatttttttaataattgaaacaacatttcacaaattgttttatttgaaaaagttcaaaaaaccccttctttggtccttgggccgttttcggcccaactctctctttcctctctctccccgcgcgcggcccacgccggcccaagccgccgctgcccgctccccctctcgtggaggccgacaggtggggcccacctgtcaggtccatcccctacctccggccgccgccgcgcaagccgccgagccgccgttttgcgccgccgtttccgcccaaatccgacccggattcttccgattgattgaggggttttgttcctctcggtctcctctttctttcccctcaagaaacaaagaaatccgttgagtattttaaccgaatcgaattcgttttgtttttaaccctaaaaccgagttttaaatctt

SEQ ID NO: 2798 - DNA, 25535 bp, Oryza sativa
cggcaacgtcgccgcgccgtctccgccgtcgccgccgcttgccgtcaccgccgttaggtgcgccgtggtgagaggaagctcggccgcccatcctttttcgccgccgaccaccggagcaccctcgtcgccgtcaagccgaaccgtcgcgccacctcttctcgtcgccggccgccgtcgtgcaccgttggacgtcgtggtgagaaccaacgggttcgcctcgttgtcctctacgcgtagatggtctccaatcccgcggccgatcaaccaaacgccggcgagctcgtcgacccgagccggccgtcgtgctgacgtcatgctgacgtcatcgccagggctgacgtcatcatccttagggctgacgtcatctctctctctttttcctttttcccaattttctaatagattaaaacttcagaaaatcataactaaataaccgtagatccgttttaggtggttcaagtttataaatttttttaaaatcaagatctacatgttaaaaatatccacatgtactgtttatgcttgttttgtactgttttattgattttgtttatttgctttagtttccgacgttccagaggagagcgtttccgttgaggaaggttccgaagcgtttgcggaagcccaaggcaagtcacacagatcccaaacaaccctttgagcatgttgcagtaaacagcatttaaagacatttagttgctcaaagctatttggtaaacacgattctagagctataccatattattaaacaaggccgtgaacccacacgaacctgccttaacccaaggcctatgatgattcagaccgaactggcaacccgacccagggtcccagctcgtcccaagccaacccaggccaaccattccaccttttagttgttaagcaggttttaagaattaaaacactaacttgggtacattgctcggcttgcccataaccgagggcgcggctattcaaatagattatactctgatcagaggtgtacatctttacccacaagacacatcttcctcacgtgcaaccacgtgccacataccaccacggtatacagacgaaagacgtgacatagtttccaacccatcctagccatagacaagagtaccgacccaatcccacctacggccggaacccccgggacaggcaggcaggactgagcccccagcagcaggacaccggccctgtgccatgacatctcgactaccgggccgcagctcgtgtagccttcatttgccctggagaatgtccatcgacccccgacttcatccatctccatccgtgtacttttgtttataactagactgagccacaaactaagccttacccactagacatgtgaaagtacggtagtgctttgcaacagaggcccgaagaccggtccttatatggccgaggtgctactatcaaaaccatgcaccccgagcccagcccaaaaccattttggggattttgaatagaaggagcggtgtgaatccaattccacaatatccagaccattccgaggtatccaggtgatatgaatatttcccaaagtctaaagttgaaaaaccacctaatgttacctaattaaattgcgaagcatctacctaaaattaaactagtggtgccatgagtagggtgtccactagttgaggttttgtttattctagggtgaacaaggtaataataacaataacaataataataaggtcgtaacaaaggtaaataggcatggctaaataaaatagtgataatgcgggaatttaaataaagcgataatgcaataatttaaatcaacataattttacaaactgggattcaatatgttcaaagatgatgtgacttgccttgctcgctttcccaaacgtcggcttcaacttccacgaagagcggatcttccgaagctgcagcgtctacacgaccaacggaaaagaaaaaggcttttactctaaataactccatataacagcagaaacaaagcacaaaaataggttcttgacttcttaaggaaaaattagagacttgaacggtccaattccgagttcaaatggccaagttatggccatttgaagtttatatgctctttaaatggatatttgcgaatttcttcatttaaattttaattaaaaatcggatttattgcgtcagccgagggagggagcgcacggaccgggtccacgggagtggggcccacgcggcagcctcacggtccacggtggaccgggcgcacgcggctcgcgccggccggcgccgtgggtcccacgcgtcatccgctcccgcgggcgcgggcggctgacggccgagcccacctggcagccgcggggcgcgcccgaaggcggcctcgccggcacggccgacggaaggcggcgcacccgagagagaggagggaagggggaagcgaacggagcggtccacggctcaccccgggacgacgagggcggcggaaacgacgaccggagcggaggaagacggcggcgcggctcgggtcgacgaggacggcggcgttccggcggtcggcgggcgaaacggaggagcggacgaggtcggcgaggacgcggcgaagccgaagggggcgatgccgaagcgggaggaggtccggggcgacgacggcggcgaacggagctcggcggcgacggcggagagagaggacgacggcgcgggcacgattccgactgggagagtgagcggcgagcggcggaaacggaggagcggagcaggggatcgattatatagggacgggagcgagagagggcggccggggaggaaggaaaccggcgcggcgatctcgggctccattgatgcgccggcgaactttgcgggattaaatccgagcgaatccgagggagagagataggggaaagagggggaaaagagggagggaatcacggggagtgatttccccctctttattgcgcgcggggacggccggatgcggcggaatccgcggcggcggcggcgctagggcacgggcggggcggcggctgcggcgcgcgcgcgggggaggaggccgatgggccgcgggggagaggagagagagggagagaactgggccgagccggcccaagaagggaaggggggaaaagaagactttttagggtttttctttttataaaacctttttaactttgtttatttcttctcaattattatttgtgctctgaaaattccactaaaatttatttacacattttaggcttttaggaaatatacaaaaatcctccaagccttacttgacttttaaatttgcacattttaattgttggaggctttcacatgggttttaattattctcggcacaattttgaggatgtattttagagtcgttttgggacgcgataacaacctatacggggaataagcttgcagagttatacatggccagagtagtatgtttgcatggtgttcctaggaagatagtgtcagatagaggtagccagtttacttcgaagttttggcagaaattacaatcagaattgggtacccgtttgaatttcagtactgcctatcaccctcaaacagatggtcagacggaaagagtaaaccaaattttagaagatatgttgagagcttgtgttctagattttggtggaagttgggataagaatttgccgtacgcggaattctcatataacaatagttatcaagctagtttgcaaatgtctccgaatgaagcattatatggtcgaaagtgtcgtacgccgctcctttgggatcaaaccgatgaacgtcaagtttttgggacagacatattgtgagaggcagaagaaaaagtaaagattatccaagagaggttgcgtgttgcccagtcacgtcagaagagctatgccgacaatcgtcgcagagatttggctttcgaagaaggagattatgtataccttcgggttacgccgttacgaggagttcatcgtttccaaaccaaagggaaattggcaccgcgttttgtgggaccttttaagattgtgagtcgaagaggtgaagtagcttatcagttagagttgcctccgtcaatggcgggaatacatgacgtgtttcagtgtctcagttgaagaaatgtttacgtgtacctacggaggaagcagatcctgatcgtatagagcttcaagaagatttaacttatgttgagaagccagtcagaatcttggaagtaagcgagaggaaaaccaggaatcgcgttatacggttttgcaaggttcagtggagtaatcattcagaagaagaagccacttgggagcgagaagatgaattgaagtcagctcatcctcatctgttcgctagttcttctgaatctcgaggacgagattccgtttaagcggggtaggtttgtcacgccctaaaaatcttaaatatataaattgttgtttaattggaattttttagaaattatttttaaaagcctacaagctaaaccctaattttctaggaaaattttcaacataaaaatgagctagataaaattttattaaatactatgcttgctcctctattttctagaattttctgggaattatttgagcaagggaggtatttttttaataattgaaacaacatttcacaaattgttttattagaaaaagttcaaaaaaacccttctttggtccttgggccgttttcggcccaactctctctttcctctctctccacgcgcgcggcccacgccggcccaagccgccgctgcccgctccccctctcgtggaggccgacaggtggggcccacctgtcaggtccatcccctacctccggccgccgccgcgcaagccgccgagccgccgttttgcgccgccgtttccgcccaaatccgacccggattcttccgattgattgaggggttttgttcctctcggtctcctctttctttcccctcaagaaacaaagaaatccgttgagtattttaaccgaatcgaattcgttttgtttttaaccctaaaaccgagttttaaatcttcccgaatcgattcctctcgtttggagttcgatctcttcaatccgagctcatatatagcttctcctcgtcgtcctcttccgtttgccccctctcccgagctctcccgtgcctcctagcgccgccgcgacgtgtttcaagtccgccgccgccgccggccgtcttcggcaacgtcgccgcgccgtctccgccgtcgccgccgcttgccgtcaccgccgttaggtgcgccgtggtgagaggaagctcggccgcccatcctttttcgccgccgaccaccggagcaccctcgtcgccgtcaagccgaaccgtcgcgccacctcttctcgtcgccggccgccgtcgtgcaccgttggacgtcgtggtgagaaccaacgggttcgcctcgttgtcctctacgcgtagatggtctccaatcccgcggccgatcaaccaaacgccggcgagctcgtcgacccgagccggccgtcgtgctgacgtcatgccgacgtcatcgccagggctgacgtcatcgtccttagggctgacgtcatctctctctctttttcctttttcccgattttctaatagattaaaacttcggaaaatcataactaaataaccgtagatccgttttaggtggttcaagtttataaatttttctaaaatcaagatctacatgttaaaaatatccacatgtactgtttatgcttgtttttgtactgttttgttgattttgtttatttgctttagtttccgacgttccggaggagagcgtttccgttgaggaaggttccgaagcgtttgtggaagcccaaggcaagtcacacagatcccaaacacccctttgagcatgttgatcccgtttaaagctattattttatttcaactatgcattgttttcgaatgtcatcgggtggtgaacctttcccagttattaatggccgaagatgactttattttcctatgggttataatttgattagcatgaaccttatatattggattggttcagctaaatgctatatataggtttgcttagccatgcttagaaacattagctaactaaaaggggttaaatataaattatattacataattattattgttaataatggttatatttaatggtagctcacgatgaggcacatggtaacatgatgtggggttgtgtcttgtgggtacagtggtacatctctgatcagagtttaatctattcgaatagccgtacccgcggttatgggtgagttgagcaatgtttttcgtgattagtctcacactactcattgatggtaataatgtgataattaatttaattcctggtttggaatggcaaattcctgttttggagggttaatttgttcaaccggggttggttgttcaaatgtggttcggcctatgcaacacgggtgtgttgtatggtgtttatttaatattgattaattattcaactgttttattattctcttaaatatttattaaatgctgttttctgcaaatgagttatattatgccatcctctgttatcctgtgcacttgcatatttgctgtgtggcttgttgagtatgtcatatgctcattcttgcaatattcattcatcagaagaggagtttctcagtgaaggtgatgatctggaggactaggcttgttctcggttgagtagcctgtggagtggagtcgccatagctgttccgtagtttgttatagttttattttccgctgcgtagaatgttttattctttgagaggaactatctacctctgtaataatttttatttgcgaatatttgatagttatttgtactctattatcaatattgtcattgtgtgcctcgcttgattcctggacgagggtttaacacacatgtaagcgtttggaattttggatagaaattccgggcgtgacaggttaatacccccaaacagtgtcctcctggtacttctagagtttcttacgacaacctgtcatggccgtccaaccggggctaaatacggaggagtaccctccccagaaattgtcttaggaatatatactatcgtggaggaatactcgtactgagctgtcaccatcagcggcccacctctactgtcccgcggcatatatgcccaattaatgatatttaataatctaagcaccatgcttacattactacatactattctatacccatgcacccgacatagagcaattgataaatcaaacattaaatccgcaccattacacctctctggtaggctacccacacaatgaatataatgcataaataaagtaagaccggtacttagactaagcaaagtaccaaatatatataaagaagagtatttcattaatttggaaagtattacagaagagattataagagctgctagagccataccgaaaactcttccgaagattccgaggatttccgaacactattctatactacttgtcacgaccggaaataacccaacgggcgttcctgacgtgcgtgcattaatccttgtcccaggaggcaaggtacaccgaaagttgatacaattcagagtttaacaagcggaagcgtaaatagaattattacacgggcagcgaaggcccagcacacaaagacaaacgagaaacagcggaagactagggcgacgaccacaagcgcttgacggcaggcacgagctagacaccaaagccttcatcttcaaggagctcctcttctgggcttgggaaaaattgagcaagactgagtacaaccaccgtactcaacaagacacacccacaagtgcataataaatgcaagggagtacaagggacttataatataaagggttagggttgcagtaatcagcatttaaagaaatttagttgctcaaacctcttttgtaaacgcgatcctataactatacaaattgtattaatcaaggccgtgtacccacacgaacctgccttaacccaaggccgatgatgatacagaccgaactggcaacccgaccctgggtcccggctcgtcctatgccaacccaggccaaccattccacattttagttgttaagcaggttttaagaattaaaacactaacttgagtacattgctcggcttgcccataaccgagggcgcggctattcgaataggttatactctgatcagaggtgtacatctttacccacaagacacatcttcctcacgtgcaaccacgtgccacataccaccacggtatacagacggaagacgtgacatagtttccaacccatcctagccatagacaagagtacagactatagttgaaaaaccacctaatgttacctaattaaattgcgaagcatctacctaaaattaaaccactagttgaggttttgtttgttctagggtgaacaaggtaataataataacaataacaataataatatggtcataacaaaggtaaataggcatggctaaataaaacagtgataacgcgggaatttaaataaagcgataatgcaataatttaaatcaacataattttataaactgggattcaatatgctcaaagatgatgtgacttgccttgctcactttcccaaacgtcggcttcaacttccacgaagagcgtatcctccgaagctgcagcgtctacacgaccaacggaaaagaaaaggcttttactctaataactccatataacagcagaaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaattaaaaactcatttattgcgtcagccgagagagagggtgcgcggaccgggtccacgggagtggggcccacgcgtcagcctctcggtcacggtggaccgggtgcacgcggctggcggcggctggcgccgtgggtcccacgcgtcagccgcacccgcgggcgcgggcagctgacggccgggccccacctggcagccgcagggcgcgcccgaaggcggcctcgccggcacggccgacgggaggcggcgcgcccgcgcctcgatggtcaccgccggcgaccaccggcgcaacggagcggcgcccgagagagaggagagaagagggagcgaagcggcggtcttcggctcaccacgggtcgacggcgacgacgggaacggcggccgaagtggaggaaggtgccggcgcggctcgggacgacgaggacgatggcgctccgacggtcggcgggcgaaacggaggagcggacgaggttgacgaggacgcggcgtagccgatggaggtgacgccgagacgggaggaagtccggggcgacggcggcggcgaaccggagctcggcggcgacggcggagagagaggacgacagcgcgagcacgaatccgacggaaatagcgagcggcgagtggcggaaacggaggagcggagctcggggatcgattatatagcgacgggagggggagagagcggccggaggagaaggaaacgggcgcggagatctcggccgccattgatgcgccggcgacgattacgggattgaatccggacgaatccgaggaagaaagagagggaaaagaggggggaaagagggagggaatcacggggagtgatttccccttctttattgcgcgcggggacggcgggatgcggcggattcggcggcggcggcggcgctagggcacgggcgggcggcgggcgcggcgcgaggtgggagatgacaggtgggacccacccgtcagcgagggtggcgggcgggcccgcccgtcagcggcgcgcgcgcggggagagagccgatgggccgcgggggagaggagagagcgggagggagctgggccgagccggcccaagaagggaacgggggaaagaagactttttgggatttttctttttataaaaccatttcaactttgtttatttcttttcaattattatttgtgctctgaaaattccactaaaatttatttacacattttaggcttttaggaaatatacaaaaatcctccaagcctcatttgacttttatctttgcacattttaattgttggaggctttcacatgaattttaattattctttgcacaatttcgaggatgaattttagagtcgttttgggacgcgacaaacctaccccccttaaacggaatctcgaccccgagattcggaagaactggcgaagagatcgggatgggctgccttcagctcgtcttcacgctcccaggtagcttcttcttcagcgtggttgctccactggaccttgcaaaaacggattacccggttcctggtccagcgctccatggtgtccaggattttcactggcctctccacgtaggtcaaatcttcgcgaacttcaatttgctctgagtcggcctgctcggatggcactcgaagacatttcttaagttgcgacacatggaacacatcatgcacgttgcccaaggaggcgggcagctccagctggtaagtgacctctccgcgccgagcaaggatacggaaaggacccacataccgaggtgcaagcttccctttcgtctgaaacctgtgtacacctcgcaatggcgtgacccgaaggtatacaaaatcacccactgcgaattccaggtcacggcgacggttatctgcataacttttctgccgggactgtgccacctttagattatcccgaaagattctgactttagcttcagcttctctcaggatatcagtcccgaacacttggctttctccaacttggtcccacaagagcggtgtccggcatttgcgcccgtacaacgcttcataaggtgccatttgtatgctggcttgatagctgttattgtaggagaactcggcataggggagactcttatcccaggtcttcccgaaatctagtacacatgcgcgaagcatatcttctaggatctgatttagacgctcggtctgtccatctgtttgcgggtgatacgcggtgctgaaatttaatcgggtacccagctcttcttggagcttcttccaaaagtgagaggtgaattggcttcccctatcagatacgattttcttgggaacgccatgtagactcacgatcctagcgaagtagagctcggctagtttgttccctccataggtggtcttcacaggaataaattgagctaccttggttaatcgatccataattacccatatagaatcatatccaccttgggtttttggaagtccggtgatgaaatccatcccaatttcatcccatttccattctggtacttggagaggttggagaagtccggccggtcgctagtgctctgccttgacacgctggcacacatcacatagggccacaaactctgcaatttcccgcttcatgctaacccaccagtatttctccttcaagtctaggtacatctttgtactgcccgggtgaatggaataagggctctcgtgagcttcctgaagtatcagctgtttaagttctctgttatcgggaacgcatacccgctttccgttccatagggttccgtgttcatcctctgtgaaaccagcggctttaccctgtttcatattcttgaggagtccatgcatgtccggatcattcttctgagcctcgcggatttggtcgagcaaggtaggcttggcttccaacgcggccaagaacccacgaccaactatgcttaggttcagggcttccatctgttggttaagctcgggtggaatgccacggacgttgagagtgttgcaatggctttttcgacttagagcgtcggcgaccacgttggccttaccaggatgatagtgaattcccacatcgtaatccttgatgagttctaaccatctcctttgccgaaggttcagatccgactgggtgaagatgtatttcagactcttatgatctgtatatatttcacagcgattcccaatgagatagtgccgccagatttttagagcatgaaccaccgctgctaattccaagtcatgtgtagggtagttgccttcatgaggtcgtagctggcgtgaggcataggctaccacatgaccgtcctgcatgagtacgcaccccaatccttggcgcgaagcatcacagtacaccatgaaatccttgcgagtatctggcaggattaacactggcgaggagaccagcttttctttgagagtttggaatgccttctcgcattgcgggctccacacaaatttctcttctttcttcaacaactgtgtcatgggtcgagcgattttggagaagttctcgatgaatctccggtaatatcctgccaaacccaggaaactgcgaatttgagtgactgtcttgggttgcttccattcagtgacggcggtcactgtttcggggtccacggcaactcctttagcagatatcacgtgccccaagaattttacttcggacaaccagaactcacacttgctaagcttggcatataattgatgttcccgcagctttcccaacaccagacggagatggtgctgatggtcttcttctgactgtgagtatatcaggatgtcatcaatgaaaaccacaacaaacttgtccaagtattccatgaacactttgttcatcaagttcatgaagaatgcaggtgcattggttagaccgaacgacatcaccgtgaattcatacagcccatatcgcgtggtgaatgcggtcttcggaatatcttcttcacgaatacgtaattggtgatatccggaacgaaggtcaatcttggagaatacagtggcacctttaagctggtcgaacagatcatcgatccggggaagagggtacttgtttttgatggtgacctcattgagagctcggtagtcaacgcacatcctcttcgtcttgtctttcttctccacaaagatcacaggagcaccccaaggggaagtactcggacgtatgtaccccttttctttcaactcttccaactgtttcttaacttcggccagttcatttgctgccatacggtagggtcgcttgtgcagaggagtggttccaggagcaagatctatccggaactcaatctctcgcttaggcggcataccaggtagttcttccggaaacacatctccgaactctctgacaatggggatttctgatagttctatttgatgcagttttgaacttctgacagaggttgggggtgcaaagaaaacaaccggttgttccggtcctcggtacagagtgacagtgcgtctcgcgcaatccactactccctggaattgagccaaccaattcatcccaagaatcacatccaaattcttggtgtctagcagaatcagatccgagggaaaaggaatcccttgaatttctataggaacggcagggctatagtactttgctgtcataacccctccaggggtggtgatgagtagagggttcctaagcctttctacccccaactgatttttccccacgaatggcacagatataaacgagtgggaagctccagagtcgaacaaaatagtagctgggatggaatgaacgaggaacgtaccaacgatgacgtctggagttgtcagcacgtcctcggccgtcacgtggttcacacgaccccgaatgacgtccttgccaccgttgttggagcggggaggcgcttggccttgctgacgccttggctttgggcatttatccgcaaagtgcccgggctcgaagcagttgaagcacaaacgctgctgaccttgagcgtccctgcggccttgaacgggctgcacaactggcgtaggaggacgggctacacgagtcccttgctgactctgctgctgctgcggctgtgggacgcgcaccacgaattgaggtcgaggcgcggagcgaggttgctgctgctgttgttgctgctgcgaggaggatccccctggatagggattggtgtagcggaccctctggttagcgccctgctgattgcggaagttcgccaagcggcgcttgtgcgtctccagctccttgtgcttggcctccaagcggatgctcttgtccaccagacgttggaagtccggatagtccccagagactaggcgaacggacagctcagggtccattcccgccaagaacttctcttgcttctcctcatcttcccgcacatcctccggagcgtaccgggccagactgttgaactcgtgcaaatactccatcacggagcggttgccttgcttcaactcccggaactccctcttcttaagagccacgactccggcgggcacatgggttctccggaaagcggcggtgaagcgggcccaagtaatcggttgcccctctggctgcgtagcctggaaatggtcccaccatagagatgcgggcccctgcagctgatgggcggcgaagatgactttctcttcatcactgcactgcacagtgtccagcttcttccccacggcatgcaaccaatccaacgcatccacgggattgttggagctagagaaggtgggtgggcggatgcggaggaactcggcgagcttagagtgttgtggaggtggtggtggagcattctgttgtggcggattttggaggtggtggaggaaagcggtcatcatgttggcttgctgggcgaggatttgggtgagaatggcgttggtgtctggtggtggtggtggaggtggattgccttgggggttggggttgctgccttcgggttggttgccttcaccggtgctaacatttctcctggtcgtcaccatctgaaaaccccacacagcaccagcaaacagagagagctaacgattaaaactaaccacccacgactactataaatcttgaatttattactgatattgaattggttcattagagttcaagttgcttaaacaaataaaacaagacaggctccgacatagttatgccacacactggcataaccatgccccacacaacccaagaagacaaacgaggaaaaacacacgcgcaagcctactaactgctcgtctaccgctgcgacgggccagggcggaaggtgagcaacagcgcatcctccgtgctaccaacgccggaggcttccccctcctggggaaccacgggcgcaggctcggcacgaggggtctcgacgaagcaagtccacgccagggactgacgaacaagctcgggcctggaggtgctcttccgggcggtgatcttctggctgcggcagacgcggcgacgcttggggcggctgtcctctccctgggcgatcttgagctggtgcagctgcgcctccaatgcgtcgaggtccttcttgagctgcaggttctcctgacgcagctccaggatcttcaggttgttctcaaccatcccgcgacgcaccatctgatggaagtcgatacgagccgcgtcgtatgcctccaccatgcgtgccagatgcacgacggtagcgtcatcctccaagctagcatctcggaaggtggcgaagtcgcgggctcctccgcgacgagggtggtagcgatagggcgagtgctgcaactcgtccgggtagcgctggtggagggtgccgatggcgaggagagcggcgttctggcaagcggcgggagaagaatccccacccgcggtgactgccagcgaagtccgctcgggagagccagagaggatcactgcagtgacctcccacccagcgtgaggctctgcatcctcaccctcctgctccgggagcggcctggcctggtaatccactccatgtggataccccaagaccacgcacatgccccgcagctccaggacgaagccagtcatgtccaaaccacgacgggtgacgctgccggccatctacaaacaaaaacaaaagaaaaacagcattttagagatcagattttggcgataaatgaagcagcaagacagagagagaatagcgggttttcacaaataacaaaagatttttaattttcaaaaatattgctaaggcttgggatctacggctcgtcctagggtcaagggaggctctgataccaacttgtcacgaccggaaatcacccaacaggcgttcctgacgtgcgtgtattgttccttgtcccaggaggcaaggtacaccaaaagttgatacaattcagagtttaacaaacggaagcgtaaatataattattacacgggcagcgaaggcccaacacacaaagacaaacgagaaacagcggaagactagggcgacgaccacaggcacttgctggcaggcacgagctagacaccaaagccttcatcttccaggaactcctcatctgggcttgggaaaaattgagcaagactgagtacaaccaccgtactcaacaagacacacccgcagatgcaaaataaatgcaagggagtacaagggaattataatatagagggttagggttgcggtaaacagcatttaaagacgtttagttgctcaaagctatttgataagcacgattctagaactatacaatgttattaatcaaggccgtgaacccacacgaacctgccttaacccaaggcctattatgattcagaccgaactggcaacccgaccctgggtcccagctcgtcccaagccaacccaggccaaccattccatattttagttgttaagcaggttttaagaattaaaacactaacttgggtacattgctcggcttgcccatatccgagggctcggctattcgaatagattatactctgatcagaggtgtacatctttacccacaagacacatctgtctcacgtgcaaccacgtgccacataccaccacggtatacagacgaaagacgtgacatagtttccaacccatcctagccatagacaagagtaccgacccaatcccgcctacggccggaacccccgggacaggcaggcaggactgagcccctagcagcagggcaccaaccctctgccattcgacatctcgactaccgggccgcagctcgtgtagccttcattttccctggagaatgtccatcgacccccgacttcatccatctccaatccgtgtacttctgtttacgactagactgagccacaaactaagccttacccactagacatgtggaagtacggtagtgctttgcaacagaggcccgaagaccggtccttatatggccgaggtgctactatcaaaaccatgcacctcgagcccagcctaaaaccattttggggattttgaataaagggggatggtgtgaatccaattccacaataaaccaaccattccaaagtgtccaggtgatatgaatatttcccaaagtctaaagttataaaaccacctaatgttacctaattaaattgcgaagcatctacctaaaattatactagtggtactatgagtagagggtccactagttggagttttgtttaatctaggtgaacaaggtattaataacaaaaacaataataataaggtcataacaaaggtaagtaggcatggctaaataaaacagtgataacgcgggaatttaaataaagcgataatgcaataatttaaatcaacataattttataaactgggattcaatatgatcaagatgatgtgtcttgccttgctcgccttcccaaacgtcggcttcgacttccacgaagagcggatcttccgaagctgcaacgtctacacgaccaacggaaaagaaaaggcttaaacactaaataactccatataacagcagaaacaaagcacaaaaatgggttctttacatcttgaggaaaaattagagacttgaacggtccaattccgagttcaaatggccaagatatggccatttgaagtttatatgctctttaaatggatatttgcgaatttcttcatttaatttttaattaaaaaaaatcctatttattgcgtcagccgagggagcgggcgcgcgggccgggtccacgggaagtggggcccacgcgtcagccccacggtccacggtggaccgggcgcacgcggctggcggcggtcggcgccgtgggtcccgcgcgtcagccgcacccgcgggcgcgggcggctgacggccgggcccacctggcagccgcgagggcgcgcccgaaggcggcctcgccggcacggccgacgggagcggcgcgcccgcgccccgatggtcaccgccggcgaccatcggcgcggcggagcggcgcccgagacagaggagggaagggggaaggcgaacggcggtcctcggctcaccccgggacaacgacgacgacgagaacggcggccggagcggaggaaagcggcggcgcgggtcgggatgacgatgacgacgacgctccgacggtcggcgggcgaagcggagcggcggacggggtcgacggggatgcggcgatgccgagggaggtggcgccgagccgggaggaagcccggagtggcgacggcggcggaacggaactcggcggcgatggcggagagggcggagcacggcgcgagcacgaatccgacggcgagagcgagcggtgagcggcggaaacggaagagcggagcacggggagggtttaaatagcgccggggaagggaaagagcggccggagagggaggaatcggtcgcggaggatccggccgccattgattgcgccggcgagggtttcgggaaggaaatcggacgaatccgagggagagagagagggaaaagcgggggaaacgggagagggaatcacggggagtgattcccctctctttaatgcgcgcggggacggcgggagcgagcggatttggcggcggcggcggcgctagggcacgggcgcggcggcgggcgcggcgggaggaggaagacgacgggtgggccccacccgtcagcgagggcaggcgggcgggcccgcccgtcagcggcgcgcgcggggaggagccgatgggccgtgggggaagagagagagagagggagggattgggccgagccggcccaagaagagaaaagggggggaaaagaacttcttttaagattttctttttataaacctttttaactatgtttatttcttttcaattattatttgtgctctgaaaattccactaaaatttatttacacgttttaggcttttaggaaatatacaaaaatcctccaagcctcatttgacttttatctgtgcacattttaattgttgaaggctttcacattgattttaattattctcagcacaattttgaggatgaaatttagggtcgttttgggacgcgacaatacggaaactatccatatacgcgtgggtataccgtattagtatataacgtacagccaaggatagagggtataccttatccgtaaccttgacagtagcccccgacttctgcttaaatgagctcatgttatcgatcgcaacttctgatgtcggaattgttgtcgctctcatctggtcgatctcggtgtgaaaactgtagagacaaagagccatcgacaacaccgcatgaagttcaacggccatgagtgaatttaaattgaagtctgaaaaactaccccacgcaacggacccagaattttccggcagcaatctctctcctttccttggaatacgcaccatcggaagcacgtttacttaaagggattttggggatccatttgaagtccgtttgcaagaaaactctcctgccttctagcactcttcgtcttctccgctccccacaaaaaaaaaccctagctcacttccttcatcctattctccggcgatcctccggcagcaatggaccttgagaaatcttcctcgaacaccgcatccatgaagaagctacaggacgacggtgccctccccggtcgcgggaccatgcagagggaggctagaggtacagaacctaaacccatctttcaccgcatggttgtaattgaacattatgtttcttgtggttttcttcctccgccttccgagtttcttcttcttgtcttgaatttctacggcctttctttgcttcagtttaaccccaactccatcgcctttttgagcatcttctctcatctttgcgaggcctaaattggggtagtgcctttccttgacctcttccatttttattacgagctgcgttggatggaatccatcagggtatctggatgcgtcggattccgacttcgggatggcctgaagtcgcgttacatccccttcagtgccccacttctcgcagcaagtggcaaacgagatggttctacctccagatagagaacttggaccccgtccttgttattcctgaggaccagccagaaaagatcccagagtggactgctaaacccgccttgactccctccctccaatcctttatcgacatcattgatgatctccgaaaacgggggttgtcgggatatgaagtcgctgccgacttcgtaggtcggcggattcaaccgctacaggcccgtgcccatccggccttcgattactctgggccagatgacgtgacccgggtctctcctcggggtatttatcctcgtatttctaaatttgtttcaagtgcatctgtttcctctaacttatcgagttctcgttctcgatttacaggtctggacagtgacactgtggggcgccgcatcggccagataatgatcagctgtcacgcccagaaattcccgaatagaattccaagcagaatgtgcaataaaatccccgtccaggaccagccagggtacacaaacgacaatgttgacatacagatccacgtcttacaaacatcataaagttttacataaatgcagcggaaggaaagaaagacaacaggagctaagccttgactaaactgcagcgggaacaccactccacaggcatcctcgacggcaaggacgaagcctactcctcggagaacccttcatctggtccgaactcaaactctggggttgggaaaagtagagcaagactgagtactacccactgtactcagcaagtcataccggaatagaggtatgatgcagggaatcatcaaagaaaagctaaagtggttcctttgcataaagcgagcatttataaacagagatttcaagatttaaacagttgtaataagtaattaagcagtattaatcatccactgtccaacgctacaccacgttgcaacaggcccaaccatccacctaaactatccaaattaaaggattacactaaggtgagactaatcatggtgaatctggttgaccgcccatgaccgcgggcacggctattcgaatagttttactctgatcagaggtgtacaactgtacccacaagacacagccccacgacacgtttccgtgcgccgacatgccaccacgacataccgaaaagaggccgtgacaggacccttcgcataaccccctctagccaagcacaccacacctcaggtttcacccccgtccccagcgggcgacgggcagtcccctctcgtgcctaggtgaatccggaagtgacagaggccgtcgcagggcccgccccgctccatcacgcccacccttgcctggatgcgtcgactagaggaaagctacactacaagcccagccgttgcccacgctggcttgtggtaagtacgataaattcttccagggcatcccgcgaaccggtccttaactgccatgggtgcgaccagcaaaaccatgcacccacagcccaccatgtgattcattttatttaaccaacaccagagcggtggtattaaaccaacattatcatataaacttatagtctaggttttaaatgagattccccattgtgtgctagttgaactaggcatggctaagcaattcctagtccaaagtctaatcatgttataacccaggctaacaaaggagaatgatatccaaaagcatggctataacaataggtaaccatcccatagtactattataaaacaatgcaatatttgaaagaaaacaatagagcatttgcaatataggatcaacatgttcaagtgacaagcatgacttgccttgctctgctgctggagggacctcggcgactatctcgaagtacaccgaagcgtcggaggaatcggaatctagcgacatacaaagcaaatattgcaaacaggctataagactactgaaacagagaacaaaaccatttttaatggattctacacatttttcttgatttactgagacttgaatggacttaaacggagctcggatgaattagttatgaattttagaaggttcactgtgtttattactataaaagaaaaaccttaaacaatttattgcgcaatattaaccagggctgacgtcagcacgggcggcgcggcgccgacatgcgggacccaccggtcagcggcacggggaggacagaggaggcgtcggcccgcgggcccaccggtcagcggcacggggagggcggtctaccgtggaccgggaccacgcaggtgatccaccgccgatccacgggactgacggcccggatcgcccttgggccgatcggacggacggcggcggcggcagcccccgggctcggatcggcatcaaagccgatcggccgacccggggctagcggcggcggtgcgtgcgcgtcgcgtcgccggcgacggcaaccggcggcggaggcgacgcgaaagcggcggcagcggacggcggcaacgacccaaagcgacggcgagcgcgggcggcggcgacgcacggggaaacggggaaggagaggagaggagatgcctcaccgagggtggccggcgcggaggaagacgatggcgaatggcgacggcaagccacggggggcgacggcgaccggcggacgagctccggcgtgccctaaggaaggagaagggagggattagagagagggagatagaccccggcgaccggcattcgaggccgaaagcggcggtagggtttagaccctatcggagcgcgaggagacgggggttccggcggcgaacctcgacggggaaggggcggccgaggtagatctcgaccccgcgaacccgacggcgacgacggaacggtgcggcggcgaccctagcggcggctagcagcggccgaagtagcaaaaacggcggcggcgggtggttgcacggcgcgggagcgttggggggctcgggagaggtcggcgcaatggggaaaaagagagagggggtgccggcgatgcttaaataaggggagagggggccggacgtggccgggagcggcgggaatcaccggccgacgtgggggagtggggaggagagagaggcgggattcgattttcgaatcccggccatctcgggcgcgggcgcgagcgggagagagaggggaatgggcgcgggggatgcggcgcacgcgcgggcgtggtcgacgtggcccggggaaggcggagacgtgggcgcggcgacggttgcgggcgcggcggcgcgccgggatcggcgggaggagggagacgggcccgacaggtgggtcccacctgtcggcgaccccgggagggagggaggcgggcgcccggctgccgggctgggcctcggcctgcggccggcccagcagagaggagggggaaagagaggggaaatgggccgacggcccatttaacaaaaaaggaggaaaaagaggggaaaaagaaaaagaaaaaggaaaaaggattttccctggaattaaaaattgcactttggtgatttttaattggttacaattgtttctagagctctgaaaattccattaaaaatcctgttaatgaatttcgacatgtagaactcaagaaaaattccacatgtcaaatccgattattatttgcattattttcttagggttttctcctgatttcacctgcattttcttagggtcttttataaattacaatttggcttgggaggaaaacttcggggtgtgacatcagcgcaccttcagaggcggacgacattcctgtcccactctgcgagaaggactcgaccgaacgcgccgccgcgattaacgtgagtgtactcgatgattcctttacatctttcttctcgagatcgcgttgtgacttcatattgtgcaggctctccctctgacggacgccatcggaccactcgtggatcactaggtggtgacgtcgttgaaggagggcgtcaccaaggaggcatcagacgctgttgctgccaccatgtcacgactggaaataacccaacaggcattccttatgtgcgtgcattattccttgtcccaggaggcaaggtacaccaaaagttgatacaattcagagtttaacaagcggaagcgtaaataattaatttattacatgggcggcgaaggcccagcatacacaaagacaaacgggaaacagcggaagactagggcgatgaccacaggcgcttaacggcaggcacgagctaaacaccaaagccttcatcattcaggggctcctcttctgggtttgggaaaaattgagcaagactgagtacaaccaccgtactcaacaagacacacccataagtgcagaataaatgcaagggagtacaagggggttataatataagggttaggatttgcagtaaacagcattaaaagacacttagttgctcaaagctattttgtaaatacgatcctagagctataccagattattaataagggccgtcaacccacacgaatctgccttaacccaaggcctacgatgattcagaccgaagtggcaacccgaccctgggtcccagctcgtcccaagccaacccaggccaaccattccacgttttagttgttaagcaggttttaagaattaaaacactaacatgtgtacattgctcggcttgcccataaccgagggcgcggctattcgaatagattatactctgataagaggtgtatatctttacccacaagacacatcttcctcacatgtaatcacgtgccacataccaccatggtatacggacggaagacatgacatagtttccaacccatcctagccatagacaagagtaccgacccaaccccacctacggccggaacacccgggacaggtaggcaggactgagcccctagcagcaggacaccggccctgtgccacgacatctcgactaccgggccgcagctcgtgtagccttcatttgccctagaaatgtccatcgacccctgacttcgtccatctccatccgtgtacttttgtttataaccagattgagccacaaactaagccttacccactagacatttggaagtacggtagtgctttgcaacagaggcccgaagaccggtccttatatggccgaggtgctactatcaaaaccaggcaccccaagcccagcctaaaaccattttatggatattgaatagagggggaggtatgaatccaattccacaataatccaaccattccgtagtgtccaggtgatgagaatattcccaaagtctagagttgtaaaaccacctaatgttgcctaactaaccagcgaagcatctacctaaattcatactagtggtaccatgagtaaagtgtccactagttgaggttttgtttattctagggtgaacaaggtaataataacaataacaataataaggtcataacaaaggtaaataggcatggctagataaaacagtgataacgcgggaatttaaataaagcgataatgcaataatttaaatcaaaataattttataaactgggattcaacatgttcaaggatgatgtgacttgccttgctcgctttcccaaacgtcggcttcaacctccacgaagagcggatcttccgaagctgcagcgtctacacgaccaatggaaaataaaagggcttttactctaataaactccatataacatgcaggaaaaaagcacaaaaatgggttcttgacttcttaaggaaaaattagagacttgaattgtccaattccgagttcaaatggccaagttatgggcatttgaagtttatatgctctttaaataaatatttgcgattttcttcatttaaaatttaatttaaa

SEQ ID NO: 2799 - DNA, 11378 bp, Oryza sativa
tgtcaaatccgattattatttgcattattttcttagggttttctcctgatttcacctgcattttcttagggtcttttataaattacaatttggcttgggaggaaaacttcggggtgtgacaaacctaccccccttaaacggaatctcggccccgagattcggaggagctggtgaagaggtgcggatgggcggctttcaactcatcttccctttcccaggttgcttcctcttccgaatgatgactccactgaactcggcaaaaccgggtgaccttgtttctggttctcctttcgctggtatccagtatacgaaccggcttctcaacataagttaggtcttcctggatatcaatgtgttccgaatcagcctgttcttcaggtacccttaagcacttctttagttgggacacgtggaacacgtcatggatgccgatcatgttggatggaagttctagctgataagccacttctccccttcgttccaagattttgtatggtcccacgaagcgtggtgccaacttgcctttcgtctgaaaacggtgtactccccggagcggagtgacgcgaaggtacacgtgatctcctgcctcaaaagtgagctcccttcgacggttatccgcgtagctcttctgtcgagactgagcaatcctcaacctttccctgatgattctgactttctcttctgcttccgctaatacttctgttccgaatagttgacgttcgcctgtctgatcccagaagagaggtgtgcggcacttccggccgtataaagcttcaaacggtgccatctgtagactggcctggtagctgttgttgtacgagaattccgcatatggcaagcttttgtcccaagctccaccaaaatcaagagcgcaagctctcaacatatcttccaagatttgattgacccgctcggtctggccatcagtttgcgggtgataggccgtgctgaaatttaaacgggtccccaattcttcctgcagcttctgccagaattttgaggtgaactgactccctcggtcagatacaatctttttgagtactccatgtaggcacatgattctcgaaaggtaaagctccgccaaccttttgcccgtatatgtggtatgtactggtatgaagtgagcaaccttagtgagtcgatccacgactactcagatcgaatcgtgacccgacgatgtccggggcagtcccgttataaagtccattccaatttcttcccatttccattccgggatttgaagaggttggagtaaacctgtgggtctttggtgctctgccttcactcgttggcaaacatcgcagagtgcgacgaattcagctatttctctcctcatgctgacccaccaaaacttttctttgaggtcttgatacattttggtgctgcctgggtgaatggagtactgggtctgatgagcctcggtgagtatcagatccttcaattccttgtcgtcaggtacacacaatctttctcccatccagattgtgccatgctcatccttaaggaaatcccgagcctttccgactctcatgttctttttcagttctgctatttccggatcatttacttgagcggctctgacttgatccacgagcgtaggccgtgcctccagagcggctacgaacccgtgttcaacaattcctatgttgagatgttcaaactcctgccgcaattcctcacacatgctctcgatgcatagagcagtgcagtaacttttccggcttaaagcgtctgccaccacattggccttacccgggtggtagtgaatactcatgtcatagtctttgattagctccaaccatcttcgttgtcgaaagtttaggtccggttgggtgaagatgtatttcagacttttatggtccgtatatacttcgcagcggttgccgatcagatagtgcctccagatcttcaaagcatgaaccaccgctgccaactccaagtcatgagttggataatttccttcgtgtggacgcaactgccgcgaggcatatgcaaccactctgccctcttgcattaggacacatccaagtccgtgacgggatgcatcgcaataaacttggaagtctttcatctggtcgggcagaatcaaaactggtgcggatactaatttcttcttgagctcctcaaagctcttatcgcactccgctgtccatttaaatttctcatctttcttaagcaactgagtcatgggtcgggcgattctggagaagtttccgatgaatcgacggtaataacctgccagtcctagaaaacttcgaatctgcgacacagtcttcggtggggtccacttggtaactgactccacgttcgatgggtcgactgccacaccctgagctgtaatgacatgacccagaaatttgacttccgtcaaccagaaatcacacttgctgaacttggcgtatagctggtgctccttcaacttctcgagtaccagacggagatgttgttcatgttcttcttcggattttgagtagataagtatgtcgtcgatgaataccacaacaaacttgtccagaaattctatgaacactttgttcatcagattcatgaagaatgcaggcgcgttagtaagtccgaaggacataaccgtgcactcatataacccgtaccgagtggtgaaggccgtcttcgggatatcctcttcccggattctcaactggtggtagcctgagcgcaggtctatcttagaaaacactttagcccctttcagttgatcaaataaatcgtcgattcgcggcaaaggatatttattcttgattgtgacctcgttaagtgcgcgataatcgacgcacatcctcttcgtcttatcctttttctccacaaaaatgaccggagcgccccaaggtgaagtgcttggtcgtatgtaccctttctgcagctgttcatcaacttgcttcttgacctccgttaattcgttggccgccattctgtacggtctcttatagattggagcggttcccggtgccaaatcaatccggaattcaatctctctcttgggtggcatggtagtgaggtcttcggggaacacctctggatactcgcagactatgggtatatcatccaattttctcaagttcttctctacggtgtccactgggatttccgtctcaatctgattcaacgagactcctttctttggcgagactagagatttgtacaccacggtttctcccttctcgttggtcagggtgactgtgcgattcgcacaatcgatgactcccttaaacttggtcagccaatccatcccaagaatgacatctaggtctttggattcgagaaggatgaggttggctagaaccggtgacctttgaatttctattgttatagaagggctgaattgaaccgaagtggagctattccctggggtatgaacccgcatcggtgtgctaagttcctctcttattaacccatgcatcccgacaaatttctttgagatgaaagaatgcgttgcaccagaatcaaaaagtactgttgcagggattgagttaacaggaaacgtacccagtacaacctctggtgctgcttgtgcctcctccgcagatgcgtggttgacacgagcctggataaaccttggcccggcacgcctaggcttcgggcatttgtcagcgaagtggccaagctcgccacagttgaagcaagaccctggttttgcttccgtctccttcttggcttgcgcgggctggcctgactgtgccgatgccactggtgggcgtggagctgcaccgcggttgggctgacctccatggtggttctgactgtcactggtgccctggtagaagttgctagggttgaacgggcggtgctgacggacgatcatggtggtaggtccaccctgctgtccgggagtgaagcgcggcctctggtgacttccctgatgtgccctgaactgagcggccttcctcttcctgtccatcttgttgcgttggtcctcctgacggattgccttgtcaaccagcctctcaaagtcagcgtagtacccggatatcagctggttggtcagctcatcatccaggcccgccatgaacttctcctgcttctcggcgtcggtgcggacatcctctggtgcatatcgcgtgaggcgattgaactcgtggaggtactctgtcaccgtcctgttaccctgatggagtgcacgaaattccctcttcttttgtgccacgaccccatctggcacttgtgccttcctgaagctacggcagaactctgcccatgtgacttcagtacccggtgggcgggtggccatgtggttgtcccaccaagctgacgcaggaccctgaagctggtgtgtggcgaaagcgaccttctcctgatcattgcactgcaggagattcagcttcttctctattgcatggagccagtcatttgcctccatagggttggtggtgctggagaaggtgggtggcctgactcctaggaactcaggcaatttggattgagggggagggggaccaaagtgctggtgctgctgttcgacgtgctgcatcatcctctggtgcatttgctggtgttgttgctgcatctgctgcatcatggctgccatcatctgagtctgatgcgccataacttgggcaagggtcggattctcgggaagtggtggcggaccattgccggaatcactgttggggtgcacgccatcaacgcgttcttcgccgttgctgccctcgcctgtcgtgcggttgccagtcctggtgtagaccatctggagggaagagcagccggggtaaagaagaaaaacagatgctcaagaactaagctttattacaaaggaatttaaactgcaattgttctgatctgaattaaaacacttaaaagagcaagcaaccaatccttattaagacagccataccataggcacatgatatcgaccgtcgtctgacccaaacaaacaacctaaacacacaaactaacgaacaaaagctagacagtcggtaaactagtgggaaaacgagcataatgctcggaacggctcctgcggtcggtggagtcgaaagcgtcctcctgctcgtcaccaggtccctctgagcgactcctggagcctggcagatacgtctcgccgctgcctgactgcgagccactggagctgctgctgctgagatcgcggctgccactgggagtagcagacaaccaacccccggtgccactggctggacctctggcggctgacgctggagcgaaggagagagcggacgcgggagctggagctggagctggagctggagctgcaggaactgcgggcggaactggaggtgctgcgggagctgctgctggaggtgggtttctgggtgcaagctggatgcgcacgggtgccgtcgtcgtcttgcggggcgtggtgcggatccggactcctcctggcgctggaagaccctttagctgagcgttctccttcttcaggcgcgctatctcgtccttcaaagcgacgatcctcatgagcttcccatcgttcaaggccttggtcgccttgtgcaggtccgagtgcatcctgtccaatcccctcatcacagcacacatgtgaccgaaggtggtgtcgttctcgccagctgtcggacggaaggagctgacgccatcaccgttggctcgactggggtggtagcggtacgccgtgtcgtggaagatgtagttgtggcgctcccgtagtctggccatcatcaagtaggctgcctcctgacaggcgtgatctgctgtgcctccagatgcctcgaccgccatgttggcgaggcaagtctgtcacatcctgattttcgtttcaggatttataaattatttaataaattattaatagaatttatattaaatgttctttaatttacaagtgaagttaaatgtgggaaataaaatttcctaaataaaaaaaagcatagatggatttaatttttattaagtcctccatgattaattatactctctggaattttctcggatttttcggagctcaattgttaattttaatcatacaaagaaaagttcagcaattatttaaatatcaaattaatcaggtaatgatctaattataattgttaagtgattttcttgtttaaaatccttaaattataaattgttgtttaaaaggaattattagaaatgattttaaaagtttaaaagagaagatcttttcttttaatttgctaaatctcaacataaaaatgagctagataaaattttgttaaatactttgcttgttcctctattttctagatttttctgggaattatttgagcaaaggaagtatttttaataaatgaaacatcatttcacaaattatttttaattgaaaaagtttttaaaatctcctcctaggccgttgggccgaatccggcccaactcctctctctttctctctcttcccgcgcgcggcccacgccggcccagccgagccgcccgctcctcctctctccagccgctgacatgtggggcccacatgtcagggccgtcttcaacctccggccgccgcgccgccgaagcccgaaccctagccgtttttgcgccgccgtttccggccgaatccgaccccatctcttccaattgattgaggggttttgttcctctcggtctcctctttcttttcccccaagaatcaaagcaaatggttgaggattcgatccgaatcgaactcgttttgttttatctctaaaaaacgagtccgagttcttcccgattcgattcctctcgtttgcgacttgatctgttcgattcgagctcatataaaccttccccatgatctcctctttcgtttgccccctttcccgagtcctcccgtgcctcctagcgccgtcgcgacgagctccaagtccgccgccgccgccggccatcttcggcatcgtcgcgccgccgtctccgtcgtcgccgtcggtcgccgtcaccaccgttaggtgcgccgtgaggagaagaagctcggccgcccctccgttttcgccgttgaccaccggagcgccgccgtcgccgctaacccgagccgccgccgccttcttcttcgtcgccggccgccgtcgtgcatcattttgggtcggggtgagtaccaatgggttcgcctcgttgccctctacgcgtaggtggtctccgtttccgccgccgatgtccctagcgccggcgagctcgtcgtcccgagccggccgccgtcgctgacgtcatgctgacgtcaaccttagggctgacgtcattgtttccagggctgacgtcatcatccctttttccttttcctttttccttttttctaatagatcaaatctttggaaaatcataactaaataaccgtagatccgttccaggtggttcaagttgctaaattcttctaaaataaagatctacatattaaaattgtccataaattgagttaaatttatttaattctttttaaatgggctttaattagatttaatcttgtaaaattcataataaattcatttgaagtcagaatgaggccgttcaagtctcataattcatctaaaattatgatctacatgtttgtttactttttatgtactgttcatttggtttttattagtctttttcttcgttttgcgtgttagcttgtcgtttccgtcgttgcgaaggttcgtgagtgcgccggaagtgatcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccaatttgcattgaatgccctattccttgataccttgggtaataaattgattagcttgaaccttatgtattggtttggttcagctaaatgtcatatatatatatataattgcttagcaatgcttagaaacattagctcattaatgggatgaattatatacactacattattattatggttatatttaatggcagctcacgatggtcaatcgtgattggttaattaattatttgccaattaaaacttgataatggtgggttgtgagcacatggttttgatggttgtgctcatgacaattaaggaccggttcgcgagctactgttgtgaaacattaaccgtaccaaccacaagccagcgtgggcaacggctttatcttttgtatagcgtgattcattatagtgtgccagactgtgaagtggcgagaagtccatgggggtcgctggggagtccatgcctctggttgtagagggggtgattatgatccaggaatggtgcactgtggtgagttgtgttatgcaggggataatgtcacagcctctattcgggtactttccagtatcgcgacgcatggttgacatgatgttgaggttgtgtcttgtgggtacagtggtacacctctggccagagtaaaactattcgaatagccgtgcccgcggttatgggcgagttgagcaatgtttttcgtgattagtctcacacctctcacaataattatggatgtaataactggtaataatttgcttagctcctgctttggagattagatctgtatagccgggtatggttgttcaggatggttgggcctgagcagcatgggtgtgctgttcagtgttgattaaaattgatgattaattactctactgttttatttctctcaaatgttttgctaaatgctgcttttgcaaatgagcctatattatgccatcctttggaatctttgtgcacttgcatatttgctgtgtggcttgttgagtatgtcatatgctcattcttgcaataatcaatcaacctcagttgaagataaaggatccggaaggagaagacgtttggcttataccccagttgagctgcctgtgggagtggagccggagcttcgctagattttatttttccgctgcagtttccttcttggtgaggactaagtgcctcttaagtaagtatttatcggtttagttattatgatggatttgtatattaaattgtcagtttgtgtacctcggctgattcctggacgaggattttatgcacaaatcagttcggaaattattagtgaatttccgggcgtgacaagttggtatcagagccatctcgactgtaggataagccaaatggtcaaaccttaaggactaattttccgaaaacataatttgtgaaagtttctcttttcttccttatctagaattcttcgcaaatcgttttgtcgttctctcctcttttccctctttcaacgtgagtagttgttaaacttgatggagaaactcgaaggcgtcgatgttgtcaacttctgcaagtaaagtggatcgaggaagaaccgaagtgcccagatatcaagatagagtgaagttggatcctagtttagaacctatgccgccaaagtgtctttgaagaatagttagtaggatagaacgtttgttgcttgcttgtgtgtaggtatggttgcattcccgtcattggagtagtccaatgatgagtgtgtaactatactaggttgtttgcttaatcaacttgaacaatataatggtttacacacatcagatcagtgttaaactggttaaggtcttgtctttagtgtaacccctctccttctatcttctctaatctgcaacagatggtgaacactcgcactagtggaagtggaaacaataacaatgaagagaacccaacccttgctcaagtgctggctcaacagacccaattgatcaacatgttagtgcaacaaatgcagaaccagcaagggaacaacaatgtcaatcctccgccgccgcagaacaagttagctgattttcttcgtgtgaagccacctactttttctagcactaccaacccagtggaagcaggtgattggctgcacgctgttgagaagaagttggaactgctccagtgtacggatcaggagaaagttgttttcgcttcacatcagttgcaaggacgtgcttcagaatggtgggatcatttccggatgaacagagcagaaggacaaccaatcacttgggcggagttcactgaagcattcaagaagacgcacatacctacaggagttgtttctttgaagaagcgtgagttccgggcacttaagcaaaaggatcgtacagtgacggaatatcttcatgagttcaatcgtctagctcgctatgctccagaagatgtgcgtactgacgaggaaaggcaggagaagtttttggaaggcttaaaggatgagctgtcagttatgttgatctctcatgactatgaggattttcaggagttggttgataaagcaattcgactggaagacaagaagaacaggatggacaatcgtaagagaggaaggattgttttccaggaggcacaggatagtagccagaggtagtgtatcaagccactccaaattggtgaatctttttctgctggtcaaggacagtcacaacagttgggcatcagtggtgagattaactcagagactaatgcaagcaatgaaggcaatgatgagcaagctactcaatcagtgtcatttcagcaggatcagtctcaagaagataacagtaatggaagggagcagcgggtgtgtttcaattgttatgagccaggtcacttcgtaaaagagtgtccgaagccgaagcgtcaacagccacaaggccaagtcaacaacattgtcctcacaggagcaaatgcagtgccggttgtgtcttcaagtgttacaactcagccactagtatcaaagcagcagtagttttctttaaagccttagaataattatcgaagttatggaataagatagactgcagtttatctatgccctttttctttctagccgttccgaatctcgggacgagattctttgtaaggggggtagatttgtcacatcctgattttcgtttcaggatttataaattatttaataaattattaatagaatttatattaaatgttctttaatttacaagtgaagttaaatgtgggaaataaaatttcctaaataaaaaaaaagcatggatggatttaatttttattaagtcctccatgattaattatactctctcgaattttctcggatttttcggagctcaattgttaattttaatcatacaaagaaaagttcagcaattatttaaatatcaaattaatcaggtaatgatctaattataattgttaagtgattttcttgtttaaaatccttaaattataaattgttgtttaaaaggaattattagaaatgattttaaaagtttaaaagagaagatcttttcttttaatttgctaaatctcaacataaaaatgagctagataaaattttgttaaatactttgcttgttcctctattttctagatttttctgggaattatttgagcaaaggaagtatttttaataaatgaaacatcatttcacaaattatttttaattgaaaaagtttttaaaatctcctcctaggccgttgggccgaatcc

SEQ ID NO: 2800 - DNA, 2183 bp, Oryza sativa
ccgaatcgaactcgttttgttttatctctaaaaaacgagtccgagttcttcccgattcgattcctctcgtttgcgacttgatctcttcgattcgagctcatataaaccttccccgtgatctcctctttcgtttgccccctttcctgagtcctcccgtgcctcctagcgccgtcgcgacgagctccaagtccgccgccgccgccggccatcttcggcatcgtcgcgccgccgtctccgtcgtcgctgtcggtcgccgtcaccaccgttaggtgcgccgtgaggagaagaagctcggccgcccctccgtttttgccgttgaccaccggagcgccgccgtcgccgctaacccgagccgccgccgccttcttcttcgtcgccggccgccgtcgtgcatcattttgggtcggggtgagtaccaatgggttcgcctcgttgccctctacgcgtaggtggtctccgtttccgccgccgatgtccctagcgccggcgagctcgtcgtcccgaaagctcggaacagctcctgcggtcggtggagtcgaaagcgtcctcctgctcgtcaccaggtccctctgagcgactcctggagcctggcagatacgtctcgccgctgcctgactgcgagccactggagctgctgctgctgagatcgctgctgccactgggagtagcagacaaccaacccccggtgccactggctggacctctggcggctgacgctggagcgaaggagagagcggacgcgggagctggagctggagctggagctggagctgcaggaactgcgggcagaactggaggtgctgcgggagctgctgctggaggtgggtttctgggcgcaagctggatgcgcacgggtgccgtcgtcgtcttgcggggcgtggtgcggatccggactcctcctggcgctggaagaccctttagctgagcgttctccttcttcaggcgcgctatctcgtccttcaaagcgacgatcctcatgagcttcccatcgttcaaggccttggtcgccttgtgcaggtccgagtgcatcctgtccaatcccctcatcacagcacacatgtgaccgaaggtggtgtcgttctcgccagctgtcggacggaaggagctgacgccatcaccgttggctcgactggggtggtagcggtacgccgtgtcgtggaagatgtagttgtggcgctcccgtagtctggccatcatcaagtaggctgcctcctgacaggcgtgatctgctgtgcctccagatgcctcgaccgccatgttggcgaggcaagtccccacgtaaccatggacctccaagcggacacggtgaggaagctcgccactgagcggtggaatggtcgtgtactccggcgcgtcggggtagcccaccaccagtgtcatgcgtgccaactctgccacgaaatcgatcatgccttctccgcggtggttgggtgggtgaccggccatctagagaagacaaaggagtaggatcaatgcatgctcaaatccaaatttaaataaagcaataaaagactcaaataagggaatcaaataagagcagaattttatgcatagatcattttacatgagagcgaataaataagacagactcacataacgataaaataatgagaaattagatacataataataataacgaacaaagcataaataccttgcaacccatgttacagagctaggacctaatgcattgcacccatcaaaccccaactaactgacgaataaatcccaataattttactaaaaccctagactgactcgttttgaaaaatctcacttaaacgagcgaccaagatttttcccttgaaccacaagaacagatccccattttcccggaacaaaaccaattgcaaagaacatatgcaatgacaaggattcagagggctcttaggtttttccatttggcttgtcctacggtcaaggtcggctctgataccaacttgtcacgcccagaaattcccgaatagaattccaagcagaatgtgcaataaaatccccgtccaggaccagccggggtacacaaacgacaatgttgacatacagatccacgtcttacaaacatcataaagttttacataaatgcagcggaaggaaagaaagacaacaggagctaagccttgactaaactgcagcgggaacaccactccacaggcatcctcgacggcaaggacgaagcctactcc

SEQ ID NO: 2801 - DNA, 333 bp, Oryza sativa
acggcgtcatttattaaaaaacggagggactatatataagaacgtcaaagcaagctctctactactccgtcccaaaatgttacggagtactacagtactagctaattaatcagagggattgatcttgtgagcggatgcgtaatttgcaggtatgaagaaaccgacatgtcgaacggcaggcagtactgccagaggccaccacgtccgaaagtaattgatttgcagtagtttctattggatcaacaccgttttcagtgtctaagatcacagggatatatatactcatacatgcatttcgagtgcttgtaggagtagtatgtacaatgccagggg

SEQ ID NO: 2802 - DNA, 340 bp, Oryza sativa
gcagaagtcgcaggacaagccggtgcaggctgctacggtactgaagttcttcgagtgggcatacaagtcgggcgacaagaccgcctctgacctggactatgtggccatgccggaaaatgtgaaggcagtgatcatgaagtcgtggggcgagatcaaggacacttcgggcaaatccatcgccctgaagtaagctgagacggtggtccgccctcccgggtgggccaccggttcccctgttttacaaggcaatcagacgtgtccagtaccatgcccgtccacgaggccccgccgcttgatgcggctgttggcgcatccaggggttcacccccgccccgtacca

SEQ ID NO: 2803 - DNA, 2070 bp, Oryza sativa
agtaattattaattcttttcctatcatttaattcattgttaaatatacttttatgtaggcatataattttacatatttcacaaaagtttttgaataggatgaacggtcaaacatgtgctaaaaagtcaacggtgtcaaacatttcgaaacggagggagtataaaagagaaaaaaaatattatgttacatacaccactcccatggagaggactcggattcgctatgatacatattcgccaatttgacagatgtggatggaaatgtggatgtcctccgaccgtcttccgtatcgtaagcgccatggcgaacttcggagcctcccttctcacccttacccccatctcaaacgggtgaatgccactggttttttttggtttgaaggatcaactggagctgctgcttcatattctcaggaattcaaccgtgctcaagacaatgaggatagaaccaaagcagacggtagttgctggattttgtcctctgacctcagtagatgcattggcttctgcagatggttacaaagttgctaagaaatgtatctttgcaaggaagatcaccgtggtgttgtccagattgcaggagttcggtttgcgaatgctccattgtaccattgatccacaacggcttcatgcaggaatcatgcctggaagctaaatacatagggtttggttattttgatggagctgacaagatctatgcctcgtttctgtgatttgatttatgccatgaagtatagcaattttatccctttgatgcatcatttttttgtttttttagacaaaatcagtggtcaaacatggagaaaggagacgaagataaaggtccatgaacactgcaatttttgtttttggcattcctcattatcaaaaagcgctgaacatcatcatcaacaaaataaaataaaacaaataaaaaaatagaaaagtttaattgctatacatcggtgtttgatcttcactgaccagtataaacaaatttccatccttttttttttccacctccaacaaccaaccagaatgtctgccatccgtctctctcaactcgttctcatgacaccttatttcttcctcttaattaagcttatgtaaaaccatcatcaatttgttcgtccattcatccatccaaccaatcatcatctgtagccttcatttcggttcatgtttcagcgtcatgagttgagcaaaaagcagtggcagatatacatatttgtccatcaagccattgtcgtagtctattggcagctcgcgaatcgcgatcttcggcctaggaagcccatcacttggcatgccccttccaacaacttccctgcaacatgaagcaaaatgatttttaggagatctgaaaggaattttaaaataacaaaccgtaaagccatggagatagatgacagcaattgtatattagtaaatactaattagttgcagaatcagtactgtgtctttatattgttgtgtcggtgttaaattggttccatcaaattattggtactaagtcacatcaccccctgatgacaataatctatatctatcaacagtgacccttgtaatctttgcttgtaatctttgcttgcaatggacatcacatttggctattccataatacttctagaatattatggcacaagtagcaagcatctctacattacatcagtgtcaactactcctgtttttcagttgtctcccattttctttacatcccataacacaattcatagctatgtcaaaattcaggccacgatcgcatagtagtaattaataataggctaatcgctatgtcaaaattcagatattgcaaagtagtaaatcggataaaacaatggtgtttcagctgcatccattccagcgactgtgcgagagagagacagaggaagcgaggcccagacaggtggagtacagccctcccagacacagacgagcggggcccagcaagaacaacaaagcgacaccaacccgggcccacgagtcagcggcgtaactacccccttcccgaatcacgagggcaccatgaaggcatgaatgatcgatccaccaacgcacggaccgtcacactgacagctgggccccatctaag

SEQ ID NO: 2804 - DNA, 650 bp, Oryza sativa
gtaggcccaccgccctcctctatgtcagcggcttaggtgccaccgccgacacctccttgcccgtctgtgtcccccgcccaccgccgaaccggcgcctctcatggacatccctgtaaacccagcaattcccccctcttccccctcccccacccccatcctagcccaggaccctaaaccattctactgttttcgtcggggtcgctagagttggagaaggtgttgccggagctggaggggaagagctaaggttaccggagcacaatcgtgaagtaaatctcaatgtcagtaatctgcatgattttaacataaaaatcattcgctagccatttagccattttgatcaaatattcagattgattgacgcatatattctccggacattttgatcgagcaacaacagatcaattaattaatcacctgcaagtcaaacacaatttttttttatctcttggttaacgcagagatctagtctagttgtagtagtgtggcactgtggcgtccttggcacgtgtggtgggcgcgcgtggcgcacgtacgaacgtgtgctgcgcgacaccccacgtgccgcacgatccaacgcaatacgcaggtggctacactccaaaagaaaatgtacgtgtatatatactcgatctgtgcaaaaaccctca

SEQ ID NO: 2805 - DNA, 1593 bp, Oryza sativa
tttggaaatcgacaatggatggtgtcttcaccgtcaaatccttttataaagctctgaaattgcaatgagtcccttacacttcttaaagacttttgaagttgaaaattcctctaaaaatcgaagtttttaccaggttcctcttaaggagtagtatcttgagaaaggataatttgcttaagagaagttgtaaaggaaaagaagtttcaattatgtgttgaagatgaaaccattgaccatacttttttgaaatgtgtcgtatggcaaaactctcatatgaagtgcaatttttttttggtggatggttaatgcaatttgatatgaagacgggaaacctgatttgcagttggagtatcagctgtgatttggcctatttggggagcaagaaatgcggctggaggaaaacgaatgaagacttcaacaggggcggggcgcggctactaaggtcccgttcatttaagtggtaggggagggcaactcagtagtttttccgttactgacacgtttttcaatatgctaaacgatgtgttttatataaaagttttctatataaaaaagcgtaaagaaatcaaataaatcattttcaagtttacaacaattaatattcgattaaccaagcgctaattgatgcggacatcactgtctcggatacacgtaacaatcctccaacggtcattcaaggaccgataacaagagctcgtgcgcgacaattaaatttagaggtgagttcattcctatgttcttctttgtatgaattcaagaatagattgctacctaataattatattgtgattaggaacaatggaggggacaaggagacacttggagaaggacttagagccatggaggatcatcggggacgtccaagtaaggtggaggcctaaaccaagtcgacgtcgggtgtaattcggagtccaggaccagtctgcactaaaatggacgcccaggtcgcatacgtgctcggattggggcgttctttatatggatgaaaagctaagaagataacctttccaatggttttggtcccacgtccaaattctttccgagtcaacgggaattgaccgaacaagttgacatccagaatctgttccggtgctgcgtcaccgtatttgggcttttggcccgtgtatcgtgttggaacccattagggttacgtcaagaggggtttgcacgaccctaaactctatatatcagtacccgccgccgtctttaggtttttgggttttgcttagattaatctatcaagaacagtttcgccgctagatcggtttgtaagaccccaactcgtgagcttaatcattcatctgcaattttggttgtttttctatctcgttcttgtttgtgttcttcgattggcaaacaggaattagccttctcggcgaggtcatccgcgtttcgacacgggtgataaccagaggagacgtggtgctgcgattgcggggctcaagagcgtgcgcgttcaagaagccggatcgatttgtgtcgcgactccgtccaaatcattgtttatcagaacctttcagaagatcaggaaccctagtgcacatcactaatggattgtctcgttttaatacacacagcaaatgtgagatgtat

SEQ ID NO: 2806 - DNA, 621 bp, Oryza sativa
cccctttttccctagtggattattccctttctgcatcattgttacaaattcattgtagtcgatccggccatcctgcagagacgaaacaagagagaagcagacatttgatgtgattcttagtcttctaggctttcagatctcataatgaatgaaatgtccacttacattgtcctgatcaatatctttgatgatatcctccagatgtgcatctcctatgccaaattcctcacaggctttttgtagctcatcttgagtaatgtaaccactgctgtctttatcaaagtatgaaaaccctgcaaaaagattatcttctctctcaactttgttcagatgcatagttgcagcaatgaactccccataatctattgaaccactattatcaatatcagcctgcaagtcgaagaacatatgcatttattatatcttggcccaaaaatatatcatatattacagctaacgtgcctcacaacaatactttcttagaacataaaaggtccattctcacgtactgggaaacttatcagaaccacaaaatttggatgagatacaatagatttacaaataaccactaccaacgtcagaaaatctttgcaagctgctaaaaaaggatgtcaaatacac

SEQ ID NO: 2807 - DNA, 11138 bp, Oryza sativa
  unsure (1)..(11138): unsure at all n locations
tcatatattacagctaacgtgcctcacaacaatactttcttagaacataaaaggtccattctcacgtactgttaaacttatcagaaccacaaaatttggatgagatacaatagatttacaaataaccactaccaacgtcagaaaatctttgcaagctgctaaaaaaggatgtcaaatacacatattttaacaactatcgtcaagtttggtatttgaatacactagcttaacagagtgtttcaagatagtggactcagaaacaaaaaacaaaggtttgttttagcatatattgaactggaaatagaaggggcatagtcatgttagaaaattcaccgcttccattagggttgtaatttccgaatccttcaaattagcaccaactctccgcaagccagtttttagttcctccaatgtgatctgaccactattatcagtgtccaacattttgaacatttctctcaatcccgcaatttcatcttccgataaattttcagcaatgacctacagatgccacacagaagtgcatcagtatggaacgtaacttgtactttggtagaaaatcaagcaaaaatatactcaatattcaccctaagggccatcttctttagcttgttcattgctgaaaattgcttcaatctagttaagacagcagaatcaagaggtttatcaggagcaactccatcaacacaaacccaaggatgacctgccaacataaagatgggtcactagagaaggctctgacatgatgctctgcaatgtgatatttatgcttacatagagcttcatgtgcagtcaatctctttctgggatcacggtttaacattttcctcaccaaatcctttgcactgtctgagatagcaggccagggatcagatgaaaaatcaagatctcctttcaaaactttttcaaatatcccttgttcagattctgtgcaagcaggccagcatccaaaagaacaaaaaacagaggaaaactgtcagcatcaagcagaagcatgggtttgaaaaggcagcataaagggtagacatatcccaccatcccaaaatggaggaactccactaagcaagatataaatgattacaccagcactccatacatccacctcgcggccataatgcttcatcagaacctcaggtgcaacatagtaaggacttccaacaacatccgaataattttcgcctgtaaagtcaatcttaatgcattagagtttggaaaagatgcacaatcagtagtatttcagtgttctaaaagaaggggacagcagtgtattagagttcatattacagtactagttaagtacattaaggctctgtcacatcaatgcattaattgacaaacaaaatgaaaaggaaagatggaatgacatcccattcccttggcattttaagcaacatgaatttcaggatcaccgcaagtacagcatgcattcaattaagaagcatatatcatagtgaatggatatgaaagttatgtgcacaagagtttgattgcagattttggcaatttgtgataaaaaaaatcagtctctttctttgtaatccaggaaataaaaaaaacagtttcacaatactactgggaccaaaaaagggtttaacagatagtcaaatacacatctatctgaaaaacaaacgtatccattgcaacatatgtgcagttatgcaagaagtccatctagttgtaactagaactcaatcgagaaatcaaagctatagggggtcgcaatgcaccaccattacctcgctaagcttgcaaaatcaacttaactagcattgcctatggtgggggtaaaatccgcaattgccaacaaaatcttgcatcttacaagacaacacagcagcaaggatcgagaccggacctggcttgaagaaaatggaaagcccaaaatcgatcgtcttgagtggcgagtcctccttatggttgacaaacaagaagttctccggcttgaggtctctgtgcatcaccccgagcgaatggcacgcctcgacgacaccgatgatcacccgcgccagctgcgcggccgccttctcggagtagtgcccgcgctgcacgatcctatcaaacagctccccgccagcgcagagctccatgacgaggtgcacggcgacggcgtcctcgtacgcgccgacgatggagaccacgctcgggtggccggcgaggtggtgcatgatctggatctcccggcgcacgtcctccacgtcctcctcgctgaccagcttccgcttggcgatggacttgcaggcgagcaccttccccgtggccttctccacgcactggtacgtggtcccgaactgcccctgcccgagcttcttccccagggtgtagaggtccttgagccgctcggagtcgcgcttgaggacggagtcggcgaggagccccgcgctctggacgcgcctcaccttgggcttattcccgcccttgttgggggtggaggaggagaggtcggagtcggcgatggtgacgcgctcgggcgccgtggacgaggtgacggaggagtggctcgactcccgaggcgggtaacccggcggctgcgacggctcggcgcggccaccggggcgccagagcacggcgagggagacggagtggaagaagccgtggcggtccgccgcggagctggggccgacgcaggtgttccccatcgcgccggcgaagtgggggggagctgcggccgccgtaaccctaggcagccggcgacggcggcggcggcataggcggcggtggcggcggcggcgagggttggtggatttggatcggaggaggattttggtggaggagaggggagatggccggagggggacgaggtgagctgggccacgtcccactgacatgtgggccacctcagccttgctggcccacttgtcagtgggagcagcggcgcccgcgggagaggcgatgcgatgcgcgccagatcggacgcttacgtgaaacggtaagtgattggataatttctttttgaaaaataatacacctacaaaaaaatatttacaaacagttttagaaactgatagtatgatttttcataacaacagtacctattagtaattaaatccaacggttaagatttttattggtaagagtttagtgaagattttttttttgcaaaaaaaaatgacacgtacgatactgatgtccgcaacaagtcatctcgtctataattttgtgcagaattttcttctctaccgaagcgatctcccttgtccgatctctcttcatttttaagccacttggcatgcaatttgcgatgcgatgcggccgcgggacaggcgatgcgatgcgtgccagatcggacgcttacgtgaaacgtaagtgattggacaattccttattgaaaaatactaatacacctaacagaattatttaaaatattttagaaattgatatgatttttcataacaagagtacctattactcactctatcgtaaattataaggtttataattttttttacacggtcttcaataatatactttgataactaatttattttatattgtgttatcaataactataaagttaacataagtgaaagtattttaaagtactaaaatagtgatataacactcataatacttagcatagttattgttagtataatgattagtaaaaaaaattactagtttttccttaaaacaaaggtttcttataatttggacggaaaaagtagttaagatttttattagtaagtaagagtttcgtgaatattttttttgtttgagaaaaatggtacgtacgaaaaaatgagattaggaggaagagttatccatacaaacaatttttaagaaaagattatgagcatgctgacatcggtgccatactaccaagatatgtacgatactgacggctacaacaagtctataattttgtgcagaattttcttctctactgaggcgatcctttgtccgatctctcttaatttttaagccacttgacatgcaatctgcttcatgatttgacatttttgactgggtttttgtattttgcgtatcatcgtgaatgtgatgattcaagtgggtctgtgggtgtaaatcttggacgtggtcgtatcaattttactacgtgcattaacttaattttgtaaactagttcctacgttaagcaaagctcgctcgtcattcgttgaggtgagaattgtatcgcagaacgccaatgctaatggggtaaggattatttctacggctaatccttttatgtgtttgcgaaaaaaattatactgctaataattgacagaatcacattaaaacgcaattgaatctgggccgcgcgcacgccattgttaccgttccgcacttatgggctgatggcccaactagtttatgggctgcgcgtgttccgcagcgacgttacagcccatgttggcacgtgctccgcgatactggtccggcccaactgaaatggctttcaagtaaggagcggggcccacttgccagtcatagagaaatcgaagaaaaggccatgcacaccaaaaccggaccggtagacgacccggtcaccctgctggttcaccggtttgacggtccaaccgtgaaccggctggtcgaaccacggttcactaactacatgtagcatatgtgtttgcatacaagcacaaagatctgtatggtaggatggctacgggaattggcttgcaaacaatcgaccaggggtcgactccccacaagcgcgcgcatttccttcaatttgtgctaaaaatatcaagcccgcggacaagtctaacacaagtccggtccgaccgaaagcagtttattgcccgattcaacacaaaaccagccggttcaggttgaacagttgcatgtccggtctttctatttgaccaaaccgtgccaacctctagttccggttgaacagccggacttcaggttgaacagttgcatgtccggtctttctatttgaccgaaccgtgccaacctctagttccggttgaacagccggtccggtccggttttttacactaggcaccaaaccaacgaggattcctgccgttaatttataaactgtgtccaaattttctactccctccatctcatatttaagtagtgtttgcaacacaaaacaaacatattatcaaattatattcaatgttagattaataaaaactattttcatattttagatggtgttaaatttttatatgaagttgatcaaacttaaaaaagtttgactagaagagaatatcacacgacttataatgtgaaatagataaagtatattatatgtccaattctatcaaaatatgttttaaaaaaaatgtcttctggtacttgcatatctgccatacttcatatactccttgtaggactataatcttacagtttttttctctactatatcaatatataatacttcaattggtaaaaagaaaattctacgcgaataatccaatcaggatcgatgttcttgcctttttcttttgtctccttttacaacatatatacatatatacacacgtgtatgcattatcttttatgaactgctgctatatattagatttttctcaccacaaatccacaatagtatggtcaaatataactatcttgagctacctggctatctccttcctccggccggccgatgcatggacgtatatgcatcatctgcgacgcanaagctcacgtggcttgacgacttcctatttttattagcatctatcgcaaattaattcaaagtttgtcgttgtgaattcgtgtgtttaaacacgcatgcataccgaagcagagaattgcggctgcaactgatcaatttgagatttgtgaccacctgaaacgaagcacccatgcagctgcgtgtgtccgggaagcatgcatgtatgcactgtaattaacaagtatttagatcattaaactaatactaactatatctaacgatagatcttgttaaggttagcagtagtgcttactccctccgtcccaaaatacttgtcagttttttttaacgtttgattatttgtcttatttaaaaaattatagaattattatttattttgtttgtgacttgctctattataaaaagtacttcaagtgtgacttatcttttttatatatttatactaatttttttaataagacaaatgatcaaacgttataagaaaaaatcaaaacgatatctaatttggaatggaggtaataattagttgtgcaggaatacatgtgatatgtatgatgatttgatctgcataataaatacgcagcagattaattaggagaaggctgcttggaacaatatttaaatttagtcagaaaagaaaactccatgtctgaccttttcgcgcgccttttgacattatataagcgtatcttcgtgtgttggtttctactactccacgcagcaaaaacatctgacaagaacaacgtctcgggcacgcagcgatcgatcgaaccatgtcgtccacgtcatcgtcgccgccgccgccgtcgaaggcaaagaggcgaggctgcatccatggcgcaaggccgcagccgctgatcgtgtcgtcggcgccggcggaggcgagccggccgtccaagaaaccccgtgtcagcggcggcggcggcgacacggggccggtgatcgtgtacgagctcacgcccagggtcgtccacgtcgagcaggaggagttcatggccgtcgtgcagaagctcaccggcggcaagcagcagccggcggcggcttcaaccttgacgacattgccggcggctgatcaggtggccggaggtgatcacgccgctgcagcggcggccgccgccgacccactggtgctcacgcttgggcagcagcgtcagcctgctccggcgccggcgatcgacggcgaccatccggcggcgccgcctcattctccaccggcggatgcttttcttctgtcgcccagtagtttcttcttgtcgccaaccacgatgcatgcgttacaagagttggctgctttgttctaattagctctgaacttctaatttttggatcagaatcacaacagtttgtgcaaaaaattttcctgtaattagggaaaaattagcacgaacaggtgctctgcgctcagctcgccgactgtatgcattccttccgttcttcagcatctgtacatttcttgatctcattctgataattaacaaaaccaatacaatttatttgttgattttgtttgattaaccaatcagctttgctcgttaattagtcgttactactgtattgctaagtagtgcaatcaaataattaacccaagcacacaacctcatgcgcaaagagaggcacgatccttcactctagatcgtctccctattgctgctccatgtttgtcaatacaggatggacggcatttgaaggggtttttgttgaaggcatcttttccaaaacaacctcaaaatattcctccctaaggcgattttgataaacatctttttaggcgtttttaaaaagagtcgtgcatcactttttcctgacgcaagtaaatatagtgtttctcaaactgcctctgaaaactattcatgttttttccttatcaaagcattccaaatcgcctcctaaattatatcatttcgtactatatattactgtcaacaacagcggacggtgatatacaatggagaagttttcactgttagctttcatcgagcaaatatatgggcccaaactttagcctggaaattctgagagttagagctaaaaggttgacctaaatcttgtaaatgtactttaggataaaacaaaaaatgacttaattaggctgtgaaagggcatgtggactatggttcattaccaccctagctagcgacatgtgttctacagtactatcccggcccactgctatgtaggtcgtacgtactctacgctatatatggttccgatcaaatagtgtatgggctatattgaccacattgtcatactggtccaactgaaatagacactgaccaagtagttgtgttggacatgttatgtaatcgacatagccataatcacttcgtcgcggacaacgacaaggaatgtgactggcggcgaaagcaacccagcgatgaacagttggagcatgttgcacactaggtgtgcctcatgacatgttgacgcctgcagccatgcgcgaaggctccatagcttattgtcacacaccatcgtggcgcccacgccgctagcgccaacgcttctttttgttgtttttgttcttcttcttcttcttcttcttcttcggaaccgagccaacattgttgctatttatattagggaaaagtccattttacacccttgaactcttatgcttgtctaaagtacacccccgaactacaaaaccggatataatacactctcaaactggcaataccggacacttaacgcccccgggctgtttttaccgtggtttttgacacgtcggctgccacgtcggatgccacgtcaaccctcgccacgacagcgcacaacataatatgggccaagcccatattctctccccctctctctttctctccctgccctgttcgctctcctgtctctcacgaccgttggcggcggcggcggcacggagctgcaagggtgacggctacggcggcggcgtcaaactgcgagggccgcggcggcggcggcgtcaacgacggcgtggagctgcgagggctgcggctgccgcgtcggtgtggagctgcgaggcggcggcggcggggagctactgcgagggcggcggcgctgtcccgattgcgcggacggtcgccggttgaagcctctgcgcgtagtcgtcagcggaaggttcgggcgtcgtcgtcgccgcatgcgcctttggatttggcttagcagggaagaagcagctcgacgcgtggtggaagcaacgacgagcactggtcttggtgtacaatctgggaagtcttcacaagatacagtcaatgtaggttaattacatcatctgaatctgatacctgaatttgtgcatactaacattttgctcttctctttttgcttgacatcgataagaggagagtgataaggacttctccccgccaccaccgccgcctcgcagctccacgccgatgccaacgccgcagccgccgcggccctggcagctcgacacagcagccgtggccctcgcagctcgacgcagccaccgtagccgttgccctcgcaactccgcgccgacgccgccgatgcagccaccgccaccagtcgtgggagagaggagaacaaacacggcaaggagagagagggagagagaggggggagagaatatgggcttggcccatgttatgttgtgcgctgacgtggcgagggctgacgtggcatccgacgtggcagccgatgtggcaaaaaccacggtgaaaacagcccggggggttaagtgtccggtattgacagttcgagggtgtattatatccggttttgtagttcgggggtgtattttagacaagcataagagtttgagggtgtaaaatggacttttccctttatattactaggagtggcgggtatgtagttgtttggagttagcgtaaggcagttcggttgtggctcctttgtaggtcttgcgtcgtccagttttgcctcatggccgtcagccgggtgctagttccttcgacgatgtgtacagtttggcattttgttgatgtatggtggcttgttttttttttcatgtacggctgtacaacctctgatgctataatcttttttccctactacatcaatatgaaactttgtgctgtttgtgcgaattgtttttttgaaaaatatcatgagtgaaaaaaccgtaattcgtggtttttaagggaaagggaaatgcacgatcaaggagcagtgcccacttggcaacgacagagagatggagcaacgggatgagaggcaaagccgccaaggatcctgattttcttcttgctccttattatccactaattgcatccagattttccaaattatatccaattttattagtatcagtaaaaacaaatgtgcctcctgcaatcctgcatgcatgccttacattatatatttagggattgtttaggttaatgtcatttcaaatcatatataccattttttaaagctattaaatatacatatcaatttagttttttttaccaaactctggtaaatacataagaaattttgctaaaacttgataatattatcaaattgtcaaaattttagcattgctaaaatttaataaaatttattttggctacaatgccttagcattcgtatacatataaagtgtaaacacaaatttaccatacgacaagtacatatgtttattgcctttgtttctctcttttgcagcgtataaacacatatctgcatgcgttgtttgacctgcctacatatatttaccagcgtattagcatagtcaaataggagtaacaccttgcagatattatctgcctccttcctccggcctccggcccgtctatgtacgtccgtgcgtgcatcatccaatacgcatagcccgctcagtctctctctctctctcgttgattaatcgctggttaattttaatcaagcgtctcattttgaaactcattttaaacaagcaaactcagttactagtagtactcctagatgcagctgttgacgatcaaattaaactgactttctgatcacctgaaacgaagcagcaatgcaggcagcaggcagcaggcagcagctagcgtagacgtggtagcgtttatcctggaaggaagcaaccatccagaaaagtaatacggataggcggatagctagtctatacaaatgcccccttcattccaaataaattcaatcatagctacaaacattgacatatatttatctagattcataactaagatttatctttttttatgacggagtagtactcctaagtaattaaatcactaaactaacaccaaccacatctaagtgacggatctttgttaatgttaaggttagtatacgtagttggtgcattattatattgcacaagtttgataattaatttggtctgcgtatagtcaaatgcgcagcaggcagattaattggagcaatatattcaaaccttttcgcgcgcttttgacatcatccttttgcttggcgccattatataagcatctgccttcctgctggcttctgccacacgcagcgagcgaaccatgtcgtccacgtcatcgtcgtcgccgccgccgtcgtcgaaggggaagaggaggccaggcggcatcatccggggcccgaggccgcagccgctgatctgttcgcc

SEQ ID NO: 2808 - DNA, 3783 bp, Oryza sativa
acgccggaccggtgatcgtgtacgagctcacgcccagggtcgtccacgtcgagccggaggagttcatggccgtcgtgcagaagctcaccggcaatcgcaagctgtcgacggcgacggcggcggcggcggcgccggtggattcaaccgtgagatctgcagatgatcagatgaccgccggaggcggagctgagatcactgacaccgccgcggcgacggtcgccgacgaccaactggcgctcgcgtttgggcagcagcagcattggcctgcaccaccaccggagattgatgatgacaattcggcgaatcttccgtcgccgggtagcttcttcttgtcaccgaccacgatgcaggccttacaagagctggcttctaatttgttctaattaattagctcgatctaggattgcaattttggggtcagatcatactcatacatttaacacgaagaacagatgcacacagctatgctgatgttgtatatgtaattaatagcttgtttcagttcggtccttcagatattttcctattgatcttgagcaaagtaaaattcatttgttgatgaattagttttatccaatcgaccctccaagtttgcatttttgttgatcggtacatatatggttaagtgacagactaataacccaaagaaaggcacgattatattaattcatcgagccgatatttcgcttgcatttgggcgttgcagcttccctccctcgtatcgtctctctgtttatatcgtcgttgatgacggcgggcgggtggtgacggtggagaagacttcgccgtgtcgccctcgagctcaacctccgcttcgtgcatcacggccagtgttttccattttggaatgcatgaaaatttcggtaagcaccgaaatttcggaagaactttttttaaaatttaacatagttttactcaatttaaagaaattatgaccaaattcacaaatatttgaaaaaaaaatccaaaaatttccctcgaaataattgcttgccggagggggggggggcgaaatttccgaaatttcaatctctaatcaccaccggcgactctttttttttaagataatggatattaaatttggtgtttacttcaattgaagctaccactatttattacattttttttggttcaaagcccaaacacgacaaaaataatcaaacatagatcctcgaaaaaaaaatcaaacatagatgaaaagatgacgcaaccataactacgtcaaccaaagaaaaatattaacttattcaaagttcatgtcgtcttcgtcatatgcacgttgccttactcacagtattcatggcgtcgcgtcggtgtcgagccgcgcttttcgatcccctcttgctgcaatgttgcggctcacatccttgacagcgtcggtgaagttggagttggaaactcctcgtcacacagatgatgcaattgcacatgtggacctcatgtgtgatgcaatcgacgtgccggcccatatcgatccatgggtctcatcggttgcacatatttcctaataagccgttttggcttatatgtaactcaagttgcacaaattaatttatatgtaaaacttttatatatttgttcgtagagatttaaaagccaacgctaaaaagaaattacgctgaaaatatcttaaaatcaactcgaaaatcaaatttgaaaattcaaattttgacttttgatttggtttattagactaaccgatgggctccacgacttgctaacatatactaatttttttcttgagcttcgtgtctctcccaattatgtatattctatgtaaacactttcctaggaattacacgactaaaagtatactcctctggttatactctttatactcctaggagtataattcaagatcaaccctttatatcttttggttatcaatagctttaaaaaatatttagtttaaagacactagaaatatatatatagttatcttacttagtataatggaagtaaaaaaaacatatttatgtattatatatgttataataaacaaatataattaaagatatattttagagatcatatcatcggtgtatgtgacaatacaagtatatgttgttgttccttttgtctgtcaattttgctccgcgtataaagacgcatgtgtatgcactggtggagaaaccgtttacagtcccggttggtaaccctcctttagtctcgattgtctaaccgggactatgaatccgggactaaagatagctatctttagtcccgggtgaaataaccaggactaaagatcgatctttagtcccggttcgtgttaccaaccgggactaaagatcggtcagccacgtggccggcttaccaaccgggactaaagatcggtgcaccattttttttatttgcatggccctgtttgctgtatggttgattatatatatatatatatatatggcaccttaaggtgccacgaattaaatggcacgtgacacagtctccacacccaccgcctgcgcgtcccacccccatcccccttcccgtaccaccaacgatcttaccggtagttaaatttttacttctatatatccacatgatagcccaccacatatagacagaatgtacgttgtaaatttttagctgaacatttttttatgttcaccactcgggaatacgatttagtgtatggagcttacatatcccatttgcagggaatatagtcaattagagcatttttttatctacaagtatttttcttttaatcataccttattttttttattatttcttatttcttggttcaagtttagcaaaaaaaaaaccattttaatttatttttaggacaatacaattatttttttaactgtcgtctatatatcgctaatacgtcattttttatttgaattaaatgttctcatctgcaatgtttgttacgaatcaaatgttcctttttttcaacactgttaacagtgaaatttggtaatcggcaaagacattatcggcttagaatcattatcgactgcagcatctcggaatcagccgatgggagttatcaagtcgccaatagtcggattcttgctatattcggttaaggaaatcaatctactaaaggaagcttatccctaagtgaccgagtttaaagaggatgcggcatggcaatttatctattaattaggaatagtttgttagtttccttttatttttaggaaagtgtgtttagtgtccgataaggactttatgttttccttttatctttaggttagtttctttcttgtccgacaaggacttgtatcaaccaatgggtataaatatgtacactcggggtctatgtaatctatcttcatcatcaatacaattcggcgcatcgccaccttttaccttttctactttattttatcgtccggcgggacttggcacccgacgcggggctgcatcgtcttcgatctccggcaaagggataagtccaatgttccgtcggcccaggcaattgtctcatctacatcggcatcgttcaaggctgcattagtacatttgacctctttgattgctctggtttggatgatatatttgcctacctatttattatatgtctctgttaatctagtcttagcatatcaatttagctctatcggctgcttttcgttttagggtttctgccggtatcggctaaatcgcggtgctagattagattagcctaggcatctaccaccctgaaaactcagtcaacggcttgattgtctagatattatgtttcttttcatacttagtgctgcatcagttaagtttgatctactaagtcgtgcttgaccgctaataagggtttcatcggggttt

SEQ ID NO: 2809 - DNA, 5308 bp, Oryza sativa
aacataatttccttgcaaattctacaggaacaatgtatgaagaatagataaaatatgtataatactataacttcgatttgaaggatggaataacagcgacttcacgctccacgtattgctgagaaaagaaaattagaaacgttgttccttcatgaacagaaatgcacaatcccctcgatgaaaaaattgagcaaaagaaaccgaggttaccttcaggtcgatctggatggtgtgcttgtgtgtgtcagactcacacacatcaactatattgattgacaagaaaatatctggcagtcggccgccgccggctggggcggatggggcgaggtcgtggggatttgatgcggagtcgacggcggcggcgttggtggcgaggtgaggaggcaacgcggggatctggagcggagtcgacggcagcggcgttggcggcgaggtgaggaggcgacgcagccgcgagatgagttgtgggtgggcagcggcagcgtcgccggctggggcgggtgggcagcggcaacgtcgacggcggcggcgttggcggcgaggtgaggaggcgacgcggggatctggcagtcggccgccgccggctggggcggatggggcgaggtcgcggggatttgatgcggagtcgacggcggcggcgccggcgaggtgaggaggcgacgcagccgcgagatgaggaggcgatgcggcgctgccgcgatgcagggaggagggcgaagaaggcggcgagaaggcggcgtgggagaaggagtgggcgtggggagcgatctcttggatcgagagaggagcgagcgtggggaggagatcgatcgttggatacggcaaacggatggttgagattaggcgtgtctgtcagatgcgtctgctgtgtcaggaatcaagaccaccactacgaactttttaagtagtagagattatttttattctggtttgagtaaaaaaaatacagttaaagttttattaactgactacttagtactacggagaaaaagtgaaaacgcagcatgtgagatgggccttttgatgggccaccatggtgagatggcacgcgcgcacgtgggctgccgataaaggggaaggagatcaagagggttggacccaccgacatgtagctctatatatctttatatactacttaaaaaattcgtaggggtggtggtgagtcctgaacgatcgaatggttaacattcatcagaggatcctctcacaggcatcagcggatgagattttctcccacgatccacccgtcgcaccacttctcatctccctgatccgcattgcgctccctctctctccgatccgtaatttcgcatcgcactccccagccccccatccttcctcctcggcgcgccacctcctcaccccaccgacgcgccgccttcccatcccgcccaacccgcgccttcttctccggttgtcctccctctgtattgtgccgtccctcgctccgccccctccctctccatcacgccaccgccccctccataaaccataacctccctcaaatcccgatcatctgcgcagccgtcgttatcgtcggaccgagctcttcgatcatcaccctccgttgccgccgctgcatcagacccatcggaatggtggataggaatgcggacctaagtatgggtgaggggtaggacgagatgatggcggtggctgcaggcacgcccaccagcacgctcgctggagtgtggagaggcgcgcgcccgctgctgcgagtcaccggcggtgtcgtcggcatcatcgtcagctagctctgcatattaaaactataacatgagttgtcaagtaaagttagtgcaatgtaataagatgtttttaatttacctatgagaatcactattagtatttccttttgcatcaatttagtggaagatatcaaaaaacaacagaagatattcaaaaaggaactatttggatggaaatatgcatatattgatggattatcaacacctggaagctaatggtaaatacaatttatttttctcgatagcctagcaacataatttcattaggataaaacctttattcgtacctaatatatttccctcttgctaagatttagctcagggtactcttcattcaatggcctagccagatccatgctgcatgttaattatgacatgggttgtgttgtttcttggtggagaagatcgttaagtatctcctggcatgcatgccactgccatcaacattctttcttgatggctgtgagcatgtcatattttatctggtgttatcccggctgatgagcatcccattcggttttttttctttgtttacattggttaagtttgatgcatttttcagatttgcttccacggatcagtttggtcaggtagtcttgttgcaatgcagagttttagatatgaacggttcatatacttcatatcatagttgtacacagtggtttgttctaatcattcccatctgattcttgggagtagccaaatcagtacatggtcagatattaggaaggaagagcagtataatatctatgtgcagtttagttctaatttactggctattctcacacgttggcttttttattgattgagatatcatttttcttctgttttcactgcagtccaaatgtgctggtcaattcataatcgatcatcaggcctggaatttgtctcaaggtatatacatggaatagtgttccaatatgagtagtgactaaagcagattaatttgaattgtgaactcttttaccaagtgaacagagactgtcaaataatcaggtaagtactaaaatcctattgatcactataaaattacaatctcatttgatgttgcctttttcctggtgatcataggagtgaccctttttttcatgcttcaaaggtatatggtttttgtataaaattccatttctcagtatagaagttaaaactctcatttttgtctgaactaataaactattgttcttctccaagatttgttcactaagttgcaattgatagcacatttttacattttcttggcgcgtccatttgtgcctccacagctgcctcatatgctaccactaacatttcttattattcattcctatttcttagagaattgtatttatctatgcaaaattgcaactcgatgtactgaggattctataagcttttaaagattaccgtgaacacatagtgtactgtccagagaattactcagattcatttatgtctttaatggattggattccatgtaaattcagttgtaatcctttatatatatatatatatatatatatatatatatatatagtctgttcaaggtatataacttgaaatttagcatgtaccagaagatagattattatcagtagaccccaaaaaggtcacactccaattttgatttatcaagtgcatgacccttgataaatttactcatgtgtgtgacgtccgtgactgcttcccgaagcaccaaccaattttgttttgaggaaaacatcaactaactatgtatcacctaagagggtaatattcagaacttgtgatcttagaaaatgaaaccatattcttctatgccaatgcctaatggttagagaaaattcttttcaagtatacctgatagtctgatacattaaccatattcctttgtttagagaggaacattagccacattctatcctcttcatttgccagtcataaataacaggcgagatgctttaatgcatacattttttgccgttgcaacgcacgggcacccaactagttttgttttagttttattttgtgacctcaacgtcacatggaataaggaccaaattaaactagtcatatcatctaaaaccgccgttcaaaccgtcttcatacctcgtttaaattggtttcattgagacgaggaatatgttgcactggttttacgattgagtgacgcgattcaaactccacccttaggttgagttcgtttgcaggggttctcaaccttccctccctcgttttctctcgtgcatgtgtttccaaactgttaaaaggtatacttttttacaaaatttatatatgaaagtttctttaaaaaaaatatattaactcatcttttaagttttttaacctaatagttcctccgtttcatattgtaagactttctagcattgtccatattcatatagatgttaatgaaacggaagaagtacttaattaattgtatgctaatctattgcttcgttttccgtgcatgagatttaatagtttccacaccaaaggacacacccttagagcatcctaaaatttaactcctaaaaatcttggattgggaccatcccataggaaattgggcccaaaaatcacctcatacttaaagagtgcccctaattttgatttccaataactttaaactatgccacatcatctcaagtaaatcttgcttcaactgtttatgtctttccatttttccgataagagagagatcggcgctgggcgctgccaacctatggcgcactagcagcccagctaagttgtgcagcagggtgatctttcgagttcttggcagctgcagcagtggacggcgagggtgtcggcaagtttgcaaggcacgtcgagggggcaggtagggcatggccatctcacggcagggcacgacagggggaagaaaaggcatgagcggcaaaaacctcccgcgatttcatcaattgggagtgtgtggagatgcccaaaattggttcaaatagagtatggttctgggtgtgggtaaatattgggatcagctttaggcatctcttggagacatgattttaggactctatcgttccacttattggcataataagtaaaacgatatatttgcaacttaaaacttttatatacgttttcttagcaatctagaagcgaagcaaaagctgaaaaataaactacggtgaaaaacactaaaatcaactttaaatttaaggttaaaaatttaaattttgacttatataagcataagtataagccaaaagatgaggctttcaaactagattcctaaaatttatcttctggacctagagtcccaatttacttaaattcattcaatctccccgtcttctcggccgccgactcccgtctcctcgcccgccgcctgagccgatctccatcgtgcgagcagcgtcgccggtgtccccttgctgcttccgccgttcttctggtgagcatccatccattaccgacaatctttttttgtcgaatttatgttaaaccctagcgtttcttcctgatctgggatcttttttctttgcccttaacctcagtaaatccagcctaccctgagatttgatttgaacatgacgagaaaaccagaggaatccttggattgcgcagctaagaacagacaaggg

SEQ ID NO: 2810 - DNA, 1438 bp, Oryza sativa
cagtcgcgccacatttcctagttgcagaatgctaaaccagcaaaatttcataaggagagttgattcaatcctgcagcaacatagtggtgtaggcgttgagcgcatggagatcaagttcttattgcgcaatgcgcggcgggacatagatagatgggtgaaatttgccgtcgcatccaagacgaaagaactcattcttgatctatcagatcttactaggttcttcatgttgccagttatggtatttcacccatatctagacagagaaggattttatgagtttccttgtcagcttcttgatgccaacaatggtggatctcatttgcagtgtctgcagcttacctctatgtatctgaaaccggctgctgatttcactggatttctgaaccttaaaaggcttaacctgataggtgtaaatatcacagatgaaggggttcagaatttgctgtgcaatcccaatgtcctggagttccttgagatctccttctgcagaatgctcacaaagattcatgcacctcattttctgaaccggctgaagcatctgcaagtggattgttgccctgtacttgagaagatagagatgaactgtgatctggcaacacttgatttcactggttcatcaatgacacctttgatttttgctacaacttccagcctgacaaatgtgcgtttaaaaacgatgcctttttgtactggtcttgactatattgtcacaggattcatcagtaatttgccggttgttcgaatgctcgaatttcatgttgttgaatataaggtttgtgatatgaccacttagtttgtttctgtagcagttcattttttttttcatgcatataaattattgtcaactttctcattagctttttttttttgttctgatgcacgccagaaagctatttctcctcagaggcttcccaaattaatttatcttcgacatttgaagttggaaacgattgtttttggatatggcaggaagactgatatccttgactatgcatatcttttagaaattgctccttttatggaaaaactggaactacatgtaagtttttcacttccaactgacaaataaaagtatatactcatgaattagttttagccaaattttggttctgtttgcttggccgattgattaaatgcgatgtgatgtctattgtgcagtagtagtaatttgtgtttttgaacttaattaaaacacaaaacctgatcctgcattgtgcccgaacgcacgtcatactttgctatattgaagtataacagctaaaatgaaatgaatttttcattcttaattaaaacaattgggtgcacatcttatagacttcctccattttcaataaatgtcgtcattgatcacttcctccatttaagctattcatgtctaatgttcaccttatttaaaaaaatatgtaaatatcatttgttttgttaatttatttaaatt

SEQ ID NO: 2811 - DNA, 3999 bp, Oryza sativa
atgcatataggccgtgtttagtttcaaatttttcttcaaacttacaactttttcatcacatcgtttcaatttcaactaaattttcaattttggcgtaaactaaacacaaccatgtgctactacgtggtatttcatcacatagaaattaaatgcaagcgactactccaaccgtatttttttttaaaaaaagtcaacctagtaatcctcctcctagatttttttttcgacggagtgtactaagctcagtatagttcaccttacctacactgattgggtgatttgatgtcaagcaccataaaaatataatattactttagtataataaaacataaaataatttgatcagatgaaatacattctaataccacgaatctaaataaccacgtgtcccatccaactcaaccaaagtctggcgatcctctcaacaggaaggacagttcgtccgtttggtccgtacggaattaaggttttgagatttaacagaagagctttgcaatagagcatattctgatttattacactaaaaaaatagagcatattctgattattggagttcacatatcatgggtagatccatgtaacatatatagtagtgttgaggtttcattggaagagctttgcaatagaggattttgactgcagtttatacgatggatagataagggggaaaaagaaaggccaatacctgattgtagttaacatgaaaagataaaatttaaaatagaggattctgattgcagtttacatgatggataggttaaggaaaaaaaattgccaataccgtacctgattgtagttaacatgaacagataaaatctgcaatagaggattctgattgcagtttacatgaaatagataaagaaaataattgccaatgcctaattgcagttcgtacgtgaaaagataaaaaaaactaaaataaaagaaattgaaaacaataaaaaaaagaacaataaaaaaacaagaactaaaaaaagaacttgaaaataaaataaaaataaaaaacaagagcttgaaaataaaaaacaagaacttaaaaaagaacttgaaaataaaataataaaataaaaaagaacttgaaaataaaataaaaataaaaaacaagagcttgataataaaaaacaagaacttaaaaaagaacttgaaaataaaataataaaataaaaatagcaagggcccaaccgggttcgaaccggtaacctattgatctgcagtcaattgctctaccactgagctatggacccttttgtgttgaatatccttatcaaatttgttcctcatttcgatgcatggagctatctacgttttttcttgagaattttctgtgacaatttacgtgacatacatatttattataatgtatatatacatggatcattaaccactcggatgataagtttaatcacgtagtccctacgttcagaagtactatatatgagtcatattttgactatgtaattttaattaagctttcgccaactactaacccccatcaacaatatttagttttttgaccttaaaaatgatattgttggattttcatcccacgaggggatttcctctacagataaaatttatttttttaaaaaataacaatataagttaatacgggacatatcactccacaaacatttaagtttaaatttgacttatacggattacatattataacttatgaaaaaattaaactaaaactagtatacatacattcgcagttatatttgttgtagtttataaaattcgaatttgagcatgcatatctgtcaagtgatcgatatttcttatattaattatcttgttattttttaaaaaataactatttagatgattaaaaaagaaatgagtggatatcaattttttaacttatatgttgactattggatataagtttaataaaaaactatgtaattatcatttatttattgtgacatataactaatttttatatttacataaaatttttaaataggatggatggtaaaaatggagggagtatatgtatgcataaattataatcattgatttaccatgtccaagcgtgtcaatgttggtcagaatgtgttgcaacttaattggaagcgaccaaaaaattaccgaccgggaaaattcccgtatatatatataacaccaacgagatgatgttggcatgtgcggccggtgtgccgtttagataggttgagaaaacgatgatgtgagatgaagtactcaatcgcgagccacgcgcgtaatttcctttttaaaatatagaacaaatacaaacattcgtatacacaataattgtgaccgtaaattcccgattccttttattgtgatatatatatatatatatatatatatatatatatatatatatatatatgtgtgtgtgtgtgtgtgtgtgtgtgtgtgtgtgtgtgtgtgtgtgtgtgtgtgtgtgtgtgtgtgagtgagagtgagagagagaaagcctctcgtgagagatgaaaaatccatctccacaagtctatattagtggaggagtttttttaataatagaatacaatattaacctttaatcaagaagctacagccaattattacaacagtgaaacacaatcttaaaaaaaaaatgagcgcaccaactactaaagacgcacacaacatgaaaagtttctaaaattattgaattatatttgtgaatctgcatccaaagttaacgaaaaactgtataaccgttgacttaagattgtgacatacagccttcactaactttatatattcatcacacttcagtagtttgagcccaagctcagaagccagtatattagtggagtgaggagagagataggcgtcaaccaattcaaccagctgatcagtggccaaacctagctataattaattagcgtagcacgtaggagtacgcgtatatggccggcggcaggttattgccgtcgacttccggcagcaggcagccatccatggccggcttagacggcggcggcgcaccaccggcggcgtgtgacccaaacaacttgccggcggccatcgttcttgtgtttccggtgatggtggtcgcgctgctgtgttggagggcggcgaggacccgccggaacaaggacgagtgccggcggctggcccggcgccggcgctggcgaaggcggcggcggtgtcgtcgaaggtcagggcggtgctcgccgggcaggtgcacgcgtgggtcaaggaggcggagagagtcgtcctcggctgcacgagcagccgctggccctgccggttcgtgaggtgcgaccgccacggcgagcagctgagcgtggtgaggatgaacctggacgaggcgtacgaccgcatccttcccgtcgtcgcccagatcgacaccgcgcaccgcctgcatcacttgctccagctgcaggtatatgtacttcttcatatatactagtatttcacattattagacgtttgagttttgaatagattcatatatatggatttatgtgttacttatatatattcacatgtcagtgaatctagacgagtgatggatatgctaaaatgtttgtaattcgaaatgagaaggtacttcagttttgatttatagtatcatggtattctctctgtctcgaaatatactatgatagtactattttttatctcttatactttatgataaagataacagtactcctcaaaataaattcactttttaaaccaagtacctttagcttttaatagataacgccattaactttgagtacatttaaccattaatgttataaaaatatataattattgtttatttggttgtgatttattttatctgaatatactttaaatgtgatttacattttagtatatttaaataaataaattgaataagaagaatgattaactgatagtaaaagtgaatgatcatttattaaaaattggagggagaattaattaatcaatacaaactttctagatattcgactaaagccaatataattctaaacataaaaaatcaaataggagtatctaatgaagcatctgtccctggcatttcaggtt

SEQ ID NO: 2812 - DNA, 5733 bp, Oryza sativa
gtggatcccccagtggaatggtcacatctaaatttgtttatttaggtacagaacagaggatttcaaggtaataactttggaagctatgacatagcttccagaaatcagaggacatcgacagccatgtacccaatgccaaccagtcagcagcaagtgtcacctatacgtcgtatgcacaattaattttctcatgattttatttcattgatctactaaattatggggtttattttttatttctctatataagcatgcatgcaaaatgggtatatataatatagttaaaggttatatttactgttctaggcttctaatgtataatcaaaatatattatagtaatcaagttcatgcatgagctatatatgaacctgatcacactgaattccagtaaacattagttttttccccgtatacgcatggagctgtgttagatttcccaaatgatcaatctataggtattaacacacacacacacacacacacacacatacatacacacacacacaatacatatattatcagcttgcataatttattaaattgccttgttcttctgtattcacattatagctagttttatgtattatatatatgcttgtataatagatttaaaatattggtccttttttcttctttacagcccctgagaaaagacagcgtgtcccatctgcatacaacagattcatcaagtgagatttcaagccacacatgcttgcttgaataagtatattttgacaccaaattaaataatagtataaggtgctaaatatatattgataaagaaccataaatagtcgaagtgcaggtacaaactaatccccacttcaaccttttggggaatatgcatgagttcctaagacagattaattatatttctttctatctaccgcagtgtgcaatcaaaaagctccatacactactatatactcgaccctcaggtcgattgtggacacacacacaaaaaaaaaagagtaaaacctgaatataatgattgggtgtttgggggaggggggggggatatttgaactccgacaatgattaatttgtgggcacttcgtaattatatattattatgtctaggctactacttccttttgcgctcctttaatttgtacacataatctagttagggcttgttcgctttcccttcccatggggattcaaaaggggatggggtgtggaagtaatccccgaaatcccttcaatctccatgggcatgggattaaccgaacaaacccttagtgaagtgatcattttggaccacaagttctgttggtaaattttgtggaaatgtactttacaaagttttatgatcggtcgttgtttggtcattggattttggaactttttgctactagattttttttgaagtttatacttttggaataattattcttattgctaggattttgtccggtgaattctttattttgaaagaacatattgcaaatttaacttcttttgtgtgaaaagaaaaggaatcttatttcgagtaatttttttcagtaaatatgaaactctagatattttcaaaaaggctagttattgagtaccataagaaaggtaccaaaacaaaactcacaatgtaacatatgtggttggatatttatttatatttgatcttgagtttttcttcggtttttagcagtatagaggtatatacctctaccgacatgtatacacctcatgcctaacactatgatgcacaaatacctatctgtacctcccaagaaccagaaaagttttgatgttgttgaactgtatacttttattctaattagttcaactattagggatgaatatacttatatattcaaaggcaggagaaaacctcaattaagaatggggttagtgtaagtgcatgttttatgactttggtagaccttagtctattcggaaacgggaaccaataataatatttactatcatcattttcacaagcctttagtctattagacaatattttttatttaaatacatttagtttgctaaaatccaaggaacatatacattatattgactgtggcaatgtagacatacaaatattgaactgagaaaacatgtttttttaaaatggagaaaacaatttaaaacccccagtgtcaaactaagaattcatggaaatgcaattcatatattaagttgtcatacaacatgcattgaccaaaccattttattagagtaatataaatacgctagtttatctagaggttcatgttgcaagattgtaaataagatttcagtaatatatatatgagacttgttcttttaaaataacaaatcgtgtatatatcaaattgttcaatgccacatatatatatatgatgaatgagtaaattcaacttcatttggagtatgtatagctatgctctaattaattatgtgcaccgatttttttttgtccttttggtctgcagcgcgctagctatcatgtatgtacatgtatatatatgtgatgagatctattttagacgcatgcatgtaatatgtgtgttttcttaattggatcgttatgcttctctaatctctctatatacacagacgacagaaacagatatatgtttaaatgcaaaagaattaaatgcaagtatatatgttaaattaagattaaatctcaagaagctgatttaatttaattcttgtcaatatcaacagggaggagatacagaggattaaaaccagcaatcctgagattagccacagggaggcattcagtgctgctgcaaagaacgctagtactctaattgtaaatacttttctctaactaattagatgttgcaggcagtcaggacatactatactccttcatccccaaagatagtgcataaatattttctttcttacttataatacgtccatacatgccaattaactaacaaccccccccccctcctcctctaaattcgttattttaattttacccacaaaatttttttattttaattttattattgttatacggtttagttaagatgaattcactataggaatttgcttagatatatatatttttttagaaaatcatgaattagtaatccgatcatcttttgttagcatacgagtttttttttaaaaaaatatcttatacaactccttctatatttccaaaaggtagcgaacttaaaacctgactaaaaagggagcgaacttaaaaccccactcaaatacggatatgtatttccaaaatcgaacgaacttaaaagcgacttaattatagacggatgacgtaccaaagtaccggcaaaaacatcttcaatttttataatagtagagattaggtgcatgctttgtgttcattatgagtaatctaaacagatcaaagctatgataataattagtatttcttatctttagattagtggtggttgttacttatattttgtgtcttaaagaaaaacttttgtacaattaagctttctgcaattaggatcaactaattaattatgatatctatctataatttctcatgcgtataatatgcagtgggctcatcttccccggctccattttggcctcagcgtcgccgacggcggcggcggcggcggcagcaactaatcgcggcggcgcggcctgccggccggccaccgatcgccggcgtgcacgccggcgcgcggcggcggccggtcgagaatgcgcgcgcaggagggacgacgacgatatattattatcgcgtgtgcccctctctcttcgccgcgtaattaattaatcagttaattaattacgtacgacctactgtgttatgctatcgatccgtgttaattaattacctacgtatcttgattaattagtctcgtattatacgtactattatacgtacgtgctgtgctatgtacgtagacaacaaaaaaaaatgtgcgtgatgagttctactacgtacgtacgtactgtgttctagtgttttaatttgtatccgaaccaaggagttgtttaattaactgcatgcacatgcactggacttgaatctggagtattatgtaagtgtgcatgcatgctggattatgcaaaataaacgaattaatgaatagaactgtttttgttaattaattaattaaaatgtttggttcaatttttcgatgtgttgatagtgcatgaattaaagctgtgtacatattgatcgaatcccatcaaaattgaacgtgtgtagctatgaattaattaatgaactgacgacgctagctaattcattcggggcaaccaacaaattgtagcctagatagactaattgtttgccttttgtttcaagttgttatggccaaaacttatactcatttcttatatagatacaactgaatgtgttaactcaacggtattgtgtgtgtgtctatatatatatatatgtgtatatatatatatatatatatataaaatctgtcaattgttttgtactccctccatttctaaatatttgacactgttgactttttagcatatgtttgaccgttcgttttattcaaaaacttttgtgaaatatgtaaaactatatgtatacatataagtatatttaacgatgaattaaatgatgggaaaaaattaataattacttaatttttttaataagacgaacggttaaacatatttaaaaaagtcaacgacatcaaatatttagaaacggagggagtatttcttaagcattataatatattatcatttgtgacatatatatagatagagaattaaagatatatcaaaataaaagcagtttgtcacactaataaaatccatgtcaaaaccaaacaaaaaaacatatatatgtacaggctacaagtaaaataccaaaaaatctctttgcttcctggtgccacgcatgccgttaattaactagtacattcatgttgttgatggatttgggctgggaaagaaattcccctggttcttgcagtttgtgtacccacaaaacagttagtttgattaattggtcggttgtacgtacgtaattaacagttaaccaatcaattgggcacaagctaaatcatattagatctcttggattctcatgcattgaattattgctgctgacaaaacaaaaggcagctgcatctgcagctagctagtaattgatatcgctcgatacgtacagatcagtgagctgcaggcatgcacgaaccccacacacgcactatctagctctagattagcttgattcatgtttgctgctgctgcttggttcatggctatactccttctgtcacccaaaatattagggattttataggtggatgtgacataatccagtgttgcaaatctagatatgctatttgttcagattcgtagtattagaatgtatcacatccagctaaaatctcttatattttgggatgaaaggagtactaactagctaaaccaatacctgtgcacttgatctgtacatcgtcgatcgaccatctaaggccctgtttgattcagcttagaattattataatctaacttattagaagtaaactgaaacaaacaagtagattattatagcagattattataatctataagccagattattataatctaactacaattagtgaaatcaacatattgggattagggttttggcgattcccgggcgaccgggagacgccggcgatatcccacattgtgggatggcttaggatggagttcttctccgatccggttacgtcgtttgcagggttttcgcctgccttgtttaacatcatggaggggttttcgtctcgggatcttacgtccttgggacaggtgattggttctcgactcggagg

SEQ ID NO: 2813 - DNA, 3934 bp, Oryza sativa
  unsure (1)..(3934): unsure at all n locations
catttgagattggaattgacgttttgcgtacggccaagggaagctgatatgtttgattttgcctgcatcctgaaagctgctcctttgcttgaaatactggaattgcatgtaagtttatcactcacttacaattaatttcacgtaccatatagtatctgtttaatattccatatgccattttcttttctagatgtggatgccctatgataaccaacattactgtgaagatcatggtgttcttcgaagtctccccaatcacgctcactccaatctcaagctcgcctatgttactggattttacggcatgaaagatcagttggagcttttacgccatatcctaataaattctgtcatgctcaatgcaatgaagatagatccaaggccggttgtcgctgttccccatggaacggtgatgttatgtactgaagggcttaattgtttgaatggatatagagttgccatggaatatcttagcaaagcagaccaccgcaatgttcttgatgttcatgaaatcctgcttgaggatgttcaaaagcgtgaaatttatgcgattatgaaggatcgttggattcaagagccgaaagctatgctaagctatttctgatcatatcatctgcaacccttttcaagaacacagtcaagcttgcttgggagaaactagttgatattgtcaattatgcaaattaaatggagaagtgagaggatgttgtaaaattggagatatctttatagctaaactactgtaataacgtttctggatatatatttttatgagtgaatttcattttgggcgtttagcttttgttgtccatctcaaattaaaaactttgattaaagaatgatccaaagtgaaatatcgaaaataaaaagatggtgcaaagcaaaatttgctttatttttgtagctactgattgactacttgactgaccatacgctctaccacttaaacttgctcacacgtggttgtgcatgttggtcctaggcttgtttcttgggttggaattcttttattgggctcaatatataatgggctcaacccaacccgataccggactttgtcccgtacgacccacgtccattaggaatggcatgcatgactttggagtgagttgggaattaatccctctagcacgcanaacagagtgacttattagcgtatgattaattaagtattaataattttttaaaagaaaatataatataattnttaaagcaactttcgtataacttttttttaaaaaaaccgtaccgcttaacattttagaaagcatgccgcgcggnaaaacgaaggggttaagttggaaaagctagcaaaagaacatatcctcaagggcaggacagccgagtgggtatctcaaaataggagtaatatctctataggttaataattaagggaaaaaaacatagtcaagttatcaacgagttgaaaaaatatcaccaacagttcaccaactgagcaacataagttctattcctctctttttctatgagatatataccaacgtagtgatatatatatagttttattcctctctttttctatgagatgtgcatagcgcgatatcttattcagttttaaattttaaaatgtgcagcgtgttagccgtgaatcatgattcatatgagtgcccggccggcgattgattaaacgatggggaatatgaatacgcctctttagttcagaccaaaatcatgccactcatccaacaccgacagaaacgcgtgaacaccaaccaaaaaccaatgaagttttttttcttttgacaggatataatatggcgtgaataccaacataatatttttttctgttagattagtgttgttgctgaattatatggcgtcagcttgtggctaatcgatcgatatggtccaaaactaagacgcatatacctggaaggaactgaactgctgcaggatctgttcatcaatcaacatcttggctcggtaaggttgtagttcacaaatgcacatccgacgtatatatcatatcatccattcatccccgtatatatgaaaatgacgatattttggcattgacctcgcacctatggaatcaccaaagccttttgtttgttattactgtagctatgttgtttccttcgtactagttagccttgcacttttttttttagataataatcatcgaagtattaacaactgtaaccggccgcttgttagtatcgatgaaaactacgttttcatttgttgcaaataacttgataaaaatttccttgacaccatatccgtacgttttccaaatcagcatggacgaactcctaatttcaccatatccattccctccaccaatcagcccaatgacctaattaactcggcatcttgttagatacatttccatcctatcatcccttggttgtagacgaggtaatttgtcccttatcttacggtgcgtttgaacattaagttcacctgggctaatctatttcaagcaaaataagatagtagatcattaaccacgattaattaagtattaattattataaatttgataaataaatttatttattgatttgaaaataacttctatatataatttcttttacaaaagtttcatttataagtttgggaaatgtgttaattgaaaaaaaaaacgaacacaatcttagcctacttttcacccgtagatagaaggaacacctcaatgccctcagttgaatggcaaacaatcagttaaaagcagaattatgtttaccaatgtgtgatggaaaatgaatggtcaatgtatcaatgatcaacggtggtccaaacaaaacacatcctatcctacatcttgtgccaccatggcgtattattgtacaaaagttaagtactagtataccgcagcgtgcaaagcagcatggtcaaacacatacgccatcaaacacaacggatgaaagcaaaggtcaaatgccccccaaaagcacagctaaaaagttttaaaaagaagcacacgacagcaaattcgcccccaaaaaaaggttttcgcgcgccggcacaacacaacacaacacaaacccgcgccaccacgcaaagcaaacttggcccaaagcatcacacacacacacacaccaaactaatcaatttttttagagtaattagacttggtttattttttttttcaaaacatcacatcgaatctttatacacatatatggagcattaaatatatataaaaaaacaaatagcacattttgcatgaaaatcacgagatgaatcttttaacctagctagtccatgattagctgtaagtgttacagtaacccacatatgctaatgacggtttaattagactcaaaaaaaattcgtctcgcatttctaaatgagttatgaaattagtttttttcatctgtatctgaaaagctcttttgatatccaatcaatcaaccgatgtgacatctaaaatttttattttcgtgaactatattttaaagaaaaaaaagcctaaaaagtcgtacaaaaaacgtgtcgcgaacctgcacaggttggtgcagagcgccgcacaccgacacaccctccccccggccccacctgccagcctgtacccacccctccctactgttatacacaatcgcctcacctctctccccctctcccaagtctccatctctctctcctcgaataaacccccaccaccccacctccatttttactcctcccacgagacagcacaaacccaatcccatccaccaaccacctcgccgccgtcgccgccgccgcagccatgggcgtctccgccctgctgctcctcctcctcgccgcggccgccaccgccgcgccgccggagcagcccgcattgtccgctactccctcctccgccgccgccgccaacaacagcagcggtggtggtggtggtgcggcgagcaacggggtgaactcgaactcggtgctggtggcgctgctggactcgcactacacggagctggcctagctggtggag

SEQ ID NO: 2814 - DNA, 1914 bp, Oryza sativa
tcctccccagacttcccctcctcccaccccaccctccccggcgagcgcgtcgacctctccgcctcgccgatgcgggtcggcgccgcggcggtcacgcggcccgacgcggtggtgcgccccgacggcgtcatccacgggatcgagcggctgctggtcccgcgctccgtgcaggaggatttcaaccgccgccgcagcctcgccgcgatctcggcggtgctcccgacgggggcgcccgaggtggatccgaggacgcaccgcctcaagaagcccgcgccgcccgtcccccccggcgcgccgccggtgctgccgatctgggacgcgatggcgccgggcccatccatcgcgccggcccccgcgccggggcccgggtccgggaaacaccacttcgacgggcacagccaggtgaaggacttcatccagacgctcctcctctacggcggctacaacgagctcgccgacatcctcgtcaacctcacctcgctcgccaccgagatgggccgcctcgtctccgaggggtacgtgctcaccgtgctggcgcccaacgacgaggccatggcgcggctcaccaccgaccagctcagcgagccggggtcgccggagaacatcctctactaccacatgatcccggagtaccagacggaggagagcatgtacaacgcggtgcgccgcttcgggaaggtgaggtacgacacgctgcggctgcccaacaaggtgacggcgagggaggccgacgggtcggtcaagttcggccatggcgagggctccgcctacctgttcgacccggacatctacaccgacgggaggatctccgtgcagggcatcgacgccgtgctcttccctcccaaggacaccgccaccggcggcgaaggctcaggctccggctcgtcgggcgccgctcccgccaggaaggcccccgccgtcaccgcccactccaagtccaagctccgacgaggtcagtaaaaaaatataattagcaatgctggttaattaatttgttgtgattactgattagtacacttgagagggtaaaaacggaagtgagtgtcggtgcggggtgtttttactgttggaggtagtgggtcgctgtcgcgggcagtttgccgggaatcgaagcaaaagacgcatccagctagccaagcatctcaccaacatttttttttggagttaattagtatagcaaagtactcttattaaataatgataaatattactccacttaatcatggcccggcctccatcttaatcgattcatttagctcagcttagctgtgtcacgttgaagtctttaggacagtcagctagtgtgggacccgcagcacagcgaccataaattggcggcacgttattccgttgggtgggggagcgaggtaaataaatgcaagctaggtgccgtggttaattattgctcccatctattctttatagtaatatttcatcttggcacatgcataattaattgtacttatcatccatttaaacatgctactaatcattcctcgtaaacaagcgattcattaatatttatatttctagatacccatatagccaatcttgagtagagaaatagagagtcacgcattaatttcgagaaagtcattaagatgatagtcatatttttaaatctgaaaattttatttttaatagtcatatttcaatccaacaacttatcatcttaatggctttattggatttaatgcatgactcttcatttttccacacaagattggctacataggcatcgagaaatgtaaatattaatgaatcgcttgtttacgaggaatagtagcatgtttaaatagatgataagtacaatcacttatccttggtctgtgtgccaagataaaatataactatcataaatagatggaggaagtaaaatttttagatttaaaaatatgactaataaaagtaata

SEQ ID NO: 2815 - DNA, 819 bp, Oryza sativa
tataaaaataacccaaatatgagatacaccagaaaactgataactatttgtgatcacttcaacaaagctatgagaaaggcatgccctggctctaggtggaatgaagacatcaacttgtggaggcaagtaattgtcaataatccggtttacagcaggtaagttatcttcttaaaaactcgttcaaaccaacaaatttaactgtgtagagaaagggaagctaactcttcaatttccttaggagtttatcgggttttcttgttcatctcttcatgtgtacatggaataataaagaaccacatttgccggcaattaatgtaagtcttgacaggcattaattattcatatattacattattatatatttaccaaaatttaacttattaaatacatgtgcaggatggtgacgagctaaggaaactttttttgctaaatctactgatgtaccaacaaaatgagtgtgaaagcaacatccctaacggcgtacaagattttctaaagtgtataaagaattcacaacattagggtagttatttaactatatggaacaacattagggtttaactataatatggagtgatttaatttgaggtgatcatccattagaaatgccgtatctacaaatgctggatgttctatattttttgtttgtgctttatttgtatgatatcatcaaattttcatagatgtcttctatctatgttactttttataatttatgtagtaaacgccatgagattgtttcattacgatgccatatttgtcttttcaatgccagatcttatccccgtgatcaacaaaattccccgtagcaacgcacgg

SEQ ID NO: 2816 - DNA, 11584 bp, Oryza sativa
ttttgcaaatattactcttcgtgatgcagttggggtacttgttccgccatgaattttagtgtactagcaccggctctgaagtcaattggcagtataattgcgagaattaagctctgtactagtggaattttaaggtggtggtagaatttcgcttgctgtttggcctggagaaggaaaaaaagatgaataataattttgcttgctgctgaatgctgaccagaattttcttgtgattgtacggtgaggttaggattggcatacgcagatacactattatctgtggcgattgatggcttgtgttttgcagttttgtttggggatgagtctacactgtgtagctatatgcctatggtgtattaacagcaagtgacagtgcgtgccatggagagtctccttttagaggtgttagggtgtgtacaattagagtttaatttagtggttgagagaaattgcagttatgtttagtaaattctttagacatcggtggcgctgttcgcaagtgcgctccttattatgctcgccctgtagtatttatgtttggcggtaatggccatgtagaacgctgcagagccctagttgatttgtgatttgctgatcacaacctagagatttaggcgtaacatggcattgatttcttgtaagcctttatcagaaatatcactttccctatgtaacggcttaggaatttagggccagtcaagtactcagccataatgaaaacattttttgaagattgtcataccaccttttatgttatgaatggccttctctaggttaggtagcatatattttagaggcaggactgctggctcatttcccctgcttgcctatgagaagcggtctgggtcgctggcgttgccagaaaaacaggagtatggttctgaagatgatgcaatcatgtgtatagtgtgcatcctgttagtaggacaaatcatgcctttgacattttctgcttatcagttcatgtaggcgagtaaataagggaactttagttcctgtcttttttttttgaattaatgttttggttcttaactttctgtataatgcgcatttaacatatctgcacaataaatctataattgtgtacatttaaggaagttgactaataagaatctttatcggcttaattacacctgagaagcagcatccatttgcctattattatgtaaaaggaagctaaaactgaatagcaagcagtgctttttctaatattcaaaatctgtgggcttgatcagtaaatccaccagattgagtcatctccatgttgcctgcagcctaccctattttttacagggcatagcaaattatgtatggacatgattaaattcagtgtatgcacgttgtggtgacaatgatcatttagtaatttgtcctttgggacaccaaagcagagtccatcttattgcatcattagtttccgcatcagtatactgtcatggtaggaataggcacctctgtaagtgaaccatccaaaactttttgttagaaaaaagggtgaagcatccaaagcattggaaatggcactgtgcctcagactcagtcatgcccactgtacccaattttttttttagtttttcctttttcttgaaacgtagtgcttaaaaccttgcaagttatagccttataggtaggtgatagatgtatgtgaggccattttgcatgtggtgtagcatcacagttggcaaaacccgtgacctttttctttcaaccaaatctaaaaaaacaaccttagtgatttgttttaccatatgagtgagtcgaatgtagctatgagtacatttcattataaaccctgatggtttctagatccaatccttagtatatatattatgcttgtcaggactcaggaatctagtttaggatcacaagaattgtttatttctttctgccatactgacaattaatttataatgaatctcgatgacctgctgcagataaaactatcggtaaagggaagctggttattgatgtgaaatacttcttcttctatgtccactcggaaactcgtgagctctgtgatgtgacttcctgcccggcaagtggtgacttcttggtagctcatcagcaaaccctgccatcatacactccaccagtaagtccgaaatttcgcttctaagtctgaaatgtatgctcttacacgataaattcagctcaaataccactgctaataccaaattgtgttttgtgatcatcttacttcggttcatgcttgatgacacttgcttcttcttcagggctcttacaccatcaccatgaagatgctgggtgataacgatgaggagctgagctgcatctcgttcgggttcagcatcggtttcgctgcatcagaagccaccatctgaatgcatccagaggcagaattcagaaatatcacaccatggatgtaattacaaaagcacctatgtatcttagatcatagaactcaaatacaatgcgcatctgccaacacattgtgttcaactaagacgttttatccagagttgaacatacaataaaaacatcactcactagtgtacctaactccgtttagctgttgaaatgtgttgcattgcatgttgaattgagcctggatgcatcttgatcttgagaaaaaattcctgaacttttgaggtgtgaagcttgtgcaagcaatctgggtggttggtgctgtacttaaccactagccacatgggaaaaccatgttatgttgacagcttagggtactagtatttggagtttgcgtgtcaacatcagtaaggatgggctaattattctctcaagttcactctgcttcgttatttgggttaatgtgatcgagattaggtagggaaagcataggatttctgccgctcgaaaacgagagactgtatataaaaaaaacgaaattgggattgctacttttacctgccatgctaacatacattcagtttaattcgcattaacaccagttgttaccacttacgaccagacgttaatttaatttgcaggacacaagttgttagcaaacgttaatttaatttggagcgatgcaaagtgtggatccaacgatttggttaataaagaatccatgattaattttaacggatttaatcatgtgcacttagtgtcaacttttcgtgtaataccttttaaggcaccgaagcaagatcatttaaccaagcaaactcatttaatcaagcaaaccttacgttcaacttttttttaaaaaaaaatccgttcaaaaatctaatcaagcaaaccctgtttaataaacccatttaatttgcaaaccctgtttggaacgcagtaatcccacttaatttcgtcatggctgtatcaattttcgtagtaattccacacaaaatggatcaatttcagcattgatacaaatttttttaccgcgttccaaacaaaacctaaaaattatagtatcattaggcgttgatcacctgaattaatgcttaattaatcttcttccatccctctgtggctctgtgctagaggaggttaatcaagctatttaagcaagcaaaccctgtttggaacgcagtaaaattccatttaattttgccatagctgtatcaatttccgtagtaattccacataaaataggtcaatttccgtatgaaaataaaaaatctccctccttccaaagaaagcctaaaaatatactactactccagtaagtatgattagtcccttgatcacctggattaactcttaatcttcctcatccatccctatatgctagaggaggttaagcaataattaagcaaccattagccatgaaaaagacttgactaatgactagtacaaaattcaattcaaccttgttgtcaaaaaggcggttaaaaaggaagcaaccccaacccccctctccctccctccatccctcttcttcttcattccttcctcctccctcctcttcaaccatcaccaaatccacacgcttcccaaaaatccaaacccaaattgcaaccccccaatctccattgccgtcgccgccatgatcatcaagacgctcaaggcgcggatcctgtgcgcgctcaagtcctcgcttccggccgccgcgtccccgccgccgtcgccgaccaagccggggcgagccgccgcggcggtggtggtggtcgcgggtgacgcgttctccgacgacgcgtccttctttgacgcccacgagaccccgaccaagaacggggcggagccgatcgatgattgggagctcgtcgacgaggagggtcgggttggggttgccgcggcggcggcggaggaggaggaggaacagctcagggagttcccggcgaggtgcccgccgggaggggagggggcggtggtgctctacaccaccacgctccgcggcatccgcaagacgttcgaggactgcaacggcgtgcgcgcgctgctggagaacctcgacgtcgcgttccaggagcgggacgtgtccatggacaggggcctccgggacgagctctggtccgtcacgggggagaaggccgtgcccccgcgcctgttcgtccgcggccgcgacgtcggcggcgccgcccaggtgctcgccctccacgaggacggccgcctcctcgccctcctctcgccgggcagcaacaaaaacaggagcgccgccgccgccgccgccaagtgcgacgcctgcggggggctcaggttcgtggtgtgcggcgagtgcgacggcagccgcaaggtgttcgacggcgagcgcggtcgcggcgtgcggtgccgcggctgcaacgagaacggcctcgtcatgtgcgcgctttgcttgtagtagcaaagtaaaaattaattagcggttaattgtcaattaccacctcccttttcactcactctaatctgcttatatctttttagtagtaattaattacccctcttgatggttttgagtgtgtgtctggacttagtggttggcctgtcatgtacataaactaccactactgctactagtacttgcttcagttaaactacatatgtgaatgtgatgtatatatgcttagtttagatgtcaatttcacaaccttaatttgcatcattgcatgcatcaatcaatcagtttcctttctgatgaaacttggtggtttcatgaaaaaagactttgacaaatggcaatcagctccaaattaaactgctggatttcatcatcttttggtgtggatttcagaatgtttcctgacataattcagcagcttagcgcatttctgatttctgacagaagcaacttaggattctcttgctgtggtggtcctgtatatatagagagattattattacagattagaagagcaagcaattgcagctttacacttttgctgtttgtgcatagccttttggattaaaagaaagctggtgtgttaatgtcttagcagctttgcatcattgcatgtcaccactcaagtttctgaagattttgatgcactgaatcaatcaattcccaagtcccaactactttatgatgtatcacattcagcaaacacaatgcatcacagtagcaaaaaaccatttgcagaggtgttacaaatgcttgcagccaaatggagaggcaattaggggactgcatacataaaccaatctgatcaaagatttgcaatagcagcaaaaagtagagcttgagtacttacacttgatattatcaattatcatgatgtgagatggtacatcagcatcaacattgtcaacatcacttttcatttttagggagcactagagattgcacctcaaatgaacagagcaaagagataaggaggatacttataggggggattaattattgatgattgaacatcacttgatttgatagttgacaccagcagtgcacatgtgagcattgcaggggaccatgatgaagccatggctgaggttgatgagcccatatgttcatcttggctaagtccaatgggcctgagctagcttggagaaaagtggctccttgcaacacaacaccaagcaatggtccaaggattgtctacccatctgtaagcatctcaatagttgtggccatgtagttgtgggtcacatttgctcatttgcattcctatctgttagcatctcattagtgatagtttagaaggaaggaatattgcataaatgttttaggaaataggacgctccccacattgttttgtatgaaattcaagtgttttttttatgagttctgctatacgtacgactagagccgtacaacccacatccgaccaacaatcaatacgttcaacatctctttatgtaggcctaggtatgtagcagccctacactagtcggatacaagtcgtacacactagtcgtgtgtatagacattttttttatagatgatgctatgtcaatatgtacttatgaattcactcttacctctacttatctgtttacgaggaatgcaatacatgaaaactcttagcttcgatattatgcccaaattaattagttatgtaaaattaattggccaagggtaaggaacatgtgtaaattattttatttcctatagaatttgaatgttttacagatgatgctatgttgatagacttacaaaatcgctattatctctatttacctattgacaaaaacttagcacatgtgaaaaatcatgtactctgtaaatatgcccaaattaattggtcatctaaaattaagaggctatgactggatagtaactataacacatgaaaattcgtttattttcatggctggacacgaaagctcaatacgtattcatttagggcctcattgtttggcatatttatatgcttatcatccaaaatttgaattttcaacgttaaatttggagctgattttggggttttttcatcgaagtttatttttcagcctttgcttttagatcgctaagaacacatatataaaagttttattcacaaattgattctcgtttgcaaatatgccatttggcatattcagaaaatatgacaaacgatgaggctgttagatagaagtatgaaatcggaaacctaagggacaaaactagggcgtaaaataacacattgatctataagcaaaacaaactttatatgacaagtgtgtaagactcaaagtaagactaaaatccataggcatgagccgtttacatcaaaatacaagtgtgtaagactcaaagtaacataacctctatattactaatccaatcgtgatacgaggtaagctcatacaagaccagtgaccaatctagctcccgggctagtcaagcagccaccaagaccccgccgccggcaactccactgttaattagtgaaaatgcttgcaaaatattgctaaggactaacaaggaaatcgctatgcaaacgacccagctgtccgacacacgtacgaccgaatttaatcaactatttgcaaacgaccgcagtgcacatgaacatactctccttgattgatatacggccatatatctctacttgtacatgagttttataactagattgtatgcataacaatactcagactaacaaaaacactccatattatctataaaaagaaacaagtacactccatctttcgctgctgcgggctccccccccatggctaacactctcacaagtcacaaccaccaaagtgcctttaaaaaaaacaattaatactaatcctccacgcccagccaaaaccgcaacagaaatccaaatccccaatacgcaagccacatctccacagccacgcggcggcagccatccacccacaccacaccgctgctcgcgccgcttggctggcagcaaccacagcaagcaaagcaagcagtcaaagaaacggctacccagccagccaagcacagcagcagcagcatcacatatacccaagccccgacgagtcgacgccccaaattcctccccggaaaattttacaaatcccagcgatcaaacgaagcgaagccacaacacacagctcacttcccgcacgcatcctcgccccccagatcccatctcgccctcgcctccgggcgatggccaccgccgccaccgcccaggcctccgcctcctcctccaccgcctccacccgcggctcccccgccgcctcctcctcctcccactccgccgtctgcctcgtccccttcaggtatatgttactcatcatcttcgctgtgttttggttgtggtttggttttggttttggttttgatggggcaatgtgggtttcgcaggtggtgggcgagggtgagggaggaggcgccgccggaaggcggggtgaggtacgcggcgaccgcggcggcgtcgccctcgtcgtactacgggcttcgcttgctccacagcttcctccacccggatctcgtgcttcgcctcgagcgcgggggttgccgcggcacgggtgccggcgccggggggcggagctacgcgctcgtgccggccgacgagctctcgcgtgtgctcgcgaggtgagagactcgctaatggcacttccgttttccatttttttgggctactcggaggggggggggatattggtggatgctagtgagcgcaaaatcgaatttagttcaatcatgtggctaagggggatgatctccattacttccgttttttcatttttggctactcggtgaggggtattgatggatgctagtgagcgcaatagaatttagttcaatcatgtggctaagtggaatgatctggtacatgcattcctgattcctatgggtacatacatgacctttgacctggttgattcagcattgagatctaattagtttctaatgtattgtgagttccatgattttttgaacttcaataagcttgaattctagttaggggaagtgtatttagcaatccctgaaactcgggaatgctccatggcttggtatgtgacctcgaaaggatgaattcagcatttcaagctagattagtgcctcgtttgtaacgtgagggtggcaatcatctatccatactagagccacaacgtgatgctgagggcagggcttgtaggttgtaccagaccatttgctaggtggtgaacttgtttcttgcattgcttgatggttaaatatgttgtcccctttcagtctagacacatatgttttagcccattttagctctatgcctttgctatagattctttcctccaacttttgaacctctaacatagcaatactggcaatttggcatggacagttgcaaacgcaacggacttttaaaactgtagcgtttcatgcagcttcacttctgatttgtgggaagccaggataaattactcttaaagaaatttctctataagctgaagttctcaacataatataattgcatgtaaaataaataaaactgtaagtcatgatatagttacatacttacatttcatgcagggctatgctaacattgttcgcatctccatgttgcgcaaacttggagggtgcagttaggattttttttttgtttggctttcttaggaagcaaatcaaacctgtctcaaaatgattgcttttaataatgcataaattttgcattcattatctagtgagagtttagtgtctcaacagcaatgctgatgggttcatcttcctttctgcacttaagtttgtgctgtgttttcttacttgaattattgctttccaaagtaaggtttctgcaatatgcttgtcaataaaatcatgcatgcatatgatgtgtgttgctctgttctgcatctttttgcaaataggatttactgagtgagcacataccaagtgttgaggctcaactgtttagtccagtagaccccattggttgataggtgcaattttttataaatacatttttgtttcttgacaaaagacgataataaatacacatgtgcacatttttgactttcgtggaaaatatagggccttctggtctgtaggatttattcaattattgagagggaaagcaattcaatatgggttccctttaatcctaggctggccctgcttttatgacaggggcttttgttgggtttgattttatagattattttggtatcacagaagcatccatgaatatcatctcatgttttgcattttggtaacctagactttcattttagaaaacaatgtgcaacctagccactatttatctctcttctcactatgttgagtagcaagttttggtcaaacagtaagcataatcatcaattctaattgtgattgaaattattcgtctatgttcagttagtaatacccctatatgtgagacatgagtaggattatattctgaacctccatattcttgcacctttaatccagcttcttaggctatagctctccctgaaacgagtttcttgggaccctaattttaatcttcaggagttctatttggttttaaatattccttacaagtaacgaagaagaagacttggtaacgaaggtaaacttgttttgctgaagttaggctagaaaatgtttcatatagaataatataaactttctattgttacatgcgattcctatttcctctcaagtctggacttatatttcaataacaaagaatctgcagtctagaggattgatgattaattgaataggataactagaaagaagctgctgttctatatattatcgttttctctgtcgctggcaagtacctaaatgtattctcagtagatcccaatgttagctaaatatgacattattttcttggtatattttaataccattcaagctccactttgtcactatgtttaccattatgcctgtctttgttatactattgtgcattttgagcacttttggacaatatacttttggaccatgtggtgatatctgtgtgctgatagcatcctctccttgcttagcacatttcatcaatgtgctcagttcttgccttccaccaatcacagcagattacatcttccttttcagctcagctctcagctgttcactgcagcgtgcacttagctttccggcctcaccatatttcctgtgcatgtgcacgtgctgcttgcagcatgaggtgtggtcagcactcacacttacatgagtagctctttccttgtctgggtcagctaagccaagtgagagagagcagaggattaattttcagttctaggaatatatatattctgcagtgctgtaatgtcgtccaattgttttgtaccttgatgccaaagatgtttcttcagaatatcaattttcatgaaatcttgtctgtgttatttttttatttgcctaataggttcaatttacagcttccatcttgccgcatctatttctgctgactttatttctgttttcttctccaggcaaaattctagtttggcattgcataataaacattcatttgctgaggatagtgctggtgcgtaccctttggtgcttaggatatctgttcgagaaacaagcattttgactgtgaagatcagcaaaaaggtaatgctatcctatttgacagatgatatatggctctatcaaatttttttctcatgcccatccttacaatttctattctatttcaggacaatccagttgagaactataaacgggcatacaagatttttaatattgattctcaaccagtatgtcgctgtttgtctgcatttcaagttcagcaatatactcccacttgttcagtttacttaatgtttctttatccaggttcatgtttgggatttttcaggccagacaaacctaatattaatgaatgagtggaataggtcaaatcatgactgctgccactcagagcta

SEQ ID NO: 2817 - DNA, 717 bp, Oryza sativa
gaaaaccagtttcacccacatcactttaaggcaaagattgcttgttttgcccctcagttcagtggcttcaatcagcatgattcacaggagcttcttgctttcttattggatggcctccatgaagatcttaaccaggtcaagtgcaagccatatgaagaagctaaggatgcaagtgggcgccctgacaaagaagtggctgatgagtactggagtaatcatttagctcgaaatgactctgtaatagttgatacttaccatgtaagttctttaaatttttcatgtgttaaagcaattacactattattttctcctgcttctcctgccattgacccttttctgacatctacttgcaggggcagtacaaatctacattaacttgccctacttgcagtaaaacatctgtcacttttgacccatttatgtacttgtctttgcctgtaccttccacggcaaagaggacaatgactgttacagttttcagcactgatggtagtatagagccaatctcatatgatgtcactgtgccacaatttgggagtcttaatgatcttgttcaggctttaagttctgcttgttcactgggagatgatgaaatcctgctgattacagaggtatgcttttatctccattgagctttggcccttttgcgtttttgccactttctatctcaggttaaacagtatgagtcatattaggccttttacttactggaagtga

SEQ ID NO: 2818 - DNA, 1301 bp, Oryza sativa
gcataatcctcatatttgcttccaatttccaatttaagattgtttgttctgcaatggataacaatggtgggagttctgtgccaacatcgtcaacaagatcaggtgacattttcatccatctagctaatgttatatttatcgctcaattgatatattattgcttgctaatatgaggatcactcctccctcaggtccttttgcagatataactaatgtaattgatgccaatttgacgaacaaccatcccgctgctaataaaaatggaactaatgtgccaaaagatcatgagaattgccagcacaacaacttggactctacaggttgggcgtagcactatattatatattttgtttctttttaaggcttttgtattaagcacagtttttgtgtgcatgcactcttcaagatgttacaaaactaagtgcgactgaactaaaaaggaagcgtgctagggagtggtatgcatcattgaccaaagagcaaaaggaagatagaaacaagaaggcacgatatatcaggaagcggaggaactttgaatcacaaggtttaaatctctactgcagcatatctaaactctctgaacagaaaactttattattaaattaattgaactttcagataatgggtctcaagctgcgacatcaaaaaaaattactactacggcctcatctgtttcaggttgagttgtcatatggtcactgctaaaaatatgtttgtaaatttgtgccaaaaacattttttaatatgtttgcatttcaatagcagctccgtttggtgatattaaaattgcaagcactgaagatcaatcagtagggggccggttggatgttaatgatgcaggcactgaaaatgtgggttctattgtaacgcctgtgcgtctaccatttactaacagttctgatatgtcctacagcttcaaacaatactaaagaaggatgagccatggagtaagccactgcaatgcattgtatacacaatcgtaattcatatatgcattaacttattttctttgattgacaggaaaatatgggtacaaagttcaaggccgcactatattagcttgagtctcaaacagcttcaaacaatactaaagaaggatgagccattggaaagtgattgcttcaacatggctattcgtaagttcatgtatgaaaaaatcgagatgattcataaaactaaagaagcaatatcgaatcattgcttggacttgcaattttgggtaagtttttaaattctaatgctcatgtcattctctattgctcatgttattacctataatcgcaatatcgaatatattgatt

SEQ ID NO: 2819 - DNA, 1909 bp, Oryza sativa
agatgagcaagatgtcccccgctgacctcgccaggatgcagcagcaggtcagatccgcgcccatcgagatcgatcgtttcgttggagatggcgatctggattaggttttggtgtcgttcgtttagatcgggaggtaatcgcgtttaattcggtccggtttcgcgtttgcgtcgaatcaggatcgtgtgccaagttcaagttcggccgggatcgcgtttagggccaaagcaaaatcgtgtcacaaacgcacgtacagatgtggagttcagtttggttgagtttgcgtcgaggcgaaatcaggatcgtgccatgatgagatcacagggttaaattgttcttagtagttgatagtattattactccttttaagtcaaaatagtgatgcaattatacatataataaagaaaatggtgtttactcttctagtcttcaagttttcaagtcaattagacagtgagttgtgggttccaggttgggtttgatttggtcagttaattgattggtgatgacaatctgcgaatgtttttctttctgttgctatcaacaactgcatgattgtataaactataagcaataggagcgttgttgctgggtcttttacacattagtttatgacttttgcttcaactgctggtgttttcgcatgtccttacatccgtttagactttgtcagcgttgtcccatacaagcacaaccatgccaaatggtgatcatggcatattttgtaccacaagcctgcttttggtgcttgtattgaactagaggcctttcgtattgatcttgttgttgcttgacattgctggttattttctgaggagccatgcatgacatgagattgacattttccttgttatgattcgtattgtttcagcttctgtcaaatcctaacctagtaaagttagcatctgagagcatgaagaatatgagagctgatgacttcagacgagctgcacagcagatgaatcaaacaagaccagatgaaatgcttgatatggccgaaaaacttgccaatgctaatcccgaggaggttgctgctatgaaggttcaagcagagcaacagatgtcatatgtgatatctggtgccaagatgttgaagcagcaggtatgtatagcagtccaacttcactttttactatcatattctgttggaattcggttatagtaaggctgagttcggtacccatgtttcccacctcactcccctcattttccgcgcgcacgtttttcgaactactgaacggtgcgtttcttgaacttttttttttcattttttcaatctagaactagaatagagcttcatgttacactttttggcaaggacaaatgagtaataaaatttaaattcacaaaaaaattggcgaatgctgtatgtgctatgaggttcataccattacaggtttggatcaccctgagttaactagtggaatgctggaaaatatacatatgaacttcatgctgacgtgaacactaaagagcatttgatgagcctccttttttccttttaccaaagaactacatctactgatgcattagtcaggctgagccagatacatgtactgttttgtgacaaatgtttactgaacctatgcacctttaccaatattatcttgtttaagaaaactctgcacctctttaattgtttaactattttgaacttgcaaacttccaagttttaaactatttttgtaatattgatatttgtaattcccataatatcacccttatttgtttcattttttttaaatttcagggaaatgaacttcataggtgtgagcagtatagtgaagctgctgccaagtacaagcttgtatgttttgaacgtcaaaccttcattttgtaagtaaatttgaatgtgatgtatgttaaatcaatgcattcctttcctgaccaggccaaggataacttaaag

SEQ ID NO: 2820 - DNA, 14095 bp, Oryza sativa
  unsure (1)..(14095): unsure at all n locations
actagtggnatcccccatagctaagggcataatagactttagcctttcaaacccaataatccatgcctccaataatccagacaaacaaacaactcacggcttattttatatcagcttattataatccagctcatagcaatctggtttaataatctagattataataatcataagctgaaacaaatagggcctaaaagaatcaaattctaactataaatctaaacttatgtttatttagatttgtagataggatctaatttattttggggctattgcgttcttacccctacttttcaagtctaattgtggtttcgcccttattttttagggtttacgtttttgcctctacttttttgaaacgaagttgagttttgcccctgatttggatggtgagtataacgatgttaagttgagcacgaaaagacatatgtacccttacttgctattacatatttgcccctacttttttaaaaaaaacttgtgtttttattccaaatttgtatcggaaacatgcaacttgttttgaactgagattttgtgaaacaattcaaatatgagctaaacatgatgaaacttgcaagttgttttaaactgggattttgtgaaacaattcaaatctgagctgaatatgaaaaagtatgacaaatacaaattgtaacaaatttttggtataatattgactgaacttcgacacaaccagcacaagtcaggtattggggggggtacaaatgtaatctcaagattcctaaatcatttttcttccttttcatttctattcttttaactcagtattatgggacccactttactctcatccatagtaggggcaaacggtggcttcattggaaaaaaccaggggtaaattcacaaacccaaaaaagtgagggcaaaattgcatttgagattgaaagttggagcattaacgcaattctcctatttattttgttggaacgaaggggtactttcttgtcacacccacaacccgtgtgcgactaatacctgttacaccagttctaaaatataagaacttctaggttgaatatatgcatggattaatactaacaaagtatgcaaaaaaaaaaaattcaaacgcataaaaagattacatgtcattttattggaaggagcaaatgatagttttgcatgacatgacagccggtatccatcgcaactaattaaagtgaatgtatgtaaaattaaatgaaaagaaatattgtaattgattgagaaggagtagttgaagaaattaaatggttgaatgttatatatgtatggttggttgacaagataattaatacaatgtaggttaagaagttgttatattttaagataaatttagtacgttataagttgcttttatcttgggatgtgggagccgagttctatactccatgcatgcatgtccccattgattaattatttctttacttaattatcacttaggttttattatgtctttatgatattgtggtctaaagcaggcgcatgtgtgtgattactattttctactactataatcatacagtaatgaaactattaacttattaattaacttattaattgtaagagcaccttttttttagcatactgataacatttttggcgatcaacattaatattttttatatatattaggtacttaaatttgaggtttgacagcaggcatagggtgtcatatatatatagtagtacatatttttgcttgaagggttccctatatttaagaatgctatctcaatgagtatactggcttatttgagtagtcataaggaccacatggtgacatggacatgaaaatactcaaatggtcgtcatacatacaaacatacatatattttttatgccacactttagtagcctgacatattttattgttaaaagtattttgcaaaagaaaatgagtggtcaaagtatgaatagtgtccgttgtcagtttatttaaaaacagatgggtactatccctaaaattatttttttagcacaaacaaagaatggatttgtttcatgtgaatcgtaacttcccaaaatgaataatctgatttaagtagttgtgttataccttggtggaaacctagctaaataaatgttgaacccgcaacaattatgatctcatatacttgagaaaatttggaaaatacataatacataaaaatcgtgaattgagcgtagctcaactggttaggttcttcgagataaaaacatgtacatacgggtgcttgtaaagggtgcttgtatttacagttaattgttcttttaagtagttaggcgatgtattaagatccgtcggttcagtctttagagatatggtgtgtgtgagtttataggtatgaatgtacgtatatctatatgagcgtcccgtcgatactgtcttttgaaaaaataaataaatataaaaattaacgagtagtattgatcatctaatccatccatatatatacatatatagagcagaattgatttcattgcatacagtatatcttcaattgattgcctctctatttcttatctgcctcgttgcatatatacccttttcttttggaaaaagtacacatgaggtccctcatcttgtcaccgaattacaaaatcattcctcaacccaaaaccagatatatagcatcccttaacttacaaaaccgggtctctaagtccttaggtagttttgaccccggttttgttctacgtggcagctgagtcagcgtgcgacccacatgggtcccacatatcaatgactacttcatttcctctctctacctctcttcctctctcttcttggcaaccgacggcgcgggaagactgaggagcgcagctgacgacaggcggggagaggagcagaggtggagacggacacggcggcggcgccaccgacgatggcctcggtttcgcctcgttctcctctctggtcgacgggaggcgactccagtgctcgcccacgcgtccccctgggtgctgcatcctccgccgctcccaacccggcggtggtggccctcattggaggcaccggctgacgaacaggatctgggcaatgggagaggaggacggcgtcgggcggcgcaaccggagaggaagacggcatcagacggtgccaacctgtagacgaagcgcgtcgcctctctccccgtcggccgctgcccctatccttgcgtcccgcttcccgccaaggacgggctcgaacgtggcggcggcgcggccggctgaggaccgcgcgtggtcggagcagccgctgccagagccgtgcaagcagcgccgccaccgggagcttgagcggcaggaggcagcgacaggcgcgacggcggcggcttgccaggaccaagcgccaccatcgccaggagctggaggggcgggagggatggcgccgggacgggggaggacggccggagcggcagctcattggggctcgacttcgacgacaacggcgaggtcttctgcatgggtcgctcttccactggggctcatatgggctcgctcttccactcctctccctgcccgtcgccgcacgtctctcggcggagctgcagcgggcggcagggcgcggccggagaaggtggagcggcagcgtcagcgggcgagcgtggctgcgaagcggcgacggcgggcgagcaacggctccggacacgggcgaaacagaggagcaggcgagtgcggctgcggaaaggcggcaggcaagaccgctctcggcgcgccgccttgttccagcgctcctcctgctcgcgcacgctgaggcggcctccagcaggcgtggcgccgcgacgcccccaagtcgtcgtcatccctcagcgccgatgaacctcgcagagcccttcccgttgctcacgtcatctcgccgtgagcggtcttaacatctcgcccgccgccgacgcgtcacccccttcttcggtgtcaccgcaccaccacaccgcccgtcgccagcggccctttcccacctcgccccatggtcggcctgtatgagaaaactaggaaagagagagggaggacgaagggagagaacacaggagagagatgatgatgacgtggtcaccctgacgtgtggggcccacgtgggtcccacactcagtcagctgccacatcggataaaatcggagttaaaaccgccgagagatttagtttgcactggttttgttaattgggggatgcgttgtatccggatttgcggttgggggacgattttgtaactcgatgacaagttgagggacctaccgtgtacttttttctttcttttcttttattttctattgggccaaactgggctgctttgcacttgggccgtacaagccatctcaacccatttgcacccacgtcgccgtgcatccgcttccgacccggcctcctccgccgcgccgccgccgaatcgctcctcctctccggccggacggcgagcatctcgccggagcaggtattgatccatctctcatcgtatatccctccctcctccccgcccctcgctcggaacaatcttggactgattaatcgattggttgatttctatccctcactgaattgtcgacttcttgcgagttgcgatattttagaccggggatggatggatggatggattaatctccccaaatggaacactgttggaacattggatttcatgtcgctgtcaatggctgccgggatttgtttattcttggtgcgaattttgtctctcggattatgccagatcccacaccctcacgagcttatctaagcctgtcgcaatcttgcttcggttcattttgtccctttgctcatcgtcctgtcggtatccgtcccccctggatgcttctgggccgtgtagattttagcttaatgtgttcttgggttgccgtctaaatttgggagtaggataacgttgcttggattggtggctagtgtagtggtggtagccagccaagaaaccatttctttccggtgtattattagcaaccggagagagggtgttgtgaattgggaatttcgggattattgctttgagaagagggcagtgatggctgaggaagaagcaaaaaagccggcggtggtagtggccatgaagggtcatccggggtctggcaagtccacggtggcgcgcgccatcgccaccgcgctctgctgcccactcctggacaaggacgatgtccgggactgcacgctgccacttgagcgcgtcgacggccttgctgtcggcatgctcaatgagctctcctatgccgtgttgtggcggatggcagagaggcaggtccagctcggcttgtccgttgttgtggattccccgctgtcacgccgcgctcaccttgacgcgctcacccgcctcccgggtgcccttgttatcgttgtggaatgccagccaggcaatgaagaggaatggcgccgaaggctggagaagcgaggggctgcagtgccagaagatggtggtgatgggtggcataagccgaagacgtggaccgagctggaaaggcttcgggatgggtaccaaggttgcacagattatgaatttggggatgtgccaaggattgttgtggatacaactgatccgacagccaattcagaggcaatttctgtcagggttgtagagtttattggatctattcttgcttgtgaccattaagtctgctattatttcttatcgagcatcaaaaatggggagtaactctaggtcagaatttcattacaaaatgatgatatgttgtcctcttcatgtatagttttcatggtttttgtgttctctttcttgtttatcctgtcccgacttattcaggtcaataggtattcctactctgtttatgaatgttatgtgaatagtgtacatatatgcaactctttctggccaagtttaaatctctttctgatcttaatttctcagaatggacaatgaagttgttgcattttcacattttaaaagaaagggaaatgggaaataagtgaaactacaacactagatcagtgtggattctagtatgcaatgtatttttatgcagtcataactgctttacgttaccattttgtaaattttcacatactttcctactctgtaaatcattcattaagtctttaggaaaatcattaatttgttattgaccattagggtatcctcttgttcatatcatcccttccctgtgttattagtttctttcaggagtcaccattaaattttgtagcaatgttgatttccatgtatgtctaatgggatatttttttctagaatgtttttcaacattaccaaacagctggtgcaaagattaatacaacaggatgtaatcatagctcataactaatggataagtgctatattctttgcaaatttttcatgcttccattaccttagttgatgggattttggaaatttcagaatgagagagatatcatttagttaacctgttatgtttatttattgaactctccagcatgagaaacttcacgcgaaagctggattttagcaatgcttgtggagttaacaagatataccacatgctctagtctttttttattattattttctgtttgacatcttgttattttattgcactgttgtaagacaattttttcctattaccttgtgcgcattccgttaagactaatataaccacctcattttctgttgtttcagtttcctggtgctagatggcatcttctgttcttcagcctggggtgcctgttaccttgcaagaactagagccttcctcagagtccttcagacaaggagcatcgcttagagtaactggagtgtaagtgtacgatgcaactattctaagcctcctatatatttctttctgaacttccactcataggtcctgaattatactaatcttgttgtattttctctagtctgcagtcgtatgatttgaactctgcaattgctgttattcaagacggcggtgcaagcctcaaggtagacactcagaacttgagagagatcagcttccgcacaaattcaacctaccagttcatcggtgaactcctgatcaaaccagataacgatgtatgccgttctcctttcgaaagtccatcagagcctatttgatgcaacaatggaagatactttgataacttatttacatctctgcaggccgttttgcaagcacgcgtaggtaggaatgtcgacggtattgacctgaacctctaccagcaatctttgctcatccgacgacaatatgaagctcaactacggtccaggagagcatgatccaaagccctgtgaatcaggaaaatgttcaatgatctgtctgcttgactgcaatggttcccagttgcaaaggggagcagagtatcataactaaatctctgaaggcagatcatgtcagtaggactaggaccaccataaacattggtggtgagaattgagatgtagagcaaattgtctggttgttttcatgcctggagatttttctgttgcatgactttgttaggaaacatgtacttttcaaatttcatcaaagtgatgcagagaacaggattaactagattggtgaaaaaggtgtcgctcgtatgcagaatcattagtttggacagtgaagtgtgaagcagaaacaaagatagtgccgcagtgtcaatagtctcaattttactacagttatttttgtttctttccttgagaaacgtaggcaaaatctgataaatcattctgaaaatgggatgataattggcaggtggcaagtggcaactgcatggtgtgattcggtaattaatatctgaaggatacagtggatattaacagtacgagaggagtatatgtgtactaatctgaaagtgggagcttacagtattcgtctatcagtaacaacaatatgtttgaataatgaataatagtacaaaccaaactggagaatatttcaaggggtccaataccaacatacaacttcactatcaatatatcatcatgtggtacccttttaaccgatataatgatatgtacaatcagttttttcttaaccggatactggtaactacagtagggctatgatctcttctagttgaaaattcttggttcagcttctacacttgtgtgaactccagtgcatttccgtccgggtcccgagcaaatattgctggtcgccctgatttgctaagtgtgtatttgattcctgcattccaacagtttaaaggcggtcatcaaattgttggcaatggaggataatggaattaatagtttgtactgcaatgcagattaaacattgtaaaggtgcaacaagtgaaatggtaatgctgacacaaagtgtaatggttctaagataaggaaatgaaataatttgtcacggcacttcataaaaatgggaaaatgtttgaaaacattatacggatgtgaatggacgatgctatgatcttaattgactagaacttttaagtagtctaatgagtattactttcaagacaacagaccttttggatgactagcaatggtggtatgtaaaatttaccaaaaacaaaggatgaggttttcaggacatctataaatttctccaaacagggcaggctttcaatttaccacatcagaaaaaaaatagcctgctgtcttagtaggttttactgtaaagatcagtggttttttaataaggctatgaagacaacaagcagagaaacagggcatttactctttatcagttgttgctagtgcactgtataagcaacagataataaagtaaaaattcattagtaccggctttgtcaaagatttcttttaacttcaacacatctttgatcgccatacaggtatgacgatcacgtcccccatgctctgggcgcccagtcaatggatcgggatttggcagctccatcaagtgaatcatctcagaaccaacccagagccaagcacctctgtaaggaagcttgtcggttggcctagcaggattcaccttaagacctaattgataaagaattagttttagtttacaagcagtgaggacatttgctcctgtgtgtcagttttactttacaagcagcatgacacaagaacatgtacaactgataactaactcaccaagcagatctttgtagaaggccattgacctttcaagattttcacataggatcccaacatggtgaatgctaacaactccataagcaggttctgcaccagaaatcatgcatgtttgatttggttcagagaaaaggggcacttactctagctatagccaatatgagtaccaaaaaccaaacaaaagctatacaaaggaaaatgtagtcagcatctcagcacccaaaatttcaaagcaaatgcacattgtgcttatatgactattaattaactttggaattattgtgatgattcttgtttccttgatggaaatagtggcttaactctcttgctcaagacaaaaaagaaagtaaggattgttgagcagttcagtctggtcatggctgtttaacaatctacacaaaaacagttttagtattccatattttgccttgtcagaaccagccaataaaaagcactactggtttgtggttttagatgtaaaaaaactaacatgaattttgcatgtttagagaacatatttcagtgtgattcttcatatcgatgtatgctacatagaactgtaaaattaaatgtatgcacggtacaagcatattgaacatttgcacctctacaacttaaccacaattgcacatatgcctatactctgtaccatcaaatcagcgagtatcaatttcatagtctgcagtctgcactacattatccactctcctccactctaataggcaaagctgcaacccccctagaacttcgaatttgctactaaaagtaatactagtgttgagctaaatagattggtgcacatcgtgatcaaattcccctaccactaaacatcaccaagatttactaactcttgttcatatgtagctccagggtacagttcagagttcagactgatcttgattcttgaaacactcccgaaatcagccagtaaatctttaacaggaacactcaatcgaacagctaccactgcaacatcaagcacccaagaactcactcactcactcaccctgggacgcctcctgcgccgtgacgagttgctccccgccggtggccaccgaaaggcgggtcccgggacggcggcgaggggcggcggaggaggggacgggcggggaggccatggccgacaccttcccggagctggagggggagggggagaggagggcgagagaagagaggcacctcgccgccattgctgctgcctttggatttcttgatttcttcagagttcagggacgcttcgcctgcacaaagctgtgggctttatgggcctctactattttgtgtggctcatatgccattttttttcctcctgcgatttttcccccctttttttaattttggttttgttttttttttctgtttttgttgtccacctgaaaatttcatgaggctgatagccactgaatgacctgaacactcaaaccacaaagctccatagctatgtccacaaccaaggagagaattgtagctaagagcagcgggtacaataaacggtttaagccagcgatagcacatccaacctagcaaaagtgatgagctggatggaaaaaactaggagagagtgccagcggacgactaaattgtcgctgactacacacgaactccaagacaagggaaacagcggaaaaaaaacttatcccatggttgcatgtgaggcaatgcgcgggaacagtaggataaggcgtaaaaaaataataatcaattcattggtgcttgtgcatatagccagcagctatacagacaccatcttctagttatctctatcgctgatgtggtcttttttaccgcccgcagtcgtccgctttattaaactcgctctaataataatatgcagaactacatgcaagagcatctaactaattctatccatcataaactaaactcctctgcattgaataattacgctaactgacgacaataatacacaataacactactgttatgtaaaatcgtgaagagatcacaatctggagggaagcaggagtgtttagcgataagcgagatatagcataatcttttcagtgctttgctgcctcgacagttagaagtagttccccccaggatgcgatcttggtcgcaacccttggaattgatcactttcgatcagttcttctaaacctgtaaatgtgtatatactccccttaatgaaatttggttggcctccttcggctgacccggcgaactgctatgtaaaatacatgtgactaaataagcacagcagaataaggatgtgtttggttatgaattaagataaccagcttagctaacttttatgcagattttatgttgagtgaaatacattacttgtccctaaacttgtgtggtgatgtcacttaggtccgtgaacttgaaaattatacgtttaggtccgtgaacttagtttaatgtaccactccagttcaaacgtcctttgactgcgtttgaccgccaacgtggcataccacataggcaacacttttgctctcagccccttccacatcacaacacgtcacatatatctccttgtagctatatagtgacaccagaatcccccaaaaaaaatcctcaaatcgttattccctctcattcttctccttgcatgtatagaaaatgtggtctcgattagcaattgctattgtgctgcctcccgccgctaatccggccgcactgtcaccgctaaccccgctgcaccgcactgcctcctgccgctaatctcaccgccaaggccgccacaaccgctacctctcgcctccttccgctaaccttaccgtcgaaaccctagccgatttagggatattttgggggatttggttgaaatgcactagtcagggtaagttatgtgcgaagatatatgtggagggggctaagcacgaaagtgttgccggcggttaaacgtggtcaaaggacgattagaccgggggtggcacattaaaccaagttaatggacctaaacgtgtaattttcaagttcacggacctaagtgacactaccccacaagtttaaggaccgggtatatatttcactcttttatgtttgatgaaaaagttctagtttaaggattcaatgtttagttagatgttaaaagtttgaatgtattttagaaacctgatgctagaaatgaagagaaccatgtatgccaatagcattactttcaacattgaaaaaaacacagagagaatatttgcgagggtcatatggttcaaaagtcttatatatgtgcaaatgctgttaatctatacaaagctactgtccaaggcataattcaataaacttgatggtctgagagtggctctgtgatccagctcatcgttcttttcaaagttatgttcttatatttacaatttttgtgtcatatcattctcatattatcagattcattggagataatttaacaaacttgatggtctgagagtggctctgtgatccagctcatcgttcttttcaaaggtatgtttttatatttacaatttctgtgtcatatcattctcatattatcagattcattggagatagttcatttggaagaaaggtgacaatgttcctatgtggttttgtgattttgtccattttcccctgtgataataaaaaagacaataaactgtagaaacctgaactttcaaaaactaataataatggaattgcagtataaagctgggtaatatcaatttgtactaaatcgatctagggataggaacatcattacaagacaacactaacatgcagatgcaacataacatgaaaacatgacattcagatgaaataaagtcagttgtcaaatatcaagggctgtagaaattgagtgaacagcaaaaactttaagatgagcttctaccaacaaccaaagcagtgaaacccacatgaataatgtaacacaagggagcctaaaatggttcggaaaataggaacaaataagttgagtacaaaaaagaataatacgcagctcgttaactcttctgacaacaagcttgcagatatgtcatattgcaattaaagttgctagaagccatagtaggtaagaactattttgatgtatgacatcatacaaacttctgagaacctagcaacgctactaatacctattcctctactcatggcaggcactcactcagaactccgttatactattctcctcatacctagccctcgtggcacgcaagcaactaaaagagccatacaaattagtcaaccctaagctattcccactcacaaaccaaagtaaactaccaagcataccactcattgaaccaatgactattcctgttcaagaacgatacagagtaaactaacagctattgtcgctcctcctacttgtagcacctcatgacttttacttctcgtatcccacaaaagagtaatctgcaatacaatagaatcagcgatatcagcaatatctaaccctaaacagcctcttccagcagattattaactctggctttcagttctcccttcatagaattcaggtccagcctaactgacagtggcggacttagaattttacaaatggggtacgataaactaatctacttataaaacaataaattatctattttttatacaatattatctctaaagaaatataaaaacctgaatatatcataaaaattggactagaaataaactaaatcttatttttatctctagatcccattgtaatgcattgacatgtaactagtaaatagaatgccgtaactcacttgaacaatatatatagctttataatcattggattcatatcaagtgtcgatctctaattcatccataaaatttgttatatgattatatattattcaatattattaatctttatagcattttagattgtgtttaacaaaaatatctttccgcttattaaaaaactagtcaggtaccttatataagtacaataatattaataaatataataattattttttactcatacaaaaacatagataatatatattacgaagcacacacacatgagttagctgctagtattcatgtgcaaataatagtgctggttgtatcaatatttattatcaaaaataaataagaatgagaaaacaacaagaagaagaagatggaacaacagaagaatataaggttaaagttttagtttcactccgtattatgacgaagaacaattttaataatattagtatattatcgattaatatgatcatataccataccatggatgtgggt

SEQ ID NO: 2821 - DNA, 711 bp, Oryza sativa
tagatgtctctccaactattatcagctagtgctctatctagacgcaccttgacatttgatctaccttctcttcggttatcataagtataggggacccctgagaagcccaagtcaaccagctcacatatttgtaacacatctcggaaagctctcatttgagcctcacctcttttagaaacagaaaaatgttcaaattgccaaagagtctcattgaaatctccaataatcatccaagggaggggggaggactgtttgagatccaggagccgagaccataaacgatgtctattctccactctcggttctccgtacacaaaggttacatgacatagaggatcttccggagacaaacgcatatacgcatcaacatatctttcattcacactcttaacatccataaagatagactcatgccaaagagagcaagaccaccactcaaaccatcactattacatccaacaaaaccttttaaacctaatctagaacgaagtctgcggattctttcaatcttctgtctcgtttcactgaggaaaaccacctgggaatttgcctctttcaccaaggcaatgagatcacgaactgtcgtggcattcccaataccacgacaattccatgccaagcaattcattgctcctgacgagaccctatcataggtcccgtcagtttaccagcggccccatggctggttgcctccgaattagacacctccga

SEQ ID NO: 2822 - DNA, 710 bp, Oryza sativa
atcacttcaataagcattttagaagataactgagcattccgttgaatccccaattcttcggtgatcctatcgtgggtgtttcgcaccaccttgttaggtgggataacaatatccttgccgcccaatgggttccccatgacaagatggacagtgcggggggtgatctggatcttcctgtcatcatcaatcaaaatgcacatagagttcggacctgtcctgtccattagccactgtatgagatctggcttctcaaggctctcaagtttcatgcatgccacggcatctaatccaatttcttctaacttttcgtggtgcgtctttgacaacgcacgacaagcctccgacgccaacgcggcgctacaacgtgtcaggttgggtcccttgaccataggatcctgcgaaaaaaattgaaaaatgcatgcaaaggtaagcaaaaaatgaacatccaatagttagaacaccatgatttatgtttgaactcacaaaaacatatggaatgaccacacagttgcacaccacggtattatttgcaaaagatagtcatcaatggtacatacataggaaaaacactataacccatcggtggatcgttgggagagcaaaacgcaaacgatagatactaacgtacacaccatagtcaaaaatccgacagaaaaagagatgccaccaatttgcctgtaaaatatcaacacattcgcattcccatgttg

SEQ ID NO: 2823 - DNA, 6145 bp, Oryza sativa
  unsure (1)..(6145): unsure at all n locations
cgaatacatcataataatgtaaatctagattgctttttatctagattttgttttctaaaatatgtcacacccaatcaaagttctttatattttgagataaaaggagtaggtccttgaataagtagggctcatatgtacatattgaccttgtttactcctgtaatttgtggtgctgagtgcaacatactttgacatttccatgcaactcacttggaaggaattaaattggttaatgccaagagtgttgcagtaagggcgaatctttgcaagtggctctgcagtgagttgaatctttgcaatccatgccatatccaatgggaccatgcaccttcatgtcatgttgctaagaaaaaagatcaacaagacaagatacaagatcatcatgggagctagattacaaattctttggagaagatgtgtatccatatatgaaaccataataatccggcctgctgctagatctaccttatctgggcatgtgatgtgtgcatatctaccagtgcccgaatgtttatagtcctgagggacatatttatcatatataatctaatttatgtttactattttgatgaatgtatttacagttgcagcttaatttagagttttagtagtttagtcatactttaggattgattcaatataaaggttagggctgagcttatcaactgcacgtaaaataagacaagtgattatcttgagtattacttttgaaataatagatttatttgaatttttaaagagacttttataaagaaagtttatgtaaataacacattgtttaatagattgggagttactatattctaatatgctcatgataaataagaatgcagtaactctaaatagaagcaaattgcatgtacaaaggtagagtctaatatgagctctttatattaattaatatcactagagattatccttctacaatgatagtaaagacaataagatttctaaaccattaatgtactaaatatctttttttattatacttctttccttttctacaccctcatgcaacaaacttttcgttaataaatgctaagagtcgactctaagctgttatcatgcgtagcaacgatgtttctcattcattccatctctttcttccacgtcaccaaatttacttgcatgataacgaagagagcctgttattagacaccattgtatactcttaacacacactctcctctctctctctctgataatctgattgttggatcattatcacacaagaccaaaaactgacaactcatatctgttaggtactatagccgaatacaatgtctctcctcctcatttgatctggtccaagaaaatcacaagtgattagcatgatgatgtgtacagtaacagtacatcgtaccttcgtacaataacagctacatgcacaaactgtcaaactgtatacctgcacacgtgaaactgtaaatttcggctttatatgcaggtcgacctactgtgctactgttttttttttctcctgatacattatccgaagcctatcaattagtctgcattagaacagactgaataacagactatagccgactataaacatattttaaatagataaaaaagaagatataaaagtagcggggcaacaggctacagatttatagccagctgcagtataaactttaagatacatgtgtgtatgataggtgggaccaaacattaattatgtagtacatgtttatagataactattgtacgaattagctattaaattaactatatatgatttgaagccaataggacatagccatggtttgaatcaatattgtcaagctagccaatcaatcaggtgaagagaagtaatctaactttattattattgttattttcataagagacaaagtcatgatcttcttcctcgctgtagcggcgccccctatttgaccatttcgagtcgcttccacgatggtcaatatggtgaaggatattgccttatgcatcgcgcaaaacctctcaaaagtagctccagaacacacggtaatgggttgtttgattagcgaccaaaggttgtcatgtcaaaactttggctgccattatcccatatccctgccctagcgtccaacgtcacctccacctttgtctctttacatatgtacactctaatcaatctcgtcgatattaatttgcgataagaagatgctattagaccgttgataagcttgaaatttaattataagtataaaagtgatcttttgcaataaaaaatgttagagatatggaggaaactcaatggtccatacgaaccaaacataactatctattgtaattaatatatactcttgtcaaacatgctgcggagtgcctgggcaatggaccgatggttgcttgaagggaggaactcttttttgttgtttacttggtgaatggaggaactcattgtatccagccattttccctttactttgattgttactactagtgcatgctggcttggtcaaaacactgaatagttcagccttatcttctcatcctaatgttcaacttcagcagcaaagcagggcaatttggcacgtgaagaagctgacgtggcacaaccatgcacacacgatagtcaactatacttgccacgtggctagatatctgcccccaaagtcaatggacaaatggatcactgccacttgggcccggatatcgagacaatgggtcactgactcgtgggcccggatatctagttctattgataccgcacgtctcaactgcgcttagctttagtactatttatagacgtcacccgtacagttgtgctgagacaactaagctaagtgggcagtgggcaccaccatgtcgtcgtcgtcttcctcgccggcgccgccgcacgtcgtcgaggactgcctcggcatcgtgcagctactcagcgacggcacggtgacgcgttccggcgactactccagcatctcgctcatgcgcgacgtcccgatcgacctgcccgtccagtggaaagacgtcgtctacgacgccggccgcggcctccgcctccgcatgtacgcgccggcgaaccacggcggcgaggaggggaagcttccggtgctcgtctacttccacggcggcggcttctgcatcgccagcttcgagctgcccaacttccacgccggtgcgctccgcctcgccggcgagctcccggccgtcgtgctctccgccgactaccgcctcgcccccgagcaccgcctccccgccgcgtacgaggacgccgtggccgtcctctcgtggctccgcggncaggccgccgccgccgccgacccgtggctcgccgcgtcggccgacttcgagagggtgttcgtctgcggcgactcgtgcggcggcaacatcgcgcaccacctcaccgtcggctgcggctccggcgacatcgcgctcgacgcggcgaggctcgccgggtgcgtgatgctctggccatacttcggcggcgaggagaggatgccatccgaggcgccgccgccgccgccggagggcgacgcgtcgccgtcggcgatgggcatcacgctgttcgaccagatgtggcggctggcgctgccggcgggggcgacgagggaccacccggcggcgaacccgttcgggccggagagcccgccgctcgacggcgtcgcgttcccgccggtgctcatcgtggaccccgagctggacgtgctccgcgaccgcgtcgccgactacgcggcgaggctgcaggccatggggaagcgcgtcgagctcgtcaagttcgaagggcagggccatggcttcttcgtgctcgaccccatgagcgaggcctccggcgagctcgtccgcgtcgtcaggcgcttcgtgcacgccggctaggtgatcgtccgaagtaaaccaagatatggaactcggatgacttgtgtactactccagtgttctagcgcgggagatttgcagcttgatcctttcgtcttcatcttgtcatccgtagccaatatttcaattttataaattgtttttatagttgattttgatgttttcttatcgtagtttattttttaaaatattggttttaagtcgttaaaaacacgtgtacacaaattttgatccttaattagtttttaatatcgctaataaatgttatggtataatcctcattttagatgttaggatctaccaactacttttcacttttaagcgctgtttgggttaaaaaaaataattaaagcgaaatggtttgtagcctaatggttacaatagcctccctaacaccttaggtttttggttcgactctccatgggagctgtattttgatctgtgttctctacaagtttgcaactctacttgctaacagttatgcatttgaaaatataaatgaaatcgtgcagagacaagcgacgatatatattggacacaattgttcttttcatttatttattttcttgttgatttatactcgtgatatgatatacacggttggaaaatccgagttttttctctctttttttttttttgctctctacaagtttgcaactccacttgctaacagttatgcatttgaaaatataaatgaaatcgtgcagagacaagcgacgatatatattggatacaattgttcttttcatttatttattttcttgttgatttatactggtgatatgatatacactgttggaaaatccgagtttttttttttggtgaaagatagatcagtcgacaactcgacataaatacaagtccttttcgtattgagacgtatactggcccagcaatcagcaaatgggttgttgatggtccgtggcccgtggtcctcccttcccttacatcggccgcaccgacagcccagaataagttaagcccatttaaacattttctcgcccaaaaatttaattaaacttcggtggcatgtcatcatcttcaaactcatcttttttttgacacagtaatattctcgaattatctccccggatttattaaattaaaaataaaagtaatccattttttgagaagaaagtgaaataatttttttttcaatgatatgctcgaattacctccaccgattttttaaataaaaaataaaagtaatcacatttttttccgacgaaagtgaaataacatttttttttcaaagtgcatgccgtcctacgacaactacaagacaaccaatggcggagctagaaaattttcattgtccgggcaaatctaactacaagtatttactataaaaattttgtgttcaattctatattatatcaaattttggaataagatttcaaaattttacttatatcaaccccctcaatacggtattatttcggccaaattttttaattttttcatgaattttagtaatatttatttaaattagactaaattttgttcaaaattttgaaaataccgtcatatcagcccacttgatacaaatactgaaaacgaaagattgaacccctgaccggaccactgctactttggtatagggatgaaaacggtcgaaaatggtctgaaacgatattattattttattattttttcgaaaacaaatggaaatggccagaaaattttcatatttatgaattcatctatttaatgtaaacttcaatgccacgctaatagaaattaaaaaaaagtaaattttaaaaacagtaaccatcggtaaaaatattattgttatattagttttacgaaaacggtacagatgcggttctactttggtcgccgggcggtggctccgcgaccgaaggctacaacgaaacgttttggtttttagcttttagcctcatcaatcggatcgtggatgcgctcagctagttagataagcatattgagcttcgttcgcagccaagcaaacgctcgcgcgcgcagccggcaatggcgtcgttgtctgacccgaactcgccgccgccgcacgtcgtcgaggactgccgcggcgcgctgcagctgctcagcgacggcacggttgtccgcgccgccgcgccgccgccgccgttctacgtacgcttggacatcgacgacggccgcgtcgagtggaaggacgtcgtgtacgacgccgcccacggcctcggcgtccgcatgtacaggccggcggcgacggggggagcggaggagaagctgccggtggtggtgtacttccatggcggcggcttctgcatcggctcctgcacctggcccaacttccacgccgggtgtctccgcctcgccggcgagctccccgccgtgg

SEQ ID NO: 2824 - DNA, 15050 bp, Oryza sativa
tggacgtcggccgcgtgctggtggtcgccgccgacggcgacctcctcagggacaagaacgtcgagtacgcggagcggatgaaggcgatggggaaggacgtggagctggtggtgttcgccggcgaggagcacgcgttcttcggcgtgaagccaatgtcggcggccaccggcgagctcgtcgaggtcatcaggcggttcatcgccggcgccgccgcgtaagtgatcgtgatcgagcgaacgccggcgacggcgaggtggtttgcctcgtgcgccacgtgttcgtaggcttattccacagatgcgacatggtggcaggcactgtgtccttgcaacaataattgagacaagcttaattacttcgtactacatttgtgttttttttttttgtggttacaaattgggcacaatggcaagcaacaaaggtcgacaaatttatgtcattgttgtgaaatagtggtcgcagtttatatggctgcgaaggaagtgtgacagtgaccgtaagcagaggtaataaagtcagcgtgcatttattattattttctgaggaacaaaaggaatatagtgtttccattcaaaaatataaaaatttagaccaaataagatattttctaagactacgaatctgacttgggacagattgagtacatttttttttcttccctgtggtatgtccttattcagtgcgaacatttaggatgagggagtcaaatagaaattagagtgaaatgagctcgaaagaaaatgaaaaaattggcaagcttccctctccaacacagtactatataggcttttcacgttacttgtgattaatcctagacaaatcttcctgtttcgtttattacccaaacgaaacgaatcacaccaaagagaacagtgatcgtaattttttttagataatagaaatggattacatcttcggcttctgtcataagacacacaactataaatttaatagtaataaaaatgtaagataaaagtaaatcaaaatgagaaataaagtgatgggacaaatccccaactcccctttattattgactagcgttaaaccacataaaatattttagctagcaattcttatggaattacgccacccatagtggaataagagacccttagctaccgattccaagagtgtagcaacattgtgcatagtatcctgctactcctgtggtagcattgtagactaaaagtggagccagtagaaagacatgaagataacctgcatagggttagatagttgtttaccattaaaaactttatcattgcgacaacgccaaattgaccaacatacagcactaacttcaattagaatcatcttcttaatggacctagatacccttctaagccaattaccgaaaatgtttttggcgttacggggtgggggatattaaaagcaaaaaacacatatctccaaacaaactgagcgacatgacacaaagaaaagatgttggattgtctcttgtgcatagcagaaagaacaatgtttgtctcccccattttcttttagctaggttatctttcgttagaattactttcttgtaaagaaattacataaagaccttgatctttagtggaatttttaagtcccagagaattctctttttatccgaacattacagtttatgatcgtggcatacagtgatcgtaatgtgatcatacaattactgaattgatgccaaaagcttggcaatgctctctaaaagaatactactccagcttagtagtgctaatatgttgatggaaaggccaaataagagattgtggtaaccgtggtaaaattttgacggcaaactagacattaaaatttttcgattttttttttgcaacacctgtatttgagttcatcaacaggttagtaaggtttacatcgattacaatacacacccccttcaactttgatcatcctgacaaaaaaaattacatctatatcctcgctttcttttttttttctgcatctatagatatatgcattattctgcttagtttgcagaccagtgatccactcatttgacctaaacttggtccgagtgaattttagggaatattattttcttcctttagcgtgcatgctcttttataacattttgaatgattatacattatattaacatactttttttttgaagataacatgaacaactttattcaacaagacagaatttaggggatataccccagtacatcgcacaaggatacaacttaagccaagaaaccatctctaacaaggtagagagtaaccactctaaggaagcaaactttctgatgaaacaaaacaacagtagggaattagatcgacagagttctgcggcaaagccacgacgattgaatcctttggcctccattgacatgcacaccgcttgacagactggaaggctactacagctgtcaccacggaaacggcacagatcagaggtttgttgtcgagccgtagattttggtgtaggtatcaccggactcagcagattggttccatagagtctttcattagatatgaggagcagagattgctcaacccgaatgatagaccctgcatggatactgctgttttgaagcaaaaggaagcaagattcaggagaacaggtagtccacatgacatgagaaatcagatggttgcgataaaacttctgtctttgtagaaggccgaggattgctgcaggattgtagaactgaagcggaccacaacaaatgaaaaggagcaagctcccaacgaagaagtaaccttcagattggagaaataagatgccacacccacacaatgttttcaccgttgcagaaaagcagcagctcaaggtatcaccagcgcacggagcagtagtacgaagagctccaaggctatcacaagaagcaacagcacctggagtttgaagactaccacacagagcagcaacacttgggctgccaaggttgtcgctcggagcaacatcgccagaaatttcaagaccgttgccaccacacagagcaccggcacccagagatccagggccgccaccgccgctgtacgaagcagcgccatccagagatccaaggcaaccgccgtctgcacacggcgcagaccaacgagttcagcaccagcataagaagaagattctgtccttcaagtcgcagctccaactccggcaatcatcaccaccagcaaccagggctcttcgcttgaacgtaaccaaatgagacatagccacaggaacaggaaaaacctgacaaagaaactacaacctagctacactgtactaataggagaggtggccggacccctcctccaaccctcaccggcggtgaaccaccggaatttggggggcaagaggggccggagaagaagaaggagctactgtagcaaaggggaaagttgggaggagaggagatggggaaagttgaccatccaaccagagctattaacatacttttaaaataagttaatcggtaactgatgttgacaatatccttttgacagtaggtttctctgttcgactagctttcggtgggggccaatttcttcctgattcacatatgttctcatggttacctcttacaccatttctaagttgcaatctacaaaacacatatactccatgccatagacgaatatatatactccataacatggatgacaggttgaactgcatgccttggtgagcacctcacaagtcacaaccatgctcagctactccctccgtctcaaaaaaaaaagacaaaccctgatttccgtgtccaacgtttgaccgtccgtcttatttgaaagaattatgaaaaaattaaaaagataagttacgcataaaatattaatcatgttttatcatctaacaacaatgaaaatactacctataaaaaaatttcatataaaacggacattcaaacgttggcacgaaaattcatggattgcctttttttttaaatggagggagtacttgtcatgtgatgtgacttcattttttccatagaaccgttgactcctctaccctaatgggtaataaaataaatcactttagtggctataggtacttgattattaactctaattcaataaagtcaactaaaacatatttcctgatttaatattaaacaggacgcgtgataaccccaacgggcccacaaattaactcttttgcatttcagtcctttgatcgtgattaagcccctacactacattttaatttgtacttctgtccaaactttacaataaggaccacgttataggaaaatatatctcataatacccgttgacccactcggcaacctaaataaatgctacaaactgcatctctttactctgaaaaacaaatattcatctctttcctccttaacatagagatggtgtcgtcgctatgaaagcccgaattcgatggcgtctccataggaatgtcgtattctgtattcaacacctatctttagggaagctcagattcgaggttgtcttccttatgtaatgcggtttagatcgaggcggagtgggccaattaaagttggccaaaaggcccgcagcccaacagcctggtccatggcacgaagttttggcccggcctaggcacggcccgacccgaccgttgggccatgcctagacctccttctcgacaggacgtgccagcccggcacgacacgaccagcgctcccgtaggccatagcccggaggtggcccacccaaatagatgagggaggcaaaatagacttattgtagccatataaggcacaaccgaaggaaatgagggagagaaaaaagacttatttcagctatataacgcgtgactcaaagagatgagggaggcaaaatatacttattccaaggacaagcacgataggttgctttggaccgacatggcacaacccgagttttattgggacgtgcctgagccgtaggtacagcccatgggcgggcatggcacaacacaactagtcgtgcccaggtgcgggccgtgccgaatggagctacatggtgacagggctacaatggctaaaggatgaacttgggatggcttttcctgatcgctagcaaaggcgtttcgctaaccttatttcgggtgtgtttagttcacatcaaaattggaagtttgattgaaattggaacgatgtgacggaaaagtttgaagtttatatgtgtaggaaagttttgatgtgatggaaaagttagaagtttgaagaaaaagttgagaactaaaccaggccttcttcttttctcacgacaggcgtggagctaactagtactccctccgtcgcataatataagggattttgagtttttgcttgcaacgtttgaccactcgtcttattcaaaaaattctgaaattattaattattttatttgtgacttactctattatctacagtactttaagcacaactttttcgttttttatatttgcaaaaaaaattaaataagatgagtggtcaaacgttgcaagaaaaaaaactaaaaatcgcttatattatagcctgtgggacggagggagtacgtgaacagaggcagcatcgaggagacgggggatggtgatggccgccgccgccgtagcttggcgcgttgggtgctgacatcaagatggagagggcaaacaagcagtgcacgtgaggtgcttctcgtagtacttggatttgccatatgcttcctggagcatcgccatttcttgttgtccggctgccagcatcaccctggcttaaggtcatccaccctccgcttatactgcgtcgtagcacccccactactctctcgctaacctctatcttttcttcccaagctaccgggccctctgcaggtagtgctaacaccctacaagggcactccttcccttcatagtggattccaaggctatgtggatgtttgagcatagaactgaggccacgcattgtacattacaagggcacttctttccttcacgagagtggttagttggaaactctctcaaaagaactcagttctaatgacccattagggccgctgggcttatcccatttttcttatttttgtcttatttcaactaggggcgattctacattatgtttttttttggggcctacgacacctaataaaatctagaacttcaatattactacctccatattttaatgtatgacgtcattgactttttatctagtgtttgatcattcattttattcaaaaaatttatatagttatcatttattttattttgacttgattcatcatcaaatgttctttaagcatgacataaatattttcatatttgcacaagagatttgaataaaacgaatggtcaaatgttaattaaaaagtcaacggcgtcatacattaaaattaaaatacggagggagtaattcataataataagagtataagaatatgatactagtacatgttttaataagtatgcacgggacactggataattatttttttagattctcactgattttaaccccaaagggcaaaggcccagacctaggggtgaaaacggtacggaaatttccgaaaattccggctaccgtttctagtttgcaccgaccgtttcagtcggtattggtaattgtcggtatcggaaatggaaacggtaatctcttccgaaaatggtagcggaaatgatatagggtgttttccgaccgttttgtcggtaaccgtttttttatcggtaatttccgtcaaatttccgacaaaattccgaagaaggaagccggctgggccttgctagcaggagcagcccattaggcatttaggtcggaaagaaaaaccctagggcgtcagccggcgtgtcgcttctccttctcatcctctccctgtcttatgactctcgcgctatcgcacagctcttcgccacgccgccgccgccacaaccacatgtccatgccgccacaccgccgcttgctagtcctagccgtcgcatcctcgcgcctcgccgcgtcccttgccggagaagcaagatggcacctgccggaggaaaacgccgcatcctagcttctggatctatccgacggcaacaacagagaaatgagcattgagttcgccaccgttgcgtttgccaggtccactaggtataggcgtatagcttgaatgcttgagcatgatttttttacatgtacagatgaatgcctgagccttaatgttttttagcacgattttctgttgatgtgcgagcgtgatttttgcagatgtacagcttaatccttgagcatgtttttttaagatgtatagcttgagccttgtgttaatcgttaatcacttcctctttttttaaatctcaatctgctgcatctggaagtgcaagtggaagtcatcatgtgggtgtgactgcatcatcatcctattgtatgctatagccacattgatgttgaagtatcgttgaactttgtttatattgtttgtcgaccttattgtcaacttattaatcatcatataacggtgttgtgtggcagcgtgatcatgcaagggtgaaattataaggtcatcttcatacatagttaaatgtgggatgataccacggttcgctgtttccgacatgaattttcgacttccgaccgataacagtagattcccgttccgatggttccgtttccgatataccgacattaccgatatcgttaccgtttccgagtataccgttccgattccattttcgaaaaaacaaaataaaaatggaaatggtagagggtttttccgaccgtttcctagcgttttcatccctacccagacctaccacgtggaaaaatatgagtgcttctagaagacaagaaaacgcctttgcttaccgcaagcgcagcagaaccacgcgacgtcatcgaatgcgtctcccacgggcagtacggccacggccacaccctgcacgagcccaacaaaagccagggccctgggtctacgtccattcgtcagtcaagttaattatcagctgaccgtccagaaggacaataacagtgttgacatattcagaatattctgaacaaagtgaaaataccatgataatccatgcttacaactctagtttaattcaattataaattcgcataatatatagttgccatcacgtttctgtttgtttcagctatgatttataagccgcatccaatttataatttagaattaatttatgtgtttttcttgagaacaccctacaaatgtaaatactcataaagcatgcagactcacctctataaacacatatgcacactctacctacgtcattacgagtagttgttgagattgatgaagtcaccataaacgtctcgctttcaagggtatgtcgtctaccactaaataattagcagtaaatgggagtaccagtgtcaagtctaagggttgattttggatgggctagttccaccacaaataacctaaacaattgagctacgctcatttcacgtgtgttttttcattgttttttttaatataatttggtctctaaacctttaaaccggtaataagaatagaaatgtaaaagctttatcctaagactacttttctatttttgcaagttgcaacgtttatgtttgccattggattataagccgtggtccgtggaaaagaagaagaatcttctaaacttatttgccatttttctcacgtctctgcttttggactagaagagtaaaagcttccctattctagaaggcatctcgttctcttccaagttccctatataatgggctccacgtctcgctctcacaccgcaccgacgcatcagctaccttctacgcattaacgcaaacatctgcacgacacgacacaagcaatggcgccggcggcggagccgtacgtggtggaggactgccgcggcgcggtgcagctgatgagcgacggcacggtgcggcgcagcgccgagccggcgttccacgtcgacctgcccgacgacgccgacgccgccgtcgagtggaaggacgtgacgtacgacgccgaacacgacctgaacgcgcggctgtaccggccgcgccacctcggtgccgccaacgacgcgcgcgtccccgtcgtcgcctacttccacggcggcggcttctgcatcggctccggccggtggcccaacttccacgcctggtgcctccgcctcgccgcggagctccccgccgtcgtgctgtcgttcgactaccgcctcgccccggagcaccgcctccccgccgcgcaggaggacggcgccacggccatggcgtgggtgcgcgacagcgccgcgcgcgacccgtggctcgccgacgccgccgacttctcccgggtgttcgtcgccggcgactcggcgggcgggaacatcacccaccacatggcggtgcggttcgggaaggccgggctcggcccgcaggtccggctgcgcgggcacgttctcctcatgccggccatggcgggggagacgcggacgcgcgccgagctggagtgccgccccggcgcgttcctcaccgccgagatgagcgacaggtacgcgcgcctcatcctgccgggcggcgcgacgagggactacccggtgctgaaccccgccgggccggaggcgccggggctggaggcggtggcgatggcgccgtcgctcgtcgtggcggcggagcacgacatcctcagggaccggaacgagcactacgcgcggcggatgagggaggagtgggggaaggaggtggcgttcgtcgagttcgccggcgagcagcacggcttcttcgaggtggatccgtggtcggagcgcgccgacgagctcgtccgcctcatccgcagcttcgtcgtcgagcacatggactcggagtagcaaagcactagctagctacatgatcaaagattagtcaattattaaaagtgatttagactttttctacataattgatgagttgagagcgatttgtatttgttaggtgtgttttgatcttatcttagttattattgatatgtttcttggtaatttgagaatgaatcaataatggaatgccacatggatggcaatgcttcttgatcaaatttattcgagtgaagacagaagaacaatatttctttttcttttaaagaaaaactgagcatccggctttgtggagtggtaattgttttgtcggggcactaactagtggacttatacataaagttgttcaaacatgatttcaccgaggcatgtaattaaacaataaggggatgccgattaggtattagcaatgggtagtcctaggtcgtgcccctagcgatggccgttcgcttttccatcggcgccgtcccgtccccctgcgatggaacgcgtccctctgctgggggacgcggctctctctggtcctcgccagcttttcgtggggagacgcagccaggcgtcgcgttgagtgtgtgtggagctcgtgggcacggcatcgtccccccaaatttctctttgcacactcgcctcactctcgctctcctctcggtctcgtcgcgccgcgcctaccacggttccacgccttagagggagagagagagaagagagaggcgacgaagacgacggatccgcgacggcaacaaccggatccggccaccgcgcgtcgtggcagccgtcggccgccagccggcgacgggcggagaaggcttggcgcgcccatgctcgccgccgaggagcacgaggacgacgtcgtggtggtggtcgttgcactcgggaacgacggcgacgcgacccggccaccgcgcgccttgcccgccaccgccggcgccgcggggggccagatccgcccactacggcgccggatttggcacccccgactggccacggcgcgaggcggaggatgccagggaggacgccgatgggagagaggggcggcggtggacgccggaaatattcctccatatttgacgatttattgcaaatatccctcccccctcctacttcatcttggtttgagattcccccaattgctattacttgcccattttcattgccgcaaaccccacatgataacacgactatggagacgtggtcaccactcatatcggccaggcatggtaacatgattgtgaaatctcggctcaatcgctcatgatgtttagcatttccttggacgggtcataagttttcgctcttagacatcgaggttgttgaaagatgaactgttatgcttgtcttatagggttcagcagtggcttgtttctttaacagatttaaagatgagctcggtatgacactgtatccttgagaaaaaaaaatgtgtatatccatcaaggaatgtgctaagtcatataacacaagcaaaaaacaggcaaaaaaaaaagaacagcagcaattgctaattggggaggaacagcggcaaacacacagaaagaggtaaattagagggggtatttgcaacaaacattttatagggggtaatcttaaaggtgacatttggagtggtttttgtaatttttcctaaatagaatggcctgccacattcaattttcttgagttcctctgtttgtttagaaaaaccagtagtagcctgtctgaagccggtagtaattagttgtcggaacaaacggccggaatactttaaaagtttatttaaatttcaaatttataataattttgataatttctcatagaagcattttggcaaccggtagtcttcttgttctatgtcatgtaacaagtttttgaaagaggtacacataaatgaccagtgtggcatgatctgattagaacattgaacccaaaaaaaatccaagcagaagcaggctgggattacctctttctgtgtcattatccttattttttttagataattgtcattatccttatactgccatcgatcgttgagaaacttcccaaaaaaacaccggagcatcagtttccagagatgacatagcagcataatacgtgtaatgatagtatactactgaacataaggaattctttttctatatataatttaacttaaccattggtacatgagggcaaagaagcttcaaagaaaaaaaatcgtataggagctcaagaaatcatgaaaatttccagtattaatagtgatggcgccattgctctctctccctgccattctttattttatttttcttactagtactagcaaattagctggccaaaccaacaagcccaaccgagtcaacacgctcatgcatcttttactccggtgaaattaacatctggagtcattttcatcagatgatgatgcattcatgcatactagtactaagatctacaacctacgaaggataaattaagacataacatcacgacttaggccgtgtttagattcaaaattttttattcaaacttccaacttttccattgcatcaaatgtttggatatatgcatggagcattaaatgtggataaaaaaatcaattgtacactttgcatgtaaatcgcgagacgaatcttttgagcctaattacgccatgatttgacaatatgatgctacagtaagcatttcctaatgacggattaattaagcttaataaatccgtctcgcggtttatagacgaaatctataatttattttgttattagtctacgtttaatacttcaaatgtgtgtccgtatacttaaaaaagaaatttgacacacgaactaaacatagccttatatagagttatactatctcatattgcatcaattgcacagtttatatatgcatgcaaagttgcgaatgcatcttcttactccaagttctgacgttattcaaatacaaggtactagtatgaactactcaacatgggctacagaatgtcaagatgctcaatacctgatttgcctgattcagaattgatccttacccccaaaaaaaaaatcagtgatgcataaacaacctttgttgctgatgctagagagcaaaatagccggctcttattactgaaaccagaatacaggaaacagctcgtctggcgtggtaagcgtaaaggcatagctaaagacaaatttcagtgagcacagaactgaggacgtacaaaaacagtacacaagagttccatgctgcaagggattatactcaatttaaaaatcatcttccaattgcattacattcataaaggccatctcacatttgtaatctactgaaaagtatatgataactttagtagatttttatagctaatttagctttgatgatattgaccattgttggtgcgacacacagattgactaccgcttgcacttggcttttgccattttcttcctcttcttcttctcagcctttgggatcttatctttgcgagcttctctcttttctgcttttactttcttcttgttttccttccgagcagccttcctttcctcaggtcccaccttcaaaatctcatgccatgaaccgtcttcatcggaactagtgcaagattcactatgttccgaggagcacttattttgcagatccaaaggttcttctgattgtacttgctggtttttggtaggctcgtttttattccgcacaaatcctagcaatggttggttgtaaagcttatccgctgttggttcattcgcgaaggatgggcgttgcatcaatgacatgttgacaatatctgcttcgcattgcttcacataatccagcgtctatgaaatagaattaacaatcaagcatcagtaattcaaacatacgccatcatacagcatgcagcacaaacattacaaacgaaacaaaatgaacacaacgtaattacaaaatagtgtaagtcatagatctagcaaagatcacggcctatatatactgtagagcaaaagcatgtagaaccaacaaaataaatgtagagttaaatattgaattatccatgattgatgagtaacataatgtttagtaaatagagattttttggcaaactgtgcaaacaatgatattaacttattcattatcttacctgaaccaagactgttggggtgatttcatcgtcgtttgcaaccatatctccattttccaacatcttttgctgaatctaacatcacaacaaaattgttaatccatcagacattctgcccatcataaagcaacatgatcagggcacatctagaactcagtggctatagaaagactgaaaggtgacattgagaaaataccttttccaggtaatgatcaacatcttcatcagcaatattttgatcaatcacaaaattaaatagttctgttactgacatgacagcaacaccacgttttttaaagaagtcctgcaaatagcatcacacacatttgaatatcacaacctacgaatgtctatgcagtgtcaattcaacttctactcacagtaacatgcaagcaatcttccttcaagaattccaacgctgaaggatgatcaaggtcaacggactgcgaaacatcaatgatatacaagtgtccctgcacaaggagaataaatggtgggaatcagagccattgatctgaaaaaaaaaatgatgttaaaaaatataataaacagagttcaactacctcgaaataaagaatgttgtattcactcagatcaccatggaccagtttgcatttttggtagagtgtccgcattgtcgtaattaactgaaaaagaagttgcatatgggaaaactgaaggtgttatacacataaaaaatacactaaacagttcccttacgaaaaaacaataagtgcatattgcaggagtacttatgctcccattgttctagaggcaacaccttaatctgccgaacttttctgaatacttgacagtaaagatacaatagtgtccatgggcatgagcaaatgaaggatatatgctactgcttggatatcaggggaaaaactatgcaaaagagttttcatgcatgaacattatcaccacacattttgcatgatagcacatcaaaatgaagtgggcatttaattaggttcaaacccaaaaaacaatgctgaacatgttgctaatagagactctcctagatccacggccctactacccacttaaacctttccagatttctaggaactgaggaaaatacggccttgtcttcagctgtcacattgcattcacattagtgcgtatttattatctgtaaatagatacaaacaatcctttctacatgacattatgataggatgtgaagaattcaatgtcaatgcgtcatcagacacaattgatgacagccactgcgtgttgtacatggatacagcaagttttctatcctgggtaagaagcaatgtaatatagagcagatggatctattacagatttacaattaatatgaactacaatattatctttatc

SEQ ID NO: 2825 - DNA, 14697 bp, Oryza sativa
ttgaaagaagaaaatttactgagtaaagcatgaatgatgcaaaaatgagaagaatctcaccgtaaaagatttctcatttccttttcagcccaggtcttcaccattttccgaggattatgcttgcagtaaccatgtctaaagcggtaatctccatggacatatcggtctctatccctgcaagaagagaataatgtagtttgttcacatgcaagttatttttagaacaagttgttttagtaaaactagaaaacacagaacatatccataatcaacatatctgcagtagctgtcaaaaagtaccctgttacaaaagaatacgtagatagatctatgccttacttaaaaacaaggacagatgttttatagactttgatcgctaactcctggccatcagcctttgatgcatgatagacatttgcctgcatagagaaaagaaaattgcacttgcagtccaggccagattctgtatcttttgtatacagctaaagtgctctatactatgtatatattctcaacatgctttcttatccacatacgaaagtaaattgcaaatagcagaaagcaatgtcaataagatatgcagttgaactaaaaaaatacctctttccctgtagaaatgcacccatttatggtattaaaaaccccccggtttaacatcttgaacagaaccatgcgtgttcttggatcaatagcctgcatgtgaacaaacaaaatcccgtctagttgtcaaaaatcatttcacaaaaatatcatcaatcatataagtcaaaacatgttatcacttttctagaagatcataactttctctagataggatacaagagatagatgctgcagctataaccactgaaaatttcattgaatcataacctcaaaaataagaaaatcacatggctaagagagcattcttatggatatcaagcacacaaagattataagtattaatggatgacatataaaggagaaatgaaaatatgagataatatgctagttaacaacattatagcaaatgcactaggcattaagtcagtgttgttcaagcttatattaaaaactactgcctaccaaccttgtgaacacaacaggccataaaaaaaatacatcttaggaacttcctaccaaagcagtcaattgcactagagcgattttcttgaatgatacagtccaaattattgtccatgcggtacagctaaacaaggcattatataatatataacacacggagttggtgtacacataataagagcaaactcggatgaacagagatggatgcttttttagtttgctattaaacacaaaagggggcagaagtgcaggcagcacatagtaaatttaagaagcacaagagtgaaatggatacaacctactaagaaaatgtgtatacctgttctactgtagcacgatcagccttctctgtgttccttgttttcccaattgccgtctcccttatgctgtcccttatcgcagtcgtcactgaatttgacatccccacgttcattctaccttcccattcctggacaattcaaaattcaccacattgcatttcagcacaacttcacaaagtaccacaacacacaggtgaacaagcattcctcacactcgcacaacgcgcacacgcacacaggtaagcactccgatttgctacagggctaagcaccgcagttttttttttactgcaaagttacatgaaatcaagttgaacaatacggggttctaggatgaatggattgtctaaattccaaaacaaaacaatatactccaaaatttataacgtaattgcatacactaatcgcttgcaaagtgaaattacgcaaacatgggatcatcacataagcaggcccagtgaaaaattggagtgtgcaaccaacacaaagcacgaggcaccgactactacgaggcgagagagagaggagttggaagctgcatacctccaggggtgtggcgcggatgtgcgaggcgagcttctgcgtgcggttggagatcggctggaacgggcgggacagcaccccgccgtgcgcgttcggcctccgcgccgcggcggcgcctcctgccgccgtgaaggcggccgctggccggccggagccgtcggggccctccgcggcgtcgagccagtcgagcgcatcggccacgtcggagtccgaccactcctcttcatcctcctcctcctccacctcctcctgatccttactctcggccacctcgactggcctcaccgtcgcttcctcctcctcctcctcgtcggcgtcggcgaagcggctatccacctcgggaaggtacacggcggcggcggcggcggcggtcgccatggttgaagcaaaaccctggaacggtcgtggcaacacgcgggggattacgcatatgggcttactactacttatcgtggccgtatggtgggccctaatgggctacggcctttctcttgtgggccttaatatcggcccttctatatagattttgggcttaatttttccagcctgtacacatgagttacaccgaaaattcgtggaaaataaattatatcaccgaaattttgacgagtttcggagaaagttagagaaagtaactggtctctttctcttctgctattatatatcaccagtggcgggcccaggtttttgaacttgtgtattcgaaatgagaaggggtaaaaaaaattgttcatacacctaaaagcctaaacatatcaaagtgccaacataataacatatgaaatacaaaaatgaaagaaaatgataaattaggaagaaatcttacaatttagagattaacttttcgacgcttgatattttgaaaataatcgatgatgtccttgtccttagcttgcaaattgaattttttttaatgaagccccatcttgtttctccaaaaaagagtttaaatcaacagctggcccttcttcgtcttcatgtttcagttctgaaaattaaacaaatttgataatatggtatgaactatgaactaccgtccagtgtccactagaccactacaaactaagcaagcaagtacactctcactaaatcagtgaattgcagctcccaatcctaaaattttcactacatttattcaaatttgtgtactcactaaatcagtgaattgcagctcccaatcctaaaatcttcactacatttattcaaattttgtgcatgtacagatttagtcactcactgtgttgtcactgttgtgctgctcctgtcctgcgcggcttgctgttgctgtcctgctcctgcttctgcggtcctgccctgcgcggctgagccggtcagccggccaggccaggtgccggcagccctcagtggcgcagccgcctaccgccctgcgcccggcgcggcgccccacatcccacgaccacgagcacgagggcacgagtcgcgcggccgggccggcgccacaagccccgcctgctcggcggcgcgccgccagccgcacgcctgcgcaactgtcgggatggatggggaggcgaattagggttagatgggaggggaattggggatatgtcgaaatgggctgagatgcaaggttgacaacggcccaattagaccgcgggctgagaggaaagggggaggggagtgggaagttttggcccaatagagaagaaatggtgaaataaggtccaatatgagcagtttaaggtttcttttttaattttttaaatacatatacgaactatagagtatatatacctattttttgtccaaaaatcttgcgtatacatctgaatacccttgaatatacactgggcccgcccctgtatatcaccacgtgccaactaccaaacatttttcattgaggaggagacctttttctttttttttctctatcttagatttgttaatcgtgtttgaattacaaaattgtttgctaagttttttttttttgaggtagctagccgggtacgtctatactctatatgccgtacgttatctcagcctgagtgacagagtgagagtggcgatacaggacaagacagtcatactctacgaaaatccgcaagacaaaagacagcgtttgcttggctcgtattctaccactgaattgcaccgagtttacacatttggccgaatactaataaattctacctttcttgaaaaattgaaattaaaccaaatcaatttaccaccttatgtctgtggactgtggctgccgtaagcccgtaacgcgacgtggaaagcacaaacataacacagctaacatagctgcattaaccattaaccaattgatgattaacttttctttttggtttaatacggagtacaccaaatcatccaattttaggctgagtttgtttctgcaaactgggcaagcaactctctcatattctattagcatattttccctaactgctaaacattgtattttacataatagaatttctacataaaagttttagaaaacaaaataattttttttaagcttatagtaattaatatttaattaatagtatgtgctaatgatatagtagtatctcattttagtgctagtgagtgatagagtttaatcttgtcattaattagaatatatgcatggttctattttgtttacatgtagtataggtcactgcatatttagtttggctccagctcattggcgagatgccgacgtgccgtgcgatgcggtggtgcgagaatggagcaaacaacgttcatgaagaccaagctcaactgcatgtggagtgctgcgagaagtagccgaattgcaagaaaggcaaggtcagtattagccgagtgaatcggtcctagctgtgcatgagatttagttgttgctagtgattagctgcatgtgctgcgattagtggtaatcatgtaaagggatttcttggcaaataagtaggattagttagttacttagtgcatgggcatcccacgtttgtgtgcatggcgtgagttgtggcttagtgggtttggccattgttatctctttgcatgtactgagtctatataaacaagaaaacgatgtgagctagttggctgcgtcaaccaaaagcttgagtgtgttctttcagttcttctgtgagtgtgtccacgagaaagaaaatttgagtgtttgtgattaacacctagagagtgaggagagattcctaacagtgagctcgcacaaatagttctaatcaaatccaagctatccaaacggcacattccaaagcttaacccgcgtaattccattagcttcccgagcgcgcgcgcgcgcgtcgaccggcttcacctgcacgctcccatggatcctatcgccaccgcctcttggccgtcgacgtcggcgtcgtcgtggccgcggtcggtgaggcgccgcgtgccggaggcggaggaggagagggagctcgggcggcgggtggaggagatggaggaggcggtggagcggctgcgggcggagaaggaggcggccgaggcggaggagcgggacctccgcgccgagctggacgcggagcgcgccgcggcggagacggcggcgagcgaggcgatgctgatgatcgagcggctgcagcgggagaaggccgccgcgctcttggaggcccgccacttccgccgcctcgccgacggccgcgccgaccgcgacggggagctccaggacgagctcgcctccctctccgcgctcgccgcctcctacctctccctcctccacgcccacggcatcgaccccgacgacgacgacggaagcaaccagcaagagcagctgcagcctcccgtcgaacacctggacgcggaggcagacagggagagccgctcggtggttgcgtcgccgcctccgtcggagaaggtgttcgcgtacgcggccgcgacggcgccggccgcggattgcggcgccgaggtgacggagaatctgtacgcgagggtggaggcgctcgaggtggactggtcggcgatgcggagggaggtggcggcgctgcgggcggagcgcgcgcaggcggtgctggcgagggaggtggcgcggaggctgtgccgggaggcggcggtggccggcgagaggggcgccgtcgccgtggcggcggagaggccgaggttctcggtgctcgccgtttgcaaggtagaatttcagctctgtgcatttgtattggatgatcaatcttgtcttgcttaattaatgttctgaacaaagcacttctggctcttaaatggataaaacttgttcaaattttgcctgatttcactgagctgttattcgccatgttgtacacttttaaaatgttggccttaaatcccttaaaaaaaatgttggccttaaataaaagttccctttcatgctcaaatcaaaatggtgttttaagtagtattggaggataaatgttatgggtttgtaggaacattttggttgcaaccgaacaccgtcaaaatactattcaaaatgtcaactgccaacaatttatagggcacattttggcttcaaatcaaaatggtccttaattctcctgccttgcaataacttcgaaattttggtttcggctagttgatgtaggccgtgtttagattcaaacttttttcttcaaactttcaacttttttcaacttttctatcacatcaaatgtttaaacacatgtatggagcattaaatgtggatgacaaaaaaagcaattacatagtttgcatgtaaatcgcgagacgaatcttttgagcctaattacgtcatgatttaacaatgtggtgctacagtaaacatttgctaatgacggattaattaggcttaataggttcgtctcgcagtttacaaacggaatctgtaatttgttttgttattagtttacgtttaatattttaaatgtgtgtccataaacttaaaaaaaattagcacacgaactaaacatagccgtaattattaaacatggagtggttaactgtagtcgttattgtgtcagcaattgcatagtagacgtgttgactgtcaagatcatttcctcgaaccatttttggttgacttgttccaaaaggcatagagcctcgcagggattattcctgttgtttaatccactttgtgtgtcctcctaatgccaagtcagagcttttgacataatctgaataggatcactaaacaggatgctgtgtgcatgttggctagcatattttctccaagattatttcatttttgtttggtgcaatacgtcatgtattttctgaacaagtctgtcatagcgttacgcaagtacggttcattttacagtggatttcgccttaaggccttgaatttcgttgttgctctgctaatgttgaaatgttcaatatacttggtggattattatgctatgtattgctctgcaaaccaatggtttctgaacttttcatttcacttccatgctacagcttttacagcttcgttagttcaaattataaattgatcattccaatgaagggtgtgtttagttcacgccaaaattgaaagtttagctgaaattgaaacgatgtgatgaaaaagttaaaagtttgtgtgcataggaaagttttgatgtggtggaaaagttagaagtttgaagaaaaattttagaactaaactcggtctaagtatcctgctatgctattctaaattctagtactatatatgcaatagttcaatgccacatccgcttccaacctgaaattatcactcgagaaatgataaggaaaatgttctttgctgctgtagtcttttctgcattagaaatgtgctcttgaattaaacttaattttctactgcctccagaaaccggcaagtctggcaacatttacgattccatctctctaatagtaatatcaccccttaaatcattttcacttttacagtggatttccttcataatcttcaggagaaagagatgtcatactgccaggtacgtaagaggcttttatgacttctgtttcgcctgtttctttgtatacttcaggagaaagagtctgactgtcagtagcagtgtcggatgaacatcgtgagcttattatgcaaagcaaattttgtcaaatctcaggtttacgttcagcttgtcgactacgcttctctgcctgcttctactcgtcgacaaatccgtcccgctgcatcgacgacgacggccacaaatgtgacatgtattcctttaaaaaaaaacatatgtgacatgtacaactaatacacgacgcagttcaaacgaccaagttcagaaatcagaacatagcagttttctcaattgtaaagccaaactgatgaactcctgtaaaatttgataacttttacggtgcaattaactagactgataaattatagcgtaaaagttctcgtaccgtttctgtcttctagccaataatttactgctacctccacttcatgttataagttgttttacctttttctaagttaatgttttttactttggtaaaatttttaaaaatacaatattttttaacataaaataaagaaactattaaaatatattcaatgttaaatttaacaaaactatttgtgctataaatattactatttttttataaaattgatcaacctcaaaagtttaatttttataaaattgattaaccttaaagtttaattttaaaaagttaaagtgatttataatataaaatggatgaagtaataataggcctagtggcggaaacaggggtagggtagctagggctactgccctactcctaaacctaaatttccactaaaatttatattttaaaatctcaaaacatataagatgaagataaattatgtaaattatactagttgacttgagccttatgtttaagaaaattatctgaattaggcccgaacatagactcggtggatttgaaatgctagtacgtttgtacttactactgtcatagaaagatgagttaaaacttgcaaacccaaaaaaggattgaacagtactacccaccaaaattggcatttggctcggatggcgccacgtagcatttgcaggcacctgaaactgttcctactgttcgtgcggctgtgccgcggcgcaccacgacgcggcggacatcgtgacacgtgaagaacgctcacgctcacgtaaccaaatacaccaacgcgaaaagcacggatcaaacacaacacagagcaaattcctcgtcgcattgcgtcaggacgggataggatgtggtggtggccggcgttcctgtacccgccgccggcgccggcgttcgtggcggcggcgtcggtggcgcagttcgcgttgctggcgaacgccgggctcggggagctccgcggcgagcacatggcctactccaagttctggcaggtcgtcgccgggaagaagaagaacggcggcggcggcggcggcggcgcgctgctgcccagccggcaggggatgctggtggcgtacgtgccggcgttcgtcgccgcggcggcgtcgttcgccgtgcccggcgccgtggtgggcgtgcgcgcccaggtcctcagcgccgcgctcaccgtccactttctcaaacgaattctcgaggtaattcatggccttgccagttgccaccggtttttgcaatcaactatgctcatagccttatagcgatagagtttacttgcgtacgtttatatgggtgagtgtgcgtgtgttatgagtttctacgttatactgtgtaattcttagaaaaaaatccatggaatgatgaaaattaaaagatgattgtttagccacaattcttttcatcttttctttaaggtggcaatgcacagtagcaaagttttttcggtctgctttgtatcccccataccccataaccacctcagcgtgttatcgatatatgctacttttttttctaatatattaatggataaggtttttacatgttcacgagaaaaaaaaagaacaattcaagatccttgctgaatgctagtggaaaatacatttgatttaagaacaaaactttaaatgcaaatgaaaacatttggcctgtacaccaccactaggtatgcaaagctaacgaaatcaaagcataaatatgcatttttttatttttctgcaaaattatataagtccagttagattgctcaaattttgaagttaataaaacattgaggtgtgaaaaagtgttgaattacagacggtggtgtatatcagtaccaatttgctaaatttgagttcattttgcttacttttccaactcatctctcgttttccgtacacagttatttaaactactaaacggtgttttttttaaatattttatatacgaaagttgctttaaaaataatattaatctattttttaaaaaatcaactaatatttaattaattatgtgctaattagatgcccaacacaggcttaaatattcaatgcattaaattgttttttaggtactgttcatccatcagtacagtggaagcatgccactcaacacggcggccaccatctcctccagctacctcgtcatcaccgccaccatgatctacgcgcagcacctcgccgccggcctcccggacccgccggtcgacctcctctaccccggcgtggccgccttcgccgtcggcatcgccggcaacttctaccaccactacctcctctcgcagctgaggaacgcagccggcggcagcggcggcggcgagaggcagtacaggatccccaccggcggcctcttcgggctcgccgcctgcccgcactacctgttcgagatcgtcggcttcttcggcttcgccatgatcgcgcagacggcgcacgcgctcgccgtggcctccggcacggtggcgtacctcgccgggaggagctgcgccaccaggaggtggtacgagtccaagttcgaggatttccctgatagcatcaaggcgttggttccatatattctgtaaatctttttcattttgatgaaaatttatgtaaaatgaataaatactgtacaagaaatatcttaggcttttcgtcgcttcgttttgaatttagactagctgtgacttgtgactatgcatgcaatgaaacaaataattatacgtgaggacaaataattatacgtgaggaaataataaatcccaacaaaaatgtggtgaaatttgattgttttttatctggtttttgatgtgccaaaacatccaacatctgatccgaaattttaaaccctgtgtcaattgcactagaagaatttctatttccttttgaaatgaaattaagcgcgagaagacctgttagccttgcccttaggttaagtctaggtcgttttccatttcaaacaatttcagcagacgatgcgactttctgtcattaaacatttttttcaagagaaaaacaggggtaatggcccagtaccatagatagatgacaaagattgaaattgaccctcatgaaacatataatgttccattgtgcgtaccataaccgttcttcaaaataatatggtaatttaaaattttcagttgattgtgatttcttagtttcctcaactatgactgactgaataaggattcgatcggatgtgtcagattcatgaatagtaactgatgggttggttttgaatgttcgaacatgttgaccttttaagcttgatagtgtcatctcataagcactgtaattaagaggcatgtcaagttgcagataattcaattgacatggtctagaatcctgcctatatgtattattggtcacggaaatcatgagatcaatcgacgtcaaagttgtcatagactgaagaagtacgcaaattagttgagacttgagaggtatagtattttacaaaaatgtaaattctcgttaagatctttcttcagaagttcagagatcatgattgggattcgggcagtcaaggatgaaaatctactctatttcaagttgtgcagattaatttactaagtaggtcatcattatctaaaaaaaatttactaagtaggtcatatgcttcttgcagggattagctgaaacttcactggatgttttaaatttgttctgaatgtttcttcagatatagcattttcttagtatcacatgaaaatggtcaaaagaaccttcttggatgaggataaaatatgaatgttttatgaaaaaaataaaacacctccaaatcaagtctagaacacacttcatagaacatccctggactcagtgagtttatttgactctgtcagaccgtcacacggcttaattaatacatgccgtgttaatttcctacatttcctaccaaatgtatcgaggttgacatgagcaggatggacagtagaaagcttgcttggaccttgtcatgtccgagtgaataattggcatttggtaaaattagtcattgtcatgagtcgtttgcagtcaggtgaagaaatctactcttgatagcgtgttatcgtcttaattatctgatgctgacaagttgaaatgttgttttgcctgatcaagtaccatgaatgaatgactctgcaaatgcagtcttatcatgtgttcacgagaagagaacatgcttttgtaaaccagttcacagatgaattttcacaccttcagtccaaatcgacctataaattgatagagaaatataaaaacagagtacgctgtgaattctcagatattattagagggatctgttctttttattttgacatgtatagattgaattcatcttaactacgcagtaatttattttcggtttgtttaacacaaatttgttttcaggatttgctttcagaattgtgcatgatcatttaatttagatggcgttcaaaagacggtgatacatgccctggtgtaaaatgaatttccctgatctcaagttcagataatgcctggagcttaattttcagaaagaaaaagaagaggaagttcataatctttcagtagaagaagcagttgaagatctgcaaagtaaaatgcaagtgctttttcacatggaatttgccttagttatccaacgtgcaaaaagcaaccatacttccaaaagatccaacaatggctagacaatttgtaatcaaacctatgtaaatattagatttatatttataaatatatatacacgctgtagaatccttttctacagtttttaacttcaaaacaagagaggaagttcagataatgcaaagtgagaaggctgatgtatattggttaaataaaatcaacaaattaattgcacttaatgtgttaactattaaaatgatcaagaaatgtacagtgccgaataacaaaagtaaaataacatccgaaggagcaatataaactgaaacaagctacacacatactacagaagtacagatcggttagcacttcgagtgcgactgttcgtgctaaattttcccctaatcgagaaaaattttgcacgaacactgtatgatctgatacaaacattgattagaaatttagaactctaagacataattagaacaaaacgcccagctcttgcaaggcctgcatcgtggtcggcgagaagaagaggctactcggcgacagaagagaagcagccgccggagatggaagaagaaatggatgcgccgaatggtcgtcgtcgtcgtcgtcgttgtcgtcaatcgccggcggagcaggctgacgctgctgcccaagcgcgagcaccagtgggtcggcggcggcggcggccctgcctccggccaccaggtccggcaatgtcgcggttggatccgacggcgccgtcgccgtcgccgtcgacggcttgccggtgagcttctgcacgatggccctgaactcctccggctgcgcgtggacgaccctgggcgtgagctcgtacacgatcaccggtcccatgtcgccgccgccggcgacgacacggggtttcttggtcggccgactcgcctccgccgccgccggcgacacgatcagcgactgcggccgcgggccctggatgctaccgccgcctggcctcttcgccttcgacggcgacgacgacgacgacgacatggctcgctctcgctgcagtggccgcgacgtttgttctcgtcagaagttgctgctgctgctgctgctagaaaacaacacccgcgaatgcttatataatggcgccaagcaaaaaaagatgacgtcaaaagcgcgcgaaatggtcagacagagttttttatgtgattaaattgaatattgctccaagcagcctgcagcgtatttaactaaactatgcagaccaaatcattatacacacctaatcatgcaccttaacacaaagatccgtcattagatatggttggtgttagtttaatgataatctaattacttgttaattagtagccgcatacttcctggacagtgcaaaatgctgtcgacagtgcactagacggtcccaaatatatatacttctctgacagctgcacgcgggtgcttcgtttcaggtggtcaggaactcagattgatcatcagcagctgcatctgcatccagtgcatatgaacttaattagcttgcttgtttaacatgaggttcaaaatgagacgcttgattaaaattaaccagagcgattaatcagagagagagagagagagagagagagagagagagagagagagagagcgactgagcgagctttgcgtagcggatgatgcacgcacgaacgtagtgcataatggccgcctggccggccggatcgaaggaggcagacagtagcttaattaaggtactagtagttatatttgactatgctaattaattcccatgcaaatctatctatctatccatccatccatataggcaggagtccttaaaaaatctatccaagcaggtcaaacaacgcaccactggtagagaaaccatctttcgttggtcggcctaattccacaatagtcccggttgcaacaaaaaccgggactaaagatgatatttagtcccggttaaaaagggtaacgggcatatttaacaccaatcgggactaaag

SEQ ID NO: 2826 - DNA, 1697 bp, Oryza sativa
ccacccctatatatatatatatatatatatatatatgtctttttcctcctccagcccgagcaagcttcaaaatttcttcaaaaaagaggggaggtcatgccaaaatttctagtgaatttattttggtgattatatacaaatcggaggtgcctaaaaggttagcaacttcatcctccaatgttttttttgtcatattacatttggagctatgttttgcacacttttttgtctccaaaattttgttgtaagttgatgagagagaaaatttgtgtggggaagaaagaatatatagaaatttagtttatttgctaaaaaaggttttataaaatagttgagaaggaaaatatagtgaaagttaatcttgaataatagaaaacaaactaaaatgaaaattaaaagaagtacaacacattaatattagtttaaaactttagaaatagtaaataagaattatttggtgcaatatttcataatttttgtatgaataatgatatgtcactattgtgtgactgttgaaagagtttgtaattattttataattattgtatgaataatgatatgtcactattgtgtgactgttgaaagagtttgtaattattttataattattgtatgactgtcattattgtacgaataattatttgtgtacgattttttttcatgtcatgtagatggatcggcaatggatgtacgctgaccggcggtccaaagagtttattgacagcatgcattattttttgagagtggccgaagctaacaggcaaaagggttttatttgttgtccatgcaataagtgtaagaatcagaaggagtattctgcatccaggactattcatttccacttgtttgagtcggggtttatgccaagctataattgttggacatcccacggagagcaaggtgttgaaatggaagaaaatgaagtggaagacgacaatattctggactttgctcagtacgctagatttgaaagaaatcaaacgggcgaggaggaaagggatgctgatggtaacgacgttgtggatgatcttggtcagatgttgcaggacgccaaggaggactgcgaaagtgaaaagggggcccataatttggacaagatgttagaggaccacagaacatcgttgtacccaggttgcgagcaggggcacaaaaagttggataccactctggaattcttgcaatggaaggcaaaaaatggtgttagtgagaaggcatttggcgatttattgaaactcatcgagaacattcttccggagggaaacaaattgcccgagacaacgtacgaggctaagaagatagtctgccctctaggactggaagtttagaagattcatgcatgtccgaatgattgtatcctatatcgcggtgaggagtacgagaacctagaagcatgccctgtttgcaaagcactacgatacaagattagacgagatgatccaggagaagttgacgggcagctaacgaagaagagaattcctgctaaggtgatgtggtatttccctatattaccacggctaaggcgtttgttcaggaacaaggggaatgctagaatgatgcgatggcacgctgaagagcgtcaacaggacgggatgctgagacaccccgccgatggttcgcagtggcgaaacatcgacagaaaatttaaagacattggaaagaacgcacgaaacatacggtttggtttgaagttcggatgg

SEQ ID NO: 2827 - DNA, 19132 bp, Oryza sativa
gtagtttaatcttagcaatcttttcagtcttttccttttctttttccttcggcaatgctatttttaacctttttgttgtgtaacttaaactctactttcttctaatattttagcgttaactcttttgcgtgttcgcgaaaaaaagctactaccattaacattttaaaccatctccctacccctctattttcatttacttatcatcattaatcatttctgctacgattttgattattaggaaattttaaataaacggaatgtttaggatacaatatggtactttaattaatagtatggcataccttttaagtatttattttttttttaaaaaaaaaagatgagggatcaaacggcagggtaattttgcaccgaacaactgaattgacaaaagaaaaccaaacattttttgcaagcagccaagtgtacatgcatctccctttcttctcttctcttcttttgggaggatcacttgagatgaaaggctctgaaaacaatgtcacatctgcaaatcctggctgaaactgaaagcaaggaagcatgacacttctgcaatttctccaatgtttctctctctctttttttccatcccccccccccccttttttttctcttcctgtgtccaagattgttggaatatccccttcccatgatgtgaaaagattcccagcagcataaaagtgaaaaaaggtaaaaaagaaaaaaaaaagaaatccaagagctggcacatttggatgtggttactcaatggctggataaaaatgtcaacagtgttagtgctttccctcaggttgggcaaggaaaaagagattaacccaaacagtttaataccttcctgacagataactaatctaacaagtatttccatgcaactaaacaagaattctgatcggccatctttcagaaaagaacagcactggccctagttcagggctttatgctggaagtaaggaggccaacacaaattcttttcattataatgagaaatactaacgtgtagttattattttatctttaatagattgataaaaggtgataatataactaatcgtacttaaacgacaactttaaattagagaaacggcgagggtaacaactttgaagagagggaccctcccaaaagccacggaatcatcactcacactgtaacacaatgtaaaatatcaatctccgtccacaaatataagaaaaccctgacagtttagcagagttctagattgagctaaaactatctgattaagaaatattacgtctagcggtgcaactacagcaataaataaaatgaactggaaaattggtacttcttcgataaccatcgtaccgataatcagatattctaaactctgtgtataaatcccttatatttgtgaacggagtagacgaagctgggggaaccaaaagcaggctaggctggaaggggaccgacacaaaggcaacaacaaacaacaacaatctcaagcacagtactgtagcatactcgattaccagtaatcttggcatttggcgacgccatcaatcgtccgtaggttttctgtacctgcatgactccatcaacaaggcaagtagcagcagcagcagcagcagcaagaagaagccaatcctgcagctgcaggctgcaggcaaccatactgccaaacagtatttcatccttccatccactcgtcagtctgtctgtctgtcagtcagtcggttggtcagtcactggctgctgcaatccaatcccccattggaggtgacgagtgtgctcttgcgccggcgccgacgaggatgggctgcctgagccggcatcagctctgcctcggcggcaaccgtacggccctcttcttcttctcctcttctttgtagctgctttctgaagaaatatttggttcttgatttgatgccttgtggccattcttgcctttggttttgttgcagtaatgcattagttttcttgagatttttctcttttttgttcttttggaaccagttgtttaaagcaagggaattttggtgatatcatttggtttcttcagtcttttgcgcacaccctgcagaagaattttccacattttcagcctgaattttcgctgaattttctcatatttttcttggcaggtgggttgccattcctaaggaaattcaagcacaaggagatcgaggcggcgacgaacgggttcagcgcgatcctggaggccggccccggcggccgcgcggcgtacagggcccggttcgccgacggcctcgtcgcgacggtgcggcgagccggcggcgacggcgaccaggacagagaggccttctaccgcgagctgcagctgctcgcccgcctcaaccaccgccacatcgtcaggctccatggctactctgacggccactccaggtgaggttcagttcatcactgtcctgaattcatctgaatctttttgtttttcgtttgtttgtttggtgttgaattgttggttacagtgtttgttaattttttctgtttgatgtttcaggtttctggtgttcgaccagatggagaacaggagcctgaaagaatgtctccatggtaaatttgcttgcgcattttgtggcagaattcttcagaaattgtgtggttttgtcagtcaagtttgtgatgatggttaatttcttggcagatcctctcaggacgcctctgaactggaggaccaggttgcaggtcgccatagatgttgcagcagcattggtactataaatctccatactacattgctctcaacatgttacacaaactggcaggaaaatgcaatttaaagtcatctgatgccagatttggtttctgaacttgtatagtgagtgacatcacatcacattgttctttgttgtgtggtgatgcaggaatacctgtactacttctgtgatcctccggtgttccatgtgtcggtcaactcaagcaatgtgatgatggatgccaattttgtcgcaaaggtaagattcacagtaaccattgttcatacatgtctgaagcacatcgatcgaccaactgaagcttgtaccattttcagttatcagatatcagtgtcatcggttacgacccgaaacgaacggtggaatccaatgctgcatcttttgaaggtctagttaccacccaaacaacagaaacaactccagatttgtctcttctatatcaccttgtgtggaacattggcaggaactgacactgacagcattccatatatgtgatcttcagatgaaattcagcagaggagaagggacctggtgttccagtatggtgtgctgatccttgagctagtgaccgggcaatcgccgggcggcgaaggcgagctcgtgcagtgggtgcaggagcctggatttgcctgcacaatgtacaaaatggtagatgcagatcttggcaatatctatgactccaaggagcttcggaaccttgtgatcattgctaggttgtgcacaaggcctggaaatgatgcaatggtttcgattccgctcattcttcggtatttgcaagggaaggtggcaaatcttgggtgtgaaagtgaaaacatttgtgaattatctgtgtagggagcagttaaaattgctccatcttgatctctgaaataatcttactttctctgtctcctttacttgtagagagaattttcttcttgtgtatcattagcattatttttcatgtccatagaggaattacagcaaatgaaatttgtgtatgttgaatatgaacatggcatggaaatttctgatgtgaactcaatagacaatacattcaaaaatgctggtacttatctagtgaaaatgcttgtgaatctgggattcaggacaaattcaatgcattctgtatcacaggggagatttgtacatccagtatattgattgacttcctggttcctgttcctgttctcaatcaattcacatccaaggacagacactcaaaatttattttgagctgtacagcatgcgaagaatgttcttaccctcaattaatccctttttattctattactgttcagaccatttgtgtcaacttttgaggaaattttgttgaaactcatccaacatttatatgtacaaagtagtacaaaaatatagaattaggtggtgttattttctcctgaagatgaagatgaagattaagattaagtttttaacgcaaaacgaggtggtattagcgtatgattgattgagttttaattattacaaacttgaaaatagattaatatgatattttagagcaactttcatatagaaaattttcgcacgaaacgaaccgtttaacagtttgaaaagcgtaccataaaaatcttaatctttatctaactctagtcgtcaaattcccaaatgaacaaatttacatccgtggaaacaaacaaatttgcttcattttttgtctacttctagtgatattttctgatgtattacaaacgaaaaaaagaaaagaaaaataaacagagagcatcagaccaagaacacacggctcacctgatgacgtcacgtcacgacggcctgacgagagccagcggcgtcacctcggcgagcggcgtcggcatggggctcggcagcggcgacgtccggcagacggggcacgtcggccgctgccggagccacgggtccacgcactcgcggtggaacaggtggccgcagtccggcagcgcgcggagcacgtcgccgtcgccgtagttctccaggcacacggggcagcacgtctgcgtcgccgccgcgccgccgcgagccttcctcgcctcgccgtagaccacctccgggaacgcctccagcgtcgcgtcgtcgatgccggtgccggtctcgacgtcgccgtcgtcgcgtggtcgaggcggagatggcgggcggccggcggcggcggcggccaccggcatggacgtgcggctgcagaagtagatggcgagcgcgacggtggagacgacgaggagcacgccgacggaggcgccgacgccgtagccgaacccgccgatgccacccgacccaaatatactcccgccgccgccgccgccatcgccgccacccggcgatgggctccccgcgctcattgcctagctaacgcaagcaagcaagcaagcaagcaagctctagctgaggtcgaccatggtgaggcagcaagaagcaagctatggtctccaatggaggaggagaaggaaacggagacgcaggtggtagcgtggcgtgtttagttgcagctcaaggtcaatgagttggattaattgcttacttaattaattaattaattacgaatgtgcaagaaaaataaataattacgactgtttgctagcttgggttggattcaattgtttgtctgtacttaatatctaggatcttgaattctagatgtggctagatttctgcttagttgtgtgctaacacgccaggttaattaagttttgacatgtttttgttcgtttctttccatgtcttttctctaaccctgacgacaacatatgtgtagaagtccataaggtcttctaggtggttccttgtgattagctacagtcatcggattaacattcatcatttttagttggtaccaacttggttgcggggtatatacgccaatgtttagcaagattccaattactatacctccgtcccaaattaaaatttcatcttaaaatagtcatcactatacacatcactatacagtaccatatgtcccatcattgacctctcatttaaatatatttttctactttattctcattcaccctcctactttcaatcatatactcttattttgttttttaatatatggcgttgctgattttctatgctatagttaccatttgttttatttaaaagatttatgtaattattatttattttattgtgatttgatttatcgtcaaatgtttttaagcgtgacttaaaatttttatatttatataaaaaatttaaataaaatgaatagttaaatatttgttaaaaagtcaatgacttcatatattaaaaaacatatataatattatttaatgagaggtactatttttaaagtgctataattctctctacttaaactttaatttatactaaacaacctagaacaacatagaatggcaaatactccctccatctctaaatatttgacgccgttggctttttaatatgtttgaccgttcgtcttatttaaaaacttttgtgaatattattcaaagactttaactttagtagtatatttaaccatgaatcaaatgataagaaaataattaataattacttattttttttaataaaataaacgatcaaatatgtttaaaaaggtatttagggactgagcgagtatagcggaggtaagaattcttaggcatggtcactcagagactaatttcaggggctgagctagccttatgatcaaagtctgttacttcctccattttacaatgtaaatcattctaacattttccacattcatattgctattaatgaatttacataaatatatatgtttagatttattaacattactataaatgtgagaaatgctagaatgatttacattgtgaaacggagggagtacatcattagttagcactcgttatttacatgtcaatggaaatatttggaaaaaaattaactcggagaggaaggcgagaaagaaaagaaaaaaaaaaagaagaagagttgccggcgcgagaccagacgaagccatccgatccccacccttcctcccctcccacctcatcagcgctggcggcggcggcggcggcggcggcgtcccctggatccctcggcggaggcagcggcagcggcggcggcggcggtagatcaatcgcatttgtctcgctaaatccggcccgcgccgcccgtcgcgtcgcggtaggtgggtagggggaggtgtgtcgcgtcgcgtcgcgtggtagatgcgctcccttcccgcatccgcggtgcctgtgcgtgccctccacacgatccccccctcccgtcgtgttcgtccgaccgtccggcagatcggcgaggtgagctctctctcttcgtcgtttccatctcctcccccatcgttgaatgaattaatccgcctctcttaaggcttttagggtttcgttagcttccactatcgatcatccaccccgccccgctcgatcgcgcggcggcatggggtttaatttgctcttggttcctctacttttggtttggtgcgagtggtgtggtgtgggtgtggtgggtttaggtggatctggcggtgatcgctgtggacgggatctttagcctcctcgtcgagacggattgaccccaattctgtctgatacaatcgactggacttggtgtccaatttgtgtgttagtcattggtttcggtctgcttcccctcccagttactccacccaattcttcagaattgggtggtggcctggtgtgcaaaaagtgcatcagacaaaatttgtatggcacacgccccattcaattagtttttgtgcgtttgctctagttgtgaaaatggaatgctgccccactttgtggggaatgaaagatgattgctgtattggcgcttgcaaaccaatcctagtgctttgtagttgtgcgtttgctctagttgcgccgttaaggcctgggtgaaaatggaatgccgccccactttgtggggattgaacgaaggttgctgtattggcgcgagcaaactgatcctagttctttctagttgttgaggtccatgagtcctcatgaaccaagtcgtcaggtccgtgaggaatctgtgaggtgaaagataaccgagacgactttggtcaatgtcttatcatgtaatcttgtctaactagtactcgtaactacaatgatgccatgggccaataacagctactagaacacacaagacaacagaatctatccacaataggaatatacggcgcgaccaactcctgagttagcacaaatcattcctaaaagtgcacatcatgtttcagccctttatggtaacatcttgaccttcactgagcccgaccaactctgagttagcacaaatcgttcctaaaagtgcacatcatgtttcagccatttatggcaaaatcttgaccttcaatgagccatttctctaagacccgtcttcttggctctgcaaccaagtggcggccttgaccatacaagaagttgggtgtcgcttggtgcgccgttggccaccaacgtagatatacaatgtcatgcatgtattagcaggggcaatgctgcaatggcagcatctcgttttttcccaggatgtacttatatagcttgactttgtaagaggttttattccttctgatgcataatatggttatgcactgtttctctgccttttagaaaatatagtttgttaaaaggtatgtgtgctgttttgagtagaacaaaaatgattgatctggcatggcactaagtgtgttctgttatatttctctctttgtaaagcaaacactcctgaaagtactatactctattggccttgtaattcatttagggtactgtagaatcacagaactaactaaattaatggcctctatgtctcaatgcattgcttgaacttactaggcttgtcttttgctctcacatgcgcatacatgctgtttgttcgaaggtgatctgagtatgttcaattatcatgacgatattatttatttcctcatgctcaagtctgttgctttcacaatcctcatttatgctttattgaactacatttaccataatatgatttatgttcatttggcatggtttctccaggatggaaatgttcttcagcagctttcttaatgaatcggcatcatcagagaacctctttggtcatccaaatgtcgagagatgcccattcctgagaaacatcaatggagctacaacatattcattttcttctgctttgccagtagctgtaagatcttctttacatgacctctggtgatgacaatatcaatatcaaaagtgcattggatccttaatctgtgctattgtgcaggcccgaggaggaaatggtccaatttttgaggacggaccaggctttgattcagcatttaaacttttccatggatgggatggaatagttccgctttcaggaaagtcatatttacctgatgagagcaacagtgagagcattgatgccaatcctgaacctgctctgctgtttaacccattggctgctagagctgccacaataagtctatctgcatttgggccatttggttttaacttctttaatggcaaggggaaaaggcagaacaagaagcccaacaatctaaatcagtcaaacaagaagcccagcaatccgaaccagaattccatgaaagtttgtcctcattccttccttttattttgtttcttttttcttatggggctatgtttgtgaaatcctatctggtttctcgcaatcaagtcctaataacaatgcaagcctcaattatctatcttaattttgtctattattcaaagtaagaatgttccctactaacttttttaccattttgttataacgaactgatccagaatttgttcagttgaagttaatgattgtgactttggttcacaagtaggcattttggcatttccttggatgtttggctatatgttacttttcatgtatccaagtgctaatgttcttgatcggacagccatagttgcatagctaggattttcatcaatccgatcagttttctcatgttacgttttgaaccattttcagcagaaaggaggtaactcatcatcgcacgaggcaatgagcaacgaatggatggaaaatgggcagtgcccacttgcccggtcttaccgagcaatgagtggcattctgccccttgttgcaaaggctttacaaccaccagcaggtgtgaagctgaagtgcccgcctgctgtggtcgctatacgtgcagcccttgcacggactgaacttgtgaagtctctccgtccccagcccctgcctgcaaagatggtagccattgcgttgcttggaatggcagcaaacatccctctcggggtgtggcgtgagcacaccaagaaattctccccgcagtggtttgcagctgtccatgccgctgttccattcatcggaatgctgaggaaatctgtgaacatgcccaagactgccatggcattcaccatagcagcctccattattggccagacaatcgggtcgagggccgagcgcattcgtctgaaggcattggctgcaaagggcgacgccgattccaccaccgtggctgacatgtatccaaacaagtctggcaattgcagtgacactgagggcaaggcatgggatccgctcgcgatgaagatggctggacgggcttctggtggcgttgctgcaccaacaccaagcatgtgtttctgattgttcattgcttttgaaaatttgtgtctataccagtatctctgtatgtttgagagttgatattgagtctatttttatcttgtgatgtaattgcctttccttgcccctcagaagtatccgtttgtttgtggggtgaggcaagtggaataagagtgctgcagttctgcagttaagcttgccagttctgcagttcatgcatctgtaatttgatgctgcaggatttctgctattttaccaatcatcattgtactgtgtgtaacctgttggatgaacgcttgttagctgttctggtgagtgaccctgtttgaattttattattgagaggattatcactgtttattattatgtacttaattatacatataaattaaatatttttagaaataaacttgacaaatatcttaaaacaaatgggttaagtaatgcagtataagtctttttttagaaaacacattttttaatcctagagcaaataattcgataaataaactaacatttcaataatctgataaatacgctgaaaaaaatatggcttggacgttggctatacagcacagtgcccacacagatcaacagccagactgggtcctaccggcagtgagagggagagagagcagcctgccaagtggggcccagatgcatagagaggtgtatgaaagcgagattaaccggaggagcagcacggactcccgccatttcctttttaccgccatttttcttggcgccaagcctggctttcccgctacgcgctcttatccctcctatgaactccccgatgttttcctacggtaagttgagaaataccagggtctttcggctagctcgatccacaaggtggtgggctagacgatctgagttcgaagcctcaccctttctaattatttatattagatcatttcttaatattcgcgttttttccctacggtaagtaaggcctcgcttagttctaaaacaaaacttttcccccatcaccccatcacatttaacgtttggacacatgtataaagtattaaatatgaaaaaaaatatcaattacacagcttgtgtgtaaattacgagacaaatcttttaagtctaattgcgtcatgatttgacaatgtggtgctacaataagcatttgataatgacggattaattaggtttaataaatttgtttcgcggtttcctgacagaatctgtaattttgttttgttattagactacgtttaatacttcaaatgtatgtccgtatatccaatgtgacaatcaaacctaaaaaatttccccaactaaacaaggccttaagagaaatgcttgccatcaaatggaagaaaaaaaaatggatgagcccgagggaacattaccgacattgcatggtgcatgcagtcaggtttagcaagcctattcaatagatcgaaaattcaaattattttttctcttgaatcttttacaatgtatgtatcgattaaaacatcatgtcaattacattttagcacgcacacattctcccatgctgtattaattgtattctgatgaaattcgtgtccattcggttatatgatgatcaatttgagaaattttaaattccattatattatgatcaatttagaaaggagggagtactacgtatttctatcatctcaagaacattattccaatattaatgacaactttaatttaagcaaattttgttgagactcataaaacatttatgtacaaaagagagaattatagctagtgatcaagtttcctcactgagaaaatcccttatatacccctgaaattttttctaatcccttctatacccctgaattttgcttacttccttatatacccccaaaatttgattttgatcccttgcatacccctcccgtcagttgaccgttagttgaccgtgtattttctataaaaatgaccattttacccttggatgaacaaagaaattcatgaattacattattaaaaatataaaagcttctcgcatgagactattatagttatgagtttgttgtgcgatgcattatttatcccaaaaaaatatttttagataatgaaataaaaaaaatacgtatttattttttaaaaaaaaggtcataaaaatgaggagcattcatataaagataggtataccaatgttcacaacattttttttatgaatgctcctgataaaaaaatccattgtcctattaaaatttcaaataaaaattttaattttttacatttattttattttcaaaatttatgtcaaaattttctgcactaattatttagtctcattagttttataaaatgcacacgatgtgcactcaaacaaaattttcaattatttttgaagcttatatttaaacctaaagcatcaagggcaaaaaagacatttgcaaccaaacgtaacagtaaaatgatggaaaatgtaacggtaggggcatggaaggaatcaaattgaaatttcagaggtatagaagggatcgggtaaattttaggggtatgaaagggattgagtgagttttcaggggtacacagggaatttactcttcttcacttgaccaccattcaacctataattacacaaggaacccaaatttacatccattgaagcaatttcgttccatcttctacttctagccagtgacattaattaattgtggtgtaacaaataaattaatgaatggaaagaaagaaagattaaccataaaatttaaacagagagctgcagaccaagaacgtcggcgggcggcgccggcgatggcggcgcccggcagaccgggcacgtcgggcggcgccggagccacgtgaagatgcagtcccggtggaacaggtggccgcactccggcagcgcccggagcacgtcgccgccgccgtagctctccaggcagacggcgcagctcgtctgcgccgtcctcgcctcgccgtacagcaccagcggcagcgcctgcagcgtcgcctcgtcgatgccgacggcgaccacaatgccatcgtcgtcgtcgtcgtcgcgccggcgttgaggcggcggcgcgggcggcgccgcagggaagacgcgtttgcagagctgcgtgatgccggccatgatcaggaagacggcggcgacggcgcagaggcagacgatgacggcggcggcgccggaccagcttgttttgtacgatgagcctcctccgtcgacgaagacgggccagtcgccggcgccggcgcccattaattggctcctcggagtcggaatcgattgacgtgacgtgacgtatgcacttctacgtaagcaagctagctgaggcttggtcattgatctgctcgctactatacatatatatacacggtggggtgtattctaatccgttgagcggatttgcggatgtccctcgtgtattttttttaaaaaattcaaacaaatgttacgaaagattttgaaaaaagttgacaatgatgtaatgatatatatctatcggtccatcaaacattaagttcaagtttgatctacacaacattgagaaaaaaaaaagaagataaatttaaacgtaaacaatatacactattcatatgctggattttttttttatatctcaacgtatgggttaagtttggacctaagattttgtgaagttttatacttccgccgttttacaatgtaagtcattctaacatttcccatattcatagtgatgttaatgaatctagatagatatatatgtctagattcattaacataaatatgaatatgaaaaatgctagaatggcttacattgtgaaacagagggagtagatatatgttgtataagtgtttttcaatttttttccagaattttttaccgtttgaatggttttttttaagtaaatgagtgaatattttctcgagggataaaaaatatatacacgacgatatatataaattcgtgttggtgcgaatcgtttcaaaaatatatacacacaacggaatatgattgggaaggagtgcaagaaaggaagacacggaaacgcatgtggtatagcgtggtgtttttagttcggggtcaaatgatgagttgtcttcatacgtaaatctagttcaaagcgtgtgttaagaggtcaagagagactcaagacacatacgagcgtaattaccctcgtatagttcttaaatggctaaatgctccttcagctcttagacgtttaaaatagggttcgggcatactaccttttgttttttttaatataggataccgttaatttttttataaacatttaatcattcatcttattattttttttacaaactaataatatttaaaccatacataaataatatttgatgataaatcaaatcacagtaaaatcagttagtagcagttagcagaggagattcaacggaagtcaggtcatattggcgggtccagatgggcgtgggtcggcacacgagtaatgaaatcagttttcggtacttcggtagtagtcccccttccaaaatataaggcacaactaccattaacccaaagaccaagaaacaattattattatcttctagtttagatcaccctaataaatgtaatgcatgcatccaatagaattagaaatcttgaggatggatgatttaaaaaagcaataatttaatggagaagatgtcctaattaattatatgcatgcatgcatgccttatattatggaacatccaaagaaaaatagttatgccttatattatggaacggagggagtatgttacagagaagggataaaaagtccataacaaatctctgagctagtgtaaacttttaatgacatatagtggaccctctcttaattcatccagcgacattatttgcgcggttttgaacgactcgcataagacggtgcgaagttatattgatagaacagaagaaaaaatacaagattacaggttgtaaccaggaaaaaggaaaaaatataccaccacccatacaccgacaacgccaaaacattgaaccaggagaaggctagcacgggacaggccgccactaagcgtgaccgactgccgctaggccaacaaagaaaacacagccgggatcgcccaaaacccaacccttacaatcaacacaaagtcccgctctatccaagtcttcaggagttagggaaagagggtgagagagaagaatgaaactcctcttccccttaggcctctgacgtggctaacttgtagagactaggacgccgccacaagaggatgaaatctacagtgagcttacaccaattggttgggtggtttcggctaggggatgcctaaacgacgtctccaagtagagaagcgacggaaagcactgccgccgccgtccgtcaaggtctaaaagagagccaagactgagctttcgcccggcatctacacaagagggatgagactgcacgacaacgccatcaggaggggaatgacgcttcaagcgtcatcattgccggcccggctgaggccgggctggattttcacacgccgctcaccacctgcgaatccatgctggcgccccgatgctctaccactatccaacctctgctgacatatgggaccactgcaccggtgccccccgccggccagccttcgtgcgccgtagtccgcaccgcacccgccggcagctcctcctcctcgcattgtgcccgcctccgtcaccgccggccacgcctcgtcgcgccgtgccagcctcctcgctgccggttgcgcatcactgcgccaagccagcctcgtccaccgctggccgcgcctcaccacaccaagccggtctcccgtcgccggccgcgtctcctcgtgccaaaccaacctccaccgccgccggccgcgcctcctatttgtgaggttttgaattttgcaaaaccttcttcctctagtaagctgcatttactctctcaattcaaaagtgttaaatgtattacttttgacacaaagatcaaatagaaattaacttattctgtatgtaacaaagattaagtagtgtatgcgctgcatgcacttaataagtattaagatttaaaactcatagaacaagatttaaaatatcagaagtggtcaatatatatgctgctacttataaaaaaactgggattgttagttctggaagcatttttcgtcccatcttattacccttcacagaaatgctagtttgagtttatttttgagtgatgactgccaataatgcctcttatcttgaagtagttgaactgcagagcggtttgtaatggcaaaacatacgctatgttaaagtacgtacatatttccttttttttcactgtgcaagtttctcgattaggtagtaaagattttcacatcactcagttgagtaatcccgcttattttgcttgtttttttagaccttttggttaagatttgaacaatatatatcttttgttggaatatgaagtggatctgtgaaatacatgtagcgcgttccaaggaaaagctgaagttgaatcactagacaggattctttcagggctgttaaaactgaataaaaacaaggccaattgatcatatgtttaaccatccattcagctgtatttaattgataattaaccatccattccgcagtactccctccatttacttttgatagtcatattttcaaatctgaaatttttatttttgatagtcatatttcaatccaacaacttatcatcttaatggctttcttagatttaatgcgtgactcttcattcttccaaacaagattggctacatgggcatcgagaaatgtaaatattaatgaatcgcttgtttacgaggaatgaccagtactctctccatttctaattgatcttcatatatgatttgtgcatcaataccaagacaatcctgcggagcacttaatcagcatcgaaaacatgcattagcgtttcgtatccgtgaatgtagcgccatcaattttgcatactgtattgctggccaatcagttgtgagcgtattaaatccatgcatgcagcggctcctaattagttttgcatgccgcatagcctgaccaatcagatgcatgcagtgttcgttaggaagtgtcattaacgtccttcacaggattttcatcgcctctccaccgtaatgcgaatatcaaaatggaattatcatttttttcaatacgatgatcaaaagggaacggagggagtattccaaattgatctacatatttcataggtacactaagaccaagaaaagctaataactctctcatactatatttactctagcaacaaactcaatgcatgcaccatccccactatttcctagctaatagcaaatcaagatattgcatgtggattataaatgcttgtgatgcatgcatcaatgtcaatttactccaatgcacaaataacgaatagacctaatgaataaacacaaatatgtactaaaaaacgagtagatcatttagaaataacctaaaaaaaactatatatagatcaatttagaatggagggagtatttaaatggataataagtagaatcacttatccttggtctgtgtgtcaagatgaaatatgactatcaaaagtagatggagggagtatcttttatagtactggtttccgtgtctaacgtttgactgttcgtcttatttgaaaaagttatgaaaaaatttaaaaagataagtcatgcataaagtgttattcatgttttatcatctaacaataatgaaaatattaatcataaaaaaatttcatataagacaggtgatcaaacgttgaacaccaaaacctaggaatttagtctttttgggacggagagagtatcagataaccagaacattagtcaaacgggccaacagtcattcagtcaaacgacaatgggaataaaattctggaaaaacattcttgactttgctctctaaatttcatttttttttgacgaggaatttatgcatggtcgttgctcatctcagtaaaaatacattcttgactttgctccctaaacctcaatttttttgttaatctaatactctttctatctagcgaggaatttatcatgatcaccggcagtggaaagaaattctttctttgctctaaatttcaaatttatggcaagtgcaaaaagagttctgactttgctctagattttgctaagagtaaattgcactttgcacccgataaagcacgcttagtttcactttacaataggtttagcgtatacatgttgccttcaaataagtttcgcttagaaccaggatatacatcatcaaatctatagaaatttcataaaatcaaattttataagatatggatgaaactttgtgaaaacatggtctttatttttttaaaaaaatcgtaaggttcactcatgatttataagattttgctttagttatatgacacaatctagtgcaaattgaaaattattttgatatgtcctgatacaaagtgaaaattgtcagggtcatgggtaaggtataccctctacccttggatgtatgttgtatactgatatggtatgcctgcacgtatacggatgtttcctatatacgttaaggaaattcatcatgtaacagaaacggagtccacggatggaaggagtcctactcggacagagctgggtcgttactgtatcgtgtgaggtccgatgtctctgagttctacttaaaaccaattgacctgcggtataaaagggaccccccgagaggacctaaggcatcgaatctcacagtcaacacatccaccacagcctacgaagtcggagcctacaggagccaagtcgccgggtgatctagtcgaaccaactcgactacggtctcgtcggtatcatcgagttctgctattccctttgtaatatgtggtttccattatataatctcatatcaactagattagggctattacctattaaggggcctgaaccagtataatccttgttccctgtttgcttgatgtcgtactacgtagatcctcatatcagcgtatcccaataccctctatatccggtctacgggtatctcccgtcgacaaaaatatatactactcc

SEQ ID NO: 2828 - DNA, 16744 bp, Oryza sativa
  unsure (1)..(16744): unsure at all n locations
ttcctgcagccctactccctccatctacttttgatagctatatttccaaatctgaaaaatttatttttgataggcatatttcaatctaacaacctatcattttaatgactttatcggatgtttatcggatttaatgcgtgactcttcattcttccacataagattggctagatgggcatcgggaaatgtaaatattaatggatcgctggtttacgagaaataactagtagcatatttaaatggatgataagtagaattacttatccttggtctgtatgtcaagatgaaatatgactatcaaaagtagatgggtggagtatttttttaaggaaaacagcgtaagagtgccttttcattgacccctaggtgtgtaaatcgaaaaagagagaagtcaaactgaaaatacatagtaaacccaatgcaaaatagaacacccagtgcaaagtgtaattcactcctccgcgataagttcacctgacatccctcacgtttacatcaagtctgttaagatccccaattcccaataccataaatctctaccccttaattatttaaaaccgtccaaagttagtcccaagacagtaaacattaaaatttttcttggtttcactgatgtggtatatgtcaggccccacatgtcagtgtaccagtgagacgttattagacggagaaggctctcctggtacagcaagacgatacttcctccgtcccataatataagggattttgagtttttgctttcaacatttgaccactcgtcttattcaaaattctttgaaattattatttattttatttgtgatttactttattatctacagtattttaagcacaacttttcattttttacatttgcaaaaaaaatttaaataagacgagtgatcaaacgttgcaagtaaaaacttaaaatccttatattgtgggccggagggagtacgattgaatttcttgttgacctgaccgctactgcaaacttcattgttcagattggagattcgatccacaaatgatctgaagctacgtacccctccagtatgaagctggtctggataatcttcagtcatgtcagcacgtaacttgtgcggttttgcctacaaaaagcatttgctgtaacttgagctttaatccgtgcacaataggacggcatactccctccgtccataaatatttgataccgttgattttttttaacatatttaaccgtttgtcttattcaaaaaatttaagtaattattaattattttccaatcatttgattcattgttaaatatacttttatgtatacatatagttttatatatttcataaaagtttttaataagacgagcagtcaaacatatttaaaaaatcaacggcgttaaatatctagggacggtgggagggagtggtaaatatcattatgtgtgcacaatttgctgtaacaagctgcagcctgcatcccaaccagctgcatattctagattagttaatcatggcacaaattttgataatttgactctttgtaaaaactaattttacaattaaaccgtggccaaaacttatttaaaaaatgacccttctatttagcgttaaatcgtatgacgctgaatttagacacctcagcgtcaaatagcacggcgctgaatgcacgttggcacgccgactcagcctcccatccgcagtggcacggtattcagcgtcagttgacgtgacgctgaggtatctaagttcagcgccatacaatttggtgctgaacaaaagtgtcatttctaaaataagttttagtcacggtttatttgtaaaattaatttttgcaaagagtcaaattgtcgtaatcatggcccgtcgagctccgcgagcattttgccaaccggcatggccacttgctcgccgctctctgaccttatgcctttggctttccacataaggtcgtcgtgtgggtggaagccgggtgacgagatgtcggcgttccaaggcgtaacggagcctcgcgagagacctcttcgacaggcgcatgaacatatgggccccgactataccacatcagcgaaaccaagaaaaagttagaataaattcatctgaggtctcttaacttgtcaacaaatccgattttcatccttcaaccggaaaactagatacaacggtcactcaactgtcaaagccggtacaatataggtcccatggcggtttggacggtggtttttgctgacacaatataggtcccatggcggtttggacagcggttttcgctgacatggtgtctaggtggctactttgactcagtgttcacattacgtgatgcttaggtggtaatttgatttgggaaatattaaaaataggtgacatggcgcacggggaggtgttcatctgtagcttcttctcatctccctgtcccgctgctgctggcacatgctgatgcagcgtgccacctttgaagtgaaatgcaaaatcaaagataatttacatgtccctccatcgacccgtacttttttaaaaatgtttgaccgttcgtcttatttaaaaatttaagtaattattaattattttctaatcatttgatttattgttaaatatacttttatgtatacatatatagttttacacatttcacaaaatttttttaataagataaacggtaaaaaatatttaaaaaaaagtcaacggcgtcaaatatttaggaaagaagagagtaataaatattagatcgatcactttccctgtaaatatacactagacttcctcggaaggatcgagcacatgtcctgcgaagacgatggattgcaacctctcctcgacgatgaagaaggcgaacagatggtcggcaacgaagtccaccagcttcagcggcggcgggtagtaaccatcgtacagcgagaacccgagatcatcgtcggactcctgcccacggggacgcactccggcgggaggtggtcgtcgacgaactccggcgaggaggtgatcctgtcgagcaggtccgatagaccggccgtcgcggtcgtcggggaggaagacgagcatggcgaacgacgggaggctgtcgcggagcttgaggtcgttgtgggtgtcgccgccttgtacggcaggcggagcaccttgaagccgtcgtggcacgcgacgtggtggtagcaccccgccggccgctgcatgaaggacacctcgacggagctcccgtcgtcgaggcggcggaactcgcgctccagcgcgatgtcgtcgatggcttccacccggcccacctccacggagcgctcggcgacgccggactccgccagtgacggcctgatgagcacgtaccaccgcctcctcctcgccggccacgctcgtggtacgtccggtctccatgtctcggtaagagcagctcacttcgaacaggtgggtgacgtcatcccaggcgggggctctcgggacgacgatgaacagcaggaagcttctctcctcgtcggcgacggagaggaggccaacgatgcactgcgcgaacccgtcctggatggccgcctcgttcgccgccgcgtcgtggtccttgtcgaagccgaacgtgtggaccggcggggagcggccgccgccgtcggtgcgcacgaagtacaggcggcacgagctccgcacccgcactcgcccaccgccgctcccgctcctctctccctctctctctctctctctctcgtcggatcagattgaatcgaggggattgaggttctctggggacggcggcgatggagattggagagccgagatggacttgtggggcccacgtggtcccaccatctttattctttttactgacatgcgggtccacgtgggctccaccctttttattaatttatgtgtaaactgacatgtgggtcccacgaagtttattattttccagatcgaattaccaagtaagcgcacgtcaatgccacaccagatgaagaccaagtcaaattagccatgaagacgccacgttagtaaaaccgatgtcaaaaccggtaagggatccgttgtatcttttttcggttgaagaacgaaaatcggattcgtggaacctcagatgaacttattccaaaaaaaaaattagtccatactactttgggatcaactttgaacggatttgaatagttgagggtttctattaggccttgttcggttactaaggattaaatccccaaggggaagcaaaccagggagggattgagtcccatgtcactcaaaccctatggggagtaaatcccttgtttcttccaatccctctcttagaaaccctgtgttcgttttgacagggaatatactggctattggcagcgaatatagcagcatattgctagctcactttatgatctactagtattagtactattagtacatttagttaccactgtttacctgaaagcagtactgctagtaccctgtgacagcagcacaggagcaagatcaaaaataccatcggtccatttaagagaaaattagaaaacatatacatgcttgttacaacttcctgatcaagaaagttgatgccaatgcagtgccagccaaaagtacaggagatatttatacagtataataagaagattgttctgattccattcccttacactcagcaagttgaatccatctgccgacaacttggatgattaattagtccaaatgcacatcaaaatccaaacttctcccaacatccccaaaatgacacatcagtagaccattcattggatggttaattagtctaaatgacaccatcagaaaactgctaccatcaaaaaaattctatggaacatcctaccagtcaatttcaaggagcctacaaggaaaatcaattagtagacatcagtttacctatctcagaaatagagaagaaacaaaactacaaccatccaattattcttttttcttctaccagacataatgcaatgaacattataatgcgcaaagttccaaactcaagtgtataacatatgtgaatcttgagttgcctgaattttaagaggatgcagaaatcatatatagtggatagacagatatatggtgaatgtagaaaagaatgaccacctcaaccttcttctagtttctctctttgaaaattagaatgtatggaagcacaattcagccttgacaaaacacaggaataatgaagcacatagctagagccacatggcacctcaaaaaacattctttcatcaggtcattcccaacccatgacactagacatagtttccatagactccacatcatcaagaaactagtactaaacactaatcttccaatgcaaacacaactattctatacttaaatttaatgttacttatctcacatgatgtcttggatgttgtgtagaaaccatgtctcatgcaagacatggtttccttctatttcctcatttattcacttgccacatcatttttcatcctaggtggcagcttatttaatgctatagacaccatcctagtcattgggttgggaatggcctcaggttcatcacctatcgaaatatccataaagacaattgggttcttcttctttgccatcttcctgaagcacagcactatcctaggaaggagagggtacaaggtcccaggaaggaggaggtgcacgtgcaatctacaaaacaaacacaatttatacacatcactgacaattcaaattcaggatccaagattatatatccggaactagagctagagttacataaaacccagaactagagctagctaccatcaaagtaggagctgttgtttttcaatcaaatagaaggatctgttgtttttcaatcaaatagaaggatctcatcatcaaatacagtataacatgggtacagaattaatcacctaatcagctcatttaacactagacatattagtgcttgaatagctacgataaacatgtttttatacaagtatcatgttgaggaaaacaaatctgttagtctaatgagactaaaagctactgttgttagtttaaaataaatcagttaagtatacattactgtatataccactgcattttgttgttagtttgcttgtgaaacaatgacgacagatttagtttacaattcagaaatgttaaactaattacaaagtacctccatatctctacaatcctcaaaatcaggacacccaacccttgtaatttccaaacagaaatataaccaaccaccacaagttgggacaccggaagcaccaagatccgagtacttcactgtaaaaacttgtatagtcaattttacaagacatgctcaggcaagcatcgatcacaacatcagtcacactaagcaaaactaatcaaggcaaacatgtttccatagccaccgtacagctctcactctcgccatctggtgcctcaaagccaccgtgaatcaagaactcaaatcaagaactagagttgggcggtgcggcggcggcggcaaatcaagaactcatccccacccaaccaagaaaaaaaagctccacgcccaaatcaagaactcaccagatcgagcaggatacgaggaggacgacgacgaatcgctgagcgctcacacactagatcgaatcacggcgagacgagagatggtggcaacgacgggaaagggagaagagaagaaaaccctaaccctagctttggaagaggaggcgagaggtagaaaggcagcgtgctcaccggagataatatggcggccggaggagagcgccgtgccgtcgccatcgcctccgggtcgcgccgcccccgccgtcgcgtcttcgctgcaccgccgcctcctcgaggaaaacttccacgccgcctcaggagatgatttattcccgggcctagagaagagggaaaccccgtggtgggccgggctaaaatcagcggcagtgcttaaccgaacgcacaatttcgcatgggccgggatttttttcctcgccggggtgatccacggggattgggacccgatcccggccgggaacggcccaaccgaacaaggccttactggggggattggggatcagacgtaaaattgaggaatgtcaggtgaacttattccttctccacgtgcacacacggtccatggtggactaatccaccgatgggtaggcccaagtctatcggtccaggacgggttcgcgcagtgcattggtggcctcctttccgtccccgtgcaggagctccacttcgacgccgagacatggagaggaccggacggaccacgagcgtggctggcaacgaggaggcggagtccggcgtcgccgagcgctccgtggaggtggaccgggagctggtccgggtggaagccatcgacgacatcgcgctggagcagggattagttatcgttttttctgtttcggtagtagaagagatcgagcagggatcggatcgtgggatggcatggttagtccttgatctggcaagatcgcgcatgtaacaacctcctgtgtggagaagaataaaaggaagaagagaactcagaaaagctgcgcagttttgcagcaccaaaacgttgttattctctggttttctgcattgtcgtttttcgtcagacaagctaggatagcgactgaaatcgcgtgtgtttgctgacaactccgtcgtggtctccttcatgcagcggctggcggggagctaccaccacgtcgcctgccacgacggcttcaaggtgctccacctgccgtagaaggcggcaacgagcggcgacacccacaacgacctctagctccgccgccgtgggcaggagttcgacgatgatctcgggttcacgctgtgcaacgattactactcgccgccgctgaagttggtggacttcgtcgccgaccatccgttcgcctccttctagctactccacgccacgaccccttcccctgcggccgctcctcggcgctgctgcgaccggccgcctcgccgcgcgacgccctgcgaagacgaaggattgcgacctctcctcgacgatgaagccctgcgagggcgaggagctcgcccgccgccgctcctcctctgctccgctagcccgctctgcccgctcgtccacgcctcgctgccgaggtgctgtcctgctcgtcggcctccacgcgcgctcgtcggcctccctccgtcgcctggagagaaaagagaggagagagagatgaagagaggggagatggggagagatgaggaagaagaggaggggtgaggatgaaatgtggggcccacgtgggccccaccattttttattaatttgtgtgtgaaactggcatgtgggtcccatgggttttattatttttttcgatcgaattgccacgtaggcgccatgtcaatgccacgccagatgaagaccgagtcaaattagccatgtaggcgtcacgttagccaaaaccaccctcaaaaccgtcgagggacctaatctgcaccggttttgatagttaagggacacattgtatctggtttttcggttgagggacgaaaatcggattcgtttacaagttaagagacctcagatgaacttattcctcgtacaagtatgggcggtcgttgaggcccatacaggccttgtgtaacaaataggcaccacgcaacacaacacgtgtaccagtagaggtaatacaaggaagtgtttgttgtaaaaaaaacgtgatcactcgcataatttccaatcttgaaatcacctactgttttttctttttgaaacaaacccgaactttcattactccattagctgagatatcctcggcaaccaaatttgtaatacaagatggcatagaaacaagcaccggctcagaatctgtcaagcacaacgatcccagctcagcaagtgtatgggctactctatttccttctcttggcttataattaacccagaaagagataaaatttgaagacaacaaatgcttcagttcccatatcatgttgagttgtgatccaaattcatttgcacttaataaatgccagcttctaccgtagtggagcggaggcccatcgccgggaggcttgggttccactatatatataccttttgtaagccgccgtgcggcgtcgtaacctcaccccagatatagtgaagatattttgctggctggcgcccgtggttttttctctcctactttgggagggttttccacgttaaatctcgtgtcttctgtgattgatctattgttatttatcatttgttcgcttatcgtttcctaacatatcacaacatatcacagtgttatagtcgggaccattgttgcatcagactccaaaatgagctcaggatatagcaaagagagctgacaatcggatacactttggaaagaggcaacaatacatgatatataccactggaattatgtgcacaaggttcataatcatgagactaagatcaagaaccgcttacccactcatgagcgatatcttcggatttcacaaaaaccattaatgaaccaatgaaatctgaacagatcctgtgacaaatttaaaataaagtttgattttctttttaaaaaaagattcaccaaacaaccgagcggtttgtgttttttacccagtcaaccggcatcgtaaaccatggtgtaggactatcgggggaagaagaaaaaaaacacttgtacgtggatggagtaatttacagggcaacttatcaacagctcggattccctaatacaactgcagaaccaagtgatgaaccaatggtgactagagtgtcctatatttcactggaaacagttaactagaaaagcgagccgattcttctgcttctaatgctttctcgctaactccacaaacaatttcttcaggggcctcctctacaaactacaacatgaaagaaatgcatggttaaatggatagttgccatgcagaagaaatatctgcgtacactttctgaaatgagatgggccagcaacggcatcatactatggatttctggctgcatctcaagaaaggcgcttggagagccggttggagaataacgtatcattaagtcggttgtcgcgcagggatccaggataagagatatcagccaaattaccctcaaaatatcaaaatatccggtagatataggccttcagaccctcatcagcaacaaaattgtgaccgattgatttgcatcacctggaattatcaaaagtagtcaagtagataattggttggcaaaatgcatcaaggaagatcgtgtctgaacaatttatggcaagaacatgggggtgattcacttacacatggggattggaggggtgaatacctgagatgtggtcgatcggcaggattcgcacccgcggcagaggtagatgcagacgtttggaggaggaagaagatgatgagcaccggacttgacctgaatccccttcttcatggacatctccgagcagtgtcaatactgtaatccgaaacgaacactggtagaattatccattttttaaatagatgtcgtcggtaacttttttattaggcgtcgtttcattaagaaaatacataatttctaatttattttctaagttgttttatcacttaaagtaccttaggcaggcatggttatatcttatacttttgtataaaattttggatgattatgtaaatatcacttaaagtaccttaggcaggcaggcatggttatatcttatactacctctgtnttttaatagagaacgccgttgatttttcttacatgtttgaccattcgttttattcaaaaattttatgcgaatgtataaaatataaatcacacttaaagtactatgagtgataaaacaactcataacaaaataaattataattacgtaaattttttgaataagacaagtggtcnnacatgtnagnnanagtnnncggcgtcatctattaaaaaatggagggagtacttttatataaaattttggatgattctgtaaatatcacttaaagcaccttaggcaggcatggttgtatatcttatacttttgtattttgtatttcaagctagaacggtgtacttctgtttcagtattacagccatgattgctgacaaaacaggggtgcataatatgatgctgacaatagcccaatcatgcattcatcgtcaggttccgaaaccttccctaacacagcatagatacgaaaaggtactctcaaggtaggaagtaggaacctactccctccgtcccataaagaatatgactcctcctaagttgatgtatgtggacataggggtgtccacatacattgtcctcctaggttgattttttttttttgacggaaagagtaagttgctctgagcatgacccaatctaaaaaatgaacggatgaagaacacgattatctcagcgcaactccatttagtttgatatactccaatccaaggcaagggggtggaaatcaatcatgagttcacgatggaccaccgaatacctgcaatacgataaatcaagtcaaagcattggtggataaatcagaatctaaatctgattaaggctgcaaacttactccggttaaaatgtcttttggaagctttggtttagttttggcgtctgtatcctcaactagtttattttccggaattgggcgaccaattttttcttctcgaacttcactgaatttggttccttccgtcttctgtttctgctttcaggatctcagaaagttcatagaaattcccgtactaaagtttaaaagtataataacataagaaaaatgcttaatgctcaatatagtttgtattatgtacaataatagtaaaaaaatatagaaggatgtagtaatattgttgtaaaagtacagtaacacgtcacgttactgtagaacacataggacattactgcacttttggcagtaacgtcgtagtaaaattgtagtagaccaggaatctaaacaaaaatatatgggttaaagcctcacatactaaccatatacttgttaatgtacaaaagtaagaatgttactacataatagatgcatgttaccacttccaagtagctatgttactacacgataatcgtagttttactacgtcatttttatgagatgaagatcgaataggtgggctataggtaaagtctgtaggtggctttgagtgaggtctgattgatgtaggagtgttttgaacaattttatgcatttggtaaaactatgttactgcatgtatatacccatgttactgcaaattacatattctgttaggagtgttaaagttcaaaatgccaatatttgaaaagcaatatctcacaagatatgtattattttctaaaaccattttcacaatgatactaaagtgttactacatgtggaggatagaacttcaaaatgcatctacatactcctctactcaagaaaccgttcttcctccctcttcttaagaaaaccggtcttctccctctaatatagtgttactgcatgcatgtatatgatgttactacacttttggcagtaatattgtggtgaattgcagtaaatcaggaattgaaacaaaaatatatgggtacaaagtctcaaatgctaaccgtatatttgttactgcacaaaagtaaaagtgttactgcacggcagatacacgttaccacctaacatttacacattaccgcatatttatgcagtaacactatcaagaactgcagtaaaaactttgttactgtaaaacaaatagatcgttactgcaccattggtagtaacatcgtggtgaaattatagtaaaccagaaatcaaaagaaaaatatgggttaaaagtctcacatgctaaatatacttgttaccgcacaaagtggaagtgttactacatagcaggtacacgttaccacatgtttatgcagtaacactattcaaaaattgcagtaagacgcattgttactataaaacttatggtctttactgcacacttacagtaacgtcgcgatgagattatagtaacgcatgacagatggtagtaacgagtagtaatgctatctagtattactacttgtggagagttaagatccaaaaaaacccaagcttcgaataacaatatctctcatgtgatatatgatttttttaaaccgtttacaccatgatgttagaaaaaaagtgcttatcaaaagtagatctgtcatgactatatttcaactaaatttgaatgttgttactgcacgtaagacacaacgttactgcacgatggctgtcgcgttactgcactgtttcgcaagacgagagttgagaagaggtgggtggtgggggagttggtaggcagtttgaccaggctttgaccgacgtgggggtgctttgactgacctttgactaaggtgggaggtgggtttggaccttgggactattctatacccgggtgtagaataatttttctatatatatatatatatatatatatatatatatatatatatgttcttggtgaattaaaagccaatgctgaaaaagaaactacattaaaaatatcttaaatcaatcttaaaattaaatttaaaaatttaaaaatttgtttttttctttggctgattagaccatccaatgagatcaatgttattgaactggtgaattcgccgactcactagtttgaccacggttcaaaagtaataacaaatatacccctgcgcaagtataatcatttcgtcaccttaaaaaaacaaaaaaaaggtaatttgactatttaaaaaatatcattataattcatctatttataaccgtgtcattaacattttacaaaattagaatcatgccggtctctagtcgtggtagggttattttgctttcaagaagtcaaagtagtctatccaaggtagtataagagcatcccaacagctcatccaaattttatctttcatatacctactaaatggtaaaaaaaaaattctctctatatctttttttactttaacagatcatccatactacatccttctatatttttttactattatcttctaactaaccatataaaatgtatgtattattgtttaagggctattatttgaacaaataaattgccatatgctttatttttttttctcacgttaattgctatgcagcgccatctgcctattaaaaaagaaacgagaagaaaatcaggcaaatcggcacacggccctgaaaatcaaccagcacacgacgcaactcaagcggtggtataggtgtccaaacgggcggcacggcccggcccggcacgggcacggttccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcccgcggcccacgggtcgttcggggcacggcggcccgtgaaggcaggccgccagcctgcagtgcacagtgttttttttttaaaaaaaagcaaaggaaatgtataaggaaaaaaaaaattaaaaatggaaataaaatgtttaaaaaaagtaataatttactaatgttaaaaaatgaaaaaatggtatttaaaaaatggaaataaaagttttttaaaaaagtaatgatttgctaatgttaaaaaaaagaaaaaatggtatttttttgttgtgttgaaaaatttaaaaatatagattgtgattcattattttgaaataatttaaagataaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaaccatgacaaagaaaagagtacagctcaaaggtcagaactacttgtaacaaaattctactggggttggtctggatccaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacttgtgacaaagttagagtacaatcataaaaagtttctagaaattggtaaaatttttggacaattgcctaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccatcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2829 - DNA, 680 bp, Oryza sativa
tgcaggacacgaaaatcttcagagaagtttgtgaatagcgtcatttgcttctaattcatgatgaccagaagtaattccataagctcatgccgatgtattgcttttattagcatccacaacctaagtatacatacatattacaattatcactgcaggtaacacgttgaacacatacaccaacactccaacaacatatatgcatgcattaacagaagagactacactatacttgacatcattgcagccactcgactcaaaattgcagtaagtttacaatggtaatatattggtataccaacactctcccttaatatattgacacaatggtaataaacaaacagtttgtaaaaatattaactgctaatggagttccaaacggtttggctccataagaacaactatgcacgcattattactatcatcttacaacagaaattgtaggttctagttctctactaaatctccttttcttccttcgcctatcagcattgttccacaagaactcaacttacattgtttgatctaatcgtacagtacctcctttacctggtggaggtagaaacaaaccagtctaacgtgcatgggcggtttcacccatggacgaacagatgtcagcaagctctgctcggcctcggcaatggcctgcctcagctgcacccggctctggttcaccttgtcaa

SEQ ID NO: 2830 - DNA, 736 bp, Oryza sativa
  unsure (1)..(736): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtatttccccttgctcttgttctgggccttgtgcacaacattggcactggactgcccaccatcgcccttagacgcggcatctttttcccgagctttctcctcaacatcaagagacgctatcaacccctcaacggagtattcctgtctcttgtgtttgagtgcagtaccgaaacttctccaagatggaggtagttttgcaataatgcacccggccacaaatttgtcgggtaagacacacttaaggagttcgagttccttagccatggtttgtatctcatgagcctgttcgactacagaacggttgtcagccatcttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaa

SEQ ID NO: 2831 - DNA, 5535 bp, Oryza sativa
gttctgttggattagtgccaccgctttggtgttggttaattaaaataaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagccgacgcatccaggcaagggtgggcgtgatggagtttggataggccctgcgacggcctatgcggcttccggattcacctagtcacgagaggggactgcccgctgcctcgcgaggagtgggggtgaaacctgaggtgtggtgtgcttggttagagggggttatgcgaatggtcctgtcacggcctctttccggtatgtcgtggtggcatgtcggcgcacggaaacgtgtcgtggggctgtgtcttgtgggtacagttgtacacctctgatcagagtaaaactattcgaatagccatgcccgcggttatgggcggtcaaccagattcaccgtgattagtctcaccctagtgtaatcttttgaaattggatagtttaggtggatggttgggcctgttgcaacgtgggatcgcgttggacagtggatagttaatactaattaattattacaactgtttaaatttttcaacttctgtctataaatgatcgctttatgcaaatgaaccactctagctcttctttgataattccgtgcatcatacccctattccggtatgacttgctgagtacagtgggtagtactcagtcttgctctacttttcccaacccccagagttcgagtatgtgtcagatgaaggtttctccgaggagtaggcttcgtccgtgccgtcgaggatgtctgtggagtggtgttcccgctgcagttctagtcaaggcttagctcctgttgtctttctttctttccgctgcatttatgtaagacttttatgatgtttgtaagacgtggatctgaatgtcaacattgtcgtttgtgtaccccggctggtcctggacggggattttaatgcacattctgcttgaaattctattcgggaatttctgggcgtgacaagttggtatcagagccgaccttgaccgtaggacaagccaaatggaaaaacctaagagccctctgaatccttttcattgcatatgttctttgcaattggatttgttccgggaaaattgggatctgttcttgtggttcaagggaaaaatcttggtcgctcgtttaagcgagatttgtcaaaacaagtcagtctagggttttagtaaaactgttgagatttattcatcagtcagtgggatttgatgggtgaaatgcattaggtcctagctcaggaacatgggttgcaaggtatttatgctcttactgttattattagtatgtatctaatttccccattattttatcgttatgtgagtctgtcttatttattcgctctcatgcaaaatgatctatgcataaaatttcgctcttattcgattcgcttatttgagtcttttattgctttatttaaatttggatttgagcatgcattgatcctactcctttgtcttctctagatggccggccacccacccaaccaccgcggagaaggcatgattgattttgtggcagagttggcacgcatgacgctggtggtgggctaccccaacgcgccagagtacacgactgttccaccgctcagtggcgagcttcctcaccgtgttcgcttggaggtccacggctacgtgggtacctgcctagataatatggtggttgaggcatccggaggcactgcagatcacgcttgtcaggaggcagcatacctgatgatggccagactacgggagcgccacaactacatcttccacgacacggcgtaccgatttcacccttgccgagccagcggtggtgatgtcagtactttccgtccgacagccggcgagaacgacaccacctttggtcacatgtgtgctgtgatgaggggattggataggatgcactcggacctgcacaaggcgaccaaggccttgaatgatgggaagctcatgaggatcgtcgctctgaaggacgagatagcgcgcctgaagagggagaatgctcagttaaagggtcttcccgcgccaagaggagtccggatccgcactacaccccgcaagacgacgacggcacccgtgcgcatccagcttgcgcccaggaacccacctccatcagcagctcccgcagcacctccagttccgcccgcagttcctgcagctccagctccagctccagctcccgttcacatgtcagctcccgcgtccgctctctcctttgctccagcatcagctgccaggagtccagccagtggcaacggaggttggttgtctgctactcccattggcagccgcgatctcagcagcagcagctccagtggctcagagtcgggcagcggcgagacttatctgccaggctccgggagtcgctcagagggacctggtgacgagcaggaggacgccttcgactccaccgaccgcaggagccgttccgagcattaggctcgttttccattagtttatcgactgtctagcttttgtttgttagtttgtgtgtctaggttgcttgcttgtgggtcagtcgacggtcgatatcatgtgcctatgatatggctgtcttaataaggatttttgcttgctttttaagtgttttaattcagatcagaacaattgcagtttaaattcctatgtaataaagcttagttcctgagcatctgtttttcttctttttccccgcctgcttttccctccagatggtctacactaggaatggtagccgcgcaacaggcgagggcagcaacggcgaagagcgcactgatggggtgcatcccaacagtgattccggcaatggtccgccaccacttcccgagaatccgacactagcccaagtgatggcacatcagactcagatgatggcagccatgatgcagcagatgcagcaccagcaccagcagatgcaccagaggatgctgcagcacgctgaacagcagcatcagcagtttggtccccctccccctcagtctaagttgccagagtttctacgtgtcaggccacccaccttctccagcaccaccaaccctatggaggcgaatgactggctccatgccatagagaagaagctgaatctcctgcagtgcaatgatcaggagaaggttgctttcgccacacaccagcttcaaggtcctgcgtcagcttggtgggacaatcacatggccacccgcccaccaggtactgaagtcacttgggcagagttctgccgtagcttcaggaaggcgcaggtgccagacggggtcgtggcacaaaagaagagggaattccgggcactccatcagggcaacaggactgcgacagtgtatctccatgagttcaatcgcctcgcgcgatatgcaccagaggatgtccgcaccgacgccgagaagcaggaaaagttcatggcaggtctggatgacgagctgaccaaccaactgatatctggggactacgctgactttgagaggctggttgacaaggcaatccgtcaggaggatcaacgcaacaagatggacaggaagaggaaggctgctcagttcagggcagatcagggaagtcaccagaggccgcgcttcactcccgggcagcagggtggacctaccaccatgatcgttcgtcagcaccgcccgttcaaccctagcaactttccccagggcgccagtggcagtcagaaccaccatggaggtcagtccaaccgcggtgcagctccacgcccaccaatggcaccggcacagtcaggcccgcccgcgcaagccaagaaggagactggagcaaaaccagggtcctgcttcaactgtggcgagcttggccacttcgctgacaaatgcccgaagcctaggcgtgccgggccaaggtttatccaggctcgtgtcaaccacgcatctgcggaggaggcacaagcagcaccagaggttgtactgggtacgtttcctgttaactcaatccctgcaacaatactttttgattctggtgcaacgcattcgttcatttcaaagaagtttgtcgggatgcatgggttaaggaaagaagagcttagcacactaatgagggtttataccctgggaaatagttcaacctcagtcagttttagcccttcagtgctaatagaaattcaaagatcaccatttctagctaacctcattcttctcgaatccaaagacctagatgtcattcttgggatggattggttaaccaagtttaagggagtcattgattgtgtgaatcgcacagtcaccttgaccaacgagaagggagaaacggtagtgtacaaatcaccagactcaccaaagcgaggggtctctttgaatcagattgagacggaaatcccagtggacaccgtggagaagaacttgagaaaattggaagatatacccatagtctgcgagtatccagaagtgttccccgaagacctcaccaccatgccacccaagagagagattgaattccggattgacttggcaccgggaaccgctccaatttacaagagaccgtacagaatggcggccaacgaattagccgaggtcaagaagcaggttgatgagcagctgcagaaagggtacattcgaccaagtacttcaccttggggtgctccggtcatttttgtggagaaaaaggataagacgaagaggatgtgcgttgattatcgcgcactcaacgaggtcacaattaagaacaaatatcctttgccgcgaatcgatgatttgtttgatcaactgaaaggagctaaagtgttttctaaggtagacctgcgatcaggctaccatcagttgagaattcaggaagaggatattccaaagacagccttcaccactcggtacaggctatatgagtgcacggttatgtccttcggacttaccaacgcacccgcgttcttcatgaatctgatgaacaaagtgttcatggaatttctggacaagtttgttgtggtattcatcgacgacatacttatctattcaaagtccgaagaagaacatgagcaacatctccgtctggtactcgagaagttgaaggagcaccagctatatgccaagttcagcaagtgtgacttctggttgacggaagtcaaatttctgggccatgtcattacagctcagggtgtggcagttgatccattgaacgtggagtcagttaccaaatggaccccaccgaagaccgtgtcgcagattcgaagttttcttggacttgcgggatattaccgccgattcatcgaaaacttctccaggatcgcccgacccatgactcagttgcttaagaaagatgagaagtttaaatggacagctgagtgcgataagagttttgaggagctcaaaaagaaattagtatccgcaccagttttgattctgcccgaccagatgaaagacttccaagtctattgcgatgcatcccgccacggacttggatgtgtcctaatgcagagggcagggtggttgcgtatgcctcgcggcagttacgtccacacgaagggaattatcc

SEQ ID NO: 2832 - DNA, 1554 bp, Oryza sativa
ccaggcagcagccaaaatgtatgcaagacctcaaggaaaagttttggtgggtcagcatgaggagagaaatagctgaattcgtcgcactctgcgatgtttgccaacgagtgaaggcagagcaccaaagaccagcaggtttactccaacctcttcaaatcccggaatggaaatgggaggagattggaatggactttataacaggactgccccggacatcatcgggtcatgattcaatctgggtagtcgtggatcgactcactaaggttgctcacttcataccagtacataccacgtatacgggcaaaaggttggcagagctctacctctcgagaatcatgtgtctacatggagtacccaaaaagattgtatctgatcgagggagtcagttcacctcaaaattctggcagaagctgcaggaagaattggggacccgtttaaatttcagtacggcctatcacccgcaaactgatggtcaaaccgagcgagtcaatcaaatcttggaagatatgttgagagcttgcgctcttgattttggtggagcttgggacaaaaacttgccatatgcggaattctcgtacaacaacagctaccaggccagtctacagatggcaccgtttgaagctttatacggccggaagtgccgcacacctctcttctgggatcagacaggtgagcgtcaactgttcgggacagaggtattagcggaagcagaagagaaagtcagaatcatcagggaagggttgaggattgcccagtctcgacagaagagctacgcggataactgctgaaggaagctcacttttgaggcaagggattacgtgtatcttcgtgtcactccgctccggggagtacaccgctttcagacgaaaggcaagttggcaccacgcttcgtgggaccctacaaaatcttggaacgaaggggagaagttgcttatcagttagaacttccatccaatatgatcggcatccatgacgtgttccacgtgtcccaattaaagaagtgcttaagggtacctgaagaacaggctgattcggaacacattgatatccaagaggacctaacatacgtggagaagccggttcgtatacttgataccagcgaaaggagaaccagaaacaaggtcacctggttttgccgagttcagtggagtcaccattcagaagaggaagcaacctgggaaagggaagatgagttgaaagccacccatccgcacctcttcaccagctcctccgaatctcggggccgagattccgtttaaggggggtaggtatgtcacaccccgaagttctcctcccaagccaaaaatttaatttataaatgaccccaagaaaatacaggtgcaaagcaagagtaaacccttttaaatcaatgcagataataatcggatttggcatgtggaatttttcttgagttctacatgtcgaaattcactaacaggatttttagtggaattttcagagctctagaaataattttaaccaattaaaattgagcaagcaatattttaattccagggaaaatccttttccctttttctttttgctttttcctca

SEQ ID NO: 2833 - DNA, 1082 bp, Oryza sativa
aaacaatagagcatttgcaatataggatcaacatgttcaagtgacaagcatgacttgccttgctctgctgctggaggaacctcggcgactatttcgaagtacaccggagcgtcggaggaaccggaatctagcgacatacaaggcaaacattgcaaacaggctataagactactgaaacagggaacaaaaccatttttaatggattctacacatttttcttgatttactgagacttgaatgggcttaaacggagctcgaatgaattagttatgaattttagaagattcactgtgtttattactataaaagaaaaaccttaaatcatttattgcgcaataaatcccagggctgacgtcagcacggagggggcgcggcgccggcaagcgggccccaccggtcagcggctcagggggagcggttcaccgtggaccgggaccacgcgggtggtccaccgccggtccacgggaccgacggcccagatcgccctcgggccgatcggacgggcggcgatagaggcggctgccgggctcggctcggcatcaaagccgaccggccggccagggctaacggcggtgacacgcgcgcgtcgcttggccggcgacggcatccggcggcggaggcgacggcgcaaaagcgacgcgaaagcggcggcagcggacggcggcaacgaccgaaggcgacgacgagcgcgggcggcagcgacgcacggggaattggggaagtaaaggaaaggggagggagtcctcaccggaggggacggcagcgtccggcgacggacctcgacgaaggaggggtggacggggtggatctcggccacacgaacccgacggcggcgacggcgcggtgcggcggcgagcctagcggcgactagcggcggccggagtagcggaaacggcggtggcgggtggttgcacggcgcgggagcgatggggaccacgagggagttcggcgaagtggggaaaaagcgagagggagcaacggggaagcttaagtaggggaggggagggccggacgtggccgggagaggcgggatttcgccggccaacgtggggaagtgggggaggagagagaggcgggattcg

SEQ ID NO: 2834 - DNA, 12442 bp, Oryza sativa
tcgacatgtagaactcaagaaaaatttcacatgccaaatccgattattatctgcattgatttaaaagggtttactcttgctttgcacctgtattttcttggggtcatttataaattaaatttttggcttgggaggagaacttcggggtgtgacatctatgtctttgcatgcttaatggttagtttatcttgattctctatataatttttctttatttgtgtgattcttgatgtatttttttcctcaaaaatattaagagatttataatgtagatggtagtgctagctatatatttttgcatctatttgttttgagatgttgatttgagaaagcatgatgacttaggttgttttcttccccaccacactagctcacgatttgtggtcttcttcttgctcatccaaaagaagggggaggttttgcccaaaaatttcaaaagcatctctcgttttctgcatgcatactttccaaagtactaaacggtgcatattttccagtccgttttgcgtgttaggaaccctcactcctgaactcaaccttatccttgagtaacttacatattagtattaattgaatagatgtagagaatgttaattttcaatttgagtaatgtctagggtattaaatcatcgagcatttgagatataaaagcttagttctaatgatgcttgattgatctacagatttaattgatatatgaatgttagcggttaattttggaattttcgtagggccaatggatgaaggagagatgaatgttgcgaagcgcggtacgttggaatatgccaggagagtaaccaacttcgtgctcggggcaacaatttctagatcattgagcatgacagaacacttgctttgtccatgcgctgattgcataaatgagagagtttcctacaaatcaagttcacgagcatctcctaacaaggggttttatgcgtaattacgcatgtcaggacaatcatggtgaagatgagaatgacaatgtgcataatcatggtgatggaatgtacggagaaaatgcggagttgcctgtcgacaaaggtggatatgacagtgaagaatcagatggtttggattagatgttgtgtgatggagagacagcctacagtgatgaaaggcaatatgagatgttcaagtccatggtgcaggactcaaaaactccgctttatccaggatgcaaagaggagcactccaagttacatgtcgtcttctcgctgctgcagttgaaatcaaccaacggatggagtgacaagagcttcacagagcttctgcagttgatcggagacctccttccagcgggtcatgtattgccagaaacaacatacagagcgaagaaggttgtctgcccgctcggactggaagtgcaaaaattcattcatgtcgaaatgattgtgtcttatatcgagatgactatgcagacttggatgtgtgtccagtttgtaaaacaccgcggtataagggtggagataacgatgatgatgctaatgatgacagtggtggccccgacctaaagaaaaggaaagtgcccgttaaggttgcaataatccctcggattgaacgcatgtttgcaaataagaagcatgcaaagatgatgcgttggcaccacgaagagcgtaacaaggatgggatgataagacaccctgccgacggatctcaatggagaaagatagatagaaaatacaaaaagcattttgcgcaggagactaggaatataaggtttgggctgagcacagatgggatgaacccgttcggtgacttgagcagtcggcatagcatgtggccagtggcacttgttatctacaaccttccttcatggttgtgcatgaagcgcaagtatataatgatgccatttctaatccaagggcctaggcaacctggcaacgatattgatgtctacttcaggccattagtggatgatcttaagtttctatggaaccggagtgcgcagatgtgggatgcgtacaaaagagagtacttcaccttcagggcaatgctgtttgttaccatccaagattacccatgtgctggcaacacatccgggcaaacagtgaaaggtggttgtgcatgtctgcaatgtatgctggaaacagcgagtaggtggctaaggtactccaaaaagaccgtgtacatgcggcatcggaggtttcttccagccggccaccactattgtagcaatacaagagatttcgatggcactgtggaggagggtacagctccaacacaacgtgagggcagagacattttcaatgaggtgaaagatattgaatgtatatttggtaaggggcctagcagtacaagcgcaacgagtaagggtggtgagaaaccttttcggaagaagaaatctatcttttggggactaccatattggaaagatttggatgtccgccatacaatcgacgtgatgcacgttgagaagaatatgtgcgagactttgatgggaatcctgctaaacatacctggcaagacaaaggatacgttgaacgcacgaagagacctcgtagacatgaacatcaggcccgagctccatcctcaagaacgtcacaatggccgccagtacctacctcctgcatgctacacccttagtgctgcagagaaaataagcctgttggaatgcctgcagagtgtctgagtccgctctggttactctgcgaacattaaaagacttgtcaatatgaaagagaagaaaatagttggcatgaagtcacatgattgccacgtgttgatgacacaattgcttcttgttgcgattagaggcatcctactagataaggttcgagacccaatcataaagttgtgctcattcttcaatgttgtatatcagaaggtaatctatcctagcacgctagacaagctccaagaaggagcaattcttaccctttgccaactcgagatgtatttttgtaacatcttgaaaattaacaattttctaatcttgcatcatgctgattcttatgttcttattaaccttttaaacctaggaaaatataattagagagacctccaaagattaatttgcgtagaatctctctttgctatttaaaatctttcgtggtttttattctaaaatttatcttattaaaccaaggtattttctttgatttgattttgcaccttaaaccttcttttacaaaattcctttattttaatttaattaaaaacccttttatgaattatggtccaagaaaccttcccatattacccttgaacctaaaccaccgaaattccgattccattggaattaattgttaactcatcctttgatcttaaacctatcctttgattccaaacctatccgtaacccttccttgtgatctagccgcaaatttaatttctatggcttgatccccttctcggcacaaaaataatattattacaaatattatgaataattgctcttgtgctaagaaaatagattatatccttgtcatctaaattttcttttagcctcaaacaattccttgaaaacccatgtcatatattttagggctcaaatctctttttttgtctccacctattttcctaccacattcccaaaaatatcttgaagaattatattaattccctcccatttgagtgctttaatatttagaccacattattgcactcaaatatttaagaaatatctcttttagaaattatatccaaatataatttcctttcaaaattccctatcccattcaaatcctattcaattccattatctaaatccccttcaaaattagaaaagcatttatctgagtttgggccgaaaccctcttttcttcctctcactcccacggcccaagccggcccagcaagccactgccaagccggctcctccctcctgtgggcgtgcgcggcatgcgcacacgccaccgccgccatcgccgtgatttgcgccgccgccgcccacagtctacaccatcgacttgctggccacggaaagtcgacgtcgtgccgtgttcctccttccccgccgcccaactccctggcagccgacgcgtgtgcacgccgccattgccgaccaatgagagaagaaagccggcgccgtcgatcctctgtccacgccgtcgttgccgtattcccctcatcatctttctccaaaacgacctttgtaaccgacgttcgacacctataaatagagggtaagacttgccatccctcaccaagccgagctcttcaagctcttcctctctctctatctatgtcgaaccgtcaccggtcgtcggccgatctccctcactagagcttctctaaccaaatccttgcgccataggacttgcctcggtgagttgaatccatttttccccttttccctctttctccacctctaaattaaacctcaccggagctctctctctctctctcctcccggttcacggccttgcactcgccgttccggccatatccctcactccctcgacctaccaccgccgtatataggtgcgccacatccgggaacacctctcgctgccggcgtcgctgtcccccgtacactggagcgccgccgcctcaaccgcctcctcctctcccttctatcggctggaggaagaagacggaaagaaggaaagagaaagagaaaagaagaagagaaaaagaaaaagaaagagattcctgacaggtgggcccccgcgtagtaactttttataatttctccatttaattcaaaatccaatttttagaagcccatatctcctaaaccgtaaatccgattccagtgaaacttggacctaaattcatctaaattcaaaatctacattttgataccaaattttctattttaagattttatttgaatttccttaatttattcaaataccatttgaataaatatttaatttaatcttatatttgaatttcctatttaaacttatatttacctttcaaatatttctttttattctcgaaataccccttagtcactaaatgttgtcgaaacgataactgcatacgtcgaaagacgtggttactcaactgtgttggaaagcagtaaattataactctaagaattttttcccggccccctttacatggccctaggggtctatttataacactattacaggctcccctattagggtttaggtttttacaggggaatttacatggttgcccttataaaagggacatttacatgggtacacagtgtcatttgcatgcacgggctcctgatgggccaacagattgggcccggcctatgccgaatgggcccgtcaggccggagcagcccatgaggtcgcttgcatgccgaacccgtcctgacgaaggccttgcgccttcgccatgcacccttcgccgtatgccattcgcccaagatgcttttgcttcgcatggacccgacgcggcttgttagcctgcagcatcttcgcccatagccttcgccatagggcttcgccccattggctctgatgtctttggcttggatcctcgctggtccttgggtttcggcaggtccagccgaagggcctcatggcataccgccaacaagcccctcacgggcgagggtgagtaaggagcttcggtcgagaccgtgcaaactatgtggtatggtatgaggcgccccctttcggccgacgttcctaccgaaacctcttctccgagcccttcaggaagaaggtggacacttggtgttttcatggttttgttagtaaactttggcattcgccctttcagaaagggcgaaactgcactgctttgatttttggcccgaagtgcgacagtaaggggccctttgtgggccggtatgtccctcttggatttcggtctgtacagtgcggcctaggccgatgggaatttaccgtttcgtctgtccctggacacatgtcgcgtcctgattgggcggaagtcgaaacatcgtgggacggggttatataacctcgtctcgggttaccgcttttctcccctcaccttttactttcaccgctgctacgcgctcgcacccttagggttcgacaccttcgcttttgtgcgctcttgagcctttcgaccactcccttcctttcgccacggactcgatggctcctcgcaagcctacaaaggctggatcgactggcgaagaccctagcagccttggcgaagggtggtcgtgcttccttggcaaatcacttgtcaaggaggccgccttgggcgagcttgtcctttctggcgttctcgtggagggccaggcgacctgcgggggcgaagccatcgtcccttcgcccggtgacaaccagactgttgtcttcgccgccttcttcgctaccggacttcgcctcccttgcaatgactttctgctgtccgtgttgaaaatgtatgaggtcaagctttaccagctcaacccatcagcgttcccgaagttagctgtttttgcatggatgtgccaaacgtgtgggttcgatcccactgccgagcttttcgccgttctgtttatggcatgcgcgacgacgaaggacgtgagcacatcggccggtccaaagaggacgatgtttgggtgcgtgaatttcatactccgccctgagcgctcggacgcctagccggtgcctgcctcgatggcgaaatgggagcgaaattggatgcaaaagtggctttacatcaataacccatattccgccgaagatagcagggcgaactggcttaggttcgaacgcgctgctgtttcgatcgctgctaagccgaacgtgtaggtcgacggtgttcttgagtcttggcttatcctccttcgcaaggtcgcgcggcggctaagtacccgtgacctctgcgaggagttttgcctgcttcggatttctccccttgctcgcgaatcgggggtgttggttagtaaggacgaaaaggtgctcggacttccccgcctcgcttttcctccgggagtccaccgtaagttccttgtgtttatcagcgtcctttgtatgtatgtggacatctttcgactcattccgctttttttttagttcgcacacatggagacgctgaaaccgaggcgtcgaagatggttgggggccttacttcagccgagtttgcccgcctgctttcgcgtcagcttgacggctgggcgaaccgagttcactttggcgaactacccggtcgattgatccccaccaaagctattgacgacgtcggaacgtcgagaaagcgtaaacgggcggtcgcgaagggcgggcaagtgcgatctcgtcgcgccacgaaggacacagctgaaagtggtgaagaggaggaggaagacgacggggaggccgagtctgaggacgatggctcccgtggctatacccctagtccgcccccggtgaaatctggggcgggctctcgcgtttcacccgttcacccgcaagacgttgctatgacgaacactcttctggcgatctctagcactgcggcgaagccggtatcagtcgctagagggaagaagaaggggaaggtcgtctagattggtcgtgccttttcggacagcgaggggtccgacgggacaccgacttcgccagttctccagcgcggtcctcgtggggggtgcgcatctcctccgccttctagcaacgccgaagcggcgacaggtgggagtgcttcggcgccagcaatcggggcgaacaaccctcacaacgaacgggttgaggtggttccttcgccagctcgccggcgggaaggaaaagctccgacggtcgaagcgattgtgtcagacgtgacacttactgccccgcacttcgttcccgccgatttcgccactcggccagagatcaccccttttgtggatggggtgtgccaagttatcgcgcccacggaaggccttggtctcttcaccgagatgaacgagttcggcgagagctatgccgccgtggtgagcttgtttgttcgggtatgcttttttttttctttgcgcgaaattttcccttttctcttatatcatggcataattgttccggactcccctttccagggccttgccgcgcatctgagtgcgaagaagtctgccctggaaaggctggatggttaccggcttcggttgcggaaggccaaggacgaccttcgccacaaggaggacgaaaggcgcgtcgtggcggacaccttgtggagggcgaatgcggagaacaggtccctccgtgccgatctggaagtgtcgaacaggcggggcacctagcatgatcgccagcttgctgcggccgaagagaggatcaagtctcttgagacccgcctcgtttcgtccgaagccgctgcttcgactttagggctggcgacagaatccgccaaggaggcctgttacacgctcaggctggccctgaatgaccttggtgctcgcgcggaggacaccctgggagatgatgggacggctttcgacttttccgagtggacgcaagagtcggccggctcagttgtcgaagtggccggcgcttatggggattgttgtgctcgtgtttcggcgggcttcgtccttagcctgctacatacgcacggttgcgagcatatcagggattttccccgctatgtgacggaagaatggcctttgaactcgcaatgctctggggcggccttaaaggcgttccgaaagggtttctgggaggacggtggccgggattgcgcgaagaccagccttcgcgagaatcttgagaggatcgcgaaggaggaggaagctgctgccgtccatgccggaggagaccctgggtccacggagctagcaggcgaagacaatagaggccaagaccaccctaaggtgtgaggcccttcgccctcatatgatttatttaattttttttttgcgttagtagccctgctatatataggctctttgaatgttcggctctcagccgctttcgccttgtaattgttatgacttcttgttaatggaaaaagaaatcgtcgtttcgccagccttattatcgtgttggacagtggtattgatttcgcctggatttttccttttgtacttgttctttggtgctttattagcaggtttatggccggaaatcatgcattcgccccccccccccactactggttggcgaaaagagaacgagaaattcgtggcggcgaaaggtttgccgaaggttaagcgtcctcttcggcctatttactgcgagatgttaataaacggcaacagctaccgagtcataaaggttgccaagtggatgcgcgcacatccgggtcggaccatagaagattatgatcgccatcgtgtttcgtgcctcgagaacagtacaaacttttggcgaaactttaagaggtcgattcgccaagaggcgatcgcttgccgccgttatggcgtaatttgtgtttcgccccctctccccttagggtagtatacgacattactaatgatggcgaaccgtgttcaccaagtcgttccttagggagtggggattacttcgggggcgaagatgtaatttatttgtgagttggactgtgaagcctttgctttctatgcttgtagcatgttgtatggctgtaacctttgattatttttccgaaataaataaagatgtgttttatttccttttcgttgttttcgcattgtcacctttcgtgcattcgttaggtcgaaacatgtcggcccctttgcgtataatagcgaaataggtatgttgacttttcagttttcgacttccgttttcgatacgtggtattccgcactgaaagaagcgcttgtgttcacattgatcgagtacaacagtgttcggttagttatttccgaaataagctgtcgcggtttcaacgttcagtgagcaatgcttcggccgattcgtttcgcccccctggctttttcactgatcaggcgtttgtcttggggtttttccacgaattatcatttacacaggtaaagaggcgaaaaacacagattttatactggttcgggcctccaatgtggataataaccctacatccagtttttttttctttttccattttcctcttttattttttgcatttttgtgccgaagggcttacatatcaatatgtacatttttacaagttggcgatttgggtgccacccgttctagacatagaaacgcctaagggaagcagtgttccaggaatggtcgaactcttcgcctttcagtgtcgctaggcgaaaggagcctgttctggacctgtgcttgatgaggtatggcccttcccacttcgattcaagcttcccgacctccattgggttcaccttcttccttaggacgagatggccaggcaacagctctgtcggtcgaatctttttgttataagttgctgaagtgcttgtggcgtatttgtgcatgtgttccagtgcttcgactcttaccccttcaaggagttcgagtgacacatcgcgcccgtcttcgcctcccgagaacatcacccttggtgaattagcccctagctcagttggggtcattgcttcatcgccgtagaggagcatgaacaggctgaacttggttggccttgtgggggtcgttcgaagggcccaaagaacagataacatttcgtctggccatttgcccttcgctgccccctcaagccttttcttgagccatttgttcgttcggctgccccatttgactatgggtgcgcgaccgaagcgaacctgattttcaagtttagcccttcgcacgtttctctgaacttgtcagagtcaaattgcttgccattgttagtgatgaactcctttggcactctgaaacggcaaacaatgtttttccacgcgaacttctgtacggttgccgaagtgatcgcaccaagtggttcggcctcgatctagcgggagaagtattcgatggctacaattgcaaacttgtacctatttcgcgccacagggaatgggccaatgatgcctagcccccatctggcgaaaggccagattggtgcgataggctgcagttcgtgctgaggtgcagtttggcttcggccgtgccgctgacagctttcacacctcttggcttgctcgacacaaacttttagcacagttggccaatacaccccctggcgaaacactttggaagcaaccgtccttgtggcctgatgtgcaccgcacagcccctggtgtatctctttcgtcatttcctttccttcggtgaaagaaatgcagcgaagtaagggttggagcaccccggaacgatacagctggccggagactagcttgtattttacggctctgagctgtaagcgcttcgcttctgcttcgtcttccgggagccagccattcttgaggtacttgacgaacggtgttcgccagtcctctgggtctttacccagttctgcctggtcaattgccatgacgtccagtctttctgtgggcacacttggtgcgtacaagacttcaaaaaagatgcctggcgaatgcgggcctccacaggcggcagatttcgccagggtatctgcttcctcattctggcctctaggtaagtgttcgaccgttacgccagcaaagcacttttccaaagaccgaacggcctccagatatctcttcattccttcttctttcacctcaaaggatttgtcaacatgactagccaccagtttggtgtctgttcggataagcaaacgccgaacccccagtgctttcacctttcttaggcccaatagtacagcttcgtattcggccgtgttgttggtcgtatcgaactgcagtcttgcagcataccgaatgggcacgccccctggcgaagtgagtactaccgcgacacccacccccttgtgcgaccacgagccgtcggagtgcattacccaaggctgttcgacaggctcggggtcgggggcggacgtcggtgtttattcggccacgaagtcagctaggacttgggacttgatggcagtacgggcgacaaaacgcaggtcgaagggtgataactccgccgcccacttgctgagtcggcccgtgatttccttgccccgcagcacttcgcccaaaggatactgcgatggcacagtgactttgtgagcctgaaagtcatgcttaagcttgcgtgaagccatcactagggcgtaaacgagcttttccatttcgatgtatcttgtcttcgccccttgcaaagcttcagagacgaagtatactagtttctgacctgactctgtctcttggacaagagccgcattgaccgccacctgcgaaactgctaaatagagcagcagttcgcttcctggtgttgggctgaccaaggcgggtggcctttgcagatattgctttagctcgtcgaatgctacttggcattcgggtgtccagctaaactttcccgcaccccggagggttttgaagaagggcaaacctctttcggctgcttttgagagaaatcaactgagcgccgcaattcggccagcgagcttttgtacttcgcgtacgcttgacgggggcttcatttgccgaatggcatcgattttctcagggttcgcctcgatgcccctttcaaaaacaagaaaacccaacaacttgcccgcgcgaacaccgaaaacacacttctcaggattcagtttcatgctagccgcacgcaagttgtcgaaggtctcttgtaagtcggacgcatggtcgaaagccttgcgg

SEQ ID NO: 2835 - DNA, 4823 bp, Oryza sativa
tttcgcccccaattgcttgtaaaggaccttgtacaccagcctggcgaatgttgctccagcattccttaggccgaaaggcatcctgaggtggcagaaagtgctgaacggtgtgatgaaagctgtcttggggatgtcggccggattcatgtggatctggtgatagccggaatatgcatcagaaaagctcatgagctcgcagctggctgtcgaatcaacaagctggtcgatccgcggcaggggaaagtcgtctttcgggcacactttattgaggtctgtgaaatcgaagcacatgcgccacttgccgttcgactttctcaccaaaacagggttcgccaaccactcggggtggtcaatctcttggatcacccccgctttgagtagcttctgcaattcggcctttgctgcctcttaccgatcggcggacatctttcacagcttctgtttccttggcttggcattcggcttgaccaccagatggtgcgtgatgaggtctgtcgaaacacctcccaaatcgtcggggttccaggcgaagatgtcaatgttcttcttgaacacctccaggatgttttcaacttcctcttcgcctagatcgccccccaacaggacgagctttgcgggatcggcatcgtcgacttgcatcttaatcaccttgccatgaggtacaggcttcagcatgcgtttagcgtggtcatgtggttcggcctctacattgtgtactgccatgctgattgcggccatgtcgcccttcgatgtggtcgagggttgtagccccttggcgacgatcacacctgttgggcccagcatcttgagcttgagatagttgtgatgggagatggcttcaaacttgttcaaggttgcacggccgaagatggcattgtagttgtatgggatgtcaacgacatcgaacagtatttgctcttcgcgcctgttttcacctgtgccgaaggctaccaccagttgtacttggcccaagacttgaactgcttcgccgccgaaacctcgaagcgaggctggcgcctgggtgagggctagtgttgacaaccccatcttggcatatgcctcggcaaagatgacatcggctgaacttcccccgtccaccaggattcgccggacttcgaagccagctacctcggccgaaatcaccaaggggtcttgatgtgggaatagcaccccttcggcgtcctctggcccgaaagaagaggatgggcgaaacacctatggggacaagagacaccgtggaaggaaagaacggaggaagagagcacacgcggtaaaagtggcaagtgtggcggtgaaaaggaaagaggggtggggatatataccccacccgggcgacgtttcgcctacccaccactaataaagcgccacgtggcgcaagggtaggcgaaacggtaaatccccatcatccgagcagcacagtaaaagccccatcaaaggaaagcccaatactgttcccttcggcccggtaaaggtaagaatattttatttgcaggaacaatgtaggtttcggcaggagcatcggtcgaaagggggcgccacataccataccacatggtttgcacggtctcggccgaagcttcattctcacccttgcccgtgaggggcttgttggcggatggcatgaggcccttcgaccaaatctgccgaaacccgtggcgaaggttatgaaccaagaatggtgtgaggcgaagcgtcgcgtgagtaagccggaggcgcctcaggcgaagagtacctgccgaagagagacgacttcgccgtgtctagttcgctcccgcaagggccgaagaagcctttccggcccatcaagcctaggggctatagggccggcgatcgcccgacggcccatcaggggcccataagcccccttgacattgtgtatccttgtaaatgtccctttcataagggcaaccatgtaaattcctctgtataacctaaaccctagtagtaagaatctgtaatggggctataaatagtcccctagggccatgtaataggggggaggaagaaggagaaattccaaaaaaccaatacatttcgtttctttccaaccactgttgagtaaccacgtctttcgacgtatgcggttatcgtttcgacaacattttgcatgaaactttgcatgaattacattgtaaaaacaaaagcattgtaatttttaagattgattttgagaaagcttatgataaggttaaatggtcatttgtacaatagactttgaggatgaaaggcttctctcctaaatggtgtgagcgggttgcctcttttattcaaggtggtaatgttggtattaaagttaatgatcaaactggtaataattttcaaacatataaaggtcttagacaaggggatcctctatctccaattttgtttaatttagttgctgatatgctagctttactaattaaaagagctaaagataatggatctcttaatggggtggttcctcacctagtggatgatggtttgtctattttgaaatatgcagatgtgtcacgcccagaagttcccgaatagaattccaagcagaatgtgcattaaaatccccgtccaggaccggccggggtacacaaacgacaaagttgacatacagatccacgtcttacaaacattataaaagtcttacataaatgcagcggaaaaacaaaagataactggagctaagccttgacttggtctgcagcgggaacaccactccacaggcatcctcgacggcacggacgaagcctactcctcggagaaacccaccatcggatacatactcatattctggggttggggaaaatagagcaagactgagtactacccactgtactcagcaagtcataccggaataggggtatgatgcagggatttatcaaggaataactacaatggttcatttgcataaaacgggcatttataaacagaagttgagagcagtaaaacagttgtaataattaatcaatattaatcatccactgtccaacgctataccacgttgcaacaggcccaaccatccacctatactatccaattccattagactaatctagagtgagtctaatcacgatgaatctagttgaccacccataagcgcgggcacggctattcgaatagttttactctgatcagaggtgtacaactgtacccacaagacacagtcccacgacacgtttccgtgcgccggcatgccatcacgacataccggaaagaggccgtgacaggacccttcgcataacctcctttaaccaagcacaccacacctcaggtttcacccccactcctcgcaaggcagcgggcagtcccctctcgtgcctaggtgaatccggaagcgacagaggccgtcgcagggcccgccccgctccatcacgcccacccttgcctggatgcgtcagctagaggaaagctacactacaagcccagccgttgcccacgctggcttgtggtaagtacgaggaattcttccagggtttcccgcgaaccggtccttaatttgccatgagtgcgactagcaaaaccatgcacccacagcccaccatgtgattcattttaattaaccatcaccaaaacggtggcactaatccaacattaccattagaacctacagtctatacattaatattatatcccccattgtgtgctagttgaactaagcatggctaagcaatccctaatccaacctctagtcatgttgtaacccaagttaacaaaggaacggatatcaagcaaatagcatggctataacagtaggtaaacatcccataggtttattgtaaaacaatgcagaatttgaaagaaaacaatacaacacttgcaatataggatcaacatgatcaagtgacaagcatgacttgccttgctctgctgctggaggaacctcggcgactatctcgaagtacaccggtgcgtcggaagagccggaatctaagcaacaaaccaagcaaacaatacaaacaggctataaggctacttaaatagagaacacaaccatttttaatggattctacacatttttcttgatttactgagacttgaatgggcttaaacggagctcggatgaattagttatgatttttagaagattcattgtatttttactataaacagaaaaatccttaattgaattattgcgcaataaataaatcccgaggagagagagggcggcgccgacatgcgggccccacacgtcagcggctgcgggcgctggtccatggtggatcgggtccacggaccggggagaaggggcgcaccacgtcgcgcacacgcggcacacacgcggcggccacgtggcggccacgcggcggccgaactgacggccccaatctacccttgggtagatcggacggcagcagagagcgagcggccggcgcgcgcgagcggctcaagccggcccggggccatggcgcgacggcggcgcggcaccggcggcgaccggtggacggcggcgcggcactggcggacggcggctgagcggctaagcggctaagcggctaagcggtggcacgaccacggaaagggaggaggaagaaggaagggggaatcgtcctcaccgagggagcccgaccggcgaggagaggggcgacggcgaccggcgacaaggagcgacggagggaggtcgacaagcggcggacggggtccgggacgacctaaggaacgaaatggaaaggattagagagggagagagggaccatagagggcgggaacgccggccgaaggcggcggccatggcggctcttaccggcgcgcggcggggatgaggctccggcggcgaatctcgacgggggaggggtggacgaggtggacctcggccacgcaaacccgatgacggcgacggcacggtgcgg

SEQ ID NO: 2836 - DNA, 14164 bp, Oryza sativa
ggtggcccgatttcgccggccgacgtgggagaggtggaggtggagagagaggcgggattcgaatttcgaatcccggccatctcgggcgcgggcgcaggcgagagggagggggagtgggtgcgggaggtgcggcgcatgcgcgggcgtggccgacgtggccccgaggaggcggggatgtgggcgcggcggcggttgcgggcggcgcggcgcgggcgcgaggtgggagacgggcccgacaggtgggccccacctgtcggcgaccccgggtgagaggaggcaggcgactggctcgcccggctcaattgggcctcggccttcggccggcccagcgggaagggggagggaaagggagaatgggccggcggcccattcaaaggaaaaagagaaaagaaaaaaaagaaaaaggaaaatgaattttctagggattaaatattgcttgtgctcaattttaattggttaaaattatttctagagctctgaaaattccactaaaaatcttgttagcgtatttcgacatgtagaactcaagaaaaattccacatgccaattcctattattatttgcattaatttattaaggtttactcttgctttacactggtattttcttgagaccatttataacttcaatttaggcttgggaaagaacttcagggtgtgacaagatgataccatcatttttttggaacatgacttacaacaagcaaagaatttaaaattgatattgtctatctttgagaaattatctagcttgaaaattaattttcacaaaagtgagctattttgctttggtcaggcaaaggagtattatgagcaatattctaatatctttgattgtaagttagggttgtttccagttaaatatctcggtattccaatgcattttagaaagctttgtaataaagattggaaagttattgaacaaagaattgagaaaaaacttagcagctagaaaggaaaacaaatgtctgttgggagtagactagttttgataattttgtcatttcaagtttagctatgtttatgatatctttttttgagattccgaaagtggttcttcaaaagattgattattatagatcttgtttcttttggcaaggtgacgatcataagaaaaagtatagacttactagatgggttattatttgccaacccaaagaacagggtggtttgggggttcataatttagagattcaaaatatatgtcttttgagtaagtggttatttatgtaaagaaatgaaaatggtgtttggcaagaccttttgaagagaaagtatctttacaataagtctattacccaagttgacaggaaacaaggtgactcccatttttgtttcttaactacgagttcttggattgtgaataatggggaaaaaaagatttttgggaagataaatagctagaaaatatggcctttagagaaaagtatccatctttatatgctattgtcagaaggagaagttcttctgttgctagtgttatggcttctgttccactcaatgtttctttcaggagagctttagttggtcagaatttaacactttggcatgaattttgtgcatctattgttcatattcagttgaataatacttctgattgttttagatggaactatcatcagaatggccaattttcagttagatcaatgtacttagctttaattaacaatggttacattgatagaaataagttaatttggaaacataagatgccacttaagatcaagatctttatgtggtatttgcttaagggagttgtgttaaccaaggataatttagcaagacgaaattagaatggtaatttaagatgttgcttttgtaaaaaaaaatgagtctatccaacatttgttcattgaatgtcattttgcaaagtttatttgaagagcagttcagttttcttttggttgatatattcctactagcatatctcatattttttatgattggcttcaaggagtcataaacaaaaagatcaaactgatacttgttggagcttctgccttgtgtcgggctttgtggttgagtagaaatgatacggtttttgacaaatcacctactgttacttatatagaggttatttttaagccaacatattggcttcgtctgtggcacagttacaaaagtgtgatgaagatggagaattcctaattgttgcgtgtcgtatgcttgaaacgaggttatgcaattgtttgccaatcatgaatggagatttaccaatagactgaaataatgttattttgtgtagtttggtttccttttaattttggttggtgtgtttgctttcttttggcctgcactcttacagagtgctagtttgtaataattggctatagctcttttgagtaaaggccggaatgttattttattccattattaaaaaaaaagaacaactcccggcatcctgcacttaggcgccaaaaaagaaattaggacccgccaaaggataaaaaattgagaccacatcagttacgtctaaatttttcatcactcaaaaaaaatatttgttttacaaaaaaaaatactatcaccacaatttaacctacaagtcatggcaatagtactggtacattgcaacaagtccaaaattaacgcaacagtaatatattgtggccagagagaatacgttagttgccataaaaaaaactgttgcaaaaaatacccttattgctacagtaattttccgtgtggccatagcccgctgtttattgcaacaaaaaataaaagtataacaacaataataaattgttgtgatataatttaccaattgccacaagatgaccagacatggcaatagaataatgcatttgccacaataaaagtttgttgcaatattttcatggcaatagcataattctctcgtagtgagattgaggttctaatcacgacttaggtcaaactcaactgatgcagctataattatgaaaagaagaacaatatctagacaatcaagccgttggatgtttcatagggtggtagataccctatataatctaagtcaacattggtatttaacctaatcggctgccctctagcgatagatgttagccgactgaaggttaaataacaatattgccggagattatataggatatatgataactcgataacttacataaacaagattagagtgtcataaagatggaagcaataatcccgagaacgcaagccgccatgacaagtttacctctagctgaagatcaaaaccgatgcagctcaatccgaaagcaagaactcgtcgagatgaaacgaaagtaaaaagggtgacgatgcgccgagattattattgaacgtgtgttaattttattacatagggctcggggtctatttatacccgagattacaaaatatgtccatatcggacatgatttttatctctaacaaactctaaaataccataagtctttgcggcagacttttgcccaagcttatctctaagaaaattacataaaatatcctaattaatagatacaattatcttcttaggactcaatccgtgcatagcaatccatatgaagcacttcaacctaacccgatgacgtgcaccgagtcgtattgtcggaatcggctcaatcggctagccttgtccgacttgaactctgccgattctggtcgcagccgattcggactctgtttcctgaacgatctctatcttagattccgcttcggttttatctccatctccgatacttgaattatcaaatctggtcgttaacacggttacgtctggactatttgagaaaatgttattaacgaatacacgggagtcaaagacactacttagatctgatcgatgaacgactaccgtatctgcgcacggcgctcaggcgaaagtgtgtcttctcaaaactcaatcggaatttgcagccagaccgttgtcgtgccggaccaactattcgaattccagctcccaggtgtactgctcatttcaccgcggacagcaacgagtcgacgagacttctgcccgcgtacatggtgactccgcagtacgcgtcggtgcatggtgccctggccgtcgatgttcttcgtcgtcggtgcgaggccctgcgcgccgatgggcgggagccagtgcagctgcctcgccgtggggcttgtgtcgctcgcgcgcgcgtacgtaaatttgtcggcgcgtacgtcgtaatacgtcgtacgcgccctcgaggtacgcggccagccagcggagccggtgcgtggccgatatgattctcgacgacgacgaggggtgagcggcagcatatatacatggcgtctcaagccgacgatctcatcctgaatgtttgccgcgcgtgcgcgagcgaccgtctgccgtgccacctcgatcgagaaccaaccgtcgcgcccactgccgtgatcagcatcgatcacacgtacgacgtgtcctcgcgcccgaaccgcaccttcgaaaacgccaacgcgttccgctggccggtggcatcgtagcagcagcagcagccagcaggacgatgaggtccgagcacggcacacatatgaactgcgggtcctttcccttgccaatttcgaggcccatacggtgcagccactagcgtcccacctcgcttaccaaacataagtttcagtcctttataaactgaggccaggatgcacttgtcgagaaacaccttgtcgtcagctgagtataacatgtaccaatttgggaggggtaaagcaggcgatcgggcattccctagccccctcctcctttgcttgatgatcccctccctatgaatttcaaaccatttaaaaaaatagaagttaaaaaaatctaatacccttaaaatatattcttaaaaataataaatgtgcatagactttatatttataaatatatacagtaaactccatacataaaaaaaacatttgaatataaattttaggtatataaccttacacaaaaagaaaattggtgccaaaaaaaaggtaagtggtgaaaaaaacatttgaatataaattttaggtatataaccttacacaaaaagaaaattggtgcaaaaaaaggtaagtggtgaaaaaaaaaatctcgcctaggaaaggcgaaaaaaacatttgaatataaattttacgtatataaacttacaaaaaacaaaattggtgcaaaaaaaagtaagtggtgaacaaaaaaaatctcgcctgagaaaggcaatcgttgtcaggagatttgtgaacctccactattacgtcctagatacgtgtgggtccacttctcatttctcaaatatcagtagttctatttttttaaaaaaaatgattgacaacatatataaggatacaccatctcgtaaaaactcaagtccaaagtcaatctacataattattagaaacaaagtaaacaaattttatagcactggaaataacgtttctagacatctgcattttgccacagttgaatcctaatatctgtacggttaatttgacttccatggttctctgaagaagaaaccgtcttcttcaattcactaccaaatatgctggaatttggatcttcaacaataggagggctcatggaactaaggaacgtagagcatgcctccttgagtttgcaacaatggtgcttctccactagcaccaacatggttgacactgagtatgtatcaatgtggttgcacaacttatcttcgtagacaaactttaacctctgtaagccatacctgtctgcagcagcaagcaactgttgagccatagctacattgtcttttccatgacctatctctggccaaatgtctgtgtagatgaacccaagtagagccttgaacactcgtgctttcatgttgtcaatctgtatcgcatctatggtgcctttcttcgtcggcccgaaaagctctgccttgaagaccagtgaccgtgccgccagcaccaaccggtgcgccgcaaacatctcgccaccgaccaggaacttgacatcggtgccttctttgcttacgaggagatcaccataatgcagatgcatgttcgacggtggtacgacgacagatggcttttcctttgggatgattacatgggcagcaatggcaaagtagtcatcattgagatattccgatcgctctaattcgtctctcctaatgaagtttttgaacccccttgcactaccagaatatgttgaaaagttacggaatttggtgtgataggtgtacgacagcaccgggttcccgtatcgatcgagcaggctgaatgtagcttttgccagcacgtcctccgatcctcggtgacgatgccctcaagcgcgaggaagatggagatgcagtccttgttgctgtcgcggcatccgtttgggtagtagctgagacatgccaggtgtggcctcctgcgctgaacggacaggagctgagggggtagtggcagccggctttcaaggtgttggagtacccgttgatcttgagtacgtgataagcctgcgccgcgatggtcatgacggtggaccgcgacggcggggaagaaccgtcgccggcgctggccgcaagtgtcgtcgccgtcgttgtcgccatgcctgcagtcttgtgttggtaggccgttctctctcgtggaaaagattgatttcctactaacagactgcacgcctgcttcttgtaggacaaagtgttagaatccaattccagctgcaggttgctgggtgaagagaaagaacttcgatttgggttattggcagcttcgtctgccggaacggccggtgcctgtgcaataatctgcacgcgtccgtgtcgctcatggtcgttgctgactagcttgtagtgtgacggtttatgtttatcgttggaggatcatttcgcaatggttgttgcatatatactgtacttttcgtttgatggtacgcggctagttgatcgaaaaaagctgtcagtgccaattgccaaaccgcctactgcactgacctgcttgattcccctttcgtatccatacgtacagttcacacaaatatttccttcgcaaccaatgacagaaatactagtttgattatatcataacgttggttacgtattttgagatggcaagagtagatctgttggtaaggataagatatgaccttcgtccttcgttctagaatataaagtacttttttatatgaatacgggtattaaaaagtagataaaaataattggaggaaaattatgataggtaaagaaaataaaataggtgaaaattaaacatagaataattaagattggttgagagaaagtgaagttagaaaatagctttattttgaaacaaattacaatgctaaaatagctacaccatacgtcccagaaagaatcaaatcctggctcggtataaatctggacgtgctcactcaaattcatagttaggatttattttttactgatggtgtatattataggacagaataagcacttttctagctcgggctatgaataattagttcttttactagataatgatgaataattagttgtcactcgacatttgtcatatcggatcgatttgggggtggataaggtataagagatgagaatgacttgggttgattagcttatggttttatgcgtattattgtagtattcacattgttgcacaaacgatctacataactaaatcatcaattatacagatctaaatcatttcaaaaaaatacggatctaaacatatcttacaaattattcttatattatccaaatatatagcatgaaaaaaaatataatactcctatattatctaaacatttttcgtgctcaaaggctggtgtgtatatagttatttttttaccaaagtatatagttattttttttgtgtgtgctgcagtggagctccattgtagaccctattctttttttttaacttatgtttaggtaatggaagtatggattattcttgacacgcttcgaagtatgatctattcaaaaacgttcatgaccatttcttaatattttgtctaagttctttgttaactttataatcatgatattttattaatatattggttaatcagcttactagctcaatacaattatttgtgacacacttcgaaaggtatgatttttccaaaaaaccttgtaaatgacaattgcttaatattttcttctgatttatttattaactttataatctatgatatttatcaattattctatgtattagtttgttagttaatcagctcatcagctcaataatgtaacacctaattattttaagttttagaccgggggttactatatgggaacatttttgttagagttgcccaccaacaccactacatgaactaataaagggctttttgattgctaccaaaatacgacctaccattgttttggtagtttgaatagtacttatgcttagtttagattgaagcccatgctagatttgtcatcaatatataacattcttccctataattcacatgttggcttcatattggtagcaaaccaaatataaccaactgcaatcttactctaccaaagaattggtagggtagcaatccatataggcctaaagattaccctcgatagcttagtttcaaaacatagtacaacacggaatagatagcaaccacacgcttttttattggcacacttacgattgatatttctacaaagatacattaatagtgctaatgggcatgttcagcaagccgactgcagcggcagcgtctatgctgcttttgtgcaatactgttggtgtcggctgtggcgcaaccgcaaaatcagtagccaaacaggaccaatgcgcaagaagatgtgtttgcgtgagagggttggacttccttcttgattaaatacttgctagaaatcatgtggtttgaaagcctatacgagattttgtatataccactggtggacaaaccctttttaatcccggttcgcaacccccctataatcctggttacgaaccgggactacgaatccgggacttaaaaatgcccatttttagtcctggttgaaataaccgggactaaaccaaccgggactaaatctttagtcccggttggagttaccaaccgttctttagttccggttggtgttcttttttctttcctgctgcttgcatgatttcgagccccacaaatcattcatattatccacaaatcattcgaacaccacagatcattcacaaaatccctaaatatatcaagctgcattttctatccccaaatacatcacaaatcattcacaaaatcacaaaatcatctccacaaattcattcacacatcacacatcacacatcacacagatcagaaaaagaaatccacatcacatagatcggccgcacacatcgcacagatcaggaaaaaaccacatcgcagagatcgggcgctggccgtccgccgcctcgccggcctcccacccagacgcctcgggctccaccaccgcctggggagtgtcgcctcccgccgcccgccgcctcggctgccggtgcccgcccgctgccacctcgggctccgccgcctcgtcgcctcgccggcctcactggccgcctgcgcagccacccgccgctccgcactctccctgccgcctcgcgctgcccggcctcattggtacgaggaggaggaggaagagaagagaagggagaggaatgggagagaagggatggaggattggatgaggctgaggatggagaagggataagggaggctgtttaattaatgagaggggaggggagaggaagggggagagaccgaggcggccgggcggggcagtggtgcacggctcggttgatttttgtcccggttggtataaataaccgggactaaaaaagaattggggtctaactcgatccgataactttttgaaccgagactaaaaatgatgttaccaaccgggactaaagatcaaaaaaattttaaccgggactaaaaataatctttagtcccggtttctattcgaaccgggactattatggattttgagcgaccgagcaaagatggtttctccaccagtgtacatagggagatttttgcaaaatagaccctttcacgcattaacttctctaaagagcctaaaccaatgaagaaaatataaataaatggaacctgagatttgaagcttgctatgcataattatgtcatatcctctctctcatgtatctgtgtacatttaacttcacttcctaaatattccctccattctaaaataaattaatcttaggatagagtttaacataacatgtcatatcatactttagatatgtttattttgggaagaagggagcagtccataaccgttgcccccaagtcatcatacaatattgttgaaactctttggtaattggatgcccatagtccaactggattattcccatcagttatgtaaggaccctatttagatcgcaataatttaaaagaaatcctagttgatggtgatcagttccaaccctttgaaaggaactgtttgtgatgttccagagtttgtttatttcacaatggcatggacagcgtttacacgtaccgtcgcacacaccattacatgtgtatataaagtttgtattcttaatacacaccatattacacatgtacgtactgtaagtttaccttcttaatacgcatccagcgtagagtggccaacagacaaatatgtgaaccttagaattttttagtgaaaatacacccgtatatgtgtaattgtggactctaagattgaaaacttttagtgcgaggagtcatttttggcacactaaaaaaggagtttctcttaacagactgtctgagaaagataaaaaattgcagtggtctataatggtgccttcacggctgcatcatgtgtacatcatggaccagagagttggtgaaagataaaagatatcgtgactgagctgcggacacaacaaagaacagaacaggtcggctgtgatcttctggggtcaatgtcttctagaaggcgaagataccaaccaacattctgtggtatgccccgaaaagctgcaaaatggagcgttttgtgtgttgttgtgcttggaataatgctaccctctttcctttttttataacgcggtgatttgaagccaaagaaaggtaatcgcaaagtaacttagcgagaaaacaactatggaaattgaagggtctgtttgatccacattaagataaactgatcgtctcccaaaaccaataaaaatgttactaaaaaaaactacaagccataagccattttttatgagagcaagttttatatagtagggtgattactacatctcatgtcatctataaactaattaagatgcaacatgtacaatatgttatctccatgtacacaaactccaacattttctttaatcgattcattatttcattttctgtttgcactttttcttgaaaattatatagaggttgcctcttgcatgagaggtggctcatgctctctcttcactttctctcctccacctcatcacctaatcccatgtgacaattttagaagcaacacatgtgcccttatagtacttgccctaatacattttgttacacggtttcaacatttgttgccagagaaaattacaaatttccgttgttggtactccatttccttcacctacccaagctcatttagggatatgccggtacatgcaaatatacatttcaataaaaagaactttgcaataatttacacagatactgttgttataatttcttaattttcaattgaatcatttctttggaatgattctcacaaaactacattcagaagacccatgcttaaattgattgtagaaatgctaagaaactaagaatgatatattatcgtcttaaaatgcaatgtgtatttttggagttggacacagacattaaaaaaactagatgaataccccaccatattgctgcggaaaattaagttgtataatatatacaaaactaaaaacaatttgatacaattttgaacctaaaagtaattgagattgcatgtttttaagagagaagaaagaaaagacaatttagaccatagatctatcattcaaaggctataaatgattggggtgatgtggcttaatgagaaaagagagaaataacattaactatacttagtggggataaactatacaagtatataagatacgtgaaaaatgatttaggaaaggctgtcacttagtgaaaagaaaatgtggtgaaaaaattcaagggaagattaaaaaaaatcacctcagaagtcacttgaaattttaacattccttgcaaatacccgcatccctctcggttttgtttgaaaaacaccctagtgcgcacttgcttaaccaaattgatatgcatggttttgtaaaatgtgaggcgtctatatggtctttaccaaagtaaaatacttctaggagtatagccttaatttttttggatattgcataaatagaattgctgatgagagtttaaacgttgttgcactcaatttcggtatatgcagaaaagaaatcaatgaaacataaagaataagtctaatgcaaatactttgctaagattgactcggctagcttagcctatggtggctctacataagtgttaacaggctttattagataagcatgtacacactgggatggtttttgcacaaaattgagtaggggtggatatttgcaacaaagtgatttatgaggtggaatgtcaaacttcaagtggcttttgggatggtttctgcaactttcccaaaattaaatgaaggatgagtgcgattagctaagacgcgagcgtaagcgaagaaatagcttaattttaggaggagtaaaaatatataacttcatgttgagactgatggattatactagtcctatttaaggatgagtaaatttcataaaactacatgtactttgatcaaactattataaaactataaatttaaaaaggtatatcacataaatacatatttaggaccaaatttatcaaataactacagatttaaggtggaagatcaccaaactaccgatgtagtaataaaatgatcacaaaacgacatgttttgtaccatgttaaatacaaaactacaacatttataattctaacataacaatagtagtagggatttaaattgtaaaatctataattttgtgataactctagtattaaatctatagttttgtgatagttgatcttaaattagtagttttctaataaacgttgtgttaaatctatagttctatgatacgacgtcttgaatctatagttttattataatttaattaaagtacacataatttttgtgaaatttacactttaatgatgaattgatttccatcatccttgtgcatgaatctagccaaatcctctgcagtattgtcgatgcagtagcaatggatcagtatcgggcccacacgtcagtgtctgttactgaatgtgcagtactgtaaagtgtaaacctccttccttaaactaatcctctattcccttaaaaaaaatctacagtatattttttttccaactcgctggccgctgccttcctccggtcctccctgagctggcatttttggcaccacaacacaacccccccaccccaccactcttctccctatcgcactccacctccccgagacgcgacgcgagcacgagcagcgcggcggcccaactcccgaggtggtgtaaagccttctcctctccgctaccttcttccaagatcgcgttcctgctctctgaattcgcggtcagtccggggtggggcgcgcgagttcttgcctcagatccgcggcggctcggtttctgttgcggaattgtctaagatttgcgggggtgtttgtttgctgctgaattgccgggtgtttgtgattcgttggctgcagcttgctttcttggggggcgccgccgcggcggagttgggtttgaccggccggtgatggggaagggcggcggctgcgtccccagcaagaagcggcagccgccggccagcaccgtcgccggcgcgccgtcgtcgtcgtcggcgccgcgcgacgcccccgaggcggaggcgtcgggggaggcggccggggggcggcggaggctgcggctgtacatcgtgttctactcgatgtacgggcacgtggaggcgctggcgcggcgggcggcggcgggcgtcgcggcggtggacggggtggaggcggtgctgcggcgcgtccccgagacgctcccgccgggcgtgctggagaagatgcaggcgccggccaaggaccccgccgtcccggtcatcgcggcggcggcggacctggaggaggccgacggggtgctgttcgggttcccgacgaggtacggcgccatggccgcgcagatgaaggcgttcttcgactccacc

SEQ ID NO: 2837 - DNA, 8813 bp, Oryza sativa
  unsure (1)..(8813): unsure at all n locations
ttcttcacaaatggattaattaagctgctaatcatatcatctttatattagtgcttgctatcatggatagtagtgattgattctttaaagtggactggattagaccacttccttttccattcataagattatctagttcttgggataagaaatgacatatactaggtgttttagatgttgaactgaaccttgaatgctgttgtttctactcagttcaaatttgaacatacccctcatcagtggactgtttttttttttttgggttagtgctgagtgcttgcaaccactttgttggttggtgatatagcatatgttctgtattggcagtaatttaggcactaactgtttctcttcttctctttttttcccctttttggttcaatatcataggtttaattttttaattgttccttcactccaattttcagcatgatgcttgctgttgcactcaatctgtctctgttcagtgagcgtgtgcgtttacctctaggacagatttataagtcaaatatagtaggtgaggatatctgagattgaaaggggttccaataaatatcagtcaaattgcacctatcttgacaaatttcaagtaattcgccctgggggcatcagcaagttaatgtcacatactaagatgtccttgtcatggtgcgttaccaattgtttggtagttccaaattgtggaaacgaggtcttattcttgtggctgttcaaaatccttacgcactacttcctcaataattaatagccatgattctgtactgtgagactattaacaacaaaggtagtgtggtcatggatgcatttatgaatagcaggatattgaagatgatttgtacaaaaagagatcttgatttaatgcacagcatgcatagcatcttgttctctagctgatcaggatctgctgtactccggctcaactcaggtgctgtcctaagcatttggatatgaaattcataaccaattgatggaggtagtgggtacaacacaatatttagtagtatctgtgaaaattttggatttatcattttcaaacccagttgggaattcagttcttgcctcgatcaaaatatttaatccacttcttacacgccaagtgtgaggaaaatagccattcacttgtttcaacccttcttgattttgagataaaaatgatgatcttcatcatggcatttggacatgtataagaattagaagatgtgtcacagttatagtactgttctttctgctcttttgccaggctatggttccttttattggtttatatgtctataccacccaacattttttttcaaagaagcattttaggttaatatttattttataatgaaagtttattgtggtggttttattactgctgagaaatggagaataccaacaaaaattctagagggagggagaggtatataggctttaatttggtggatctaagttaaaggcccagatatgatagttgtttatatattgattttctgaaagaaccacatctcaatcctgtcacttagggagatttcaaataagttggcactaattcaacagaatataatatcccaaatttagattccgtttgcagaagataattttaattcacttcacaatttgcacagggcaatcagctagtttactaagaataacatgtatactgctattttgcttctcagtttaagttggttttgaagtctatcttcaccctgctattgctgaccatgcttctctgttcattttagttggacggcaatcacccagatagtgcaccatggaatgctctttgtcccgattggctacaccttcgggtcaggcatgttcaagatggatgagatcagaggaggcagcccctatggcgctggcgtcttcgctggtgatggcagcagacagcccagcgagacggagctcgccctagccgagcaccagggcaagtacatggcctccatagtgaagaagcttgcccaggcttgagcctagaagaagttgaatcctcccacgacgccactgtgcagtccaaactccacacgatcgtccagtcgccattgatttccccctattggtttttcttcttctatatgtaatgtgcacagcctgatgatcctcagatcgtcgtcgtatttgttcgtcacagatttatctgtaaattgttgacataaaacattgtttggtgtccagttgaacactaagtgtgccatacggtgttgatcgaaataacatacatcacttgccatagatttgttatgcagaactctgtttctgtatccagaactttgtttctgtatcatgaatgaagggaatgcacatgcttgtacagtttgtactgatgaatatcagtctgaatttctgatactgcacagtggagtggcgtcaggctatagcttgcaggttccaactggcggattcgaaggctgagccgccacctccagcgccgacgatcaccggccggcgaccagcagggtgctcgtcgtgacgttggcgcgaggcagtgttgcttcccttcagaaagcgtattcggagaatacgccgtgttgcctggagccttgaaggggtttatgtggcgaaaatacgtctcttcgcatagaaagcgtattgggagaatgcgtattatggctggtaggtggattcaaaattttgaaatttgcctttctgcagggggggaaaccgcagcagcagcggggagagtttggtcgcctgaggtttttgcctcgccacgccggagtggctcgccgccgccgccgccgtggtggaaggagtccgttccggctcgtctcgccgtcgcacccccctccgctggtacgagattctcagattccaccccctcccctcccatccccgtcccctggcggagctccgatcgcacgcgattgagggcggtgaattagttcgaggtagcgatcacaaggtaggggacgctcgctcttcgattagggtgcttctcctccgggccggcgactgggctcaccgacgagttctgcacccttagggttctaatgttgtgttcctaggagtttgattaggctttgggggggggggggggggcgctcgcttgtgcaggtgtagcgttggtgttccctggtgacccaaaatctgctgggtaattgatgcgatacctcctctgttatgccattagcgtgttgatttctggagtggaaggggggatgatgggtctctgatatggacttgtagaattgtgctacatatgtctgaacaaaaagttctttgaacttggtggatttttccagaatgatttctggctgaaaactatcaaattggaaagattgtgcagtttggatagattttcctgggtctatacctttttcatctttatttattacacagggaaatcctataaggatgatcgatatttttgtttattccactatctgtttcagtgtcatcattgtacaggaaaagggcactgtctattgtatgtttacagcgtttagttgacatgtcgcacctacttttacaattttcatgcttctatgatagtcttggtatctaatttttctggtcatatctcctcacctgtgcataatttccaaatcttgttcatcataaaataaatgaattgatatggagtagtgaattctttgttgttgcaattgacttcaacagagcaaaacggaaccaatgatggacactctagagcttgcaagtgcaataccagaagctggagatgaggcatttcagattcaccgcttgaagcgatctgcatatgctgctgtgctgagagcgttctatgctcaaccagaccttctctcaggggtacttatttcatggatactttctttgtttgtacaagttcaattgcaaaatatcagtaaacaaatcatacataatatcagtaaacaggttcaattgtacaagttctatgctcaaccagactttctttgttttatcactcatcttgcattctgcattttttttaacgattgttttgttacaatgaattacctagaattacatagcttgatcagtgaatccaatctgagtaggttcacgtagccatgcgtcataattggataacacggcaccatggaataatatttgctttgaccattaccatatgtatattcttgttgttcattatcttcaactcacaggccaaggaaggtagtcttgcaaaactgagaagtgaattcacaatatttgacaccgagcacagagaatatctaatgaaggctatctcaggaagtcagtctttgaggtgcgcaaatcaagtgttgtttcacagaatataaaatatatgctgatagaatgatcagtgagcttacctgctctacctttccagattcccaatatctcttttatatttgatagtattgaactcatatttctacggttgttttagtgttggaaatttcagatctccttgactgtgcaaacatttctcatactgtgacaagtaccacaaaacaaatcaactgatattgtgctgcatttcttgttgcagtgttggtttgaacaaagcaagcatttgtaatattgaagttacaaaggattctctagatcttgtacccatgataacagatgctcaagatactgcatttcagattcactgcttggagcgatcagcatatgcttctgtgttaagagctttctttgctcagtcagaactcctctcacgggtataccgtatatgtgtcatccacttatttctataagttagagtatgatatatcactatacaatgcagcttccattttatagaactttcagttcttagttttgggagaggtgtatgatgccacattttcttggtgctggagaaataggctcacattattgctcattccatactatctttcttttgcgcatttatagtcattatactcttatggtgaattattttgatttattgtaactggcattgcttcatctttattttttttatttttttgccttacagtcacaggccaagcttctcactgaactgaggaaaaaacttagaatatcagatgcggagcttagagaagttctcatgaatgtcacttcaaacgagtatatcaagtctttgcggtgagcatatctacttattgcctcccaggaaacaaaattcatgttgatcaatcagatgtctgtatttctttgcacttagcaggaattgtagtttggcaaataactctggtcttaaggatcctacttttgatgcacgtgccatggttcctgataagctcgtcaaagatggacaaagcttcacctcattcacaaactgcatcagtttgtctcaggaatcacaaatatcaccgcgttcaatgctatctgtgaggtgattatgtttttgttttttattatttcacataagttaagattgctctgaaattaactaactgttggattttcagttttctgaacaattttcacttatgaaacaggagtgttgacatattacgtagctctcacaggaccaaaaagggtccctgtctttatccccatgcaatagttcctgctaagaagtactctggaaatgagtacacattatcatacttaaaatcctctccagctgaacaattgccagttgcagtttcctctgtgcaggtggtatgtatcggttctttcttagtagctaacatcttaaactacaatatgagtggtattctggatttatggaattttttggctcttctttttcctgctagtaattattatctccagatgatgtcatgatgagcttaatttcattaaaaaaatatccacagtattcagaaggtaaccacaattgccaattggtaatatgcccattcaaactattgtggttatgtacttatgtggaactgtaaattatgaaaaaccttcccttttaatacctctgtggtttagtaaacagcttttgccacttctctgcctgtttttatggtaaaaactcagttaaagattttctttaaataaatcacttggcactgatgaaggttcgcttctaataatctagcattctagccctatgtgttgattataatttttgacagaaacgtagcacagatgatccgcttgatactaagacattaccttgtgaagtgaagactggctgcactctatctcccatccaattaaagcacatccaagcaaatgctggtcatgttcctttgtgtattcatcaagacatgaaagcatcaatgaaaaggaaaactgaagtgccagaagtgacaggatctaagagcttgactgtcatcgtgtcaactgctggaaacatagaacatgattttgacatcatgaagcttgacctaactgccaacctcctgagcaaggtacatgtatcatcctgagtattaaacattggacttggctctagatggtgaactccccctaaattatgatatctgactgcttactaactcttttaaatattcttttttccggtgatgtttcttagaaattaaattttctttgataatattataccacttcctgtttagcattttctccctctctttgtgcttttatgccgtttatttttaagttatatcaaggtatcaagctatttggttaaggtgtggctttattccattacttgtgtttttttccctctctttcatgtataccattcgaccttgtttgatctgcaatgtttgctactttaagaaagaagataaggagctctttgtattataatgagctttagattcacattctcattttacaggttgaacaactgtttagagaaaagccaaacccagatgatttagagacagcaaaggcgatactcaaggtgagaaccctcttgacttggataactcagtatgtaagcattggatttcatccaatctccgcttgttctaagcattatgtacttcaatgccatttaaacttgaaccaggaacaagaaaaggtccttttagatgcagtccttaagctttctgaagtatcatatgttggtgagtcgctttttgtatacttttttgttttctcatagcttagaatgttagttcttttaagaaaatattttagtatatcaactacactactttagggggttctgcagactcttttcctttttttaaccaaaaaaaatattgcatcaccatcataatatattcctaccaatgaactactggatgagtcctcttagaagttaccaaaactcttagatatatatttagttattgtgatccgtatttggcataatagaatgtgctatgagactgcaaatataacaatatttttccacctgaaaatattgaatttgatgattgacccttatgaagaacggcatccatcaaatccctctgaaaacactggattcaccatttctattttttctatcttcatcaaatccctctgaaaacattgaatagcaccgatttagaactgacatccttctctttgtcccatctactccgtagaggagtgtttcagcaccaactgccagccagatgagttcaaccagcactatgagtatgagagcgacgacgagatgccgcagaagacagcgagcacaaacgacgccgagacgccaccaaaaccggtgagcccaagcgacaaggaggcgcctccgcagccagtgccaggacgtggtggtggcgccaccagcaagggtaaggcgaagccccgcgactccggccggagctccggcggtggcagcggatcaggcggccggctcgacgcagcggacgaccaacccacctccgcctccacgtgcacatcatcaagcacactgtcgccgcgatcagaacgagagggggaagccaaagcccagcgcgcgcgcgggagggtgtttgaaccaccggccaagcgggcccggcgcccctccgtgaggctctcacggtcggaatggctctggtggtgaatgcgcgcgcgactgtgttcagctggaagcccccgcaatgtgaattcgcttgacaacaacatcatgactgaccatcaccaactctgctactgcaaaatttgacagttttttgctggagacctctcacctctgatcaggtaaagtatagctctcgcctctgtccggcctcttaagctttaagcacaaagtggtacatagaacatagttaatgtaactagctagtcctttcttccatgcacatataggtccatcggtagtcactttcaattatcaaaacacattttgagacagtttcatgttcccactaggttatacagtacctaaaaacatttcattactcactatctgctatgcacttgtggcatatttttttgtgctttgccatggattggaaacagtgataaaattgatggttttgatagtgtactgaattaggctgcattctcaggcagctttaagatgttgcctgctagtagcatagtactatccctgcactgcagttctggaaagtggtcgctggctgtgcccatgtgagtgaagatggtggtaatgcctgtgccttgtctatcccatgcaattctccctattcgagctgtagatatcatgccattaggtacagagactcgagtgaacagcattagatctgaaaaacttgcattggccttttataactgctcgcagctaccactggtcccggtcacaagtacttcatgttttttgttggtctgtccagctccagcatggttaaactgtacattcatcacggttttgtgatggctgagtggcttactcatgcaagatctagttatgcagagacagggattggtcttaactcttaaacaaagtgtatcatcatgatgtgatcgtcgtctaatcaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2838 - DNA, 1930 bp, Oryza sativa
  unsure (1)..(1930): unsure at all n locations
tacttttcccaacccccagagttcgagtatgtgtcagatgaaggtttctccgaggagtaggcttcgtccgtgccgtcgaggatgcctgtggagtggtgttcccgctgcagttctagtcaaggcttagctcctgttgtctttctttctttccgctgcatttatgtaagacttttatgatgtttgtaagacgtggatctgaatgtcaacattgtcgtttgtgtaccccggctggtcctggacggggattttaatgcacattctgcttgaaattctattcgggaatttctgggcgtgacaatagatctcttgatgcttttgaaatttttggacaaaacctcccccccccctctttttggatgagcaagaagaagacctcaaatcgtgagctagtgtgggggggtatatataggctgcaggctaataggtgccagttcttgttaaaaaccggcagctatattaaaaaattgacacctatactttgcatcataaccagcacctataatcctccccgacctatatgatgcaaaccggcacctataggtgttatttgtgctggtttttgaagccttattggtgtcgttttactaaataaccggcaccttttatataggtgccggtttttttgcatggctgccacctattaaatttttggaccgctagcaggaggatttttaatgccggttttagacaaaaaccggcaccaatgtcccttccaactaaaaccgaccacaattaaccgttatatgtgccggttttttggtctaatggcaggaagcgccttataggtgctagtttttagctaaccggcacctttgtggccgatacctatgggtgtttttgtagtagtgtgtgatggtggtggtggacctcgacggcggaggaccgtcacggatgctggacgtgagagccgccgccgccgccatcgtcgtcgtcgtcatgcctgcgtactccagcccgtggcctgcgttttgttggaattaatgaatgggccttagcccactcgaagattaattctttggaaaatcacaaaaagcccacctcatgggatggcatgcatgtggagtttagtaccaccttgcttattctaggagagggggacctccttaaaagggaggatgccctcctagccacttgaagcatgtgtggtggcagagaagaggggaaacacgcgcgcgctcgctcgcctcgccgggccgggccgggccggcggcgcgcgtgcacgacgtacgcgtcgaatggtccgaaaaattggctcctcacccttgcgcagatgcagcctccttttgcagttttgttttgctgcaaattcggattcggttttgttttggaaacgttccgaaaaatccggtgcgtgcaaacggcgtggnagtccggataagttcgcgcgacttatccggtttggttacgtgcagtagagatcgtgcgggcgccctgatcaagcgacccttctctatataaaccaacctgccgtcttcacgcaacatacgcgaaatcaatctagggtttgcctcctactctgtactgcgccgtcgctcgtagactactccatccctctcgccggcgtgcaccggcgatcgggagagcaggtctccggaacctctgccttcgacgtcttgcaccgggagaaggcggcaataaggtttttgggaagcgcttcgcgcgacggctcgccttcctcttcgctcgcgtgtttcgtgccttcgtagacacctgcgaaaagtttcgaccaagcagccggtctttccgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatttcaacaatccaaaaaccttattgta

SEQ ID NO: 2839 - DNA, 2671 bp, Oryza sativa
agtgccaagcacatgtattagagagcagagctggtaccttcttccttgctgatgttgatagaagaatcagtctcgctggcacttatatcaacctgggactgtgcagaaatagctgcttgccctgcagctacagcaacatctgaaccaacaatggctgacaagaacgcaacctgggaaaacaatgctattagtcagtttgccgcatcaattgttacccatattcaaaaacctgctacataagaaaagcacatagcaactattgacttgaatataggattaactgtgatgttccagccgaagtgacattcttagataatagatgtcacgtctctcagttagaatttacaaatatagttttcttggcaactatggttgcaagcttgcacgttgcagtctttgttccaagtataagctacaagtgtatcgcataatcaagaagtcaagatataacaacaattaacttcaaatggataattactgatacagacctgggccatgattggattgctagcatcagccagtggcgtgaggcgtagtcgttttgagatatgtgatccagattcttcattgagatcacaatcattcccaaactgaattttgtcctccttgggtcccatgaactgttccccaaaaggtaatcgggtgaatctagcaatgcagtccttttctgatcgactaccaacatgatgagaaacctttttccagtcttccccataatgcaggacggcctcaagaaggtgaagagtttctttatctgtccaatctgattttgcgtcctcagtaatttcaattcgcttgaagtctgccgaagtaagacctggccggtaattggcacggacatagcatctagcacagaggcttatatctgcctggtcataagcagaatttaaggagtttagtagtgtttccaattaaaagatacaaggaattaatgagactttcaaaatacaccaggatgatatatgacgacagtatctcaactgacgtataaagtttgcgtgactagcaatgaacttcccagacttaaaagtgtcactaagttattataatcgtttgcaaatacttttcttaatggtaattggtaaaacacgactgcaaagagtatacttgttcaaaatgagttactggccacctccttaacaagcaatggacaaatgagctgtcgtgcacgcttttgtgagagactggcgcttgcatgctagatcaccgcagcaagcagcaaagttgtgcttgattgtccttggccacaagaaagaaggcaaagagataagttggttgctagtattatctaacatgctctgttaggcagtcaatccatatagttggaatttattgcctctggtaaactttgctaggaaggtgcctaagaaaataccaaacaaaataacaaaggttgcaagaacacggatacccagaactgcctttcacagggaacaagactattgttggtttcaagaacaactgctcagagccgcagatatccccttttctcaatacccaaaccacatcatggagtttcaacaaaacataggtaaagccaaatggactgttgttccggtaagaagggcaagctctgaactgaataagtgcaatctggaaatatttgcactcttactgtctaattgaaaccatgagttttacaaacctaaagacctcaatttgtgtagaaatttgcagcacacatgtttgattaccctctcaatttataatttcataagaaactaaacacaatagttaccaaaacaaagtatatatcagactatttgtcaacaactttgtctgctcatctgtcctgcccttcctacgggacatgccaaaactagctaaaccaaatcattgcagccgaaaacatctccacacccaccaaatatatttgtttacaaatgcgtaaactcataactgcaaaagaagagaccctttgttccattccataagaaactaaacatctgaatatttacaacactgcgcagtaggtgggaggcttggatgctcccaccacccaagttcaaatactcttaagcttaactttggtgtttctttcttttctactaattagataccaaggtttttgctgcttctttcttttctactaattagataccaagttctgccttggtatcctcttttttttttccattcgaaaaaatatttaccacttcccgtatcaacagccaagcgctgtcatagcttatcagaaataattcgtgaaaaacagctaagataattctacagtggtaaacgatgcatacacattgacaaacttgtaatacaactgtacacagcactgcataaataactcatccgcaaatcaaaacaagagcaaatcactcaccttctcacaagagaaataagcaagcccgcacacggtgcggcacccggtgcaaagcttactgggcattgttgccccaatcggcaaagaggactgcgataacgctgcctcctctttcttatctctcccctgcttcgctcccgacggcgaagctccatagtttatcagcccccattcctcaaggaagtcgaacacgcgacgcacggagccgacatctccgacgagcccacgcctggcctcggtgagcgtcagccgccgccccggccgcgcccggaacctcctcacgagggtgacacggtagtacttgtaagcctacgggcccctggacccggacgccgccgc

SEQ ID NO: 2840 - DNA, 11611 bp, Oryza sativa
  unsure (1)..(11611): unsure at all n locations
gctgcggcggagcgagaggcatggagttcgccgtcgccgtagtcgccgccgccgccgcctcggccgccggcgctggcatcgacggcgtggccatgagagctcgagacagccgcgtctcgtgttcgtcttgggcttcacccgcagtggagcctatcaagccgcggcccaccaagaggattgggcccaaccgaccaacgcggcagagagcgggagggcggtttcgtggtctcggtttagtaccacctcgccgattctgagcgggaggaggcggggagcgggtataagaagacgaccgggggctgagataagattaatgtatgttctgatcttattcttgaataagttcagaacatactggaataagttcactttgagtccctcaactttatatcgagtttaatatcggatatgtgggccatgttcgcatggcctgcttctgtatccaaatatttttttatggggaaaggcccattagtggttctgccactagggcccttgcgcgttgccgaggtgttgcactgctgcccgggccggcgcaccccaaccaaaactcagttccaatgtttgtaattactagaaaattccaatgtttgtaattactagaaaaaatacggtgaagtttattttaatcttattgttattaagatgaaatttaacatggttaactgagtatatggtttagttaagatgaaatttaacgtgggatactatatagagagaattacactttggaccaatttttattaccttgcttacatattggaccgggtataggtaaatattttcacttagggctagattttgttaccaaattttgcatttgaggctattggtccacatgtcagtaaccaacacatcatcttcttcctgagcagtcttccaggctttattccgtgcatgtctccagtgagcttatttcgtcctcacacagacaagctcctcttccccaatctctagccacctcgaactgcactccgctacttgacaagcctgagcacataggctttgaactaccaaaaatttgaactcatggtttgatgtcaggagcatggagaaagagacggggctggagtttgaggcgatggagaatataagggattgacggagctcgagttaaaggtggtggagttggactgttggagctcgagctcaagcagcagaggaggtatagctcgagctttgaggcagaaaaagagttgaagctcgagttgggaataatggaggaggcaaagcttgatattggggagcatggagatcgaaacctgcgaggagaccttattctttctttttttccaagcatcagcaagaagagctttgtatgtatgggcatggcaaagcttgagctcgacctgccttgctctgactcagtggttcacagtggctcttggaggagagacgcaggagagagaagctagaggttgaaagtaaaataccccctccttccctaaatatttgacgccgttgatttttttaaatatgtttaaccgttcgtcttatccaaaaacttttgtggaatgtgtaaaactatatatatacataaaagtatatttaacaataaatcaaatgataggaaaataattaataattacttaaattttttgaataagacgaacggtcaaacatatttaaaaaagtcaatggcgtcaaacattttgggatagagggaatattttgcaaagatatctagcccaaagtaaaaaaatggatgtttaacccttgtccaacttgtaactttggtaaatgcaattcactcaatatatatatatttaaaaaaacatgagctgcagttaggtgtccgatcgtcttaagttaacatgcgagtttttttaaacatatttcttatatgattcctttggtattatcaaaagtgaacgatcttaaaactgactcaaatatggatatctatttccaaaagcaaacgaacgtaaaaaccgactcatatatggatgacgtaccaaaataccggtaaaaacattttagtttttataatagtagagataaagagtagcaataatgcccgtgctttgccatgggataaaaaagaattatagataaaagcgttgccatgtgtacttttctttaaaaactgaacaaaatgaaatctttgattgaactcagcaatgattatgcaagacaaatgataactatatgtatgtgttatctatggcaacatatcatatacacacaggtcctcacgtgtacacacgtgcacaccaactaaaaaatatcaccaaaaaatctagaaaaaatcatacacatactttcaattgtattacacctagggttaaaatcttaacgtcaaattcattatattttagccgtaacaaaaaaaacaaaaaatctaaccgttttaaggttgcaattttgtcagaattttatcttttttgttattctctatgtagaataaatttgaagatgcgactttgcacgtaaatgtaatactattgaaagtacatgtatgaattttcctagaattttttttgataatttttaattggtgtatacggtgtgtacacgcgagggcttgtgtgcataggatacgctcccgttatctataacatatcaaaagaaaacaattaacctccgtgtgctttcattatgtccatgaatgccaaattgtctagctaagattttgtaatttacaaaaggcatttaaatttaaattgacaaatagaatctggactccacctcaccactacccctccccccctcccccaaaaaaaaaatctacaggtcatctaaggctgagttgaactacaacttcaaacaattttctcgatttccttcagcacaactgctaagggcacctacaaaagtagagaccggtatgatctctacgttaattagatgctatcatgttacaatagttaagataatacggtctctaatcattaatgtaccaaaatactttcttactagttatcttttctttattagactcaatgcaacgaaaaatttcctaataaatgctaagagtcgactctatgccgttgtcatgcgtagcaaccatctttctatttccttcttcctctctcttccacgtcactaaatatgtttgcatgacaataaagagagaccgctaataaaaactattgtatatgccttaagggcagtcccaaccctccacctaggatggtgtctatggcattaactacattgccatgtaggacttttagcttatgtggcactatattaattaagagagagagtaaagagagaaagaaactgggtctcatgcaagacatagcttcaacatgagaacctatgcactagacactatcaagttttgtattgggagagaatagtgtcttcataatagatgaagaatgaatatgattggtagagaagagagatgatgtatttattaatggcccactttaagaaaccataggttgtagagtgtagtttctattgtgatgtggcaccatagacactgcttacggatactatgggttgggactaccctaaacggtggttttgtggaccagccaaccagttgctgctaagttgcaatttggagttgtcagcctaagaaccactccttgccaatggaaaggagacttgtctaccggtgcacaacgaattcataaaagggtcatcgtcgggaaagcctactaaattatgaacgctcaacctcaccaaaaataggatctgtatgaggaagaaaaataagatcacatggctcattttcaacttcacaaagtcatttttcatcaataagcagttatgactaactgaataaaaaaactaaagctccaagttatttatctagctcattttgtacctgagtttgttttagttcttttagctctattgttatagcataagaagagcagccctcaggattctatttacaatagaaagtattaaagaacagtgcattgtttcagcattttagattaactggcagtacctctttattctccacggctcctgatctttcatttagcaaaactatatgatatatttggttcggaaagcttcagaaatataacaattgttaagactgataagttggttcaacccggcaaatatttaacacaatgggtgctatgagaatctgagttgctgtccctatataaagttttatattacatcctaatgctctcacctagttctgcaaatactttaacctgcatgtaattggtaatcaaacagaaaacaatccaaggcaaaaaggaggataatctttgtaccatacaattttccagatcacaagttctacctatgaaaccaagaatattcagaaacaccatcgtatatcatactcctacatgaatgcagcttctgtttcgaacattacaagctccgctgaaattggctgttgttctgagtccagatgactgtgaaaagacacagaggattcaatacaaagagcaaagagcattttcatgaacaaccgtcaaccctctccaacgagctcctcatgcacatacaaattcaagacctcagcgtcgatggaagtaggcggcggcacctcgatcgcactgtggctccgtttgagaagaagattgcgtcggctcgcgtcagcggccgttgccgaggccgcgagaggagggcgatgcggttgcatgagggatctgtacttatggatacagctgcatgtattctctcagccaagtcaaactcagtatgtatgagagatgcgtgccaggctaggaggacatgagcaaccaaacacactctttctgattctcttgcgataacaacaacgatcgaacgaacgatagcgtgtgttcttgtgcacgccaaatcacacaacgtgttcccgaatcggccatggagaggatggacgaaacaatcggtgagtacggaattgtcttcaaattttataattggtaactgatatatcgtagtttagttacaatgtaattacatttcgattatactatagttatagttacaatgccctttttttagatattttatttttaggttcactaataaattaggtcaatggattgattgacttaggttgtatgaaacagataaagtggtttacaattatttgatatgtcatcagataattcaattgagatatcagaaattttttgaattggtttgttcgtttccttttgcagaaaatctgctaaagataaagataaagataaatattaattgtttcacgtaaaatgaggtagtaataacgtgtgattaattgagttttaattattacaaacttgaaaaatggattaatatgatattttagaacaactttcacatataaagttttcgcacaaatatcccgtttagcaatttgaaaagcatagccaccagtatatatttttgttggagaaaagaacatggtatatacttttgtcggctatgcattgcattgcattctgatttctgacatggagatgataattgcctggcttataaactgtcataactgatatgcacttcattagatcaaattctgtaagtatagttgatatgtcttttcatgcacactccaattgaacaaactgaattccctaatccacgagatgctaacaagtaaccacatatatatatgagacgtaagaaaaagtaaagaaaaactacgagatcccaacgttgtcagttgtcacgtcaggctcacgagaagctccggcttttattttctgacccttatgaaaactaaagcaaagccgtgaccgccggcatggagtccgccgtcgccggcaacgacggcgccgcgatctgggttcgaggcggccgcgtctcgtgctccaacaaggccgatgctgagagtagaggcccatctaatacattggcccacccagaaggcttcggcccaacatgccacggagcagagagcaagaacagcttcgtctcttcggtttagtaccacctcgcggattctgaggggagggaaggaggaggagcgggtataagaggagggcctgggtaacaatgcaactcatacctttctcggccttttggctaagatcaagtgtagtatctgttcttatcagtttaatatctgatatgtgggccatgtgcccacttcgatattaaatttattttttgtgggggagggcctatcacagtggcttgccactggggccctcgcgcgtcgcccaggcgttgcactgctgcccgggcctggcgcaccccaaccaaagcatcaattaaatttttaccatacaatccgaagctgcagtttcagtgaaagccttttgaagtatattgatccatataaaaaacatattttcaacatctgaatttccaatgctgtatgatgagcaaatacattaggagttagattatatttgttgttcagatcggttaactcacatgagattcatctctcgagattatattttttatatgatgctcaactttcttccaaaagattgagagttgagactccatgattattaactgaaattctagctaaacagaatgttggtattatcattcacagtgtaggtccagctatgtacactcgatgctttccatatcataaatcaccaggcaaatgaggaatagggatcccaaagaaatctgaggaagaagatgcatgtaaactgtaaaggagctggagctggaagagcaggaggagatggcacttcatcctgcactgagcatcaggatgagttgatctcgtcaagttgtcagcaacctagctctctcccctcctctctagttactccggctttgtttcgttttgcagcaacttttaggaagatcagttgtcattgagatactttgttgactatgcaagtaatgcatgcagtgtattctgatttctggtaacttgactgctagacttacataataactagagaaaatagtttgatgcacactaattaactagagaaaaactactgggcaattgaacgtcccaaaccatgagatccttaccacgtatgtgacctaaattaaagtaaacaaagctaccatcaaatatattgtcaggatcatgacaaactccagctatcagtctaccaccaatatcgtcaagctttcccagcattcagtttccactcttcagtaaaagcaagcaatgatcagtgttcatttaccagtctccaaagcaaggtaggcagcatttagcatgtcattacaagaaaaaccatggtgctactgactaaaagttacagaactaaagatggcaacaatgttttaagtgggatggtcaatggagatcatcatggcattgcagccaacacatatgaccgatcacaacgttttaccaccaccaccaccaccacttgacatgagtgaggcggcagcagcgcctgcagtcgggacgattccagtcgaattgcctggtttagagagatgcagaagcctgcagtgtgttttgcagtcaaaagtgagaaaattcgtttatgccagtctagtaataatcttgagatagctaaggaacacttagttacttacggtgctagatattcacagaacgaagtgacggctgaaacgacatcgttgtaattgtcagcagcagcaggggccgtgatttccactagctgtattgcaggagtgattggcacagcttcgttggtagcatggagttttgtcatcttgctaacagaggtaacggtcacagttatctgggcacctcggtggaaacgaaatgcaaatcctcccttcagaacttcatgatctaacttgtaccctataccgtagaagtaacgcaatacattgttgctggctttgctctctacaattgaccgcacaaggactgagatttgctctgcaccagcacctctcatggcacctccaacatgtcttatggtcctacatgaatactactggattcagaatatcatcaaatatcacaaaaatgtaaattttagcagctgaaagaaaagttaccaggatggcgtggactgagctaagtcacacaataaacgaacctctgatgggacaactcctgtatgattggaagatgtatatgagtaacaatggcatatgatcagaataatgaaaaagttgcaaactgacctagatttggcccacttttaagacagagctcatgcactctgacacgttcttttgggacaccagagaggccctggagaagaacctcaagagcatcaacatgctgcataacaagaagatcaaccaaaagttacactgatgtcaaagcaatgaaaactaaaaaaggttaaatggtgttctaagcacaagacattgacatgtgtatataaattaatccctttattgtaaaattacaaaccatataagtgatatgattcctccaattgtatataaaatagaaccatatcaacatattgaaaagagaatcaaaaaaagtctgcaagtggcagaagtagtgccctcagagtggagaaacatggttgaccatatagtggtcagcatgatcaactgtatactttttttttattatcctgaagggaagtgttgatatgctgacaagaggaagctataagagactaacaaaaggtcatatagagacaatggatcgacgacaaagtcttaatgctggcatgaattattattctctattccctgatgtgtttcgttcaagaaaaaagaaattctctatggacataaagttccaatactacttcatgctatatggagtgaaaaaataactttgttcctaagtaggactattgagatgtaatttgacattggggctatgcagttgatagatttgctacctgggatagcttaagtgttacctttcaaaaggttttatcacaattacatttacagaggtctgttttcaggcaattgacacctccaacaacaaaaatgctatcttaaatcaagtgatagaaagttcatttagtaaacgtcgaaattctacattccaactcctttggataaggttactacaaagcgaaaggccaaataaccttatgccaaaaattaaataaaattcagaattctagatacaacatacaagtaaggagcgcaaatgtcagatcagcaaacttgactagtaccgatttcccagaaaggcctaccatcatacaaaaatcaagaatccatgaagaacatcacatctaccatcactccggcttatgttacgggccatgtatgattttccgggtaaaagttcaaattggtcatgttttacagcataaacagacaaatcagtttcatatgaacaaaaatgcatcgttgcatagctacagatcactcattctcggaagaaactaccgttcacttcaacaaccgctcacacagtcaccactcatacaagtctactggcgaagtgagaaagaagaacaataacctgggtctcgatgatcccctgcaccacgcactccatcaaccccaccgcttctcgctaccacaatccctgcaagagagacaaaccctgaaaccacgctgcggaatttcgtcgaacagctacctcgcagcaacaaaaattcacccccacctttaacctaacagcaataatccgcggcgcggcgggggctgaggcgtcgggaagtgagccgatccgaggcgcaagagctccccccacctcgcaaaccccgcgtccccgaacactcccctctccgccactgaccgctcgccgtcctccgccgcctcctcctcctgcagcgatggagacgagaagaaagaattccgagaaaccgaggggggtaaagtgataaaatgcctcacccccgcgcgaagggtcgcggcgtttttgcatctaggcccctggaagaatctgaaatttcagtcatacccttcctctgacttctcctcttcctcttcctcccccacgcgctcgtctcgtcttcctctcgaattcccattttcttccacctcctcctcgtctcgaggtctcagatccaatggccgcgacggcgacggcgacgaccaccgcgtagagcgcgtgagagtctgcgtggacggctaactatggcctcgccggcgggggcaatcggcggcgcgtcgccgtcggggcgggtgctgggccctgcgctggaccggatcatcaagaacgcggcgtggcggaagcactcgggcctcgtggcggccgccaaggcggcgctcgacctgctctcctcgtcggcgtacgcgtcggcgtcggcgccgtcgccgccgtcgctgctgctcgggttgccggcggccgccgcggacgcgtgcatccacgcgctcctcctcgcgctcgagtcggcgtcccccaaggtcgccgacccggcgctcgactgcgtcgccaagttgctctaccaccgcctcctcgtcggtgatctcggcggtggcggcggcgacgacgactccccgtcctccaagctgctcgccgccgtgctctcctgcggcgcgctcgccgacgacgccatggagctctccaccctccgcgtcctcgtggccgccgcgcggtgcccctccgtcgccatccgcggggaagggctcggccagatgctcaagacctgctacaacatatacctcagtagcagcagcggcgccaaccagctctgcgctaagctggcgctggcgcaggtgctggtgatcgtgttcgcgcgcgtggaggtggactccatggatgtgcgcgtgcgcacggtgtcgatcaccgacatgatggacatgtctgaccgcaacctgaatgactccagcattgtccatgcggcgcagagcttcataaacgagacgatggagggaagcgatgtccctgagccggggtccccggttgagccggccgagacggatgggaaggaggatgttgtcatgagcaagatcagggaggatgggttgacactgttcaagaacctgtgcaagctgtccatgaagttctcgacgccggataatcccgaagatcaggtcctgctgcgcgggaaggtgttgtctcttgagttgctcaagatggttatcgacaatgctggggcattctggagaacgaatgaaaagtatgatatgatactcattattgtcttacttctgtgcattttaacagctcaacttgctgtgttgcctatctatataaatattgttgttgcagtgatttagaagaatgcagatggcttaaatgactaagggaaggaaggcataaaatgttcagtatagtaattgatatggaggcttcatgtttgcctagtagtaactcagaaattatggatacacatttttctgatactaatacattattttcacaatccaggcacgctttactattatctgcttggatgtgtcaacattttggctatatttttttaatgtattatgatggatgaaaatttttctagggaaaaaagtgcagagtttaatctatggtggtagatacatgtttacgtgacctactattctgtatttgaattgccattggttcttttaaaatgtttcaaatgatgtcctgatgataatctgcatttgtatgttgttctcttaatttgtttaagtctcttcactaactaaaaaaagaaaataattaatgagctaacaatacactggaaagggaataaaaacatgaagtgttgatttatgagctccagatgtaacatgatggccaggagagggcacaagcatcacgatattttatttataacattaggagtgactgaactttattccgttctttttttccttcaaaatatgctcatccatctaatttgctatgctgaaaaatatgattattgttcacnnnnnnnnnnnnnnnnnnnnnnnnnnnnnnnnnnnnnnnnnnnnnnnnnnnnnnnnnnnnnnnnnnnnnnnn

SEQ ID NO: 2841 - DNA, 529 bp, Oryza sativa
tttttcatcataacaaaacacattcagggcaagctaacaaatatccaacatgatatctattgggacacagaatgatattaaatacaactagcaactaggccaagccaactactcaaatacagtaactattggaacaccaaaactatgttatatagtgttatagaccagagctagtaaaggctttgaaaggtggttggtcccaagtaacttctattagatgaaaaaaatgcaagttacagatcccttcaacagatgaatgatgccactatattggaatgatgaatatacaaaagcaataccttcatggatcccaaaaatactgccatcccctccggaaagttatgcaagctgattcctgcaggctcataataagtatcaaatcagattgttgtagtatctcaaggaacaaggaagcaaagccacacaacatatatcaagaaacagtttgaataatggcctggtgtaagttcaataggaatgcatgtctggttgtatgcttagtgatacagaagtcttattttcttaccaa

SEQ ID NO: 2842 - DNA, 14743 bp, Oryza sativa
cttgcctgcatcagctgttggcacaacagttggctctggaataaacttgacaaccaaaccaaagaaaagaactccagcaaaaaactgcaaaatattattattagttaacaatggttgctgcttattgtatgagatagatcggcattacattggcatggatactataagtataggcaaagcatgactgacccaaaggttgcccttcaagaaaccaatagaattcaatgcattgtgtgccaaatctagaaaggaaatgctcaacataagtccagcggcaaaaccctgtattcagtaacagcaagagatcaatctaccaagaaccaatagcaaaaccagaacttgcttaaaagatagtgaagttgctccattactatagagaacaaagcttatcacctgtagaagcccaagcatcttaagattaggcgtcggattcaaaatcacaaacagcgcacctgaaaaacagaaaattggagcttctaaagtgggaaaatggcacaaagaagccttgctggaaaccctccacatagtattagggacagttttaaaagagagtactcatcgctcaatgtcctgagatcattcacggtcgcaaattgttaaccaaacataaggaagtacaatgttgaaccctaggggttaaaagtttttgaccatgcaacgacatttattacttatcctgttatacatagtacacataagagaaaaccacaccctgccactaaacctgtccagttatgccacttatttacaaattacaacaccccattgctgaccttaaaacaaaaaaatctgatgaatcattgtgatcaattaattttcatattcagaggcctaaatagcaaaacattcatcactcacaagccaaaatggtacaaaagggagatactcactggattctgaactctctttcttaacaaaaatcctaaacactaattttcgatttgctaataaaggatgcatctgaattcgcatggaagtcacctatacgagcggtagcaagacagaattcgctatcgacacctgaaactcaccagaaacacagaaattcccaggaacgcgagattgcgagatgctcagccacttggcgattccttcaagcagcgagcccgcaagctacacaaaacggccttaaatccacccgcggaaccctaggaaaccgcgcccgaccgcaggcagagcagcatccaaacccccgaaacgaaactgttgagaggggaagaggcgcgagggggcggggccataccgatggacgtgctgaggccgccgacgagcgagagggcgagcgccaccagcacctgcgactccattggcggcgagagagagctagggcttgcagggtatcgaggcggggggaggcggggaggagaggagaggagagggagatgggggaagggaagcttttgctgcggcggcgtctcacggcgtgcgtacgtcagcagtttgatgagagagagagtacggcgtcttttgctaatcacatgcttatgtgctttgggtttgggttagtcaatagataggggaattttgtcttggtaattttttttttcttctgttcttttttttgttgtctttgtcagggcatattggcaacttgtgttcttggaattttgtattttttaaaaaaatatatatatcgcgaatttgatatcgtggatcgtgcagattcgacggtcgagatctaactggatgagcagatatagcaggtcgaatttagatttggttgagatgaagttaagccaccaaaaacaaaagaaaaagtcattaccatgtgattgattagttgagttttaatattctaaatcaacttctatatgttacgtccgtcccataatataagcgattctggaggaatatattttctagtattacgaatctgaaccgtctcttagtctagattcgtagtattatgaagtgtcacatctctttatgattttagtaatgtgacgcggataacatgatgtagattttttaaggagaaacaatgtactatactccattcgaactggtaatacttatcattttgaagcagagtaaagtcaaaccttcaaatctttgactataaataatttataaaatatttatcttagaaatatgaaaactatatgtatatattagttttaaaaatgtacttcaataaaattatatatttgtgatatttctatatatattataatagaaaatagtggtcaaatatgtttcttagactatatttttaaaacgacaaatattatcaactcggagggagtagtaatatcaatattatttatcagtttcataaaagctaactgaaacaatgtagttgggctaatacaatagccagccacatgaatcatgccatccacccacctactcctgcgtccattctataagcttgagcggcagatggttctccatgccacaaaacgacttgtgttaaagatgtttaccgttttcgataaatctataacgatctgaatgtattttaaacaaaaaaaacaattaaaaaggaacaaatcaattcatatgctatatttaaattgccataaaataacggttacaagcttacaagtgtggatttgagcaggtacaacgtcagaaacaaattaagcaacatgatatatatatatatatatatatatatatatatatatatatatatatatatatatatatatatatatatatatatatatatatatatattaaccacaattcacaaacacgtagatttaaaatataaaccaaaaacaatcaaattagccaacgaattagatcatatatttttaaaaaaaaacacaaataaaccagccgcgccgccttctcccacgtgagacaccctctctctcactctctctctcctcgtcatcaatgcaggcagtaggcgaggaaggagagcacgacggcggcggcggcggcgggcgcggccgcgacggcggtggcgccgctggcggacccggggcccggcgcggacgccggggactcggaggcctcgaccgcggaggcggacgccgccacggcgagcagcacggcgcaggcgatcttcttcatctccatcccgggcggcggcggcgaagtgctgggctctgcggggtgggggaggagacgggtgatgttgtcgatcgacggcttctcgggctgcaggcgcgcggtggtggcgttgagctgcgaggcgaggcgaggcgcgcgggggattttaatggcggggcgagcggccatgagcgaagctcggggtggagcttggccaaaaatgggggtggtgattagtgggtttgccaagataggggtggtggtgattagtggaggtgattgctcgatgaagttctaatctaatggcgtttgccaaatttcaatcgaattttgctgtttaaaccctaaaattttcaaataccattcgaacccccccccccccccttctcaaaaatatgatttctagcctatctcgaaatcacagaaaatttcgcaaaaaccaaccagtttttatcaagattgttcatgcgaattttattcgagcttcccaaaccattcagttttatgaatagttccgtttgaaatttcatcagaatttagtgaaaatagtgctgtgcctcacaattcaaccccaaaacgagattgcaaacccgcctctcgtccctgttgatgatgcattcttgtttatatcgtttacaggcgtaaaaactcaagacagctactggattaacttatacagaaactagatcacaagttcacatccaggaaacatttaagattttgattatacacatatgcagtgatgctaaagatcggccccagtttcagcaaaagagcaggaagttcagattccagcctgaacttgcaccacaacagaagcagccaatctcacatagatactagggatcagaatatcagacaatctgatctgtcaaagataggcctggttaacaaactcgatgaaacagaattgcacaagccacaagggaggctgcaaggcgaatcatttgcggttcttggaacgctttttctcgagcctctgacgagcttgctcaaactcctcttccgtgggctccgagctgctgctcccctttgggtcacatttggacatgatggatgagagcaccgagtcgaaccggtccttccgctgcgccctgcgctgtgagatcgcgaggatcagatcgttctcctcgctcttcttcttgttcttcctgtgacgaggtttgaggcaaatgcagtagtgagcaactgatggtagacaacatctcggaaggcggattacttgggagataagagaatgagagcttacttcactcttctctctaatgggtttgtgggaggttcaatctcggagatcttcttggcccatttatcatatgcttttgttgacttcagctcacctacaaaagggaaggaaatggaaaggagtttaaccattagagaagtttcagggaatagattgagttagcatgataagctaaacactttgccagcgcttcattgtagaaaaggaatagaaaaaggtattcaatattatatgataaaattatatggcaacagcatataatcatttaccttcagcaattgcctcatcaattatatctttaaagcgatgggaatcaagctttggatctgagcaaatcattgaacaaaaaagcctgcatacaagggcaccaaattaaaatagaaatggaacccaattattcacttgcaattcattgccttctgtatagaaaattaatcaacactaaattttgtaagccacctgttcatgttgcctttaaattttgtatatagatccttcaagtcctttttttcagaatctgaccctctgtacttagcttcaaattcttcaatatcagcctcagtaacctgcagaagtgtaggtcatcaccgatcattgtataggtgaacagatagcacaagtttttttgttgatatggaccaaaaagatacctttttgtaaacagctctgaagtactcttgaagattgtctgcagcttctccaaccagtgcctacaggaaaagacaaaacttcagaaaatctactgggagtgaaaggttggaaatcacactacttggaatcaggtgctcacatcatcatcagcaattccagtctcatcatataatgcccttttctcctcatccccaagaatagatatcaccttctgaagctgctgaaatttctccttggcttcctgacatcacataacagctcaattgagacaaatggcacttaatccatggaaaaaatttggaaacaagatcctacctcatctccaggattcttgtctggatgaagacgtaaggccaacttgtgataagccttctttatttcctgctgtgaagctgtcctctcaacccctaagatcttcagaatgaagaaaggaaacatcaaatgagttacttgtgttataaagaaagacaaaactgaagcataacaattgtttctgattgcatatgtactttaggttcctttctacagcttcgcttaaaaataaataatttaggccgattccactgagctagctgcacctgcaccacagacaactgctgcaggaagccagcaatgccctttgctaggggtcactgctagggaggtagcagcacaataagtctcattggttgcccatattctctaataagccatataaaaattaatttataggtaaaacttttatatatttgttcatagcaacttaaaatccaacactaaaagaaactacattgaaaatatcttaaaatcaagttcgaaaattcaaattttggcttttgctttggcttattaggccaaccgatggggctcttaagttgcaggcttgcagctagctcagcctataggagccactgtttctggttgcaatcttatgatttgtggcctttttaaagtcaattacatgaatttccatgaactctttcagctcttctttggcacttcattaagcttaggtttcagcaacatttccttcagtctagaatttttttaaaacgcgctaaacagtctagtagtgtgcgccaattaattacaatttttcagcacagatcaagacaaaaaaaaaatactgatgtctgaacagctgggacatatataaggtttattgaattaagttatgcaagtaaggtaatgctattgtacttgcttttaaaactaatagtggtatagcttgagatcaaccgccaatcacaacctcttgtacctcttggctcttgcacactttacccagtcattggtgttttctgattgatcagatgatatgagaaaccctttttatttgacaatataaatttttaacgagacaagctagcaaggattgaactatgtcctcaatgtatgtgcatagtagagagttagaggccctatcacacccagccacgtaactgtttgattgtttgacatttactccagattccagaacatgataaaaattagatttaaacatcagttgaccttcataaattctgtggcagtaatacttaagaggaacaggtatagctcaaggcaagaatgccataccatcaaagagcaattggcaggaaggccagcaagatttaaagaagattaagtcactataaaatccttggagaggtactactactgcgaagcccaaaactagagctgaaagttaaggccaaaccaataagcactctcccatatcagtcataaggcttcacaagtgaaatgtgagccttcaagcaactgcctccatgtttgggatacaaatgtttttcctattgcataagtacgcacttcgtactttgggttcatcagtagcataatcttgcccaattgtttttgcacattgaaatggtacacacagttgcttcaattcgaggtaatctggtatgcaaatatgggttatacttgtacactagtactaacacacgatcaatccgcgcagcgaaccacgaaattccccaacgggcggaacctgacgcgacaccggataaacaagaaaacgaaagctatcccgctatcgcatcgaacaatcagatgcgctcctcaccctcgaatcccggaaaaaaaagaaaaagaacaaaaaaacatcgatccaggcatccagcacacgattcgatcagaccaacaccaccccgccgcaaaatcaaccgctacccgtacgggtaacacctcgtaagccatagacctagggtttggagttggggatttacctcgtagaggctcttgctctctgcggcgaccggcgcgggctcctcctcctcctcgccgtcgccgtcgcgggaaaccctagccctcctcttgcggcccatctggtggaagcggcggggtgaagaggactagtagtgtagaggagaaggcggctgcggcggcgagatctttataggtggagatggcgcgggtgcggggaaatttttcccgcgctttttggttcgcgccgggatttggcgttggcggcgtctcgtcgaatgaaccacccgccatggggatggagggttcgatggaaaatgcttgtacaccggaggtgagagatcacttcacggtgcagttgtaaagagcgtgtggtttccattttaaaatctcgtgtttaatttttgacatgtttatcaattcattttacaaaaaaaagtttagaggggtatctctcccttcaaatctcgtttttatacaatggatgtgtagtagagaggagagatcagccacacgagcatacataattttgcaaaattcctttagcatgtgtgctgggtagaatcggtacaatttgggtagatagaatttgtctttaaaactagggctcgaataaatgtctaagtttatttagggcacatacatagttaaaagaaatatatgcgatgtggcataagattggctagagatctccaacaccatcatatatgttacaagaaagcttggtacggttcgaccgggtagtatatcaaatgttacatactaaaccgagttttgtcctaaagaaaatgataattataacggatgagtaatgagttagagctcctccacagtagacgaagatgggaaataacatgaggaatttggttaagacagtactccctccatcccataatataagggattttgatattttgtgtgcactgttcaaccactcgtcttatttaaaaaaaattgtgcaaatataaaaacgaaaagttatacttaaaatactttggataataaagtaagtcacaaataaaataaataataattctaaatttttttaaataagacgaatggtcaaacagtacaggcaaaaagttaaaatccttatattagggacggagggagtacaatgttgtaggaatcttctttttctctacgtattaaagcttgttagttaggttttatcaacaactcaaacaataccttataaatagtttacttatgaaatttagacctaagagatcaatatcatctgctcaattgagatcccctgcagagcatgtgcggtacttcaggctgacatgtgggcccgagggctgtgggcccacatgtcagcctgcagtactgcagacgacttgtgtccatcatctgctctatactctatgctatttaaacaaaatatgtagagctaggtaacaattatctgcgcactggggcggaaaacaaacatggagcaactagggttgaaaccctatacctagctccgtaatccttattatatttttaaaaaaatgctatataatttgtgaaaaaaatagctcttatttgtttaggctgaaatcgctccgtaattcttattatattttttaaaaaaatgctatattattcgtgaaaaaatagctcttcattagtttagccctatgcgtgaaaattttcgagctctgataccgtttacacattcttctttgcaaaatagaatggaataaatggtgcatatttcaggttctatatatgcaaggatcataaaatttatcagatactctcatacatgtaattgtccatttgctgcttctcacaggagtatgctgaaatgactcataccaacatatattagttcacccgggtatctaacgttttgatgaatactactctctccgtcccataatataagggattttgagtttttgcttgtagtgtttgaccactcgtcttattcaaataatttatgcaaatataaaaaacgaaaagttatgtgtaaagtattttggataataaagtaagtcacaaaaaagtaaataatgattccaattttttttaataagacgagtggtcaaaccgtataagtaaaaactcaaaatcacttatattatgggacggagggagtacaatacaagatcttacaagcgttggttaagaaaaagacaaggagaaagtacatatgctgacatgtgagtctctttccatgtgtcagtggctcaattacacaacagttaagtcagatgatcccttttcattggagaaaattgacatttagccatcgtcaggatggggtttcgccagaatgccactccggattgtggcttcgttataatgccattttcgaacgacgccacattgctactttgccatttcgaccaaattagctgatttgcaaatgatttccaccgtggtgtgacaaaattgcccctgtgaccatttagttgacttgcgtggaggagatggatccctgccctggcaccggcgcggctggggacggatcgacgcctccctcctcgccgacaacccaaactccaagctcactgtcacctacttctccccgctcgcctccgtctccctcgccccgtcctcccccatcgcttctccccgctcgcctccgtctccctcgccccgtcctcccccatcgccgtcgccacgctcccgcccttcgcgcagccgccgcggaacatcaccacgctcgccttccgcctcgaggtggatggcgcatacgtgggtcccgacgacgccgcgccgctcaagggcgggggcgttggtaccatggaggtccaggtcaggctcgccgccgtcgccgtcttcgatcgcggtggctggcgcacgcgccggaggttgggggcagccttccccacccacgccggcgtcgtccccttccccgtccccgtccccagcttagctggcgtcgtccccgtccacagccacgccatcgagccgtgctgtgtatatgcaacgtgagaggaagaagagagagatgagataggataaagggtattttagtcatctcagcaagaaaaaacactacaaaaatcattaaattgagaagaaatggataaaatggcattacaacatgttgcccctgtttgaggatggcattttaacgaaaccacttttgggagtggcattctggcgaaaccccatcctgacgatggctaaatgtcaattttctcttttcattgagcacctatattactaagtgcatgtatgctatgccaaatgtttatacctagcatacctaattagctggtacgaaatcaacgacttaatccaaacccttatgattgaactaaatcctaaaaatgtattcttacccctatatcaatactaccaatcatccatagttaaaagcaagttggtctgaccatattctttatttttattgttttgtacatgataaggtatatacatgacgcaataaggtagagtgctatgtcacaataggtcgtctcttgcttaccatgagaataggtttatggtcctctagtttttcatctactccacatgtggctctcttcttctttttatttggctccgcttataaattttattgttcttaatacataggtgcgcaactcttttgtgtattaaaaaaaataattttcatgaacacaagagtgtcaagcaggcaaaaattgttttatatctaggacaacctatatgtttcatttataaggcaatatgattttatagggaatggttatgaacatgttgttcttttcatctacaaaagttagcaacaatttatacgattatcatatgaacacgttatctttttattttataccggttcatattatttcacagtattactgcaatagaaaaaaactaaattccagcactataataagaaaggatttaataattaaacacaagtatcacaccaacaataaagagaaggaaaagggacacgctctccctctcctccatcttcttccccagcaagaaagaaaaagcccctactttttataaccccacatctcccagggacccaaccgcaaaaccccacaccctccctccgattcccatccgtccaaccacgatccaacggcccacaaccccaccacgtggcgtaaatacacgtcgaggcgaggggcaaaccggtaatttccccgtcgccatcgggggctttcttttttatcagtgtctctctctccccccacccccaccttcccctgaagagagagagtgagagagagagagagagagagagaggagacgccaccacgcgcaccgagctcgcgattccaatccccgcacgcctcctccgccaccgccgcctcggcctccgccgccgccgcgaccagggttagggtttgccctcttgctccccctgcctgattccacccccccccttgagtttgtgggtgacccgtttgatctgtgggcttctttttcttttttttgtttttttcttggggtcgattcgattcgatcgatcgatccgcgtggtgctggtgttggggaggggggatcggttttgggttggtgcggggatctgatgtggggggtcgttgtttgatttggtatttgatgtggttggttattggttattgggctcgaggggaaagcgtttatgtttgattttttttttcggttgtgtattaggctatgtgatctttcaggttgaaatgattagattcgcgtgagtttcctgatctttttttggggttgatttgttgtagaaccgtgggcgattaatcattactcggggtaaatgtgagtgggtaaaacgtgttacagcagatttacggtgtttgaatttgatttcgtcgaaatggataggcgcgtttggttgataagatgaggaatccacttttgtgatggcgatttcgttgcgcctcatagaaattaggatcttgtttcataaagtgtaagctcgccgcagtgggttataggttattttaaaagtcacaattatatggaaatttcgataggaaaattgtagcaactaggtgcttcttggattatcttaccgcccgatttaattggacactagttgatttatccgtatgttaaattttaaatttgtttcttatacgcatttcggtattgagttttgcattgtttgtttgatgaacagatcacagttgcgatggaacacaaggaggctggctgccagcagcccgagggcccaatcctttgcatcaataactgcggcttctttggcagcgcggcgaccatgaacatgtgctccaagtgccacaaggagatgatcatgaaggaggagcaggccaagcttgctgcctcctccatcgatagcattgtcaatggttgtgacggtgggaaggagcatattgttgctgccagtggtagcacggcggtggcggtggctcaggtcgaggcgaagacgctcgttgtgcagcctaccgatgtcgcgggcaccagcgaggaggttgctgtagtccccaaggtcaaggaagggccgaaccggtgcgctacctgtaggaagagggttgggctgacgggattcaactgccggtgcggtaacatgtactgtgcgttgcaccgctactccgacaagcatgaatgccagttcgactaccggactgcggctagggatgccatcgccaaggccaacccagtggtgaaggctgagaagctcgacaagatctaaggcggctaggggcgtggaatggattgcaacctacaagatttcaacatccacctttgctgctctatcctcacacttcttcttgtcggctgctacatttcttaaattgttcaactttgtgatgcacactgcatcctggcagccgaaagaattcatcctctcagtcaagtcaagtggtttgcgtgttgggtatgttgtgtaatctttattcttggtggttttcggtcagtattgtggtgtctcatttagctagctctgtgatgtactatgtcccatgcttgctacatttcaatcagtaatagttatcagcaatggtccatcatattgccaacatgtccattattcatttttccttaaagattatttatgtatgcacctttatctggtgcgcattcaaattcatgtatgttcaaagaagtttgccggattgtgcttggttggctgggtctactctagattgaaaatcggatctgagaggaaattgtgacaaatgacaagttagttctcaggttattactctatccccaaatggtcattctttaatgctactgagaatagttgggattagatctgcaacatgtaacactgaaagttcagcatgtgaagctgttctgtttcagtaatctgggatgtagttaataatctgccttaaagttcaaacatctattaacttgtgatctgaaccagcatacatattgttgtcacgaagataaccattttgttcgattatttcctggtgcaaggcagctgcagttctgattcgattgataatttcacagattctgacatctgctaccaaattctgccccccttatattatccaattgaaatccttaggtggataatttcacagatgcttacattttgttatatcacttgattggcatgactatggattggcatgactatggattgcagaataaaccaagttgtgccaaaaaattctttgcagaggatgacttcttttcccccttgatttgtgccattgtggttgggtgggtttctttaggcatgatgggtacattgatcaactcctttgccgggtgttaagccgaaatgcattaaacaatgcaggcactaatggtgagctctgatcagctgagattcctcagtagtttattgaattggatagaatctccagtttgtcgtcctctcagtcgctggagatgtattttatgagacttaaactgctgttacctgctctgatcttatattgttatactaatgccattatagtgtatatcacgcaatcctgataagaacagatgatttttttccctcttgtgtttaccggacaaaagccagaacaatggagataaatgatacttcctctgttttatattataaatttatcctaagttaaaccttttcaagtttgatcaaatttataaaaaaaatatagcaatattttcaacacaaaattaaaaatatactataaaaacatattcaataataaatttagtggaactaatttagtgttgtaattttttctataaactcggttaaacttagaaatgtttgagttaggacaaatctaaaatgacttagaatatgaaacagaggaagtagcatctactgcatcatatatgttgcagaatggctgtatttcaggctttcagcagcattttcaattaccaagatacgaaaatgccacagaaaaaaaactcataattgcacaacattgcactgaactcagtaaaaattatcctacaatttcagaagaaacaaaacgtttcctctttggtgcatattctaaattacagtatagtaaggacaaccattattctgaattcttgattctttctactaatgagtaacctctttcaaggttcaagccccaaggttgaagtaaaccgtgtagaattcgtctctcaggctgtacaatggttcaagcaggaagttcctcttcaccccctttgcaatgaagctgataggatggcgtgcctcaatggagcagcctgcacaaagctcgcggccgctcgaaaatcccgttaaccatcgggaaatctgcgactgacctgatctttgtacccacggagtaatccacgcctatcaccaggaagcat

SEQ ID NO: 2843 - DNA, 339 bp, Oryza sativa
ctcacagcggagttctactgaaccactttggattatctgaagctcggtatgtttatctgtattggttaaacaatctaatgccatgtctaatttaatcttgaacttatgatagagtagcaaatctaactttagaacgagtacttaagaaaacttctctaactgcgcaggtattacactgttcttttcggagtttcaaggagcattggaataggatctcaggtatctctcactttccactttctacctcatttctttggatcttctctgcattttgtactacaatgcagaggatccttcttcattctatcaaccaattctttcacattatctgtgtggcag

SEQ ID NO: 2844 - DNA, 8947 bp, Oryza sativa
gagctgattggctttagttgttgattaacagtaagcccagctgctttccagttataagcacttggtatgtactgaatgatgtttagcaccggtctatctcctttctcctcgaagtaaatggaatcgccaagtttcgaaaggattctatccctgtaaatgaaatagaagatccataaagaaacaggccacctgataaattgcctttcaattcaaattttcacaacttcgaatgaaaacacaagcaaagtaatactaaaatcacggtattaatttgacaaactgttaccgcaatattttcatgtaaaagcagcagtgttaaataagcagaactcagaagcattttatttacctgtcccataacaacaccagaaggagtcatactttgttccccaaccatgataggaaaccgctttagaccgtccaggggcctgaggtagcatgtaaatcatcaccccgggatcagtccctctttggatgcttaaaacaccatttatcagtgccctttcataatagtctgcatatgataattcctttgtccatctgaataggttgcgagaaacctgcagtagattgcattgaacccattgagagagagagagagagagagattgaatgttcaggagagtggtttgatattgtgaaccttgagcatgttgtaggttgtgcaagattcctcattctcagtactcagagtatcagctaaacgctttggattggtcctgaataattatatagaagtagatagtcatacatcaaagagaaatatactattgactatgaattcagaatctagagtaaaattaccaaaattcaccagcagatgtgcccccagtagcatagctatgagaagaattgatggtatccatgaaaaacgttgcaatttgctgtttcatgagaattatgattacaatcagcttttctctcaaatgatgttagtgaaaagaattagaaagaaaaacagatagtataactccagtaaaaaacagcataaaaaaactccagtaaaaaaccaacacatggctttgacatacagctgacaaaaaaagggactgcatatggataactacagagctaataggtaatgaaaggtataatactgcccaaaaactatagtttacctagagaaagcatgggttagcaagaaatatactattttccccggattatgctatcacacttccaggcccatatctggaaatttaccaatatcagcaggaaatatgcataatctgtaagcagaataaagctatccttttcctttcagccaagcagccaatatgaccactaaaaaaaagtaaccaatatgataatctaaactattagcattgtacattcatatccatatccctggacagataattcatcttcatgtatgcatatggagtaaatatccagaaagaaaggtttgtgttcttttaccttgtaaagaagatcaccagtaacttcatatctcatctgtgcaccaataacaactggaatgtgtgtattggaatggaagcctgaaatactgtcggcctgaattgaagcacactcaagatttatcagtcagagacattactgcaataggaatactactattcttgtatcctctggaatcagacacccaagccaaaagttctaaacttcattttaggtagtgtctttgctatagtgggaaaaatataatgacaaaatgaacagtagaattgaaataatagatccatttggcacgcaaacatgtagttatattgattttcaaactgccaagtgccaactcaaaactggatattaggtaatccataatttttgacagttagtaaaacaggtaaattgctatatgacaaacaaggttgaagttgaatgtaagttggtctgagtcattcaccataaattgacacatgttcatagatgatacagaatataagaacaaaagcaggtaagaaaataaatcagcagacctgaactgcaagcaacccaagaaaacatggcttatcaaaaagatgggccagagtcagatgcttctgatcattctgcacatgcaagaaaactagaaaagttagcaactccactagagaaaattgcattaatcaaggcagtattcctatctcataacaaaccgacaatcaccgttatcgtgtagagctgatagagcacatcattcatcccaccactctcctcattgagtgaagcccaatgcctctcaatactgtatttctgtatgacattcttcacacggtcactgaagtaattggccatcccgaccaccaaatcaagggccttagaattcccggccaccgtatactgatcaagaagaccttgcataatctgcaaaccaagaattgcactcatgtagcaagacaatgatataatatagtgatcaagcaacactaggaactgaaattcccccatataccttgtgaattgtatagtaaggagcccaaacagccttgatggactcaaccctgtcgaagaactccgaggggaagggccgacaagtaccccgatcccatcttcttctggcaatcatggagcgcgtcgacgaccgatgacatcttcgccaggagagtgtcattgtgtgtgctcgcccacatcttggcagtagcactcaggtagtgtcctgcaaagaacacagcaaagcaaagccaccgcaaattcagaccaattgcgcgatttcgctgtgcaagtgatgccgagaaatggcggtggcgcaccgacgaagtgtccccggagctcgacgccggggccctcccacccgccgtagggcgccccggacgccggaaggccggcctgcgtgcggaagctccacacgaggcggtcgacgtcgaggaggagcaggtactccaggttggtctgctgggcctgccagtacacggtgcccggctgcagccgcacgtcgtgcagcgacgcctccgccaggagcgcgccgccgctcgcggcgatggcgccggcgccggagccggagccccggaggttgcggtagagcatgagccagtcgaacgcgtcgcgccgcggggaagagacggggctcgcgaggagcctccgcggcatgagagacatccaggtggactcgtcggtgggggtgaggtggcggtccccatcgtggtcgtcgccgtggccgtggccgtgggggaggaggagatcgatcacccgcgccgcctcgacctcgccgtccggcgtgctccgccgccgcggccgcacgctccgtgtgcgacgccgtcagccccgggaacccgttcgtgcagtccttccccgcgacgccatcgacggcggcggccaagaacaccaccaccaccaccacgaccccaaccgccgccgccgccattcccgccaagaaccactccctcctcactaatcaagactcaagaacaccaccacactaccagacgcatcaaatcaatggaatcctccaagaattccacctccatttatgcccccaatgattgggcgatctcaaccaagaattgcacggaaagcaagccgcaacaactgaatttcaagaacacgaagccctccttatcccctcggacagatcactccctccgagtccgatgactagtcaccactaaccactgagccagtgattcttggggagaagaggagtagaaatcggcgcccttttcgtgggcggataagcggaaagggggcaagaaatacgcatcaatcatcgggtaggatgagagcgacggcttgtgggatttcttgcacccaaagagcagcaacgacaaggagcgacatgaaagccaagccaccattgatgcatccatccatccattcgagatccaacaaatccatttccggccatccccgtgacactagcagtgagcgccgcttgcttgcacgccggagctaccgctcgtcgtcggattacgacgccggcattgtccctgtcaaaatcgcagcaacggaagctggccgcggcgaggggcgtgtgcacttcacacaggcatttttctccaaattttttcttcgaacttccaacttttccatcacatcaaaactttcctacacacataaacttccaacttttctattacatcgttccaatttcaacaaaacttccaattttgacgtaaactaaacacaccctcagtcgtcgctgatcattttggttgtgtttcccaacaaacctccgtcccataaaaaatcagcctaatactagatgtgatatattctaatactatgaatctatatattcatctgattcattgtagtgttctagatttctttttttatggagggagtacaatttgtagagtaccattaatttacaatatagatttaaaaatatgtattataaaataatagatttaacaccatttaaggtagttttcatgtttgaaatatatatttcattttataaaattgaagctaaatttatagttttgtgatacacatatttcaatatgtacgtagttttacaataatttgatcaaatgtagttttataaaatttactcattaggagtcattaggaggttgtcacaaataatcccaaatcatgcaaaagccaccgaaaaccttagtttaaggtaatcttttatcatgtatccaagctaatatacataattgctaccagaatgaatattttccatttaatgaaattctcagttttgacttttttaaatccctagtgaaggatcaattatggcttagatatagtgaaattggcgaatttaaaactttaactacttgctaaacaaatgtactctaccatggatataaataaatatataaatatactttttataaaatatgttattcatcatttgctattggaaatattcaacttttgattttatacgtggttgtatgttagaattcaattattttaaatattaaaaagttctaaggatgctttataaaatctactgttagagtaggtggggcagtaaatttactgacactaccattagtttttttaagaaatatatagaaatgaggttcacatccgctactgtaatgacactacaattacatagaaatgtgataagcggaagcaagtctcatgtttggaccaatatagtactttgtaaaaaaacggattcgtcacaagtgagcctacaataacacaagcagcaactagtaataagaagctaaccacaaaattgtagagagaaggggacagggagaaggctagcagccaataagaagcttggcagtggcgagaggcggggagaagggtgcatgtgtcgaggacgatgcgaccacaatgtggtgcaagtggagttgacctcgaagacgatgcggcggaaccgcacgtgcgcctctacggacgagaggcggagctcggggacacctgaacacatcggcttttgagcagctcgacagggggtgactatgagcttgggggataggagcttggacagcgtgatgaggtagaagcctcatcactcacgcgtgcaggtgaagacgacattgcagttgtggttgggacccgcgccgcaccccccctgcgtgcgcaagtccatgatgtgagcgctcccggccgtcgagcttttcctcgccgaccgacacccttctccccacccattggcggatgcccaggaggtttgggttgagatgggaggaggggagtgaagtggaagaagattgccggttaacttgtggggtccacgtgggactcagccaccacatcaacaaaaccgaaaagcaatactaccttgggatcaaaagtgatccgatccggttttacaggattagaggtttcatggccttttaaactcaacaagaagttagggaaccttagatgaacttttttgggagatgaaaaattccagcctcatgggcctgtgcatatgacccataggcaggcgacgacctccgcctccccaatccgtcccggccgtctcctcgcccgccggccgccgccgatctccatcctgccagctgaggtggcgccggcgtcctcctgctcccgccgcattcgctcaccggtgagcatcctaatccatcccatccggcctcggcctcggcctcggatttcgcctcctcgcccgccgcttccgccgcgagcagaggtggcgcccggcgtcctcctgcttccaccgcatcgtcgctcgccggtgagcatccttccctacccacacctcatcagctattctgcgttaagcgttatccctggttcaaccgaaacagggttagatctgcctctgctcagttccacctactttcaacttgttaattttgatttttgtttttagcggatgtaatttggttactgaatatcatccacaaacccttagaatagttgcattagaaagaaaaatgtaagctcatataatttgtacttatccaaactcagtaactcacataaaaatttcttaagaagagtagtcacacacaatatctttttatcaaggtatattcttataagaagttttcaacaagatttgcttgaaaatttgagtctaatttagcaggcagaactaagagagcatggtggcgatggcgcggtggccgtggagggtgctgctgccgctgcttctccttcactcctcccccgtcttcttcgtcttcgctcaaggtactgcgacccccgtcttctctctcttgtggggcggcgcttcctcttcgccccaccacccccaaatggcaaatattggaagtgaatcatccatcatacagataagatgaacgcgagactcgtcatctcattcgaccacctcagtgctctgcatccatctgcgataccattggatcgtttctaacacaagatatttggatctagagccagccttggatcctattaactgctccatcatgggttcatctcatgaaatttaacggaaccactccatcctaaattttctattcagcatattaatttcatggatcagcaatgtcctaagtttcttttcattccaatcagcactacgtctacacaaaatggatgtttcctttatgcttcctggtagactaagtatcctttttcccctcattttttcagaaggccaagataatgatccctctactttgttcaaacgagccttagaaatgatgaacctaaggaaatatgatggatcacttggtctgctaaatgctgtgctggaggttgaaccaaatcactcagaagcttacaggcagcgtgcatctgtgcttcgtcacaagtgcaggtaaaaaaaagttgtatccgttactttagattataatccattcatgtttgattcacatctgttcctcagttcaaagttactgaccagaaaaataattacttgccaccgccagatagctaaactcccattttctcttgtcctaaaaatgtctaaactttattattaaaaaaacatccatatctgaaagactccattaaagaaccgttaagcatatgtgcctacttataacattgtcagttttacacgtatgtgtcacctttccgtatcccttactcgtttcaatgtgttttttctgaagtctaggtacaaggaagcggagggtgactatagcaaatacctggagctaaaacctgggagttcttcagtggaaaaggaattatctcaactgcttcaggctcaaaatgcattagagtctgcttatggccagtttgagtctcatgacttctcaaaagtcctggattacatcaacaaaattgtgcttgttttttctccagactgcttaaaggtatatttcagaggatagtaggaaccatggacagataaatatttcatctaattttgtctcagtaagctgcagtactaaaaatggatttttcaggcgaagcttctcaaggctaaagcattgctagcacttaaagactactcaactgttatctcagaaacaggatttattctgaaggaagatgaagataacctggatgccttgttgcttcgtggccgagcatattactaccttgctgatcatgatgttgcatccaggtaaagcgtgtctggtattttaggtttggacaagtgcatgcttgtttgtgcctgcacacacaaatgcagtactagataaatgtgctagctttaaatatttgtacagtgatgacaatattaattgtttaggcactaccagaaaggccttcgtctagaccctgaacattcagaactgaagaaagcatattttgggttgaaaaatcttgtgaagaagactaagagtgtgagtatgatttctttgtatcaacaaattaggggcttactgcatcatagtaataggatcaaatggtgtgcatgcaggctgaagataatgctgccaagggtaagctacgtgtgtctgctgaggactacaaggcatccctagcaatggatccagatcatacttcttacaatgtacatctttatcttgggctatgtaaggttctggttaaactcggaagaggcaaggaggctataagtagctgtacagaagcactcaacatagatggagaacttgttgatgcattaacacaggtgacattacttgcttggcatgcacagaaatacacatttttctaatttagagtggaaaccaaagttcttattattcaatgttgaaacttccgtgaaaaaaagaagggaatttcagtctgattgccctgcaattaatgttgaatcttggactccttccgcactctgatgccacattattgagcaagctgcgagcatgcagacatgcagtcgcattagcctgtccttctaattctgtattttaaaccacaagacttgggaaatctgcaactgctattcagaaaccacaaaaaatgtaattcagtatgcacaaataatgtgttttgactttatgagtgaataagtgatgcaaaaaaaaatagtaatgtatatttgtttggtaaactaagttatgcaccagacaatgcaattgaattagttgttatagccagatctcgctagtctcttacttcatctgcttgttgtatgttaccttctactggttgcagagaggtgaagctaagcttcttacagaagactgggaaggagcggttcaggatctaaaagaggctgcccagaaatctccccagccaagttttatgtggacct

SEQ ID NO: 2845 - DNA, 13593 bp, Oryza sativa
gcagaaacaattatttgttttttacggtagtcatctgatgatacttttacttccccatgatgtatttctatttggtgcccttctgccagcaatctttgttatccgctttttgcagcgtgggttcgtaggttgcatatgtttctctagcacctatgcatgcagtggatgagttgataaaactagatttgcacattactattgttagtactactaataataaagtgggccaccgaagaggaactttatgccaatgtatttatgaataagcaacaggatctcaggattttaaactagtggaaaaggtgagggcggtcagaatttcgaacatgggtgagccccgcttgacggctgccccttacagcacagttctcaaataatattgatagttacataaattgcttctcagctatattacaaataggaagttaacttgttgcttccctgtttctttaacctcaggaattgaatccaaaggtcatgtgcttttaatggaatgctttattagatttatctatcaaacagacttggtctctgccctttttctgtatttttttggtacaaatgtaacagtggtttgcactgttcatgctcaggacatgggaatccgagaagcactaatgagagctgaaaagcagcttaagttaagcaaaagaaaagattggtataagatccttggcatttcaaagacggcatcagctgcagagattaagcgtgcctacaagaagttggcactgcagtggcatccagataaaaatgtagataagcgagaagaagcagaaaacatgtttcgagaaattgctgcagcttatgaggtataaataaacaaaattgaactgtactaagtatttaatgttctatgagatgacattttctattaatatggttaatttaaaatactctcatgcattccaagtttctagccctggtgttgtactatgaataagaactagctgaagtgcatttcatccacaaaatatatcatgctagacactgcatgtgtccgagacaaaaagtgtcccaataacataaattctggtcacccatatttagctataggcatgcttgtttcgaatcagatcgacatgctgcagatgccacgcgtgtcttttaacaatgcgcaatcggcaatttgcaggttcttggggacgaagataaacgtgtaagatacgaccgaggagaggatcttgatgagatgaatatgggaggaggaggaggtggtggtttcaatccttttgggggaggtggccagcaatacacattccattacgatggtggattccatggaggaggaggattccccgggggcggctttcctggaggctttcagttcaactttggatagaaagtttactgcctgtggagttggtgtttgtatgtttgtttgtttgttttaggaacgctgataagcttaacaacaggtattgattgtaggcagtcaagccgatcgatcgagatgagcatcgtatacaagtgttgttttaagcaccatcaaattttcctcaagttgtatccttccttgggattttctgacgcatatgatccaattgaaataaacttagccttacagtggagctagctgtttcactttcactagccaaggatttgcgccgaaaccataaaaaccgaaggtccattccatgtattgtgatcggagtcggcacgtaacagaaaaactaaccaaaaaaaataacttaaatcctctgaagaaacatttgaaccactcgctggatcgtctagccatcagtcaaccatgagcgtgatgtccaacaatctccatgttaactgtaacatctgactatctatatatctacatgttgtactgtaacatgtgactatctatctacaccgatcaatctgatgatcgcttactttctctattttatattgtactagcaaaatacccgtgcttcgctacggtgtattaaaactaaaaatatttgattttaaccgaagttattttcacactgctttggtacttttgctcgctagaaaaagtctcaaatgatagaaagaaatatagttccgaggaaagggagataaaaaaacaaagccggtttgatttccacctttatacggtgcgagtcaacatggactctgaagatatgggtagatctacggggtggctcagcagcacggtcgaccagcgaataagcgagcaaactcagaccaatcgacggccgatcgatgaccgtagcacggtaggtagcagccgcatctggccgtccgcttcccttccgcgacaacaatgaccgtgactctacgctattattatttcaatatttcttatttttaattctagccttcgtcaaatttctacttcacaaaattaaacttcttttcttcggctgagggacctagaacagactttttcccagcctagctggtacttttcttcggccgagggacctagaatagactttttcccggcctgccggtcagcccacggcatattatgcgcacgtgcgggcactccctcctccccaagccgcaacctggacctgggctggggaagctgcccagcacgcgcctctacttgggccggtttcgatccagccagtgccggccgttcgatcttagggtttctatcgaatagccggccgccgacgtcggagggacaaaagcccatccctcccagccgtcggcgaaaacccaagcctctcgccagaactggagcggacggcgaaaagcagcggcgccggtgcatgcctcctcgccggtgcgcacactcgcccaagggtgagggcgccacctttgagcagccctgccccggcgccgtccccgtcgtctctctctcatcttccgcgcggcgtcatcgacggccggaggcggtggacttcccttgcgcgtcggcaacgaccggcggcgggtgggctacccgcgcacgtgggtgacgaccggcggtggcgaaggacttcccgcgtggcgtcggcgacggctggcgttgaggttttccgttcgtcattttttaatttttggagcttttcttcagggatccaagaccccctttttcctacagacaaaaaatcaccggatggatgaaacagattgtgatgaaaggaaaattatgaatattttaattagttaagataagattacagccggtgtttttttttgtttttttccagatttttttttgtgtcgtacgaatcggactttttgagcctgtttttttttccgccgttctcttctttttacggtgcgttttctttttttttttctgcctggtttttttcgctctttataaattacggacgatggaaacattttagattttttaagtagtataagtagaagtagattagcaaatatacccatgcgttgcaacgggttaactaaaatttaaagatttgcattggttttaggagtttgaggggacaaataaagggagctaaagcgaacttattccgtgtggagcgtacacgcggcctatgtggtggcccaatagtgtggtcggcctgggaacaatttggggacaacttgagggatctaaagtgaaattttttcacgcggagcgtacatgcggcccaatagtgtgggcggcctgggagtggcacccgacccgacgtgggagaagcagtagccgtccgatctgatggacggtcctgattgatcccaatctatataaaaactcataagtctaaaccctaatcctaaaatcatttccattctccccctctctctcagccgctactcccctcccctcccgtcccccaccagcgccgccgctccctctccccctcaccggtggcgccgctccatctccccctcttcctcctgtctcgccggcgcggcgacagggaaggcaccctgccggttcccctcggccactccatcccccttcctccacaacgacggggagaggatccaccgctcctgccggttcccctcggtcactctctcccccttcctccacggcgatgggaaggggatccaccgctcctatcggttcctctcggtcaccccctctcccttcctccacgacgacggggatcagcgacggggaggggaaccaccgcctcggccactccctccccccttcctccacctgctccactggcggcgctctccctactggcgtggagccagcggccctccgccccttctcgcctccctctcgcgccagatccagcggtggcggcgtcggtggctccctccgccccctctcgcctccctcccacggcagatctagcggcggtggcaatctgctcgaccacatcgccgtcgtggcactcatcagcacctccgcggtggccatgtccgaggcgcgcctcacgtccacgctcaactcgctggcatcggtggttggcatcgccatcatcgccttcgtgctggccgcggggttttccacttcgacaccagcaacctcgcgtcgcccttcttcccctcggtgctgcgggcgtgttctgtgcggcctaatccgtactcccgtcgccgtcaaggtcgccgaggggaggggaggggaggttgccattgttgtccatgaggtcgaggtcaccgttgtcgccgaggagaaatataggaaaaagtgaagaaagtgctacgaaatagaagaattcgcagtcacgatggtatattgtagaaggcgtgcggattaggtggtaaaacatataaggcatgcgtattggatggtatattatctaaattctccattatatatatatatatatatatatatatatatatatatatatatagtggaatgacaaatggccctacacatatttattttaattctaatgccacataagcgccacatcacagccacgtggaacaaagaccgggtcaatatagccatgtaggcgccacgtcagcggaactgtcttccaaaaccaccgaagaagtcaaattgcactagtttcaacagttgagggtcgagatatccggtattatggtttggggatacgaattagattcagcctccagttaaggaagccaaagtgaacttattccttgggaaaatgaaaaaaaaaagaactcagcccaagttggtttgcagcccggcccaaagcaaaaccaaaccagaccttcctcctttccgtgggccgcaggtgggccccaccttatcccctcgcgcctcgtgcctcgtgccccgctccgctctactcactgaagagcgggccccacctgccccgcctcagagcagcatccggatccggatctggaaacccgcttcccaaatccggcgcccgtacgcccgcccgccactaccgccgcggtgcccaccgcttcgcttctctcccctcctctccaatggcggaacccccaatcacagcccactcctcctcctcctcccgccgcgtccccaccgcaggcgactcccccaccctctgaccccacctcccgcctccccgccgccccgcgaccgccgcggatcgatcgaggggattcttgccacctgggatctctcctcccctcccctcccccgattcttggtctcgcgcgtctgtctgcccccccgtggtggattcttgtctggctcccggcaaaaggaacggcgtctcgccgcgggccgcggattcgaccaggtgcggtgctggaaccggcgccccgtgtgtcccagatgttaattctttttgtttttattgttctatatacagtggttgatttctgaaccgatccgttgttcgcttggttgggggaggacagagagtttgtttgcggagatagttttcgaattgcgtggtgaaatataaaatttagactagtttggcttatcttggcacctccgcacctgcattgcgccgttgagatgtaacgttgttgatgagctcaattggtcgggttgtttttttttccccagatctggatggttaggttcttcacctggctaacaagaaagatgttgcttttagctgccctggaattgttggtactttctgcgggtgcatctatctgatgaaattgagctgcattgttctggggagtgtttgcttctgctcattgcctcatagggcacacaatgacaccaaggagttatagaattaccgtctcctggaaatccttagtttaccatcctgttatgattttgctcaaatttagccatcttatcattggttatgcgtcgtggaattccaagttgtactgtcctattttacttttgtcaaatgtagttatccatcatatgttatgcacaacatatgctcaaagaagcatttttactggctaggttagcttaacacatgctgatcagtatttttcctttacagttcaatgcacctcaaccctcaacttgttgactagcttctgtgctaaactttgtgttgcaggcatctcagtgtccacggctgtaatttataaccaagcctaagaaacttacattattctagcattcattggatatggtatcggtgaatcttgggctagtacattatgtactggaccacatatatggtaccgtccttcatcgcaccaaattaggaacgccatttttctcgaaaggatggggaggcaccaaacttgatttgttagagaagatggtgaaacagttattccctgaagcacgttgccagaactggccaccaactgccgtgcaacccatgtggaaaacggtttgggagacaaagagttcttgtctgcgagagggtgttttcaggactacatgcgatccacggctaattgaagcattgcctcctgagagtcacaatgcaagagttgcttttcttacacctaagtcagtttcacctgagaagatggcctgtgtgattcatctggcaggtacaacagtttaatcctatttatttgttctatactttgatgtaccatgcatctacatgtttttttctatataagagactattttcaagcctttagatattgatgtttgtacactagctgaatgttgtttatttcatcccatcggacagaaataaaagttgactagatttgatgtttcaactttccatattgagtgatctgctttctggttctaaatattatatttcatatcatgccatgttattaactgatgagttgcaaaaatgttctttgtccagctgttgaaatttgatctgggcttctaatacaatgggtcaagttaaacttttatctaatattacaggcactggtgatcactcgtttgagagaagacttcgacttggtggacctcttttgaaggacaacattgcaactatggttcttgagaggtgaggcttgtatagaatgccagaatggttgtcttacgccacctttgataccaaagcttttttcctaacccgcaagatctgatttctcaaatgaattccagcccttattatggacaacggcgaccaagcatgcagcatgggtcaaagcttcagtgtgtgagtgacttgctactattaggaaaagctactattgatgaagctcgcagccttctgtactggttgcagaatgaggctggttatggcaagatgggcatatgcgggctcagcatgggtatgtaattctaaagttttcatctataattgaataatgtgaatgctttaagtcttaagcaacctgcagcatcccatttatcaaactcacccccattttcgtggcaacttcgtttcaagattcctttacaagtattgatgtgatacatttttccctaagactggtaactgagatgatttttctcaaggaaatatcttttatttcacctcaagtactttggccccttctattaatttctctcttgcggaagcgctcctttttctatttatttggattgcttattgacacggaaaaaaatgctatatgatagataatgaggttaactctggcatggctttttttgggaaaaaactttatcttgacagtagttaagtaccatctacatatgaaaattgctgttatttcttacaagcgtctcatgctaattacataggtggtgtacatgctgcaatggttggatccttgcacccaacaccaattgctacgctgccatttcttgctccgcattctgctgtggtgcctttctgtgacgggctctacaggcatgccacagcttgggatgcattgaggaaagatgcagcaacattggcccaagacgtaacttctttgacagaagacatggcccagaaatcaggaatcactattgagcaagtaagagagaggttgcgatcagtgctgtctttgactgacgtcactcgatttccagtgccaaagaacccacaggctgtcatttttgttggtgcaacggttagtgtcaatgttctatcatcatttctcaaacatgatttacccttcctgtgtcttatatatttcagcctagcacgtaaatttcttgataagagtaactcattatcaccttccagtactagtgcattctggtttcctactattactcatatcttatttttgcattcattcaaaatagatttattgcctgcgtcatttgcagcaacacatcatcttagttgctcctttccaataattacccacgcctctctgtagtactgttgtcatctgcttaattctgtactttcagatatcaatatgcttttttcgttatcatataatatttaatggagcttggtctgaagcaaatgttctctttattttcaggatgacggctacatccccaaacattcgataatggagctccaaaaggcatggccaggttcagaggtccggtgggtaaccggagggcacgtatcgtcgtttttcctccacaacgacgcgtttcgcaaggccattgttgatgctcttgatagactataacagcagaggaaactcatctttgtgatggcatttcttggtgtgcttgttgtgaaactcataggcatgccacatgacaagatcacatttttatgagtgggggagcctagaaataccacattctgtctgtaactcaatatatgtgttttcccaaagattgggaagatgcatgagtgtaacattgacattcgttacctgttaactaagccccccattgttaatctgtcccaaatttcacctactactaaccttgcaactgaagtaatttgcagttgagacaagaaaggaagaagatgacagtgcggcatacctaaactctctagtctctattctgtgtctgaagtctgaactctgaagcaaagtcagtcaaaccatatgccacaagacaaaaacattacagtgtcatcatcaatctcagcacttattttcatactgactagtaattatcatcagcagctactagtatacagcttagtttctgtttcttatacattatatgcacaattacagcatgctgctaccctcctaatttaaaaatgaaatcatctgatcttgtcaaagaagcaaattaaggcctgatcgattgatcatctctctatgcactgtagtattctgaaacttttgaaactaatctgttcctgtctgtctgtctgtatgtaaaactgcagtggtgtagcagtgtagatgctgggccattggatctccagggccagtggatggatgtggtctaatttctagggttgatggatggcggaggcggaggaggggcgggttggtcggggtggcgcgggcgcgagagccagagggaggtgagggcgcggaggcggtgggagtggtcggcgatggcgaggaagcaccgcgccgactgcctcgccgtcagtatctgcggcagcttgtacagcgtctgcagcctcagcgcgtccgcctggatcatacgcatgtacgtcatcagttcatcagtcagtagagtactcgtgcattatatttaaagttgtataagagcctcgtcggttggcctaataataaatccaagcaaaagcagaagctaaaatttaaatttttaaacttgattttaagatattttcactgtgatttcattttagtgcttttaaatcgctgcgaacaaatatataaaagtttgggtgaatacccaatatgatccttgaactttcgcttaaggatcaatttagtccctgtcatttcgtattgtccaaacaagtaccttaagttcattgtgtgattcaatatagtcctttaaccctctaaatatgccatgtgtacatgtcacatcatctatgcatgcaaattcaatatttaaatgtcctttacacccttatgttttcataggaaataaaggaaaactattgagaaaacacacaaaaaaaaagcttttgaccattggcaaaaatatgtagcattgatagataaaaaaaattaacatttttctttgttttatgattgcttcttcttgtttttcttttctttatttgatagaaaattgaaggttaaaatggacatttaaatgttatcttacatgcacgaatgacgtggcatgtccacgtggtgttttaagtggctctaaggactatattaagccgcatgataatttttagggtcttggttggacattataaaacatgaaggactaattcgactcatgaacaaaaattgaaggactgaactggctattcaccctaaaagttttaactataaattattttttattccctaataagccgttttggtttattagagagtatgagcaaccaatgaggttctaacaagtattttattttgttaggacaaaagtttgagcaacaatcatcctattagtgtgaatttttataacacaaaatgaatgttattagatccatattaaaagagtcactcgccattatgtttctttatcatacaaatagtatatatatacggagttattcaagtaattactatttccatcctaaaataaaatataaatattggatagaacacatcttaataatacaaatttgaacaaatgtttgactagtttcgtagtgatagaatatgcccttttcagttctagtttgttatattttaagacggtggtcgttgtattagttaaacttgtgtggtaacgaaactaaatgccttttgcaagtttagttaattagagatctagctgttaataagaaaaagattatccaatttcaggttttatttcaatcactgtaattaattaattattaaccaattgcctggctctagctagctaggtgctagctaagtatgggctcttgttgaagggaacagaacaaattaaaatgcccagctagccaataccattgatcattagtggatagggtttcttagttataggattaaaaggagacagtacaacagctatagctagctggctagataatcaattagcctaagcagccacacagttttgtacaatccaccacttaatccagagccaactaacctacctaatgcagccatcaactgaattaaaaacaaaaatcagctacaattagcaagccgatcgaatcacgtgtggtaactacttagctccctccctttcaaaatatatggcactgttgatttttcgttcaaattcgtcttattaaaaaattagtataaatatataaaagtataagtaaagattatattttatttgaaataaaacaagtcataatattttttttgaatatgactaattgtcaaacgatgtaaaaaagttaacggcgttatacatttttgaatggatggagtaattaacaacgtacctgcctgacgaaggcttcgagggaggagagattggagatggcaagggagaggtgagccatggcgacgtcggagtatgcggtggcaccggtgccgggagggaagagcaggagtgagtccgagagacggcatcggagagggcgtggtgggtggcgtggaggtcgcggtcaagtgcctcctccctctccctcgccgactgctgcacaccgtacacacccgccgcctgttgctccgtcaatggctccgcgtgccgcgccatcatctagtagcaacataatcattttatttcaattagttttcgacaataataatgaagaatatttatagttatgtaatcatattatatataggttcgcaagataatcaaatataactattcgagttcatgtagtatcacttaataatattatattagtatgatagagtcgtggatgcatgactatgactatgagtattaatactcacaaatattgctatgagtgtattaattagtatagagatcagaagttatacttactttatataaaaataatatcatatcggtaatgggacgacacgtaaaaataatatcttagaaataccatattgatgatggaacacgcaaagaaaattagagtacctaattaacaagggtatatctaattactaactagttagctactttttatgagatatatatgatagtactactataatataatgtagctagctagctttttatgagatttgcaagtattagatagtagctaggactctgtccatctagaagaattagcttgctaaagtatgtatacacatcctctctacatgcattattggtaaattagccatccccatctacatcgttgatcactcttatctaacttgcctccttcaccaactctccgttgtacattactgcacactactttcttccaacacagaaaataacaaccacatattagtagccatcaaagacttccaagagcctaactgttccatcaactgggacctctcacctacttaaatcaatattttaagatagatagctagctaacccatcatacatctttctttctagttggagtacctaatatatgtgtctggactctggtgtactatggaatactgtctaacaagcttctttccaattactttttttattttttgcaattatgcatgaatggaaatctatgtatgtatagggctactacacacactactaaaacttaaatatatactccatatatatatatatatatatatatatatatatatatatatatatatacttatacatttagagcactaacagatccataaatattgcacgtatatatagggtatttcaggtattttattaaatatatgtaaagctattaattgtactccctccggttttaaattaattgaagttttggacaggatctcacatacttagaaatggttagttagggtgcatattcatgttttatccatattaaatacattaggatggcacatctaacaagcacatcctcttaacctagtggctggctgctagtcccaaagcatctttttactgtcttgtgccggagttgatgcatgcatgcagccatacatgggtaaatcagtttaaattaatcacatggaagctaaaacgccaagttttatcatccaaaaggtctaagctccaaacgtcaactaatttgaaaccggagggagtacatgtttagggcgtgtttggttgcctgcatccatgtatagtgagcagcgtgtttggttgtgcactggctgatataagcaaatattatatgtatatgcatgcatgcacgaggacgaacgaagtaaccgaaggcacgcatggaatgatggaagaaacgtgctgcaaacaaacatgcatgtatatgttgctgtgcatctcggaggaagaatgatgacattttttagtcaaaatatactaaaaacgtacgtaacaaaaaagaaaaaaaatatcgggaggagcaggtagctagttagctagctatatactccctccgtttcgaaatgtttggcgccgttgactttttagcatatgtttgaccgttcgtcttattcaaaaaatttaagtaattattaattcttttcatatcatttaattcattgctaatatatttttatgtacgcatataattctacatattttac

SEQ ID NO: 2846 - DNA, 7683 bp, Oryza sativa
aaacattttgaaacggagggagtagtaggttaattggtgaactcaagcttatggacacctgagctcatgcaatatatgagtaatatacagttatgtcgatctagttaattaatactccatctgaaacagatgcagtatattaacctagtatactagctagctaatatactgctacttctgtcgctctagtatattaaacagatctggttgtaagacgttttgattttggtcaaagtcaaactacttcaaatttaactaagtttatgcataaatatagtaatatatataatatcaatttagtttcattaaatcaataattgaatatatttttcataataaatttgtgttgagttaaaaatattattttttttctacaaacttagtcaaacttgaagctagcatgtattttcttggttcaccttcctctgtctctcggtccatattctacatacccatattggaacatagacaatgggttttatttttttatttttaacgtaaaccgaattttatcatattaacatatttaatttgtatatagtgatgaatgacaccatatagtctatatatgttgctattttctttaaaaattattaccatatattttgatgccatcctccccttcattagctattacattgtataaacccatctctctttatttttaagtttttatgtattatatatgtagagcgcggcatgcgcagctagccaaatacgtactccaacatgtccaataactaaacgcgtttcacaaaattatctgactatatcatgtctatcatatattgtagacgcccttaaaccctaaaaatccaatataatctagctagtatctcaaaatctaaagggtgcctatactacaacacatcttttataatttacctctgctttcagaaggatgacgtgctaatttatccagttaaaaatgaagaaatcctaactcatcaatatatgcaaaaaaaaagtatattgcaattcaaaacatcgagattatgggtctgttcagattatagccaaaataaaccttaccaagttttggcaatgctaaaattttggtaagatggcaatattgccaaaattttggcaggattttttatgtattgatcaaatttggcaacacactaaacgtggatatttttttagcaactttgcgaaaaaaatggtatggttgaaaatgacatcaaaatgaaaggccctatattagtggattatttgttatgaaaactctttcatatagttatactccctctatcacataatacaagggattttgccctttctaattgtctcacaaagatttttgtgtactactgtcagtcacatccatcaacttcaattcaaatttctacctattttgaccctcaactatcccctcacccaaaccaaatctcatttaataggggtattttagtcttctctcgctattcttaatcttataaaaagggaatagtcccttatatatatattattatgggacagagggagtatttataataattttcataaacattaatttgatttgaaaaggtaatgataaatcatatcaacatctaaaacgtcaagtaaaaatatcactgccagttcagatccgtttgggtgggtaaaaccatggtgaactggcattagtactatctctctatatatatcaccattggtttacactaaaccgtcagtgataagtcatcagtgatgatattttgtggtagtgaatccttaatatataatatataaagccggctttaaataattatctataaattgattatataagatattcaattaattatgtgctaaccttgatgagctcggatgggcggaagccaccaatccagaggaagcagcgctcggcggggggcagccacgtcccggagaagaggtggaagacgtccgcgctggccaccgcggccttgagctccaccagcacgccgtggtgcgccaccgccgcgtccaccagctgcggtagctgcgcctccgccgccgccgccgccacgccgccgtggtgcggctgctcctccaccgccgcccgcatgtgagccatcatcctctcgtggctctccacccaccgcgcgtactcgccgtcgaaccacgccgcctctgcatgatgacgatgacgatgacgacgacgatgatgattagtctcccttacacattataatatgttcttttttttctcttaatcctttaagtctagattcactaacattcatatgaatttgaagttttgaacacatatataaaatacatacgtggatctatgtataaatctatttaaaacccaacgtaaataatgtgaaacagaggaagcattcattaaaaattttagttgtttccattatgtattttaaaaattaagagttgtgtgtttttgcacatggacatctgcattcattcctgacatatttgatctaatgatgaattaattaacgagtaaacaaattaattagagaatttgttggtgattatgtggttttgagtattatatggatttaattataataattaattagggttggtttgatcgtatgcatgcatatatgattatatatacctgggctttgtcctccaatgccggcagaaaaagctccaccacccaaaattgcaccctatgttgatacgtgcgttagacatgcatcatgaaacaaatcaatcaattaattagtttactgaaaacatcgtatagttcaggagcatttgcatgtatatatgctgtacctgagttcttgatctttgcaccaactcctgttccagctgggacagtctgatcctgcttgtctccagattttgaatgtaagcctatatacacattgatccatatacgagacacaatttaaaaaaaaaagcatagttaattaagtgtcatgagaaacgtaattttcagatagacgtagccagtaatgttgcacatctatattccattttaggtggtaagtaattctccgtacccccacactcacatgcatgcaaactcatttgtttaattttgactttattttatatccgacatgacacatgttagttattttaattttgacttaaatttggagtaagaacgtcgtaactgcacaagtctatactcctgtgctgtcgtaaagtagggtgaaatggcagtgcggttaattaaacaacaggtaattaattaatctcgatttacagctaccctaccagccaggtagagcaagagtaattaactataattaactgcaacttaattaattaacaaattaccttcttccttagcctgcttttcctggctgcctccctgttctgtgcaagcctccgcagcgtcttggcgtccggcgtcttggggccctcgtgctccgacgccgccgccgacgatgcgccgccgtgatgcttcccgccgccgccgccgccttctttctgatcggccgatcgagacgaccacacacacacacaaactcatgcgtgagcttgagccactcagaatgtcgtagatcagctgaagacgaagatgatgagatcatcggagctaattaagttaccttgacgacggcagccttgccgtccttcccggaggccgacggctgatcggccggattattcagcctcgacggctggccgccggccgccgccgccgccggcggccgcttggaagagccggcggcgatggcgagggcgttattggacggcgccgagttgatagccgccatggatgatgatcccttgggagaaggctcgccggcgtgcattggctgtgaagggaagatgttgagggtttctgcatccatgtagagatcagtaaagtagcaattcagaataatactgagaaacatatgtccaaaaatatatgcatgttgatgaactaaattgtccaaattaactatatgtaatgcatggcattaattaatatattaacacatatatcaaatggtgtaacagcatgtcaacatgcatgtggttgtaagttctgttgtttcacacttatggtcctaatgtaaattaaaagtatgaaaaagtgaacaaaagggagagaatatatatgtgtgtgttcatgtttgatgtcctagatatgtaaatagctagctagctagcagtagtatatatacatatatatgcaaatcgttgttgcaaatgtctctggatgattaaggttaaaaatgcatatatctagcttgctttagcattacatatatgtgtatatacgataatcatcctagcaagaacgacacacatctccaggtgtttgttatacgtcactctctcctccccatctagagaaaattttgggaaaatgacatgtcagtgagtaaagctttgaggcgatcaaatagaaggaaaaaagaagatggatcaccatcgctgcctgctcatcgatctctatagatagctaatactccatatctgtcgtcgaaaaattcgataatgaccatatatattcacttgtcaaaatcgaggtagctagatgagatgcttgccggcctgcttgctatatatctgatgaaattaattaattaatatgaccaaagaaagattattctccctctgcatccttgtcgatcacatcttttttcggagaagaatataatgcataatttgtgaaaagtctgaagatttggtgacagtaataagtgcatatatatatgtggcttacgaggttgttcttgaattgctgctgatgcttgatcctggctgttgaggtagaggaagatgtgatccaattctgccatgtcgtatcctcccccaggatcctttctgctgcacttgcacaaattaatacaaatggagaaatcatcacaaaattatattatcatctgatctgacagtagctatagctgtagtagttgctaaattattctgcatattttaaggttttggtaagagaagccaagccttccgctccaagaaaggggataaaataaaaaaaggaatttttggaatatacgttgtttgctaaacaaatccagtattagaaaatgtaaaaatccttagaagatatcaaaattaaggaaatgaatgaaaagcctcggcaccagctagtagaattagttgcacccatcgcttattaaatttggagcaaacaataagaacacccacttcgaataccactcttcaaattaattaagagatgcttaaatatacaccaaataaaacccttaataaccaggataaagttacttatcttgcgcaaacatgcaccattagtaatcaacccattcatgcatcatacaaattaaaacatgaaaaacaattctgtaatcttgaaagttcaaaaaagcactccataatctcgaaagaaaagtaaaagagacaacaaattaaactgccaagaaagacagcatcaagagagagagagagagagagagagagagagagagagagagagagagaattgtggagttaattaaagctccagttctgatgataagacaaaaaaggggatcaagaagctaaacattgagcaaggtgcttcaaatttgttctgataaaacaagatcgaattagggaggaaaaaaaaaggcacaagtcgtataggagttagggtttttacatgatgttgttgccatggatggaggaggaggtcgcagaagcttgcatcatcatcccggccgtgactgagcaagaagccgcctgctgatcatgtggctgcagctgctgctgccatggcctatcccccatgcaaacacactgatccccagtagcaaataaactatctctttcttctccttgatgatgatcacctcagctagcaattaaatcgatcctatcaccaaatcagctcctcaagtacttcacatctgatctcatcacctctagactcgatcgatatgatatcgattgattttgcgaggaatttatcggtagacgacgcgtgtcgatcgatcgcgccgcaatccctcctcctcttcttcttcttcctccaagctaggtagacatagcttctaattctccttagcttcttctgaccggaagctagctagctataggtagcaaaagtattaggacttgtagtagctagcttagttgaggtggagtgcttgtacaagaaatataaggggagtggttacaaggccatggaaaaagctaggcaataattagactttttttataaaggtcgaatacgatatgtgattggatcggggttgatcggtctctgcgactggttttggagcgcggttttatattgatttttgttaattaattggtgtttgatctttacgtgtttcatcattggtccaagtcaatttgaagaaaaaaaaagaaggttatctagtgcttgtattgttgttgggtattttgggttcagaagaaattaagtattatcactgtttcttcttgttaattaattttgctcaacttgttgtgttttggcaggatttaggttgggaattaattgggtcctgcaagaaaacaaagtatggtttggactagccgctaatatatactagtatatattttttaagcaaattaattaaggcatatgctttgcctttgtgtatattgatagagcaggggagatgcaaatatatatatatagttgattatcaattggattgtgtaaacatatatttatgttgctgtatatatagcacatactattacaaattaaaagtacacggtatgaacatatataatttcaaattccctaccgtgtacttttgtaatggttcgatggcaataatagttaagaaacatcagtgtcttaatccaaccacaatgtccacccttttcaggagccaatagccactcaaaagagaaaacaattaaaggatgtgttattacaagataaacataattaatagggtttcctcccttggatacaaaagaagggggccctggagacaccacagttggttgatccttccaaaatgtcaattaattagtaagacacatgattaaattccagatacccatgaagcactatgtccggtctgttgtatatatgttcagcatccaaatatgcaaaatttgggtttgattcttctctggccagcaacagacctggcatgcattgttggctacacctttctcttccaatgagcacattattatacaggtaaaggtcacagctaaaatacatgccaatgagttgacctctaatgatgcatggcatttagctactatctagcattagtacacatgatcgacccttgtatatatgcatgcatgcaatccaatttcagtatataatatattcttataccaaacctaaacaactaattaaattaagagaagatagcaactaatacttgatgaaaccagccaacaaaagcaccttatttctcttgtttaatttgtttcatatagggtgcatatatatatttttatatctctgttactgccagttcaattaatctcgttctgctctgcatgtgtgtatatatatctcccttaggattatttaataagaaactcatatatatatatgaatatatcacacacacaattaaccagaaatattaggtggccagaacacacacaattggtatatataaattaagagatacacaggtaagtacattagtgtattaattaggatccggattaattatatataatcgtacacttacttggttaaaaaataattatgtctatagtatatattaattatctgtcggtacgtgcaggagtatatggttcaaactgtacggccggcttgtgtcgtcagatatggacgactcctggcgttggcatacatcatacaatgctgaatggggctgcagg

SEQ ID NO: 2847 - DNA, 8274 bp, Oryza sativa
aagattttataagaaaatcctacattccgagcagccagcccttatttttagattttgtttggcataattaagctcctatctttattatactttgaaaataaattagttatgataatatgttttttgtgctgaactatctttcgactaactagcaatcaatttaatacaaattgttgtcgcgtctgaaagggagagtggatcataacaattaacataatgtcgtgacagtgcatacggaggatcaatctatcccctccttaattaaaaaaaacatggatgaacagaagaatatacaaactgcttgttgaactatgatataagttgtcacttcaaatgtgtacatatatcggattctcttagaagataaggaaatgtcattttcatccatcttttacattgtcaatcactttgtttttttctccggtcagtccatgcattcgagcatgtgttccgcgcgtgtacgcttgcgtgggtggattggttcatgaaactaaccggcaggattaagaatttaagattgcccaattgacatgttggttattataattattaacccaagttgcttgtatttcttcttcttcctcctccaaaattcttcctaatttatttgtttcaaaggtatcgggtcagacttcgaaaccaattaacagaagggattatgagatagttgtgcatgcattcattatccatgtaattcgtccattctcaaatagatgatgttttagtatacatataatcgaatgtcgaaatcctaacccatcattagtaaatggaaaaaaatatacaacgattatttgatgtgtgaaatagaattagagaatttattatcaaaaaactttaacgtagctgtatttttttaaaatatttctatgggttatatgaatgtgtgagacagtattattgatatcttgaatgttttatgaaaaaagaaagaagatgttgtaagaacaatctgggttaatggaaaaagtcagagaagaagaaagtggtggtggtttcagattacagttgaatgagatgctgtcggccaggtcggctacaacaaacaggcaaagccaaataaccttgtaacacaaaatgaaaacaagaagatacaaaaggtcagggagaacatatcttgaccttcttggggtcactacaaagatgatgctaattaaagtcaactctacaataataaacaggaacaatatatggtctctgcatttcacatggatgcatgctaaattgtgtctaattgttaattattggattggaaaacccatgttatgattctgaaggaattgccttgttttccatggattttctgtgttctgataagttattccaattcagtgtatatataacgatcacgtacgagtcgatttcagaaaacagcaaatgcaataacgacattattgacctatgtataagagctctaaaaaagatgtcctaaataaaattgaccaataggagccaatctgaattgaagtgatcgatgtcgattaattaaccgtgggaatttccttcacaagcacggaaaattcagttttgtcctaattagggtcaagtcttggatcctgaaaaatgaaaagaacttgaccattacaaaagcaactgtttccaaccacaaatggagtctcttgtaataaagcgacggcttaatttgttcttttagaaattagaatcttctactcggtcgatctaagaaaatgaatatatatttcctgcatgctccttgaaaccgtgacaggaaaatgtaattttaagttaattactgacaaaattattgaacataattaatttcaaaatgttctgaaattttcggttctcttttcccatcatgccgtttctcatcagctagcgagcgtgggttttggagttgggaaacggcccacgggccagcgacgatcaggcatcagctctatgggcctcagttcggtccaaaattaggcctgtttttcaacttttttttttcggactgctagaaatttcaacaataggttgtccaaatgcggccttccagtgtaactaagggcttgttcatacccaattttggtattgacacctttggccattgtcaactttttaggctgagttagtttgtcctacgcataacttattagcacatgattaataaaatattagctagtttttttaaaaacaatagattagtatgattttttaaagcaactttcgtattttttttaaaaaaagatcgtttagttatttaaaaagcatgtacgcgcaaaacgaggaagatgagttgagaaatgtaacaacaaacacaaccttagcagtcggttgagcaatagtaattcccagctcttccccaaaaaaaaaaaacacaaccttagcaaagtttgatagtgttcgtatgaaaggaaattatctgaactaacaaaatttggaaaggtaataatgctaagagtagcttagtttgctacctaatcaaacattggtactgctaaattttgagagttaaaaatccgcgacaaaatgaactgccaaacaaaataataaatagctaatttcgatgcaattaaaataaatcagaatattttcgatgccacaaaattgtaactggaaacttttatatttctacaaaaagtataaactactcctttgcttgtcttttggcttattacccgtagccagaatttaaatttaaatatttaattttcaaactgattttgataattattttatcatggtttatttttacaatcatatgactataaaaaatttatcaataaattattaccagttttgatcgataaatgatagattaaaccatttgtttcctcatataaaaaacacagtttaggacatactcaatagtagagcctagtatgatctcttaaattatttagagataatatctttacaatataatagttgagacgacgaaaactcaaattttgtttattgttgttctttcttgttttttctcaccctcatgtaatcatgttttctttctgtaagtgctaagaatcaatattgtgctgttgttaactatatcaacgatattttgtttattttttttcacaaatatttctaattagcaaggttaatagcttatgatttaatacgggttgtacacttgtacatggccttacatgtgccatattttggccaacaaccaacgttggattgctagagctatcaactcttcttgccatgtctgaaactacaaaacccatttatcctatcttactataaagttatcccccactaactccttaagcttaacatgcaaagatgccacatcatcatctactaatccactaattaacaagatgtcacatcatcatccactaacaatcatcacatttaaacatcatgcaaacatgctatatatttatagtttttataatttaagagcttttcaaatacaaacatgttaaattatcattcaacacaattcacataatgtttcaatgtatatttttattatgttttatgatatcctatatacttatatagttcatcctcacttagttagtgcttaaatgattaatctatggtccaaattatctttctccttttttcctctaattaagtcatatcacatcaattatttttagcctttagatgattaatttacggtccaaactatctccctacttttcttctttcataaagtcataccaccttacttttacgtttgaataaccattctacatactatttaaatttaaattatcataaaccacattaatttacttaatctgatgttatctagttattttacacgttattttttttgttatcatattaaattcccgcagcaatgcgcggggtttcacctagttattactatgggcatatttggtgcagctccagatatagcaacatctctcttggatcttaagcctaaccaaacaatttcagtttcatctaaattggagtggagctggctagagcgctctcacaaaatgaactaggctaaataatctgcaaataaaacttttatatacgtgttcttaacgatctaaaaagcaaggttgaaaaataaacttcgatgagaaaacctcaaaatcaactccaaatttaacgttgaaaattcaaaatttggctaataagcataagcataagtgaaaagatgaaactgctaaaagggtggagctagatttatactgccccacaactttatactagacccaattcatgaagttaaatttagaatttaaagctctaacaaacgagtcgtttggttctataccaaacaaaattcccactataatggaaaacaattttaatataatctaataaataaaagaaaagaaaagaaaaatcacccgctcccctgcgatcccttctcgccatttccgcggcgccaccgcactccgccactctccccctcctctcctcctcctcccagatctcctcctcctcctcctcctcgccgccggcgatggccgacgaccccctcgacccgccgccggagccgcagccgcagacgctgccggcggtagcagccgcgtccccgtccccgtcccccccgccgctccttttccgcccccgccgcgaggccttcgagcacggcctcctccccatccccaagctcatcttccccgagggcacgctcgcgcacacccttggcccaggtcaaggacaagctcgcctccgccgcggatggaggaggccgcgtggccgcggcggcgctcgcggaggcgctgcagatcccgcacgagcaggcggcgctcgcgctcgccacgctcgccgcggtgctccccgcggacgaccccgcgctggactccggcggcgggggcagggccgacctccgcgacgtgctgctcttcctctacatccagtcgtacaagcgcctcgtgccccgcgcgcacaaggactcgcccgccgtcaccgacgtctggccctccacctccgccttcgacggctacctctccgcgctctccccgatccaggtcagggatctaggcctcccccccgttgctttataattagaatttgggtgctcccatgattcctctgcagcagagaacaccttggatgtgtgattgcttagccttaatcatgtgcccaattgagcttagaacatcgccgtcgatttaaacaaggcggctgttgtgccaccttatatccttcatgttgcagctgatgctgccgtttatctgctgtcacaacaaaaattgatatgtgatgtaactcactcgagctataagaaatgctccacagtaaaaagtcgtgcagctctagatatatagtgcaaaggaagatcctagctgctgatacttattggatgctatggatggtaccgtatgctggggtcacttcttgacttcaatttaaggttatcttttttattggtggccgtcagaaatgaatggttggttgcatcaaattacgtatgatggttggacttgtatgctaacagtaaactcagaagcacacagactttgccataattgagcgaccagtcattgttgtgaccattttgttatagattcagtcaattgtatgtttgcttaattctttcgatttgatctggaaccatgcaaacctggtaatttcactataggcacaatattttacttccactcttttagctcaaatttcaaaatttggagactatggtgcattcaaatatgacttacaaaattcccagctgctaaacctctgtttcgtctatcagcaatatttttaaactgaaatcctatgccctgtgccttttctggtttgggtggtaacagtggctacagagggttagtattcatgcctttttgtataaagtttttgtaaaatcaagatttctcctacttattcaatttctcgtatttaaagcttttacgctaccaacctcagttacatgttaaaattgttctaggtgttacatttagggtcaatcccaatttcccttccccaaaccaacagatcaagcaaaagacataaaaacaccttctgttccttttgctaatatgagtcgtatggtacctccttcacttactctttatatttatattatttcgcagcttgtacgcagtaatagccgtcgattcatgccttctcaagctgatgaggaaattcaccagctatcttatctgcaaaagcatatggccaatattcttactctgttggccgattctgttgagggcgaaggtgatgattctctggtacgcagccttttctttcttttaagtttgccgagcttgttgctatttgtgatatccacttgattactcttctgtttgacaatttgtatcttgttttcttagtagagtgaagctttatgtgggaaaagagtgacagaataatgcatagcatgttctgataatggagtttatttgtttttctatatctcaaaacactagaatcgacccgtaaaagtacatctccgtgttggatgcctggaactccagggccgtgatcctgtaaaattatatgcaaacctacctctcagacaagtatacctctaaatatattgtgatgtatgagtatgcttttggtcaattaggtgttaacttcactcagaaggtgccctgcaaaaaaagaaaaaaaacgaagaccacccatcagtagatgttttgagatagcagattcttttttaaaaactaatatatagacaagcaaatataaaggtagcatatatttgacccagttagatatatctggcccaagtaagaactcatctttttgttaaatttaggatacatgtcacattgtcaccttacatttgagggcattttctgaaggcaattgcctttgtgcgtcctatttaggtttttattccttaggattctttgtggttgggctttggtagaccattacacttcagaatgtaaaataactgtatttcacaatttttgtgcaggtattgaccatggagacatttgaacaccttggatttctactgaagttctcagaaggaacacccttaagccaggcagccactttttttgcaaattctgatcctgacatgcctgctgcccctgtacctgctgcccaggttcatgattggatctcacagaatatatctgcttcactggaattctctaccgagaagtccatatcaaaggaagttagccagcagggttacttccgatatagacgtcacaatggctgatgccaatgctagtaatgcaaggaacagcacaccgactggtacaaatcctgcatactacagaaacacaacatttgtggaaggcttctccaaaacttctgttgtcaagcacgcgtctgatgtcaaaggacattcagtgaaggtatggatcatagctgcttaccataaactatttttggatgctgaaaagactacaaagatatgtcacttttcacatttctacatgtttgcattgtccactaaatcccccgggggggggggggggttaatgttgataaaaagaaccatttatgcgaatctagtttaaaacagtttcaagtgttttcatatgcttacatatcttgaatgtaataatttattctagtgctactcttagtacaataaagaatatgttttaatctctggatttccagtggagtattagtttgaaagggaaaaacattgttagccacatctgggtgattaaggagatgatggcttaaactggcattatttgggccaggatatgtaaaatgttaaaaccgaagcgaaaaatttagatagctatattttgggacgcggggaaataggctgctaagtagaattgggatgagaaaacaaatatgacaactgttctcatgatgaaaattttttgcagactccagcttctagctgtttgtgtcagtattatgttttactctatttcaagaaattcccacttctgtgttgtattgtgacgtagctgctttgtgtatttaattttgtgatcatggaggtgggactccacatttttggttttcttaacaaacagcttttgtaggttttaaattgccatgagtctgttatctacatattggcaccattgaagtcgcaactgtgtatggatgttctgatgctactgttgttcttggtgctattggtaaggtatggatgccaatcggtatatctttacaccctcctttcccattgttgcagaatattgattaatatattcctcatatttttctaagcaatttaaagagaaaaacccttgtatacacatcagttgccaccagactattttagctgcaccggatctgtttgagacttcaattgtgtatgccttggtatcacctgaatggtacatgagtgctgagtattttgtccaaatagaagaggaggtgatgataataataacaatagacagtgaaagatgtcacacattgttgtgtgaaccaaaaactgacatgctagttgct

SEQ ID NO: 2848 - DNA, 2084 bp, Oryza sativa
agtagtttgaaaagcatgccacaagtatccaaaatttcatccaactcttgtgggagaaacgaacgcagcctaagagagaggagatgaaaaatttagccaaccttatagctaatctattatacatgttaactctaatgtgggtttataactagcagttagctctactattaaacttgctctaaacttattcttacatagtttttagttgttgggttacagctggaagaaagtatgaagtttgtccaatgctgaacttattgatgtgctattaataacatactgtgctttgattttaaccttttactatagtcaaatttctccttttctgtaccaacaggttgctccatttaatacctactacccacaattgggtgaacatctggcaaaagttggtgtggatcctgcaatcaataaatgggaccagccttttgtgttgggagttgttgatccgcacgattcattatcccatcccgcgggggtttctgatgttcaggctgaatctgcagctcgtctagatcctgatctattcacaaactttatggtacatcatgtatattttgggccttctgctttgctaaacttcatgaatataggaagacagatagacgaatttattcaatctgcaccatattattttctgctggctgtcttgatgggattggtgcataacatggcatacattaaaactcattcattcatcttgcttgcattgtccatcttatccactgcacttgaatagagaggccattttgcaaacacatgctagtagtggtggtagggagctgctactttgttaaagtaggagctggtgtttttcttttataatacagctaactttttttttctagtacagtgttgtatcatgactgttttcctcctgcagattcctagttggtttgggactgaagtgcaagaacctacaaaatgctgtccttttccattgcctgaaatttattgtgcatcccagagcaaaaaggtatggtgcattgttaaattcatcaaagcttggtcttcaggtgctcttgctctgacttgattaattctaattatgtcccctactgttcttaaaaaaaactctttaaaggtcattgttcagacttcggactacctgcatgtgcattgctaatttgtctatacttgcgctggtgcctactttagaatgaaccctcgaattttttcccactccatgactttgtgggcttgtggctttatgtacaaattgaacaataccattgaaataattggtgcttcgatattcttccacaattcgcatgtctaaattgtagtagcttagtgtgtacgaatctagctgcattagggatgctggagttatggagcacaagatctggttattatttgtgaagtaggagaaaaatttgtcctgttgtttttaccactgacatttgcctcatttagatttttctattcaactctgtgtttacaccattcatattcagcttgctgcactggaagatattaggaggactattcgggagctgcaaattgatgacaataggaagaaggaattgacaaatgccctccatgcacagttcaaagattggttatatggtaagttttcatctgtacattcagttgctaatgcattcatatctcctttatgcttgttttagtgccatttgcctatgatgttttgcctaagtcattagaattgcaccttgctttctgaaatttagtctcttcaaagaaacagtgtcaagaatcaaattgtttgctttgaccatacaaacaaatttgcatgaatggagcgctcagtaatgagtaattactgctcagcatgaggattcttatgtactgttgggtagctacaatcaaatgtgcacactaatacagtacaaacctgtcacaagaatatatgattgggtcaacctagtagcttcaataagtgttttttttccaatataggtgtagtatagagtatgacggccatacataatgaacttgaaccattattctgggcttccaattccacatgattctgaatccgttttattcagcatgtcagctggagtattaagtacaacatacctacatctatactactttaaaagcctcttgtggtggtg

SEQ ID NO: 2849 - DNA, 5619 bp, Oryza sativa
  unsure (1)..(5619): unsure at all n locations
ggccacggccctggaactcagaagttggaacggcgcttggtacttctcaaagaccacgtgcttgatctgacggggcagccaagcatgctactgcagttgtcgtccaatgcttgaatctttctgccatagtcagctttgtaacagcagaccacttttgttggtcgcgttggttgctgccactcaaagagcaccgcagtgcccgggtgactggttttcagtcccgagcttcgctccccagaggatgggatgtagatcgtgctagagcctagaggaggtggctggcgccgcagtgcagctgtgtttgctcaccagaggaggaactgtaagggaacaagaggaagtcggttctggagatggctaggggcggtacgatggctattgaggatagaggagaggagagtggaatgatggtgctggaggtgaagggaggaaagaggcgcggccatgcggtgctggctaactcagttgggggagttggcgatggaggagagggtgtctgcggctgggggagtttctggggagagttgttgagatagctagtgttagcagattgtagatgggctgggcctttcccagtggagtacggcggtctggcaggttgtctggtaatgtggtatacccgtgctgtattgatggaaacgaataggagatgttaattagatggaaaatctacatcgatatggcaacagtattcagtgcttctggcaagctcaccaggctaaaatggttttctaattagataattttggacttcaaaatgtatgtgaaactttttttaggatcccattgcaacataccggcaatcacctacgtatgtgaaactaattctttgagtttcgttctactttatctttttcatgccatcattgctgatggtatatatggcttgctcaattttggtgagctctgggttcccctaaatcacattttgttaatttttcagcttcaggcaacatccgccagctctactgcctgcaaggcgactgaacatgcgatcatctgctttcataaaatggacctgtttactcaaaatattcgaccgtgtcggttgaagctgaccttactcccaggtgcgaaccaataatgtaaaaaaaacatgtacttcatcctatttctgcaaagtagtttgatgtatttctccaattcttttcccatttgctgtggcgtcagtcgttgggatgtcatctttcttttcattttctggtgattacacatttttggcccttccataaataacacggataagccagtgtaatagggattaattaattaattaattatgaaccaactttggagaaatgacctatataaacacttgatttccccacgtggtggtccacatatcaaatcattagcattcggtttcctatcatttcccttgttggtatcttaattatgtctcgttccaaatgggaaatgattttctttccaattgaaatatgaactgtatatagcccgataagtgggatttgcggtgccgttgggtcacatataatgcagatgcatgattgagtctctactgtactatgcgtggctgcgtgcagcctttggaccaggatccaagctacagtccctacaggagaagtccagacagcattcattcatgtttatgtgctcctaaatataaatggatttttgttggatgggacgtatcatagggctgcgaatctagatgggaaatattttcagatttataatactagaatacgttttatctattccaaaatctattatattaggtcggagggagtatatttgtatgagcagcaggtataaatggacgtttccggtttggtgatctgcatgcacaaacacatgcagctagcgcccaccgacgaggattacatgtatacgacctccggtcctaaatggtacacattctaaggacctgttttattatttcttgttttcaaactgttaaatgttgcattatttaaaaaaaattatatatataagttgttttaagaaaaccaaataaattcagttttcaaatttataataattaatacttaattaatcatgtgctaaggaggtttctcgttttgcgtgccagaattgtggagatcgaacggggcctaatactatgggtgtgtttagttcacgccaaaattggaagtttggttgaaattggaacgatgtgatggaaaagttgaaagtttatgtgtaggaaagttttgatgtgatggaaaagatggaagtttgaagaaaaagtttggatctaaacaagggctatgaatcagacagattgtttaagatatgtcatattcgattataggttgttatattttaacatggatgaatcagacagactattcaggatgtgtcactactgaagaaatgatctttgttgggtcacgcaaaaatcatattattcccggtttgagtaagaaccaggactaaaaatatctttagtcccgatttaaaaatccacaggtactaaagataaatctttagtcccggttgtttataccaaccgggacccaagctctaaaaaccgtgaaaactcctgagccgcgcgcgctgtgcctctcgtccttatcccatcctcctctcctcctcccctctcattttctctctacctccccctttcttccccctcctcactcctcctccgacggcgacggcggccaggaggtggcggccgggtggtggtagctgggtgcctgggcggcagatccggccgggaggtggcagaggtcaggaggaggtggccgggcggcgccaacatcaggcagccgcgaccgggaggcagtggctgggtggttttgtgattttttttttagatttagggatgattttgtgaatgacttggggattgtggatgatttttttggatgggcaattgtagatgatttgttgtgcataatttgtgaggatttgagggtgacaataaatggaagcagaaagaaacaatgaaccaatttttccaaaaaaaaaaaactaaccaaccaggactaaagatggtagcgccagccacgtggtgttaccatctttagacccggttggtattatcaatcgtaactaaagatttatcttttctcccagttattttaactgggactaaaatgggtatctttagttttaaattggacgtctcggtttgcaatccgggactataaggggctataaaccggaagtaaaaagactttccctattagtacgtacattctgatcctacacatcttatctgaccatacatggttctacaggcaaattgatcagcctccctcgtgatgcacggtcaggtcgatcgtatgcacgtacaaagccttaaacatgtaccagctagctataggcgcgttgtggggcatgcagcatatcaatgcaatgatgcagcatggcaaagggcttatgcatgcatattcgatctttggcgatcgatatgactaattacgtggataaggcgtgtacatacacgtccttaagcgtcttctaattttaacacacgcttaaattatggtttggcgaatggtcaagtgtgtcaaatctctacggtcctgtttccaagatacgaagattaattagcctgtgacggtgaatcaataacgtgctagcgatgatctaaagacacgtaggcttacctaccttctaagggcatgttcaatgatagagacgtgtatggttttttaaacaactatgaaggtggcccacgcgatacgcgggcatccatgctatcataatagaaattatattttataagggcaaactataggtcgggcatatctgaaaaccattgacttagaagatagatcaaggtcatatgacatttgaatttacttttggactaagtgagtaaatatgatgtatacgcgttcgcgaaagtaaatattatgtacaccatttaaacacatactatataatattgctacaagtaaaaattgcgatagcaaggacttaaaattattgtgatcgaatcgtctcatgaagatgcacgatttagtgacaaccaaattaggatagattaacggttggattgtttttcccttcgtagaagttcaaaattttcatattcttttccaaagttttaaagaatttttgttaggaccaaatcatttgcagaattgctttgttgggtagtgcaaaatatcagcaattgtttgaagcttttctttttttttctttttcgcatgtttgattgttttcttcgaaacgatatttgtttgaaataagagcaaaattatataaatttaattggtatgtatagtgtttatcggatcaccatatcaccttagctgctcaggtacgatgcttcatcacacgtgcagaaggcaaacatacacatgtgcgtggtctttagaagtttcattttacttttataaaagatagatatggcatgcttgttaataggtccttaataggtctaattaatagatccatcagtttaagtgaaaaccgatatcaaaatattttgttaaaaatagtataaaatagtgggttgagtaattaatgtaaaatattagttaacatagatcataaatgggcaatttactggtagagaatattattgcgtaacatttatattaaacaacatgtttttaaaattttcatataaaataatgatttgatataatagatgcatcggtttaagtaaaaaaaatattatattgttaatataaatggtaaaataatatagttttataaaaattattttcaaacatttgtgaatctaatttagacatatatatatgatgatatatataatctatgtttataaagttataatttcttcaaatttattaccactactaataattacaatttcgtctatacatgtagaagagaaagaagaagaaggaagcaaatgtaatttttaatgacataatttatatttttatgtttttccactttatctttttaaatgtgtgttgcagttgtatatgtattttcagcttttttacaagttgtaagtacgtacctttctcgtcggtgcgctgagagagattaggagagagattataaataggatttaatctaatggtcggagataacagatccatcaatttaattaaaaattgatggctagatattgtagttttttttctcacattttctagatttttttctaatttattagagtatattttaagtttaatacgaattttgattttgtatctcatctaacctagaagggaaaaaaaggaaagaacaaagaggagggtaggtacatatgtacgtgcacgtccatggagtgatagaggactntgggtgacgctaatgggcgatcgatcgcctggagcgatcaacctccatcccctcgtataaggtcctctcccctttcctcctccccttcttctcttcctactacaacataatttttttaaaaaaataaaaaaacaaaattaaaaaaatttatgtatagaaatactatatataaaaaatatttgaatttaaattcaaatttgaaacgggtatgtaaacttttgacttataaactttgggtctataaactttaggtgtataaagtttagatgtatagaaatactatatataaaaaatatttgaattcaaattcaaatttgaatcggatatataaacttttgacttataaactttaggtctctaaattttaggtgtataaactttagatatgtaaacttgaggtgtacaaactttaggtgc

SEQ ID NO: 2850 - DNA, 6229 bp, Oryza sativa
catgatatatatcaaccacaacatcaatatccaacaattcacatgtttattagatgctcttttaacttgaaatcaaaaaaggaaaaaaacagagaagaatatatattaaagaaacacatctagattaacccataacaatgtagtataacataaagcaagctagcttaaagttcagcaaacttatatatgctatgcgaattaagattattggaaaataagaaaatttcaagcaactgagacctaacaaaactatatataacaataacatttctcgtctagttcttataagatgcatatgctctagtcaagaaaatatgttgctttggacaggcctaacgatttggagtatttttagtatatccgtaaaacccgacaaaatttgatactgtgagaaaaatatgtatttgatatgttgtttttcatacacccgatctaaatattaaaaaagatattgacattcaaaattttaaaagttctagtgtgccttacacatccaaaacggtaaaatcaatgttttgattgttattgtgatgaacaattgacatgagattttatttgtattggttttgatatatggtgatttattggcgaagtgattttgtctctgtatgggaccagacagtaggcaccggtcaaactgtaggcatggtggcggtcaaaccggccaaccagacggtttgattgactagctcctgtttggagttggtttggagttgattttttgattaacaatgattgcttcttgcttatggcttccagatgatttctatacgtatgttatatatactgttgtgtgataatattgagtcaagttggaaaagaactaatgcttgaatatggtttcttatttattcatatgtaagtgtgtcttgagatctcaggagagtattgccgatgatggatagggagtcaacttgagagaagttttgtctagatgatcaggagatcttgtggggtactaatcctagaggacaatgcatgtggtgatgaagattttgtatgtcatacaagaggtgttgtatgcatatggaaagcatagttaattttgaatggagtccaagtttgaaaagtttgaagtttaaatttgtaaaggatattgagttggatacttgtacaggtgagtttccgaatggattaggactacttactcatgttggatttgtggcttttgtgcagtcatctcaggatataaatagagaattgtcatgagaaaagttagggtttaacctagatttgagtttagtcgaaagttgagagaggagcgtttttgttgcactttataaacacaattagaagcaataaagttgatctacattcaaagaatttttctgatttatgttctctctattatgatggtcaggccagtagaggaacgacagtcagaccacgacggtgtgaccgaaggcatcttggtggttggaccaatggcatcaagtcaagaggaaacaacaataggagatcaggcagacgatagggaggcggttagactggtcaccggtggcataccgtcggtcaaaccaacagtatcaggtggtcagaacgacgctcaacgggcagtttgaccggagcaacttcttcgggttttaggatattttcttattaaaaaaatttggatttttatgttcctaccattgacgtccctcgctggtaagcttggttgttgtgttcgattaaaaaatgttttatggcctagtggattattttgttagacatgaatcgtgataacggtacattctacaagtccctttttcacatctcctcagtaattttctagaaattatgcaaaaccaagaaccagctagtgttgttattttatttaacaagtgtcttgcgagttattaagtactattgaatatatacaagccataacaaatggaacgaattgttacagagaagcaaattcgaggtaatggaattcattgattaattccggcgtttacttacaaccaatattccaaagtttgcacgactagctaccgatgtctaccataagctaaataaaatttcgcaatgctattatttcttgtggatctaaaacttcaaaaaaagcatctcaactttaattagctaagtttgaattatttcacaatatgcaataatcactatagtcatagcaatgtcaaacatagttcgaattaataaatctaacctcagttcaaaacccatgcatttaccataagcacactgtatatatatagtgtttaattaatataattaagatctcacacccaaactgcaaattgcatgcaatacacatcaaatcaaatcaaaccaaacaaaaaaacaattaagagagtcctccacatatatatatgatcgatcacaaacaaattaattttctactaaaaaaataacctgaaactaaccaataatcagctaattaatttcgcactcacatatatataaattaaggtcatcgcagcacaccggcggcggcggcggcggcgcggccgtcgtcttcggcgccggcgccggcgccggcgtgggcgtgggcggcgccgaaggcccgtgcgtggtcgttgagggagcgcttgtgtcggaagtgggcgccgcaggcgcagcgccagaggcggccgcagttcttctcgtgggtgcgccagtcgccgcggacggcgaagcgcttggcgcagcggcggcaggcgaagtcgcgggcgccgtggcggcggcggtagtgcgtctgcagggtgcggaagtccttgagcggccgcgcccgcgggtggtcgatgtggttgcggcaccccgccgcgcagcagtagcacggcagccggagcatcgcggtcggctgcgccccgcgcagcgccgccgtcccgcctcgccggtactgcgacccgtgcccccacatgtgcatctgcactcaccacgcaacgcaatttttcattcttaattttcagccagctgcccattgttcatcttctcttaattgcatgcatttgttttttttttctctataggttgcgtccatcaattgaatgatcaatagatacacgaaatcaacctttatttttcgattaattacatgcaagatacgcacaccaccacacacactatgtgagatattctctcgttgtttgtatatcacttaaatagttatataaaaattaacaagaattgagaatatatattaatgtgtgacatatcactctacaaaaatgtagcttaaaattcaatttctacatgtcatacaaaaaatcaaattaaattatagctagttaacatatattctcagttaatttttttttacacgtacaagttaaattttaagttacatatttatgaagtgatatatcacatgttaatatatcatcttatttttttataactatttaagtgcaacgaggggacgtctctcgagtttaaaattcactctccactatgacaagcattaattacacaaacacaccacgacgtaagcaagagcatgcacattcactaagacacattataatgactaatgataaacttcatcgattgttgggagtttcataagatagctgatcataactcataaatatgctcaattgctagaaatttattggtatatctttttatgaccatatagatcaaatggggatcggagtaggaatttaaaacacacttgtcatatactccattatttaagtatatatgtgttttttgcacgtataaatacctggaggttgttgtatctgttgaaggtcttgcggcagacggggcaggagaactggtggcgccggcgaggatctgcgccgccgtcgggatccagtactgcccgccgccgccaccgccgccgctcctccgcacgctctccacctccacacccacgccggccatggcgccgccgccgccatcatctccagcaactcctgtactagaagcactagccccatggttcgccatcgccggcgacggcgacgccgacgccgacgagacggccggtaggcctatgcgcaaggcaaccgtgacctcctcctcctcttcctcctgctgtttgttgcagctgcagcaaccgtaccggagcagctgatgacgatcatggccgccatggccatcatcatcttgctgctgctgctgctgctgaccactgctgctgatgcaagaagaggtagatgaaatgaggctgaggaaagggaattccttcatgagctcgggttgatgatgatggccatggcctctcgagatcaggttggtttgggcgtagtcctccatggatggatggatggatggatcaatgcgagctaaggtagtagctagggtgcatgaagaattttgcagatgatgtgatgctgcaggggatatagctagctggggacgacgatgacgaaggggtattgtggatatcgtttgatttttataagatgtgggttggattaatttcacgtacggcctccagaaaatggagcttgacattatttgtaggacgaatcgaacgatgtcacttttaataatctaaatggtgagaatatatatactttcgttcgttctaaaatataaagacgcaactgataccaagaaataattattatcacctttttatttggatcaccctaataaataaattatgtacacacctaataaagttagagataagggtggaggatttaaacaaaccaatttaaacgagggaagctagttaactatatgtatatgcatatatgcacgtcttgtattataaaacatagaaaaaaaatagttgtgtcctaatattttgaaatggattatagagtaatatttttcagatgtatgtaaacagctagtacgactattatatatcttcttcatttccttgtacgtcctgcatgcatggttgcgtatatatgtagtgacgacaatatgtacggttagcataaagttaaaatataaagaattacatttaatgtaaagatagtagacatgattctttgaaggtattacatatgctaccatttatatatatatatatatatatatatatatatatatatatatatatatatatatatatatataatattacctgtacaattacaaccatatgtaacaggattttattaaaaaaatatcattaacccgtcagtaccattaatttgtataaatattatcttttagtttatatatatatatatatttgttacttaaatgtgatctctctgggcccactagcccccacaatcctttttccttcttaaagaaaaaaataaagagttggtgataaggttgattgacgtgtaagcccttatactagaccccacattattctttatccccaaaaatgtatcgagttggtagtacaaataatggtagattcaccatttaccaccaccactaattaaggagtatagataaagaaaatagcacataacccctccgtgtttctatgacaccgattacaatccacaggaaactaagcattttaagcgacaatcatatgcttacgatggaattatcatagccattcaatatttggcaaatgaagtgattgagatgaaatatttttttccttatccttaatctttgttaaagaacatactcccttcttccatttatatgaaactttggttagtttaaatttttactaaccaatgtcatatataaatggaatgagggagtataaagaaatgctttatttaagaatggatggagtaattttttagggtaattaatacttttagaattaatttcttactatccaaaagttaagaatgaatatatagaaaacctaaattaagttcaacaattcaaaattggtataagccacagttcaaacttcagctaattaatcaatcatcacctacatatatacatgtgagaaaattcattttttatatatcttgaacagctcacatgcacatatctactttctctgacaaataattatctgccagaagtacagttttgtaaatcctaagctgtatatattcaccagtcaaaccatacaagccacacaacaaaatggacctgcagccagggcccactgtttttgcatagctagcagtatagctcaatgttcaactggacacggcttgattgattaattgaaaatgaaatgccaaatagtagcagcattcattgtcctgtgctgctttctccccagcttaaattaattcccaattaattactgtaggggtcgtcgcaagctttgcaacccccaactgacagcacttagggttcaaggtatggatggaatagatcaatagtgagagccataaatttagatacagtaacagcacgtactaggtagcagagggacagatcgatgatcatcgatcctagt

SEQ ID NO: 2851 - DNA, 2502 bp, Oryza sativa
agaccaagtctagcagatccatccatggcatgacaccgccaggacaaaggagacagaagtcgacatctcctttaatctttacaagaaaggtgggggagggggacaaaggatctgtaacataatttacccgactatgggacgagcttgagcactcccccggaccccccctccccccaatcctttcaccggcaaccaccggggacgaagaggagagggattccaacgagacaaagacaccgtcacctgtgggtccttctctaattgtgagagaacgtgtgttgggggaatgaagtccgtcttaaattaaacaagagttaggtaagggtaattcaaaaatcttccaactatgcctaatgttaatcttactttcgagttttgagggattttggatcgaatgaagggacatgacactttgaaaatttgcacaactatgctttagcaaaaaagcattttaaaaataccgataaataacttttatcaggtgtttggttcataccaaacctttggcaatcaggtttgcttaacatgtggccaggggtggatccactccaccacccgatgaccgggctggtcgggtggccgcacaatgaaatttaaatgttttaattttcaatttatagaagcaaaattttcattgcaaacacttgatacaatattttttccccatgctctaaaacttttttgatctaccactatatatgtggctaagagtttttttcagccaaacaaattatgacataccacaccgcaccttagctctaaaagttggtaaactaaagcatatatacaaccaaacagccccaagtgtttctagctcccgccactggaaagggctgtgactgaactgtgcatgcttgaccgatccgagagaaaacgtacgatggcaacacaagcgaattcacgatgatgataatgcagggaccagcagtacatgagccgctagcagctagctaagcactgtctccatcgcatcctccccctcgctaagtcctcaacgaatcacacacatttcgatcgaccacatgcacgcatgcacaagaattctagcatacagtactactacaatgtgtgtgcatgcattgtattccctccctcccataatacaagggattttgaagaatacaacacattcagtacttgtagtactttgaatctgaacacatgatcatagtactatgatatattacatactttgaatctgaacacatgatcatagtactatgatatattacatatatttaaaatctcttatattttactctctccgtccaaaaaaactcaacttctggagtttgaattttgtccaaaaaaaaaccaacttctaccattctacctactcccagcaagtaaaatgagaagttttattccttcaacattctttacctacatatcatcattactattttttttaataataagaggtattttggtcattttcactctccactaatgttacattgggatgctaggatttgattttataagggacagagggagtaagagtaaaaaagaggagggtttgattttatatggacagagggagtaagagtaagaaggaggagtagaccacaaatggtactacactgttatatcacatgatgcatgaacacacacgccacagctagcgtagtacacaaagatacccaggattgatagcgagagcttcgatctggatgagaggctgctttcccgtttccttttctaggaggctacgctgagctagataagctgcaatgctgcatcatatcacgctcacaccaagtactacaagatacccacacacaccggtggtggtggtacactactactggcttctagcttttgccttttgatatgccaatctatggaagatcatggttcgtgcactggtgatgtggagagggtgatgctttctgtccctgatggacagataagtgcaacagtggcttggaaaagctggtgttgtgatcatcttgattttgaattaatcatggaaaagttggtgttgtgaccttgttttgcattaatcatgtagtagtacaactttggcatcttgctattttttttctttcaattcgattttcttggatgccatctagctacctagctaggcaggcaaaatgaagtgtaattattgacattataaagtgttctgtaagaatgtggcttgggtttttcagtaatcatgaggcactcctagctagttagttcccatatttggtgcaataatccaattcttttagtggaaacatagcattacggtgtactaagatttgatttccctagttcctacgaattaacgaaggatactggagtgacctctgaaaaccgctgcaagaaggcaagagagaataccatgaatagacagcagctgagcagcagaagcatccatccatgttgtccccagatgcatccaggggagattaatctgcaggaaacctcatgatcacaaacgcgaaaatcgccgattgatcggtccactgaaaaactggagatgataagctcaggttggtgggctgcagg

SEQ ID NO: 2852 - DNA, 352 bp, Oryza sativa
tagaggaggttaagcaataattaagcaaccattagccatgaaaaagacttgactaatgactagtacaaaattcaattcaaccttgttgtcaaaaaggcggttaaaaaggaagcaaccccaacccccctctccctccctccatccctcttcttcttcattccttcctcctccctcctcttcaaccatcaccaaatccacacgcttcccaaaaatccaaacccaaattgcaaccccccaatctccattgccgtcgccgccatgatcatcaagacgctcaaggcgcggatcctgtgcgcgctcaagtcctcgcttccggccgccgcgtccccgccgccgtcgccgaccaagccgg

SEQ ID NO: 2853 - DNA, 399 bp, Oryza sativa
cagccactctggcgcactccccctagccacctcagcatcgccccgccacgtcggcggtgggacggcgccaaagaggctggcgccgtcctattgaacgacggcgccagccactctggcgcctcaaaaaggaccatttttgggataagtttttctagagatctacttgcgaaataagtttttcaaaaggacaaaaatgtgaaaaatccagtaagccagcatgcaggtcaccagcggcgtcgtgatccatcggcaacttgatcggcatcgatggcgcgcggcgattagatctatgtccacagccacgttgcagcgactcgatcggtgtccacggcgcaggcgctcagccgatcggcaaagccgaaggtgacgaccaatccattggctcgctgaaatcatatg

SEQ ID NO: 2854 - DNA, 6913 bp, Oryza sativa
tgttcatatatataccttagcattataaggaaaaccctaaagaaagtaagtatataacatgggcggtcaattttaaccgcattatcgagtaatgttggctgttttattttggccccaagaaaattaattggctgcctgcttaatcaaattatacgctgcggatgctctgatcccttcatgattccacaaatgctggtgactagccacacccttcttaaaaattaatggcattgacccatcacgggacagcttatatatcatcgatgggcatatggacatatgggtggacaaaagctcaaattaagctcgtggctttgatcggcttgaactcgtttcgtaacgagttaagctgagctagacttttagctcgtgagttataatgagctagctcacgagttgcttgttagtaaaagagataacaatatatatctttatatattccatgcttcttaattagtacgtagtctttaatttacattcaaacttttgtatttgttgagccttttcttagtcagcttttagactatatatattaatacgtgataaattggtaagtttgaaattataaaagtgatatataaatgtgttaacgagtttaacaatttagctcgcgagctgagttgagctagacttttaacttgttaaggttagcgagctgagtgaactgacttgtgacttgtaaagataacgagttcaaacgaacctgagctggcttattatgcagccctagatgagcatcttcggatgcagccacaagagggaatatatcatcaggattttcagtaaaagaaaaggagagagagatcatcaggattacaaggtagtccaatcggcccctctactacttcaacagctgtcgttgtaaattggtctattgcatgtctacgtacacatatatacaagcaatgcattttttttaaaaaaaacacatacaagaagtacttcattagtatataggtggtcacaatccatatcctctagaatgggatcgatgtatagcacttcaccacacaaattctttctatatgttccacatgactatatgaggctctagtaggagaaggtagctaggatgtaagccatacatatatagcttaattaaggttgtacactactcctgcctgattgctgctgtattattggctagcaacatactgatgctttgcaagcacatcagctacaactaaaaaattaattttgagtaaatttcataaaactacatatattttgatcaaattatcacaaaactatatatttaaggttatatatcataaaattacagatttaaaattaaatttatcataaaactacaaatctaatatggagtattgcaaaactacagatttaataagaaagttatcacaaaactacaggtttcagagtttagatccttagcactagtgttatgtttgagttataaacatgtaagttttgtaattaaattgtcactaaacctgtagttttatgataactttattactaaatatgtagttttacgagtactgtgaaaaatttagtgttaaatctgtagttttgtgataatttgattaaagtatcggttgttttataaaatttactctttaattttagagacgattttaagtttttcatcatataagtatattttagcgttgtcttttaaatcatcaagaatacatataatttttactgataagttatttttgttaattgttttatttatttatttttaatcggtgaggcacatatatattagtcagtatcactagcacatattagaagacaacagaacagcacgcaaaatctatagaaaagtttgcaacagtatgtatgatctgtcaagagtcgctgtgatgacagcgaaatttttgtataggcatctcccggttgatggaagaatccatgcacagcattttcagagatacatgtgccctcacacgaacggctgcaacggcttcagcatgattaggcctagccaataatcaaaacgtactgtggcttcttgaatatttaatttagaactttattcgagggttttttttaatttcttcgtcatttccattgcttggctctcttttcatgattgttgagaagataaattttttttaaaaaaactcccctgaaattatatctaaaaataaaattttagaatacaaatcgctttaaattatactacaaaggtgaaataagcttgcaggcctatcgttgaaaaaaaaaacttgactagagaatattggatgataaattacgcttagtctggttacttccaaggctacaaggtcaagccactaaagaatattgaatgataaacaacacccaatctctagtagtctcggacatggaatgcaattttttttacaagaatgtccctcttttccatctcaaaatataagacattactatcttttagaaaaattattatttataacatttgtctaataattaaagtcatatgttataactagatttgtatttagaagtacctatatgacgttaattttctttttaaaaaaatatatttagaaaaaatattgtcaaagtataatgttgcattgtaaaccgtgtaaacagttaataatgtcttatatattggtaggagctatatgagaaaaagtttaactcatagtatatatatatatatatatgaatgaaaatcttttttcacatttcaaacaggccgattcattgtcgacctcaaaagtgaaagcatatatggacatatcaacaacagtactatagtcacttcaagaaagtgcgaggaggccaatacgtacgggagcatgacagtacaacatgtatacttcacatcttttcctcatttgagatctctctgatgttatttgagaggaatatttttgtatacggcttattattaattcgcagccacatgtttggcagcacatgctatatattagatgttgtattatcctgcaagctaggactgcatgctgtgaaccgcaaagccgttcattggttgcacacttgtatataagcctacagtttgctactagtatacatgatatccaaatcatactagtttattaatgtgaaatctgaattattttatatctattcaatttaccaccgcgcttatttattaatttgaacatgtttactcattttttaaaaaaaccgaatgaattacaaagacatacacgtagtgaggcaccgttgttggtggctctgtatgaagaaaaaatgattcttctaaaatacctctttgccttgtcgcttgtgttatgctatatcggacctcttctttccattgccttctctcttcatccttcgcagaactagaattttcttaattctagagttgagctaccgtagttcgcataattttatctttattctctctctttttgaagaaaaaggaaaaacttacatatccttgcacaccagcactccaatctctatggttttcctttctcgattaattatagcttttaacacaaggttgcaatatgacgatgttagcggtattacacgtatgttaaattttaacttgatgagataaattggacctgcaaatgcttttttttttccaaattttgatggaaacactcacagacacatacaaccaaagcttcctttcctgatttgtccggtgtgcaaggtagcatataacctgttgctgtttaagggtccctgtaacgtgtacgtagctagctaaactccgggtaacaattttgtcctcatttattgcatttgatgtgattacagcttagactgactgaccggtcagtagattatagaaatcgggcagccgtactaattcagactactattagtgagcagtaacaataatccaactcaatcgaacttgaggcatcaccattcatgatgcatgtactttaattaaacactgttagtagttagctaaacgccggctaagtacagttttgtcctgatttactgtacctgctgatgagatgcttgagctcatgcaagacagctagaaacatcaccagtgcacgtgaaaaccaaaaggtatgtgggacgtcctgtggtaaataaaatttaattaacccagcacaggaaaagcaggagagttttattcttcggtgatagccaatctctccaaaaaaaagtatttgttgggtcctgtggttaataaaatttaatccgttctttctgtactattacagaaacgctacttatttgcatttttaatatatgatgccgttgatttttgacatatgttcaatcatttatcttagaagaaaagtacgaattaccccccgaactatcgaggtcgaccgaattacacccccaaactcgaaaatcagacattctacaccctcaactattgaaaccggacaaataacccccccgactcaatccggagtggttttgggtctacgtgacaggccagtcagcaatttttcttaaaaaaaatcaatgggccccacctatcagttctcaacccacccccccccccctctctctcttctcaccagcacggcggcggccacgcgagggcgggagcaggcggcgctgccggtgacggagggcggcgggcggctgagacagaggcggagctcgtcgcgcaggttgccgtgcaagttgaggcggcggaggagcacgagtgagccgagtacggacggcacgtacccggacaggtttttcccggcgatctttcaataagtaaagccaaaaaagatcatatcaaagtacgacaagtcatggaatttaaatggaagacaaggagagaagacgattcgattttatttttcaaccagttatctttcactttaaaattttaaaacccaagatgcagcgctaagagtggttttagtggtgtttttttaccactttactaaccatcatgctattatatgccatgcatcatggtggctaatatatataggaaactgtatccacgtttcgcactgttatttccatcatttcctcgcgctaaagtgataagatagggagatgcggggaggaaagggaacaaagtgtatgatatgatgtgtccagtgttagctatttaatacaccctccattctaaattgatctacatatagtttttttaagattattactaaatgatatacatatttatgttcattcattaagtctatttgttatttgtgcattggagtaaatagacattaatgcatgcatccatgcacacaaatatttataacccacatgcaatatcttgatttgctattggctaggaaatagtggggatggtgcatgcatcgagtttgttgctaaagtaaatatagtatgagagagttattagtttttttggttttagtgtatctatgaaatatgtacatcaatttggaatggagggagtagttaattatagtggcggaaaatagtgttatatactatgaatcttaaacggagatttatgagccctattttttcacataaatgaaaatattaacatgttccatttataaccgcggaacaacgtacattattattacacaaagattaattgaagataagtattattcatacatatacaaatatctgtgacgcaatctataggatgtgatatacacctacgaatataagtacgtgaatttttttaaaaaaaaagaatcttggagtaaattattaacgtgatatagctagtttaatttgtgatagggaattaaggatacatagtcatgtcaccttcgtcatatatattaattattcactctcgatcgattgccaagtaattatattattaacacgcatgtggtaaacggtatacccacatacagtgacatggctagtctgatagagaaggatgtacagtcaagtcaccttcattgtcgattttgccaagtagagtaatttttttaacgcatggtaaaatggtagcttagacgtagacacatgtacagtgatagctagtctgatagagaaggatatgtacagtcttgtcaccttcagatttggcattggccattttgccatacacttgtacgtgccgattcacacgcttgtcgatctgtgactgtagtagtgtggcaagtctcggtctctctggcaatgaccctgcttcaattcatactccactggtaattttacatctatatatatccagccgtttattgagatagagacgtgtaacggggagagcaggccggtctaatccatatatgcatatttgtgtgaacgatatataggcacgaatttacaaaaaaatatcgggtattctgacttttaatttctaatgtttgtttttagagtaaactttataaaacgatgatttgaccaaactatcacaaaacaaatatgcgttttttttaaccaaaactacatatttagtgtcaaatttatcacatatctgcatatttaaggcatctacagattatgaggatattaagaactatacattttatagtttatatccatagcagaagtttagtttgtgataaaactgatgttaaatctatgtgattttctaatacaaatctattattttgtaaatgaaaattatgttaaatccataatttttgtgatacaaatttttaaatatatagttttgtgatatacaaagttgaaattaatttaatcttgtttttaatgcaaaaatttataaatactaaaaaagattacgtattacaaaagttttttttttgcttcatacgcattagttttttcttatttcaaccattttaaaagaaattagtgatcaacgtcgacgcaatattagcaatattgtttaaggaagggagtacttttttttgtatattgttggaattttatgttccctagcttgtgtcctgttcatcacgatagctacgtatatatatgtggaatcatcctgactcctgtggacgaaaaggtgggtcgcgagaagtacgttcatggtaatatcgtatgtatggaacgacgttttaccttgcgtgaagtacgtcttctgactacactttacaccattctttcatgaaagaattattttttttttcaaattcat

SEQ ID NO: 2855 - DNA, 7292 bp, Oryza sativa
  unsure (1)..(7292): unsure at all n locations
agtacttttttttgtatattgttggaattttatgttccctagcttgtgtcctgttcatcacgatagctacgtatatatatgtggaatcatcctgactcctgtggacgaaaaggtgggtcgcgagaagtacgttcatggtaatatcgtatgtatggaacgacgttttaccttgcgtgaagtacgtcttctgactacactttacaccattctttcatgaaagaattattttttnnnnnnnnnnnnnnnnnnnnnnttttttttttccggatggagtacgttttaactttgcttgcgtagtacctatagtagatatttcggtttttgattttttttttctctcccttgtccaggcagttgcgttttgtaattgaaatattttttttctaatatatcaacgtgtaatctttttacgcgttcgtgaaaatatacaaagagtcgtttttttttccatacgtaggacatatccgatatatgtattggtacgataattaatactgcccaggcaaagaaaatcgactcaaaatattgtacaaaccatgaagtgttattttttgcggatgatagcacggtagcgtaatcaatatgtagcacttggagattctctaatgcaaatgggctaaagatctagggaatgtcatttactctcggcacagtggaaaaatgtaacccacttccaattcaaccatttagttttccatataccataattcataacgcctaacaaaatatgatagcaaggaaagggatgtcatgtcctcttatttttacgtgtgaagaaatttgataagatagaccaatagattatgtaccactacataaacatagaagtttaaaatcgacctatacaagttaaaaacaaataacaaagatcaaatttgaacttggatgtagtgtacgtagtcagtgctctaaatatggaagtttggagtgatataccaagaattgatacatcttgttcgatttttaattagttttatggctattcggaaatgtcatgaaggaggaaaaaccgtatatatgtgctaaatcggggatgagcacacacttgcttgtcttcctacagtgtgaaatagctgtagcaaataatcttgtgagaggccactgctagctctagcttagctgctctatggcacaggagaacatataggagatgtaacagcaagtgcacagggagggaaagagagagagatgagtgattggcaatacacgcacgtgtcccaatccctcgatcaatcaagctagcctagcctagctatatattaactagggcgccacaccacagacgccggagatcagaacgaatcatatcgttcaacgagcgtccggccggcgggcgacgcgctgtcgagcaagagcgccgccgcccgatcaatcgctcgccaccatgattcaccccaaccagccgctggcgctgtccgcggcgaagaacgcgagcaccgtcgtcgtcggctcgccgctcctcgcggcgtcgccggcctcctcccccgcggcggcgtgctgtagcagccagctgcagcagcggcgagccgccgggcccgggaggaggggcgccggtaggctcgcggcgccgaggtgcagcaccatcgagcaggccgccggcgtgtcgtcggccgtgacggtggacaggacgctgacggtgaccgccacggtgaccgtgcagccgcccatcggcgtcgtctacgccgcccgcggcatcgacgacctcaccgacctcatcggcaagacgctcctcctcgagctcgtcagctccgagctcgacccaagtgagcagcacaacatatccatggcttagccgaagctccatggatgcatggacaaacacatgtagtagtaattaacaccatgtctatgcatgcagggacggggaaggagaaggagacggtgagcgcgttcgcgcacaggacgatgaagcaggacacgtacgaggcggagttcgccgtgccggcgacgttcgggccggtgggcgccgtgctggtggagaacgagcaccaccgcgagatgttcgtcaaggagatctgcctcgtcaccggcgccgacgactcctccgccgtcaccttcgactgcaactcctgggtccactccaagttcgacaaccccgaccgccgcatcttcttcaccgtcaaggtactacaaacatcgatcgatctcaccatcacaccatccatgaacacttggaagcatcatatcaacgacgtctagcgcggccatggatcgatgcagtcgtacctgccggcgcagacgcccaaggggatcgaggcgctgaggaagaaggagctggagacgctgcgcggcgacggcaccggcgagcgcaagttcttcgaccgcgtctacgactacgacgtctacaacgacctcggcgaccccgacttcaagatcgagcacctccgccccgtcctcggcggcgacgaacacccctaccctcgccgctgccgcaccggccgcccccacaccgagatcggtaaccccacctcacctcccagaaattttacatcattttcacatcaaattaatcacctattccctccgtttcaggtataaaacattttaacttttgtcaaagtcaaactattttaagtttgactaagtttatagacaaatataataatatttataatattaaattagtttcatcaaatcaataattaaatatattttcataataaatttgtcttaggttaaaaatattactacttttctctacaaatttggtcaaagttaaaacagtttgactttgaccaaaatcaaaacgccttataacttaaaacgaagggagtaataatgatcgaagacaaacctaggacagcttagacctgagcctatgtttatctccataatcatgctcaaaaaatttctggctcagccactgctaatggattaaatgtatatgtaattaattagatccgcggacggagaagaggagggggccggtgtacgtgcctcgggacgagcagttctcggacgtgaaggggatgacgttcagcgcgacgacgctgaggtcggggctgcacgcgatgctgccggcgctggagccgctgctggcgaaccaggagctgaggttcccgcacttcccggccatcgacggcctctacagcgtcggcatcccgctgccggcgcagctcgccgccgccggcgccgccactgccacggccggcggcgccgcggcctcctcctccacctccaccaacatcgtcggcggcgtcatcccccgcctcgtccgcatgatcgaggacaccaccgaccacgtcctccgcttcgacgtccccgagatgttcgagcgtacgtgataattaattaattacgtgccatgattaaaggctaatcggtagtactaattagtactccctccgaatgtattttaatgtataaccgtcgctgactttttaactaatatttaaacattcgttttattcaaacttttttataaatatgaaaaaatttatgtcatgcttaaagaatatttgatgattaattaagtcacaataaaataaatgataattatataatttttttaataagacaactggttaaatattgaaaaaaacttaacgacgacatatattaaaatataaatatcgaggtagtaacatgttgattaagctatcgaggtagtaacatgttgattaagcaatggatcaattggatttggctttgcattgcgcaggagataggttctcgtggttcagagacgaggagttcgcgaggcaggtgctggctggcgtcaaccccatctgcatccagctcctaacggtagcaccgccattcccaccacatacactattcacctgaggacgacgtcacttttcgatgacgtcatcccccaaaaagaatgaattttcgctcgtcccgtcctggtcatcctttaatgtgtagtggcgaacccagaatttttatactaataaatatttcaaaaaatatacatatgttgatgtctttaggagagaaaagatatatagcagtagaaaaataaacaaggggtacagtggcagatggaaaattttttacaatgggtattaaaaattatgtagtatttaaaaaacatgttagagactttatatgacaaaaaaatgaaacagtacaatatttgggtaaaagctgggtggctgagactaggaatcgaacccaagatccataatgggtatattaaaaatcacgtactccagtatttaaaaacatgttagtgtctttagcagaaaaaggattcaataataaaaagaaaatatgcatcctatatgttagcatcatactcccttcctcaatttatggcatgaagttatacccatcttaaactctcaactgagttttttgctgatgtggttttgaaatttaaaaatatatatataactaacaagttgtaaatgatacaaacaattcttttaattaaaaataatcatatattaaccatacggtaaaattttaatgtttatataatcataaaagtagcccatgaattaaatgcacaggtttcctaaaatttatatgcagaaacttttataatacatactattttatattaaaaacaattgaattcgaatctaaattaaaatctggcataaacttttggtgtaaaaattttaggggtataaactttagttatataaacttaacaaaaaaataaaaatcgcgtgacaaaaaagaaagtgtggccgttcacagtgtgcaaacattagcccttttcgctagataatttccctctcaatatttagctaaaaggttttaatggctttaaataaatgacactattgctttttctaatttctaggactatttgtcatttgttagcatcatattcccttcttcctcaatttatggcatgaagttatacccatcttaaactctcaacttagtattatgttgatgtagtttagaatttaaaaatgtatatataactaacaagctgtaaatgatacaaaaaatattttaattgaaaaatagccatatattaaccatatggtaaaaatttagtatttatataatcataaaaatagcccatgcaatgcataggttttaaaatttatatgtagaaacttttaatacatactcattttatatattaaaaaaacatttgaattcgaatccaaattaaaatcggacataaacttttgtggtaaaaattttaggtgtataaactttagttatataattaaacttagcagaaaataaagtgtggccgctcgcagtgcgcaaacattagccctttcgctagataatttccctctcaatatttagctaaaaagttttaaatggctttaaataaatggcgccattattggcttttctagtttgtatgactatttttcatttgtagaaatatttgtgcaaatagacaaacatacgagtcgtaaagtattattgatgacaaatctagtggtatccctttttttctattttgcttaacattgaacgaatgtctgtttttaaaagttttgaggaaaaaagtctcaaatggtgtgagtagcaactaaggaaaacgaactcacccattaattaatggcgatcgatcgacgtgtgcaggagtttcccatcgtgagcaagctggacccgaggtgtaccgggccaccggagtcggcgctgacgaaggagttgctggagagccagatcgtggagtcggtgacggtggaggaggcgatggcgcagcggcggctcttcatcctggactaccacgacgtgttcctcccctacgtgcaccgcgtccgcgagcggccggagacgacgctctacggctcccgcacggtgttcttcctcaccggcgccggcacgctgtcgccgctcgccatcgagctggcgcggccgcagtcgccaacgaggccgcagtggaggcgcgccttcgtccacgggcccgacgccacggcgtcgtggctgtggaagctcgccaaggcgcacgtcctctcccacgacaccggctaccaccagctcgtcagccactggctccgcacccactgctgcgtcgagccgtacatcatcgccgccaaccggcagctcagccggatgcacccggtgcaccgcctcctccacccacacttccgctacaccatggagatcaatgccctggccagggagagcctcatcaatgccgacggcatcatcgaggagtccttctggcccgggaggtacgccatggagctcagctccgtcgcctacgccgccacgtggcgcttcgacgccgaggccctgcccgaggacctggtgcgccgcgggctcgccgttcgacaggaggacggcgagctcgagctcaccatcaaggactacccgtacgccaacgacgggctgctggtctggaactccatcaagcagtgggcgtcggattacatcgacttctactacaagtccgacgaggaggtcgcctgcgacgaggaggtgcgggcgtggtgggaggaggtgcgcaccaaggggcacgccgacaagaaggacgagccgtggtggccggcggtggacacccgggacgggctcatcggcgtcttgaccaccatcatgtgggtgacctccggccaccacgccgccgtcaacttcgggcagtaccactacggcggctacttcccgaaccggccgacggtgatgaggaagaaaatgccggtggaggagaacaaggaggaggagatgaagaagttcatggagatgccggagcacgtgctgctggacaccatgccgtccaagatgcaggccatcacgatcatggcgacgctggacatcctgtcgtcgcactcccccgacgaggagtacatgggggagcacgccgagccggcgtggctggcggagccgagggtcaaggcggcgttcgagaggttcgcagggaggatgaaggagatcgagggcatcgtcgacgagcggaacaacgacccggagctcaggaacaggtgcggcgccggcatcgtgccgtacgagctgctcaagccgttctccacgcccggggtcaccgggaggggcatcccaaacagcatctccatctgagtttcgctagctaagatagctagctgcatttgggacaagattggagatggttaagatttgtacactaagatcatgtaccaacactaatagctcccgtgtatgcctgcctgccacgggagaggcatttgctagtgtgtttgagttactagaatgccacaaattagtaaagaggttattgaactaaagctcagttcgctgagttttctagaaattggcagtatgtcatgcggacggatgggatctgctggattcagcacatatcatccaagaaaaattactcacagcagaacaggcatgtcatgcatgtgactgaatcgagcagcattgtgagttgatcaggaccagca

SEQ ID NO: 2856 - DNA, 3232 bp, Oryza sativa
agagttcactagaaagagcattccgagcagcatctccatgctcacgccggctcatttgagtccaaacttgtggagttaaacggttcctaatacatctagccacgcgtgacttggatgtaaaagagtccacttcgctcggttctctgaggtcaagtgatcaaccatgaaaaatttcaagtcttgtgcagtccacttagcacagcagctttgggtttctccgtttgaactgacagggtgtgcagaaagtgatgcggcgcttgaaatacttgagtaccgctcctcgagtacagaaattgggggggtggagggaagggctttatctctgggagatgcagcctccggttgcactttgacttactaaattagagcaatgaaaataaggcttcgaaatgaagaatataagaacaaaaatggaagtgtgtgttatcgagtgaggtacctgtaaaggatggctcgaaatacggtctggttgttttgaaagagggttcctgagcatcaacctccaagtgttgtgtcgtcgtgctggtcttttgaagacctgtcgactggacaagcttcagtagtttgtctgttatgactgtcattggcggacggagctctggtgatttctgcattgaaggaagaaatacagccagtaatgatcacaaatatagggtgctgaaattcattcgatgaattcataaatcattaggaccgcagtaattagacatttttcagctataatccccttcaattcccatttaggagcagagtctaagcattaaggagtagtgcatgcggtgtttcaatttgcagcttggcttctatcctcaaggtagcatagttcaactaagtaatgtgtaccagaaaaaggtaacggacagttaccttgatgcagagtaagatgatgttgcctaacgtagagatagcttgaggtggcatagatgcatgtattcttggatcagttattctttccaaagaatcaaggttatggagatgaggagatgcccaatcaactagaaactgctcattctgccttcttgaactgaagaggaaaaagaacttcattagagaaccagactacagctgtacaagattaagtgagcatatacctgtcaaaggccttctgcccagtcaaaagcacgagcaaaatcacaccgaaactgtaaatgtcagccttgatgctatctgttgctgggtcagtaagctcaggtgcaacatagcctttaccactgttgagagcttctgagtcctgttttttcaggtgaggaactgttaacggtcaacggattatacagaagatatatcattgactttgaaaaacaccagtatccccttaatatgtgtgtgatttttctacccacttctgaagggaccacggttgatcctagtagggacacacacatatacatctttcaaatatttcaagggagagtagcttgttttgatataacactataatgtataggagtctatccagcgacctacctttgattttggttgagatgcaactgtaagcaatcgtgacaaaattccaaaagtatgggtctaaactggcttattattaatttagtctttcttccttttggaaaatagttcaagagctatagcgttcaccaaaggacataagcaccagcccggtgccttggtcttaggacttgaacccaagcagatggggaggttaaacagcctcaccatcaacaggacaaacccttttccctaaaaagctaactttatggatcgttttttctcaatgcatccttctctgtctaaacttaaaattccttatcgttaagtatgcagtaagaactccaagagattggcaatccatgacaacaattagatcctagaattgttcaagtaaaacattaactatatcaccatcactaatgattatgtacagaagtaagaacactatccaatataacatggaaaactagtgagcactgaccgttcttatggcactgacaaattggcttagcctggctaatccacagtggctgaggtagggcatgagctgagcatcgagcaaaatatttgtcgctttaatatttccatgaacaactggaggagagcacgtcgaatgcatgaatctgcataagcttcaaaatttcaggaaagcttccagtatatgtctaaaaattgacatcagttcagcagaacaatttacagaaagccattaacactatgaggatgtgtataccctgcagtacaaaacaaacagctagatgatttggtaggaatctaagtccacaaaaatgtacttactccaaagcataggcaactccaagagcaatcttcatccgagctttccatgacaaagccctggaccttgtggctgctgaaaacaaaatatcatcaagagagccattttctgcatattcatatagaagtgcacagtgcccaaactcgacacagtagcccacaagcgcagagatattggggtgcttcaaattggacattttcccaagcatgtctatgagctcatcttgttccgataatgacagatctaccatgttgatcttcttgatagccaggagctgcatgtacgaggataaatacatgttatacatataaaacacagatgtaaaataatctgtagaaaaaatatgcgcctttactatttagcaaatgataaatttgataaatcacatatttttttctaatattgatttcgggaagttgcaatgagactaggaattgcatcctcctcgtgcattgaattttaaagcttatcgagagatcaagagaaaaaaaatgtcaacgatgcaagacaagttttattgccgataagaaaaggaaaacggccagttgatgaacaaaaagtagtagtaaataaacttaatacaccaactaaaggaaaattcagtattaggacactgaaacacgtagtagaaattagattcgagagcttgttctaaagtaacaaaccaatagtattttccaacagggtactaacaatatgatacctggccaccaggaaaatcacctctgtaaacttggccagtgaaaccttcaccaataaagcattctttactgaagttcctggtagctgctaagatgtcaacagcttgaaactgttttgcagttagaaagtttttggatgtcttggcccaaacttttgttttcatagctctttcaggcttaatgacgtcactagaggaagcctcacagtcattcataagagaattccaagagtacaagacctcatttgctttagggactgtaaaatgatatgtatgaatttcagtga

SEQ ID NO: 2857 - DNA, 18295 bp, Oryza sativa
ttttccacattggcaggtggagatttggcattgttagcggtgctcttaggactgtatgtgcagcttttcagaaccaagccaacaatgaggagcacaaaagctgtaccagtaacagtagctattgcagcagctgtcactcgagagtgtgacttcctgtgctgattatggttgtacatagaagaatggcttaaggaaggcttcaaaggttcgggcttgtgtttcaaattttccttaactgctggtggaggtggggacataggtggtggaggtgaagatggaggtggatgtggagttggtggtgaatgagcactcctggtaaatgagggagatgcacgtttgaaacctggttgaaactggttcccatcaatcctggaatgttagattagccacttatttcaactagatatgaagtcaaggcaacatgtatgcataaatatcctacggaaagaaacgtgggttattaagcagaaccgaatacctcaactcaggaatggactcaaaagttcctggcacataaccactgaagctattgttttcaatgttgctgcaaccagttgataattgtcaggaaggatgagaataaacaaatatagagaaggataaaatacagttgaatttcttacagggatgataatggaaggtctgccaacaaaataacagatcctgtgaactcattatgctgtaaataactgtaaaaccaaaacaaaatgaaccttttatattctagcatatttttgtgcatgaaatcgttaagaacgcacatcattcttacaggtgatgaaggttcttcaatgagctaaacgacgttggcaagtcaccactgaaagagttgaatgataaatccctgaagttgaatacgaacaaaaatgaggtacagactacagtgggtgaaagatcgaattactcgaagatatatagctaaatttgcatggagaattatagtagaattgcaagaaggtccaaaggaactactctagcatcaaagtgtgtgcccatattaacaggtcaaatgagcttgagccttgaagattgttttttaagaaaccataaagcaaataaatgcaaaaatagaaacaaacagactgtaaaaacttatgtatcaaatgatccatgtgatttatgtgagtgcaacgaaacatgcatttttgtggggtggctaagaaaacatgcagttattcacaataatggagggggaaatctaggaaacacaaatgtatgcagttaagcatggctgaagcttctcttgtacatgcaaatattaaataatgtttgggctgcaagaattcgcatgtcgttgcaggctacagtgcaagaaataattcatttattcaagaggataaagaaattagaatctgggagcactacattgttcctaagctttccatgttgacaaaaacatcaccaattattccagagagcttattgtggctgaggttcctgcagcaaagattaattacaggccagttatttgattctgcaaccagagttcactatagaaaattaggaagtgctccaattgccaaaaatgcactcacagatatttcagagtgtgcaaccatggtagtgaccgtggtatactcccctcaaactggttggctgcgaaatttctacaggagcacaacatatggcgattatgtcaaccatagttcatatttgatatttaacccagccaaaagggggataaccgaaatacaaagagaacatacaggtattccacacttgggggcaaattgcgcgggatttcaccagcaatgttattgaagctcacatccctacggtcgtcatgattcagcgaagcaaagaaattaaagactggactaagaacagcagaatcatgatatgctaacagattatcacaaactttctggtcaaaagctcacagtattttcagagagtaaaacttgagcagctccagaccaagccacccgccaactcctagcccactaatatttctgtgtacgagtgaaagaagagcaaaatattcaactcagttaataatccctgcaaagttgcaggtgaaactgatcaggaagttaagaataactgaagaattacaaagcgacaatggacgaatccctgcaaaggactccatgccatggccgttgttcaccaccgcggccacaggggtcaccgccctgagatgtccacccagaaagctgccatggagaatccaatgttcgatataattcccaaagccctaaagctgtagaacaaccagaaacaacagaaaattaaacataaggcagcgaagtcatacacaaacatgaagacggcatgacacgcaggaattgaacaaaggtaactacgatacggtcacaatagcatgcacactcttgttgtggcacacaatcacatacatcgatgtggacaggatcagatcagaaccaacacgaacactaataccaaatgggagcaagcatagatattcatcatgagactgtgcaaactactgcacacgcactgggcaaactcatgctcgcgcaatcaccgaatcacgagtacgcgtgcggcgtgcgcgcgatggctagctgcgccgtcaaaccagcacagacccagccctcgcaagcaagcgcgcgagctcggagtagaggcatcaaacggtaactgctcgatcgctacagattaggggttgagtagactcaccatcggaggggtcggtgaaccctgatacgggggcgaacgcggcgcacagcaccgccgcggcgaggaggaggcgaggcagcgccgccgccgccattccgatgcctccgcggctcagcgcgccccctcccccccaaaatccagcgccgccgccgatcgccacgaaatccagaccaaatcgagcgatccgcgcacgaaatcgccgacgacgccaaccggaacgttctcgaactttcccaaaaccccccgcgctcgcgcgcttgctcccgacgccgccgctcccccagatccgcgcgcccccggccgtctcccgatcgggccgagcaatccgcccgcgaattggaggaacccaccggttgggggggaggatcgaatctccccgagcggccggccggagaagccacggggattcgcgaggagggtttagggtttttcaaaagtttgggaggattctcgctttgggagggaagaagcatggggtggggaggaggagagggcggtcacgtgaggggcgcgtgagaggccgttacggcggcgggaaatggaggagagaacgaggaactattttggggagcagcaaaattcttccggaatcaaaaacatctctatctgaataatttggtttctcgttcagatttcgaaaaacagaagttacaaaatctagaaaatcaacgaaaagtaaaaggcttgtttttcctcgtttagattctcacaatatgatgaattgccaccagctacttttagaatctaaaaatttcttccatcagaaaaaaaaatgaatctaaaaatttcctaaacgaattatgagaggtttgttataggaacttccggctgttacagaaacttcggctgtgttctgcccataagctttcaactcatcatcctccctcgtttatcgtgtgcatgttttttaaattgttaaacggtgtgtgttttataaaatgtttttataaaaaagttgtttttaaagatcatgttaatctaatttttttagttttgtatagctttttttttgcggggatagttttgtatagctagtacttaataaatcctaagttaacctattgtctcatgtatactttgtatcaaattatcaattgttgtttagtctaatatatgttataactaggataaagaaaatgtaattggagttcacatttgccatgtgcttgtgaaatttgtttatttaaggtgcttgcaaaatcatatttatcaatgtacgtcaaacattcgagccatgaatactagttgtgtccaaataaagggcagataattgatgtcatggcatggaaggttattggcggttttatgtcgcgacacattgtggatatgctgcactattaacagatgattatacgcttcgacatatagaaaaaggataaatataaaaccaatgatgccatgtgtttgtcttttctaattgaatattattggacaattaatgagaaaggcgtgtccgagatataagggtaaccacaatatttatttaccaacttgatagtaacgtgggtctcaatatccgacaatagttgttattagcaggtttcataatgtttagtgctgaagtggtaattaagatggggttcacatttaatgctacttgagaagattgttatgcatacacgagcaaatagtatattttaatggtttattgctagtagtaagcatactactcggttataactaccatctctaccacaatgtatcttaccaggtaagaagctagcattaattgcttattacccattttatcctcatattgtggttactctaacaacaccaaatggttttgtccaagaataaatctacagtgcgtggctttactatatatactttacctttaccaatctatatcatcatggtaactcaccttttatccaagctgctagggatatcaaaagcatcagcaaagatgcgatagggtgcataggtgttgattctaggattacgggtctgcttattttcactcggctatatatttatcgaagctaatggttatgaggttaaagtgacggcattagcgagacgcgacacgtggcaacgataatctgtatttagtaaaattgggtgtcggtatggattgtctttttgacaatattattatccggtgctttctttaaaggtggagtcatctaatattagaactttgcagtggagtgaaaaaaccatttctggattttctactttattcttaggggcaattgtattcttgcccctactttcatttgcaattgtgattttacccttactttttaaactttgtgattttgccctcactttttgacgttgaatggtctgtttgcccctggtttaaacgtctgttaggtggactcagattaaatgagtttaagaaaataagaaattgacttgcaaaatgtaaaaagacatctctatcccaaacctttcaacctaagccactgctgactcctccgtccccgattcctaaccctcgcgagcggtggcggcacacgcgggcaagcgagagcgaggagcgcgcggtcgtcgcggaggagcgcggggtgaagcaggctgggccggcgccaaatggcgatgtcaagctgagctagcccgtcgccgtccgccgtggtggtcactgggctcgtcggcatcggcctcggctatagtacccgaaccgctgcacagcagatgatcgagtacatacgtactgttgcatatgcgtagctagctaggctgccttgccaccattagcatggccgcgaggagctcgcctgaggcatgatggtgacaaggaggagaagaacagcaaggagaggaggagaggaacatttgagttttattgtcttttactttttcttctttgtcactccccctttagtttttatttttcttactgccttggactattggttggttcctaaactggacaggaccaacaaagctattctgttgttgaaagaaagagatgagagtagtgtttcttgtttgcatattcataaatcccttgactgttaaaatgattaaacatgcagggcaagttcatacgtcaggcattgaggcattgaattcatacctcagtccatagtgtttcttaattaataaatcccttgattttttttaaacatatgctggagaatcgcatttcttgtgtagttacaaagttggatttcgttgttaaaataattaagcatgcagggcaagttcatacctccgttttctactgtaatcgtgaaacacagccaaaacacaaagtcctcacaagccaaatctgcaagggcatagatgtccttttacctgtcagttaacaccattaaagtcctcctgacggaacaggggcatacctgagcttcagttcaaaatagtgagggtaaaatcacaaagttaaaaatacaagggtaaaatcacaattgcagttgtaaatagggacaagaacacaattacctcttattcttatgattgtatcgggtcgacatgctccacccaatggaggtaagtaaggaaagtaagctccctccagttataatgccctgcaaatttagcaacatattagtgctattgttaagatgtaccaaaaataaaatacaaccatttgtgggcaagagaaaacagataacattagcagagcaaaaaatggcatcccatttcactgcagtaaaaaaaaaaacagagagaaacggaatagcagaggctactacagggcaccgcacagtgcagcggccagcagtgcagtacaccactgcagagtgcagacgaaggcaagcgtggctgcaaccgcaagcagcaaaagcaaaaccccggaagcttcccccaaaatctctctctccctctccccactataaatcctcccctctcgtcgatcgccatggctcccatgctctcgatcgcctcccgctcgccctcgccggcgttgattgcacctcacgcctccgcccgcgccaccggtcttcgtgctccgttcgccggcaaccgcattgtggggtgggggtggggggatcaaaccaaatcaggtacggatcgtaatcgcgcatcgatctgtgtcgtcctgttcctgcgcgtccgctccggcgagcccacgcaggcgccgcgggatccccctgctgcggtaggcggcggcggctgctacgtccggctgccggcgccgccgcgagaccgggacgcggttttggtaagcacgatccatttctttctcccccgaattccgacccgctcgtttggttgattggtttcgattcggtcgtgcggcctcgggtcacgtacatttacttctactacgagcaagcctaataatacagccgacttgttggttataaggttctgtgtagcattctctcagcctacccatataatagttagctccttacaattaatacagggctcacatgtctctctcgtagagtttcttggttcctgtgtctaagccggctgtaagtttatagcccgcttctcctctctctcctctcttttctcctccacctcaatatttaaccggcttatagtctactattatacttgctctactacgaccatagcagtacaagcgtgcagttttggagtttattaaactttaaagttggagtagttgtactactatccgaaacgtaattagtaagcgcaagtcaattctactatcggacaagtaattacgtttcggttagtagttttttaatatatctctcgtttaatgcgagtagcggcttataagacaaagacatgtgtacaagcggcgataaataactatagactatagagtatggaccttatatttctactagctaaataatcatgcttttatacggattaaaacaaattaaggtttttgggacaatttcattctagatgaaataagatagaatcatatgtagaaggattattttataacattaaagcatgtagagtaattggaagaaaacatgatggggtagtcggtaaataaaaaaaaacttggtgaggtggcaacattgctctcttttataaggagtatagattcttagcggcccaaaactaaagttaaaaatggaaaattacgaaaaccttaaattaattatatatctcatgggatttaaatttggttgctgcttataagccaacgagggtctaggaaccgataaaatttgtaaaaccaaagggcgataaataaatctcagggatacgaacacatatgcttcagccagtgcccggtggatagaaaggctatacataggaaagggaaaagagacttgcaaaaatactattgttctagtagaaagtttcatgttggtaattaatttaactttttttttgatcaaagggccttaaccctccatttccattaaaagaaatgtcacagtttacagcagaaaaaaaaaacagacttaatttaacatttgtctcagttcttcagcaattgaaagttgtttcgtctggagttgggataattttactagttttacaaaggattattctgtgggacttgaatatattaacttgcggttttgagtttgtgccgtgtgatgtcgattgaagtgtggattggtcctttctttcttgaatatgttgccatctgcttttgaaatgttggcactcttgacaaattgacaaagaaaatattaggcttgtttgctaatcatttcttattttcttgtagttgtatgtagtcgacggttccagaaaactgagtagctgacaggtgctgcctttttcttgttgcaggatttatttctcaaagactaccatttcagattactgaagttgggcgatctgcataactagcacggtgccacggtttttgagaagaagaacgagcaatggttcgacaggtacctggtttaagttctttctttcagctgtttgcctggacacttcattgcattgggtcgatgttctgggctgtcaagaactctgctgcctgaacaatgatgttttttttgtttatctagttagtttgcatgtgaaaatatcattagtttattcatatttatattgaatttttattagacatatttactgcatttctttagctttgctattacatttacttcatttgttgagcagatatgcataagctagattcttctatctaaaaatatgtataagctggacagcccccaaatacatagccttgagtagaaaacaatactatatctcaaaatataagattcatagtatcagctatgcctataccatacacatcaaattcactgtatcataaaaaacgagatttggagggagaggcgttcctccaacaattaaataagaaattgtgagcgtgttggggattgaacacgggattttggggttaaaaccacacatcccttgcgctgcattatcaagtgcatctcaaattcactgtatcatagtctacctgtaattgctgagcatttgcaaattagaaccttgaacataagtcaagtgttataattctttccttcagctgttggtattgttattgattttgttacctgaataacgatgcctttcattgtaactctccctttcctttttccagtatcacgtttgcttgttcactctacttctctgcttcatccctatcactgctttggcggaatccgatatcaagaatttatttgctctgaggaaagcaatcgctgttggaaaaggcttcctccacaactggtttgagctagaaactcctccatgcaactggtcaggtatatcatgcgtggggcttactgttgtggccatagacctgtcatctacgccactctacgtcgattttccatcacagatcattgcattccagtcactcgttcggctcaatgtaagcgggtgcgggttttccggtgagcttccagaagccatggtgaatctgcagcatctccagcacctagatttgagtgataatcagcttggtggccctctacctgcctcattatttgacttgaagatgctgaaagttatggtgcttgacaacaacatgttctctggacaactaagccctgccattgctcaccttcagcagctcaccgtgctatccatatccacgaattccttctctggaggcctccctccagagctaggcagtctgaagaacctggagtacctcgacattcacacaaatgcatttagtggatcaataccggcatctttcagtaatctatctcggctcttgtaccttgatgcaaacaataacaatctcaccggatcaatattcccgggaataagagcgttagtcaaccttgtcaagctcgatttatcgtcaaatggtttggtgggggcaatccccaaggagctttgtcaactgaaaaatctgcaaagtttaatcctatcagacaatgagttaactggaagcatcccagaagagattggtaatctgaagcagcttgaagtactcaatctcctcaaatgcaatctcatggacaccgtccctttgtcgatcggcaatctcgaaatcttggaagggctttatatatcattcaacagcttcagtggtgagcttccagcatctgttggtgagctacgcaatctgaggcagctgatggcgaagagtgcagggttcactgggagcataccgaaagaactcggcaattgcaagaagcttactactctagttctgtccggcaataacttcactggcactatacctgaagaacttgcagatttagttgccgttgtcttgtttgatgtggaaggaaacagactctcaggccacattcctgattggattcagaactggagtaatgtttcatctatatcgcttgcgcagaacatgttcgacggacctctaccgggtcttccattacatctggttagtttctctgcagaatccaaccggctgtcaggatctatccctgccaagatatgtcaaggcacctttctgcagatacttagattgaatgataacaatctgaccgggagtatcgatgagacatttaagggatgcaagaaccttactgagctaagcttgctagataaccatctccacggagagataccagaatacttagctttgctaccactggtgtcacttgatttgtcacataacaatttcacagggatgatccctgacaggttatgggaatcatcaaccatcttggacatctctctcagtgataaccagctaactggcatgatcacagagagcattggtaagctcttgagcttgcaatcgttgagcatcgacagaaactacttgcaaggacctctccctcgatcgatcggcgctctaaggaatctgacagcactgtctctcagtggcaacatgctatctgaggacattccaatacagctcttcaactgcagaaaccttgtcacattggacttgagctgtaacaatctgacagggcacatccccaaggccatatctcacttgacaaagctcaacaccttggtcctgtcccggaatcggctgtcaggcgctatcccttctgagctatgcgtggctttctcgcgcgagtcccattctgaattggagtacgtgcaacacattggattgattgatctgtcgcggaacagattgactggtcacatcccgagagcaatcaacaattgttctatactggtagagctacacctgcaagacaacttgttaagtggcactatacctgtggaacttgctgagctgagaaacataacaaccattgatctatcttccaatgcattggttggacctgtccttccatggcctgtaccattggcaagcctccaaggccttcttctgtctaacaacagactcagtggctccattccttctggcattggcaacattcttccccagatcacaatgctggacttatcgggtaacgcgcttaccggcactcttccattggatctactctgcaaagagagcctaaaccacctggatgtcagtgacaacaacatctctggacaaatcccattttcctgtcatgaggacaaagaatccccaatcccactgatcttcttcaatgcaagcagcaaccatttctcagggagcctggatgaatcgatctccaacttcacaaagctgacctatcttgatctccacaacaacagcctcactggaagattgccatcagcaatagcaagggtcacttctttgtactatcttgacctatcaagcaatgatttcagtggcaccatcccttgtggtatctgcggtatgtttggcctgaccttcgcaaacttctccggtaaccgcgacggtggcactttcaccttggcagattgtgctgctgaagaaggcggggtttgcgccgctaaccgtgtcgatcgaaagatgccggatcatccgttccatgtactggaagcaaccatttgttgcattgcaacggccattgtcattgtgctggtggtgatcctggtggtttatctgagacgacggaggaagatgttgagaaggaggcagtttgtccttgtccctgccggtgacaacgccatggctgaccatgagacaaccttgagtaacaatcttttggggaggaggaggatgaagaagagggagccaccgagcatcaacctcgcgacgttcgagcacgcgcctgtgagggtcaccgtggacgagatcatgagagccaccgggaatttcgacgggatgcacgtcgtcggcgacggcggcttcggcaccgtgtacagggcggagctccccggcggccggagggtcgccgtcaagaggctccacggcgtcggccgccggttccagggcggcgaacgcgagttccgcgccgagatggagaccgtcggcaaggtgaggcaccccaacctcgtccccctcctcggctactgcgccgccggcgacgagcggttcctcgtctacgagtacatggagcacggcagcctggaggaccggctgcgcggcggcggcggcgcggcgctcgggtggccggagcggctcacgatctgcggcggcgccgcccgcgggctcgcgttcctgcaccacggcttcgtgccgcacgtcatccaccgcgacgtcaagtccagcaacgtcctcctaggcgagggcctccagccgggggggtcggacttgggcctggcggggatcatcagggcgtgcgagacccacgtcagcacggtcctcgccggcacgctcggctacatcccgccggagtacgcgctggcgatgcggtgcaccgccaagggcgacgtgtacagcttcggcgtcgtcatgctggagctgctcacggggcggccgccgacgtggtcgtcggcggaggtgacgcggagggtgacgacgagcgcggcgggggggagcctcgtcgggtgggtgcggtggatggcggcgcgcgggcgtggcggcgaggtgttcgacgcttgcctgccggtgtccggcgcggagcgggagcagatggcgcgggtgctcgacgtcgcccgcgactgcaccgccgacgagccgtggaggaggccgaccatggcggaggtggccaggagggtgggggcgatcgaggcgatggagtacgggcctctggtggtggcagtgtccagtggcgagccgccggcgatgccatgatcttgctgctgctatactgtatactgtagtgcatcatgctcctttttgtgaattaaggtgttttgatctcatcttatatgcggacacagagatgcagcagaaactcaattttttaacaagttcatacctcacaggcatttcatcaaacacctgttatgcgtgcaaccaacccgctcattataacctcatctttttttttaatgcttatccttataagttaatatttaaaattttcaaccttaaatttgaatttcattttaggttttttcatcgatgtttacatcagttgcacttgcagcacaaccaaacaatttggcggtgtttcatgcaaaacaaggtgataatattaattgagttttagttattacaaacttaaaaaatggattaatctaatattttagaacaactcttatatagaaagttttcgtacgaaacgcaccgtttagcagtttgaaaattgtgccacgagtatttaaattttcatccacttgttatagaataaactaacgggaccaaatgtaattccatccatcccacctgcggtttctcccatctacaagggctaaccttctgagcgcgctccatctctctctctcataacagacaactttcattatccagattggaaaccaagcccaacagcacaaacacaaagtcttaatactccgtacaagaacaagaacataacacgacttcattgggaataagcgaaacgacatatttgtaaacgaaaaataatttacgaataaaactttcatatatgtgatcttagcgatataaaagcaaagactgaaaaataaacttcgttgaaataacccaaaatcaaatctaaatttaaggttgaaaaattaaatttaggctgataaacataagcataagcgaaaatatgagaccgcacgaaccttctaccttctcttgacagtcttttatcatgctataatgcaccacatgtaccccttatgccaaaattagctctaaaattatatttagtgatttaaagtttgaatgccactgacaagccaacaagtaaactacagagcaaattaatatggtgcaatctgtcatcttccaatgttgacatcctcttgcttggctagtaaccacgttttagggcttggtccggagagcttaaaattatgggaagcagctagttggtagcttctgagaatctacaaaacttgggttttccaacttatgacttatagttcattttctaaattttacaattacaacttttcaaaatctaaaccaaaagctagactgcttggggagcttctgattatagaagaagctgcagcagcttgaaattgcctccaccttgacagctcggttctgctaaaagaccgctcctgcaatcgaaccaataaaaaaccggtgaacatgccagtttttccttgaaccagtggcgggtatttaagtatcgaaccggtttttatttttcctatggcattatgacaggatgaatttattatgttaccacatcacatttattttttttaatgttatgaccatgtaataataaatataatggtttatttatgcatattttcaccaatttgtgatggttatatattaaaaataatacaaattaaatgtaatattaataaataaaaaaccagcggtcgaaccgttgacccggtggttcgtccggtgaaccaatggctagagcggatcgaccctcggaccggtttttttactatgcctcaaacatgttcttagaaaccaaagaaacactacttgtatacaatgacaatccctcgattccgatgtatagctggacaataacgactctttttattcaccatggtttggaacgaaaactttggttcgaaccaaagcatctcggaatataattccgtttttttatgttccgaaatccgaatgggaccgaatcaccgcgagttctgacgcaactgataagtgataaccaaccaaccaaccaaccaaatgtttgaaccaaaatcgggaagcccggcaaaatcctcccaaattcggcaaattcccagacctcgtgccctacctcaaaatagcgagcgggaatcaaaaccacacctgaattctcaaaccacaacacacacacacaaacagttggtccatagccctatactcactgacatgtggaccccacttaaataaaccccacgagcccactgaagtactgaaccagacgcgtaggagtactctcaaacacaacccgcacgcccgtcgtcccgctcactgacatacgggccccacgaagctctagaaaaaaaatccctagccaccgacctccactccaccttccccacagccactgacaagctggccccacccaaaagcgaaattaatctcccccgagccgcaaggattctcctcgggaaggcaggggctttcaaatccgcgcctcccctctcctcctccgccggctgcttcccccccacgaaatttcgcccaaaattttccctctcgcgctcgcgctcgcttcgccgatcggggctcgagtcgaggccgccggggcgagcgcgttggggattcggagatctggggggaggggattagggtttgggagcgccaggtcggtccccgatggcggagggcagcagcggcggcggcgggaggcagcagcagcagggggttgcggagcggcggctgctccggtcgcggtacctcgccgtgaagaatctcatcagcggtagggggctcgccgtgggggtggggtttggtttggttttgggtgtgcgggggtgtgtgatttgagctgtttgtgctgtgtgttttgtccgccgcagatgagaaggatgacatggcgagggcgggctccgacacgttcgccgccatcatcacgcaggtggactgcctgcacgagctcggtatacgaaatcctccccccctttcgcctttgctaaaccgtgtgtttttctgcagtttgatgtggttatccttgccttggactcgctgtttccgatttgtattgcatttgagtcacagattagaaagacatcgtgatatttgaaccttatgcttaggctgttagtactagctgctgaagtggctgctggagcacttgttgcaggttcagaaaaaagaagaaggcatattagcaagttgttcatctgcattgtatgtgtagtgaatctcagcaggatctcaaaacattggttggtcttcagataactgatatagcattattgcgaactacttctggtttattctactgttgacattttacttcaaattgctactcgaacatcagagcatcagcatgattgcatttagtttcgttggttgttctcccatgctaatgttgatgtaattactcagttcctatcttctacaagaccaatgctttgtaatttgcctgcatgattgcatttcttggcaaaacttggtgtttattgccatgttaatattagaagttcagaactcactgtcgcattccaaaattagtactagtacttcgaatagctgcttatgatatattttactggtttggatcatttaagcataagtgctatatgaagtacacaaaatgatggcatccttctacaatgcagtgcagaggcctagggagcaaatagctgatgcagaaactctgttggacattgcaaacactttggtaacatccgttaggtctcagtcaagtgaaggaatcactccctctgatttcgtaacagccatgctgaagaaatttgggcaatcagggggccttgattctgaggctgcctcattgcgctggggggatgttgggctttctgtgtcccatgtcttcagggctgcacctggatgctgcactatgtaatgaagctctcttccgtctttatatatgcgcatcatttcttgctttctataattctatccgcctggcaaatgacttaaacaactcaaatctgaatctttacaggcttggacccatgaatacagaagtaaaacaacggaaggctgtggttgccaatagaaaacggactgcgaggccaacggaaaatgctcgtcctgaacaggtagccaactaggcaactagccatatgctattctatattacaaagggtatgatagataccaacaaaaccataatagccatctgtgcatttctttcatcatggtattcattttttccctccattagtctctgaggtagttaacaggtctggtgctattgttcatgccataacaggtctggtgctattgttcatgtcattagctggaacttaacatatctatcttactgattccattttgtaattgtattgcttacatgttcaaaaccatagaacgtttctttaaaggaacatctggaacagaaacatttatattccttgtccactatcaagtttcttgtccgtgcatctggcagactgatcttttttacggcaatttattttgtttatacctggatgcaatcactgggcttgtatactgttccatggcttactctgaatagcacattgatatgatgctaccttgtatgcagcttgctgaatctttggagggagtaaagacagacactgataggaatgtgtctgtcatatttgatatcctgaggaggaataaaagggcaaggctggagaacattgttttgaacaggcgttcttttgcccaaactgttgagaacgtttttgcactgtccttcctagttaaagatggcagggtggcaataaacatagatgacaacgggcatcatatagtctgtaagacccttttccgctgccctcatttgtttccttaaatgatatgacaagatgccgcttctttagtgacatgtctaagataattctattggtcctatgcagatcctagaaatgctcctgctgctagtgcgatagcctcaggagaagtctcctacagccattttgttttcagatttgatttcaaagactggaaggtatgttagtagttctttttgttgataaaccttcagatttttgactttgattaatcaacttcaactgtagaactgtacaaaattcaacttcaagatctgatatatagaattattcttaagttttaccaccccattttgggatactggttttctcaggagtgagtgccctttgtcttcatttatctgataccaatccattttgttgctgtacattaggcctaagctagagcttaagctaggaagaaaaatccttgtgttgatttttgttttggccagctcctctataaaatgacaatttttttcgcacgccttttctctttttatttacagttctgggcatcaactaatctacaattggccctcttttttgtcatccatttccagcttatgcaagaagtcgttccggacggggaagaact

SEQ ID NO: 2858 - DNA, 7424 bp, Oryza sativa
agttagccttgacccataattctgagctacgactaaaaagattatctaaccaacatggtaatagtttcacattgaggtagaaaaatgaaagtgaagacacattggggtagaaaaatgaaagtgaaaacacatcgaggtacgaggtagcagtttagcaacaggaagcgcagacagcagatcatccttgtttgggtagttccaacaatcaacgagactgctcactttgccagagaaacagtcacagtagcattaattttatgaaaagcatagtaatcatcaaccacagtaggctttaacatcgcaggagaaaagggataacataatcacataaccaggcgtacgagaaatagctcaaaaataaaatgcaataaagaatccagaggtaaaacaagacagcacataagcctaaacggtcagaaaattcagcatcagccctcaaagtttcgagttacaatgactaatcgctacaaaccacaatggatctcaagcagcagctgatttccgaagctcattttcaccatgggcaaaatggcacctgtcgccaaaagtgcacgaccctttggtgaagttctcgcacagcttggtcttgaagttgcttccggggcctcccccgcggtgggatcctcccacaggtttcttgccttgtggaggggcaccgccaccgatgctgacaatcagctccctcaccattgcactagcgttcttgatctgatcaaatgtgccctcaagctcaatgtttttcaagttggtgtctgattcatgatcacggatggccagcttggcccctgtgactctggatatctgctttgtgttaaccccacccctcccgattatgccacctgcaagagatgcatcaacactgatcttggctgtggccgaagcgccaaagcttgctggagtggacatggcagggctaggcattggtggaggtgcaaagtgaccagtgggccttggtcccattgggggaggcattgagctatccatcaacataggcttgccgagctccctctcaccgtgcgcaaagtggcacttatccccccatttgcatccctctgcagtgttatacttgttgcacaggcgagtcttaacagtgggtgttggtggcccatcaggaacagcatttcccattggcattcttcctggaggcggcgcaatagctggaccaccaagattggtcatctttgcaacagcttggtagccaccagggaagtggtggaggaagtggcaaccctcaccaaaggggcaaccagaggtactgcacaataagaatatcatgagtgcaagcaaaaagatgctgcaaataatgtcctaattgaagaactacaccaaaagatttcattgtaaatgcaactgatgtttacttggaagattctaatatgtgaactttaataggtcaacatctcataaacaatgattggaaatgatattaacaagtgaagaacaaatgttaagatgcagtatggactggaggagatttctggaaccaccaccacatttaaaaacaacatggcagtaaactacattctaaatgttgagcttgacaatgggtgctaataagagatgtagaccatatgcacaaattttggtaatgactcataacatcataagcttgatagaaaataatttcaggagcaactatttacggaagtatagattcaaaccatacagtagtaaaatttatccctgcatgtagcaaatgttaggataaatattatatgttacaaaggacataagtggcaggatttcaaaatgtgagttcagttgcagttcccaagtcatgtattcaatcttcttttctcaatttgagcagatgaagctgcatcatgatattactgacaggttgttcatctgacaaggagttacatatccttaattccttatactgttgcatctttcacaggttcaaagtgatttcgcgcaactgtgcgcattccaattttactccagtgagtgtttcttaagcttggattaggtacaacctgtatcacaatctttacttgattcatgtgttagcaacaatacaattcttttaggaaaaaaaacagaagcaaaattttaatgaaataaccatgcataataaatgttaccaggtggagttcattttaagttggattataacctgaaaaatttggtgcatggcttcgatttgcttcctacaccggtttgaaatgactccgattctgttgcatcaaattaattatgcgttccaagttaatagttgttgatttgctaatctttggtacacaagagaacattaatactccttttaactacttttacgttcctactgcaaaaacagtgcaaaaataccgcattaattgaagcagctactacactctttatcaactacccacagcttccctccaagtttttaaaacccataattaattcaaagtacgccttgaaatgaagaacacggagcaacgagaccaccagatctggtttaagcagaccaaccaatctgaaaaagaaaaacacatgccaactcggcgaatcttggaagaaaaactacaaaaacattagctcgcctttaccaaacgagagtcacatccgctcttagtctctctctctctctctctctttccaaacctacaaaccctagcagaataagcagcaaaagggcacgaatcggggaggctcctcgatctaactacgcagcgaggaaaccaaatctcgccgcggcgggagagagggggatgcgattcgggaagacgagagcaaaggtcgggcacgggaaaggggaggagagggttgcgactcacctcgcggcgcgcttcccgccggcgccgttcgcaccgtcgggcttgcccctcttgcggccgcccacttccatctctcggctcccccacacccgcgcccgcgctcgcgctcgcgcacgccgcctcggagctcggctagggtttccggctcgtcgcggcggcggcggcgggtagaaggcggaagggattgggtgggcgagaggaggtgagagatgtggagtttggaagagagtggtgtgatgtgttgggccgcgcgatgtggagtggagtggtgtggtgggctttgtgccttcgtggctggatcaaagcatcgccaactcactgttcttggaaaaagaatataaatgaactgcaccccaatcttgcaaattgaaataaaaatcattttctcggatttaaggtcccattcgtttccaatgaaattatttgagtgaataataagaagttagggcacaaataataaaaacatatattaatatgtgattagttaagttttagttattttaatattgcaatataaatttatttgatattttaaaataatttttatataaaagattttttttataaaacacacctttttacagtttaaaaaaattgctaacaaaaccggaacagaatattaccccctccgtatcctatgtatccaggttcattgctagaattgaattctttgtaggacagcagtaatcagatttattgttagaattatttttttttaggacagagtattaatcatcaatagaagtgaactgagcctgataacttcccagtgcaatcgaaaatcaatttctgggtttttttcttgacaacgttccacttattgccctatactgcataataattttgcaacaaaatgtcaaataacttaaaaaatactccacgttaaacacctttttattttgcaacaaaataatatcccacgtatggtcaattaacctcgtaaatcgaaaatctagggtttaagtctaatgaaagataacaatcggcctgtcgaaaagtctgatgggccaagcgtaacaaacggccctttaaaaatttaattgatgctttggttggggtgcaccaggcccgggcagcagtgcaacgactgggcgacgcgcgagggccccagtggctagccactgtggtgggccctccctcacaaaaaataaatttaacatcgaagtgggcacatggcccacatatcagatattaaactgataagaacagatactacacttgatcttagccaaaaggccgagaaaggtatgagttgctctcctgctctgggcctcctcttatacacgctcctccgccccgcctcgctcagaatccgcgaggtggtactaacattgagaacgaaaccgtatcagctcctccctctctcctgctgcgttgtttggttgggcccgcgtctcttggtgggccgcgcagaaatgggcttttcatagcccaaatcactctggattttacttatctttattttattttataagtagtttcatgtttgcatttttaagcgtggcgtgatccgtgttctgttcttcttgcggagcaagcctgcattccaatttttgcctgggccatccaaaattcagcaatttatttatctgtttctacttttgcacctgctgaaaattaaaactatttttaacaagctaattattgaccaatgacgtggctgaacagtcacaggccttcttcctccccgaagagacaccaaccacgcgatgataataatatattttatatattttattttagtcatggtcgtatctaatttgtcttcctgtttgcaatttgcaatgaggtgtcaactacctcattctagaagcaatttgaacccaaaccttttggaatcaatttgaccaaattttactatctttattgaccaaagtgtaaaacggagaatttttgagggggctaagtgcgaaaagtgcaggaaaaaaatgggcgattttttttttatttataggcgaggaacaatcgctcgctcggtcgccttccccttcttcctcctctccgggagcgctttgaacaatcgctctctctctctctccctccccgattcgattcaattcgcgacgcctccgtgaaattctccaaagcgtaagtgcatttcatctctcccggttgcgatcctgttcgccgtaggctgtaggattcctgggcgggtggttgtgtagatggatttttttatgtggaatttcggtgggtttttttctattggattttggttttctacgcgggggattacgaattgtggatccgttgtagtttcgagagatttaatttgctttttttaattattatttttttcggtttgggaggaattgtttggaatcgatgtggcgatctgttcctccgcgcgtgcgcgtggtggtgtttaattatttttttgcgggattttggttgattttgggatgtattatgttctgacgaaatcgtttacttcgttgtttgtgcgcagcagcttgccctgtagccgcgtgctccggccatggcgttcttcaggggcctgaccgcggtgtcgaggcttcgatcccgcgtggtgagccatccaacatcttgcatgcctattttctggcgatgcgtttgcatttatgtgcgctgaaaaattgttcgttgctttgtgttgtcaggcacaggaggccaccacgcttggtggtgtgcgatggctgcagatgcagagcgcatctgatcttgtaagtcaattagtttttgttcgttcgtgctaaatgtgtggttgaaactaccagttactatgtgccatctgtggctaggctcgaaagtggggaatgtgctctgaaaaaagatgtttgattgtgtttctaaatattatatgcaggatctcaagtcccagctgcaggaattgattcctgaacaacaggtttgttactttctagcacgtctaataattcacacaaagttggaaagtatatggcatccagttctttatctaccctttttgctttactgctttagcctgtagtgatatcatcttcttgcttcatgcgatattgtgtgagggcatgcttgcaacttccaaatgttgtggattatctcttttttgtaaaagctgtgctggcgcatggaagcaaatgctgcatgaacattgcattacaccattgtttcagcaccttcagaaaccgctcatcacaaaatgtgtatattttgagcagccactagctttgtgttttctgcactattgaaaatgcattacaagattggcatatcaggttattgttttcttcacaagtttagttttgcaccaagcagtaatcacaatattcagaatctgtatcagagaagaccataattgcagctagttgcatgctcctatcattatgaggaagtcatcatggttgatataaaataacttcaccatttcactgtttacctaaaatccatatatgagttgcatgccctgtgctttgtctcaaccatccaagagtgccaaattcctgtcaaataccaggaaagaaaagctcaactcactttaccattctgttacaggaccgcttaaagaaacttaaatcggagcatggaaaggtccaacttggaaatataacagtcgatatggtatgcttttggtattgattatttatggattgtttctcaagggtgtcctttattgattggtctaaaatcttaaatggtgtttatccaaggtccttggtgggatgagagggatgactggaatgctttgggaaacatcattgcttgacccggatgaggtatgcttgtaaactataatgctacgataccataatggcataatatagaagcaaatttggatattttgtctatgtatatcttgaaattggaatgtgcaaaagttggaaaataaaatagatgaatgatgaatcaccatattttcatgatctccaagcaagtgtactaacagttgagcatgatccgttcagtgcacagtaggaatgacacaatgattgctcatatttgtcaatctgaatcaagttctgtaatcaactttagcacattgatttaaaagaggtacagggactaaatagtctagatttctatagtcattatgtaggaatgtgcttcatacaagagtttgatgcttttatgatttattttttaggatggcggcttttctgcagattttaagttagatttttagcttagtttgactttgtgaaatttaaacgtgcatcactctatatcttgctgttggatgtaagtctgtacctctttcctatccagggtattcgttttaggggtctctcgattccagagtgccagaaagtgctgccgacagcagttaaagatggggggcctttgcctgagggtctactttggcttcttttgaccggaaaggtttggcttcttttgtttaactgtttttcttgtaaacttggttttcctgttcttatttttgtcggcatttagctgctagtgtggactgataggtatttgtttgtttcaggtgccaaccaaagagcaagttgatgctctatcaaaggaattggctagtcgttcgagtgttccaggtctgcaattgtctcttctggtttattgcatattgtttgctcaattagtaaaaaaacctagatgagttttatgtcattatcttatttcccttttcttagaagataaaaaatatagtcacggatacatacagagattatggagtttttgttcctacgaagctttattctg

SEQ ID NO: 2859 - DNA, 1531 bp, Oryza sativa
tagcatatatcactcatctgaaataaatacatattctgttgccacttatttgaaggtatatttattttggagatggtgcatgtaaaaaagacaatcatttaaaaaaaatccattgataaaaccctcttattttgctgtttgtaattctttctaggtctccacacttaattaatttgccttttctattttaattcttatttgcaggtggagagtgagtttcaaaaagcctatgacaaaggaatgtcaaaatcaaagtatgcttgggatttatactgcctccaaaattgcattagttgttgaatggattttccatgtgtgacctggtgctattttaataggttctgggagcctacctatgaagattgcttaaatttgatagctcgccttccagcagtggcttcatatgtttaccggaggtagctttttatcaattcattcaccatctttacttaccaggcaatctgtaaaaattttcaactgcaatagcaataatgccgttttctggttctctgaaggatattcaagggagggaaaactatagcagctgataatgcactggattatgcagcaaatttttcacacatgcttgggtttgatgatcccaaaatgcttgagttgatgcgactatatataacaatccacacgtaattcattccatccttgttttagtttctatttatttctaaaagacttggtttgatttctttttcctttcacctgtgttcttccagtgatcatgaaggtggaaacgtcagtgctcatactggacatctggtaatttttgtatttctggtttcaatgcagtttttttcttgttagcattgccactattgttgtaaacctgccaatggatcatttctggctgctacatcatccttgtgcctttttacatatgttacacttttggcatgcactattgcactggatgccactttaagcctttgatttgctttgctgttattactatgtatcggagatatattaataagcactgataaaccaaactagccattttaaggaatatgaactaggaacaaaactaaaacttaaactgcttttagctgagttcttcattactttaactgttatcttgaaggatcatctgcttagtactcatggagtcattagtcttacattttattgtctaatagcatcaaagctatgactgaaaatatgtatctatttctgctagatagctattgtatgtctaggaaaatcctggtgtatcagtatggccttttaatgcattaggaaaggtaatataattggttgcgctgtgatccttgatccagttagctgaatctctatcttcaaggtagaagtggtaatgatagtacaaggtagcctcttaatttgccgcagaaaaccttgcaatccgttatctttaggatttatcacttatgatctatgacttattttcttttgctggcaatggcctctctctctctctctctcatgactcatctatgggcactgacctcttcattccgtgctcatgatattcaattacagggttggaagtgctctgtca

SEQ ID NO: 2860 - DNA, 1105 bp, Oryza sativa
atcacatcgaaggtttaaacactaattataaatattaaatgtagactattaataaaacccatccataatcttagactaattcgcgagacgaatctattgagcctaattaatccatgattagcctatgtgatgctacagtaaacattctctaattatggattaattaggctttaaaaatttgtctcgcaaattagttttcatttatataattagttttgtaagtagtctatatttaatactctaaattagtgtctaaatacatagactaaagttaagtccctggatccaaacaccacctaagggtattgcaacgatttgtatgtattgctgctacagtaaagcatgaggcttgatttgtactatatccaatgctgacccttcaatgcttctagtacaaagctagaaataataacacatactgtataatagtacgtcattcgaactcaacaagaacacaccatttcattagctggactgcaaagagtttaatcaaacaccattcatacaatcatactacagctaatcacagtttttgaatattctactacctaaagctgtcaaaaagtcgggctacatcacaggattgcattgtatcatactaatgccatgtcaattgacgaagctcggctagaatcaacttatgctgataacgggcttcggtttctcatcgtccttgctctctgtggtgacagccgggggcctgcgttggtgctgcacaacagctagctgatcagaaaagagcaattccttcaagcagtggagttgcttcctctctttctccatcagcagctccttctgctcgaaacgacgtattttatcctggatttccttcatctgaaaataattttaaacaggagatatcaagaagtcaatataagcctcgaaattcaatgtggttatctcaggaattttcgtggcgccctacctgaacacccactatgtcagataaagactgctctatagccttccgttccttttcaagttgtacttgtgcgttggcagacgcctctttgagcaaatcattggctgaaagcccatctgtgcaagaagattctgtacaagacactaatttagtgaaaagatcttttcaaaatattgcaggtat

SEQ ID NO: 2861 - DNA, 1238 bp, Oryza sativa
aaagaatatatgttatggctttgagattttctatagacaaaagagtgtactagttactggtaaaaaaagagtgtactagttactggtaaaaaaagagtgtactagttgaagtcatgaattgaggataggtgtgtaagatttgagaactagtcattggcgaaccactcttatctgctagtactacattccacctgttgcacttggaggattacagagcattaataatttctaatggttttgctttagcgaaaaggcaaatgatgcttaaccttttcaatttgcaataatagcatgtttctgatagttctcttgtaattttgtaacactttcttctaccacagtaattatatcttgttccttttttcacatgtcaaagcaaatggcaagcatttaaagttgcaaccctctctggtttcgctgagccactaggagtgatcattgttggtatgctatgtcatatgcacttctctgtaatatttttcttctggtgtatatccattgagtgctgaaggctgatgcaaatgtgattgcttcagcttacttgtttccgagcagcttaaatcctgaagttcttgaaggcctacttggttcaggtcagtctgttaataaaaagaaaaactggtatcagtattctgcattttgttgacctcccatgtgcctttctgcagttggtggggttatggccttcctcactttgcatgaaatgttacctctagcatttgactatgctggtcaaaaacaggctgtcaaagcagtctttgttggcatggccttcatgtctgcaaggtttgttgatgtttcaaataaagtactcctaatatgtttcagatcatccattgtgactaatgtggatttgcattcagtaaagattttcctttatattttttgatgcacttctaccctggaatataagtaacttaatgctcgcaagtgctgaattgctaaaacatcattgtcataaactcatcatcaaaattaaaatatatcaaatgaatagactgattaacttattgaccttgacactgaacagctagtcaatcttataccgcagcataccgtcacattgccttggagcggtacatatgctattcttacacaactaatctctggtttttgcattgtcagcttgtatttcttggagatcagcctgccaaaggaagtgagcttgtagcacatgactatccatacaagcttgtcacactatcctctgaactgaagcggagaacttaggagagatg

SEQ ID NO: 2862 - DNA, 10964 bp, Oryza sativa
  unsure (1)..(10964): unsure at all n locations
tcctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtcgccgctgctcaagctcaagcacaagctcaggttgccgaaccacctcccctcgccgttcgccagcctcagccggcgatccagggacagccgccaaggcaaggccaagcccccatgacctggaggaagttcagaaccgaccgtgcgagcaaagctgtgatggctgtcgaagaggtgcaagccctccgcaaggagttcgacgcccagcaagcaagcaaccatcagcagccagtccgcaagaaggtccgaaaagacctctactgcgccttccacggacgctctttgcacaccatggagcaatgccgaaacattaggcaacgtggcaacgtgcaagatccaaggccacagcagggagcaactgtcgaagcacctcgtgaagcatttcaggagcaaacgcccctagccgaacaacgccaagacgcacagcgaagggtaatccaagtgattacaagggctgacccgccaagccagttgtccaaacgacagaagaagatgcagatccgaatggtccacagcatcacttcggcgggtgaaggggcgccgcaatacctgaaccagctaatttattttgggccggaagacgcagaaggagttatgttcccacatcaagatcctctggtgatctcagccgagatagctggcttcgaagtccgacgaatcctggtcgacggagggagttcggccgacgttatcttcgccgaagcatatgccaagatggggttgaccagccaagcccttaccccagcaccagcatcgctccgcggtttcggcggagaagcagttcaagttcttggccaagcactcttgttgatagcttttggctcgggggagaacagacgcgaagagcaagtactgttcgacgtcgtcgacatcccgtacaactacaacaccatcttcggccgtgcaaccctgaacatgttcgaagtcatttcccaccacaattatctcgagctcaagatgcccggcccgacaggagtgatagtggtcaaggggcttcagccttcagccgcttcaaaaggcgatctagccataatcaacagagcagtgcacaatgttgaggtcaaactgcatgaccggccgaagcacgcgcccaaacccacccctcacggcaagataataaaggtgcagattgatgatgccgtccccacaaagctcgtatcgctggggggcgacatgggcaaagaggaagttgagagcatcctaaaggtgcccaagaagaacattgatatcttcgcctggagccccgacgaggtgggaggtgtttcgatagttctcatcatgcatcatctggcagtcaagccggaggccaagccaagaaaacagaagttgcgcaagatgtccgccgatcgccaagaagcggcgaaagccgaagtccaaaaactgctcagggctggggttattcaagagatagaccatccggagtggctggcgaatccagtgctagtgcagaagtcaaacggcaaatggcgcatgtgtgtcgatttcacggacctaaacaaagcgtgtccgaaagacgatttccctttgccgcggatcgaccagctcgtggattcaacagctggatgcgagctcatgagtttcctgaatgcatattccggctaccaccagatccacatgaacccgctcgatatccccaaaacatccttcatcactccattcgacacattttgtcacctcaggatgcctttcggcctaaggaatgcaggagcaaccttcgccaggctagtgtacaaggtcctttgcaagcagttggggcggaatgtggaagcttatgtcgacgacattgtcgtaaaaatccgcaaggctttcgaccatgcgatcgacctgcaggagacattcgacaacttgcgcgcagcaggcataaaactgaatccggagaagtgcgttttcggcgttcgcgcaggcaagttgttgggcttccttgtttccgaaagaggcatcgaggcgaatcccgagaaaatcgatgccatccagcaaatgaagcctccgtcaagcgtacatgaagtacaaaagcttgcgggccgaatcgtggcactcagtcgattcctctcaagggcagccgaaagaggtttgcccttcttcaagaccctccggggcgcgggaaagtttaattggacaccagagtgccaagtagcgttcgatgagctaaagcaatacctgcaaagcccgccagctctgttaagcccacccccaggaagcgaactgctactatacttagcagcttcgccggtggcagtcagtgctgccctcgtccaagaaacaaagttcggacagaaaccggtctacttcgtctccgaagcactgcaaggagcgaagacaagatacattgaaatggaaaaactcgcttatgccctggtgatggcttcgcgcaagcttaagcactacttccaggcccacaaagtcatagtgccatcgcagtaccctttgggcgagatactcctaggcaaggaagtctctggccggctcagcaagtgggcggcagagctatccccgttcgacttgcattttgttgcacgcactgctatcaagtctcaagtgttagctgacttcgtagctgaatggacaccggtattggcctccgagcccgagcccgccgaacaattctaggtgatgtgctccgacggttcgtggtcgcacaggggagcaggcattgcggtagtcctcttttcgccgaatggtgtgccgattcggtacgctgcaaggctgtagttcgacacaacaaacaacgcagcagaatacgaagccattctcctgggcctaagaaaggcgaaagcacttggattccggcgcttgctaattcgaaccgactccaagttggtggcaggccatgttgacaaatccttcgaggcaaaagaagaagggatgaagaggtatctggaggccgttcggtccatggaaaaatgcttcaccggcataacggtcgaacacttacctagaggccagaacgaagaagcagacaccttggcgaaatccgctgcttatggtggcccacattcgcctggcatctttttcgaagtcctgcatgctccaagtgtgcccacggacagctcggagatcatggcaatcgaccaggtgaaactgggcgaagacccatatgactggcgaaccccgtttgtgaaacaccttgaaactggctggcttccggaagacgaagcagaagcaaagcgtttgcaactcagagccacgaagtataagatggtctcaggccagctttatcgctccggggtacttcaacccttacttcgttacatctcttttgccgaaggcgaggaaatggcaaaggagatacaccaggggctatgtggcgcacaccaggccgcaagaacagtggcctccaaagtgtttagacaagaagtttattggcccactgtgttgaaagtctgtgttgagcaaatcaagaagtgcgaaagttgccagcatcatggccgaagccaaaccgcaccccagtatgatctgcagcccattgcgccaatatggcccttcgccagatggggactagacatcatcgggccgttcccggtggcgcgaaatgggtataagttcgtaattgtggctgtggaatatttctctcgatggattgaagccgaacccctcggggcaattacttcggcagcagtacagaagtttgtatggaaaaacattgtttgccgttttggagtgccaaaagagttcatcactgacaacggcaagcagtttgactctaataagttcagagaaatgtgcgaagggcttaacctggaaatcaagttcgtgtcagtcgcgcacccgcagtcaaatggggcggccgaacgtacaaatggcaagatcctagaagcactaaagaaaaggctcgaggggccagcgaaaggcaaatggccagaggaaatgctatcggttctttgggcccttcggacgaaccccacaagaccaaccaagtttagcccgttcatgcttctttatggcgatgaggcaatgaccccagcagagctagggactaactcaccaagggtgatgttctctgggggcgaagaggggcgcgaagtatcgctcgaactcttggaaggggtaagagtcgaagcacttgagcacatgcacaagtatgccacaagcacttcggcaacttacaacaaaaaagttcgaccgacggagctgatgcctggtcatcttgtcctaaggaagaaagcgaacccgattgctgttggcaagcttgaatcaaagtgggaaggaccatacctcatcaagcacaagtccaggacgggatcttttcgattggcgacactagaaggtgacgagttcgaccattcctggaacgccgcctctctcgagcgcttctatgtctagaatgggtggcacccaaatcgccaacttgtaaaaatgtacatatcagccctttggcattatgcaagcccttcggcactatgtaagcctttcggcaagaaaaaaaaggaaaaaaaagaaaaagagaaaagaaactggatgtagggctattatccaccacagaggcccgaaccagtataaaacctctgtgtcctccgccttctttttatttttgtgtgattgataatttgtggaaaaaccccaaggcaaacgcctgatcagcgaaaaaggccaggggggaaaaaccccaagggttcgcctacccaccagtaatacagcgccacgtgtcgcaagggtaggcgaaatggtaaattcccaccaaccgagcagcacagtaaaaaaaaaaggcccatgaagggaaagcccaatactgtttctttcaacccgagaaaagtaaaaatatatatatatgtatatgccaccggccgcaggaggcgaagagcggcaaaataataccagtcgcacaaataacaaaccttattcgcaggaacaatgtaggtttcggcaggagcatcggtcgaaagggggcgccgcataccataccacatggtttgcacggtctcggccgaagctccaatctcaccctttcccgtgaggggcttgttggcggatagcatgaggcccttcgaccaaatctgccgaaacccgtggcgaagactatagagcaagaacggtgagaggcgaggggtcgtgcgagtaccttgtcaagccagaggtgtcccaggcgaagggtgcaaggcgaagagtatctgccgaaggaagacggcttcgccatggcaagttcgcccctgcgagggctgaagaagcctttccggcccatcaagcctaggggctatagggtcggcgatcgcccgacggcccatcaggggcccatgagcctccgtaacattatgtacccctgtaaattttcctttcgtaagggcaactatgtaaattcccccgtataacctaaaccctagtagtaagaatctgtaatagggctataaatagtccccctagggccatgtaatggggggatccaagtgaaaaattctaaatttaatacacttcgtttctttccaaccactgttgagtaaccacgtctttcgacgtatgcggttgtcgtttcgacaatacttactttcttaataaccgtgtccaactttaaaaatgcttatattctaggacagaggaactagttagtatatagactcacatcgaattgtatagggtgagatataaccaactaaaaaccgacttaaatacgaatgacgtacgaaaattctaaccaaaatatctttattttttataatactagaaaaaatacccgtgcgttgcaacgggtaaaaacatttttggattgctatacattatactctttgattttgggtcaaaaactcattttcttccttccttttcagtctcggtccagcccgctacctccctcctgcttgactgtttctcttttgacctagcccacaagtagaactataggcctagctcacatagtcggctgccatctgcttctctttgacctagcccacaagtagaactataacctagctcgcatagtcgactgtcatcttcaacctccgaaagacagtcccgtgtagtacgatgccagaaccgatactcccatcaaattcagtcgaatctttcgattgagggcttttgattcactcaatctccttatgtcgtttttatcaaaattggagtgaatccacaaaactgtgggatataaacagtgacttctaaataaagatggaatctggtgaattaaagcggaactgaaaagaaaaaaaatggggaaaatgatgatgtagtagagggcatttttttacaatcaaatagaggaggaaaagcactaggagattgatcaatgtggcggtggtgctaaggttcggcccgacgaaaaaaaacgagtagataaaaaagaatcctcaccatatacgcacacccttccgcataaaaaaaatatgaataaaaaatagagacgaaaagaaaatggatgaataaaagggaaaaaggcgatggcaaaataaccggaaagaacagtggataaaaaatacggatggaaaaaaaaaagacgaaaaaaaagaaaagcgaaaaaaaggaaaaaaggcagataaagagacgaactgataccaatccgtttttccacatgattttctttacagtcggtgattttttttaacggtcagcctttttttttacccaaaattttttgctatttttttatccggtaccaatcggacttcttatttcctctgtttttctttcgcgttttttatggtgtgttttcttttccgcgtgcccttttttatgttacggattttgaggagtagagattaaaaccgaaaaaaaaaactaaaaccgactcaaacacggatgatttatgaaagtaccgacaaaaacatctttaatttttataattgtagagatcagaggtaattcctccgtttcacagtataagactttctagtattgctcgtattcatatagatgttaataatctaaacactatatatatctagattcattaatatcttatataaatctaggcaatgccagaaagtcttacattatggagtatattatatctcattagtagagtgatcgagatcaatggatcaactgttcgttttatgaagcactgtagccataatactcgaaattatatgtcatatgccaaaatttataactattaccacagcattcggatcatgtaaaatttcatcgagattttaatgactgtcggattatatatgggttaaaaattcaaatttgggactcagatctttggtcaggccggaaggccccacctccgactctccgagcagcaaagctgcaatgttccgcaacaaagtcctcgtgcgcgcccgcgccgtcccctccgcgccacctcctccgttcatcctccgacaactctccttccccgccgccgtccccgccctcgacctcgacatcctctgctgcaggctctcccgccgccaccgcctcgcgtgcctcccccagcccccgtccgacgtcctcgttgtctaccaggttcccaactcttcgcgctagctcgcacccacccgaaaaaagcgatgtgtgctcgtccgtactgttcttgacggcgagtttcgtgctgtggctggctggatgcagagatgccagtcttgcgctgccgcggaggccgtgtcggggatcgcggaggcgttcgagggtgccgcggtgagcgcttctatcctgcgcccgccacctgctcgacgttttgctgcaccgagtaatggttcgtgaggatgtgctggcttgttcggcgttggacgttgtaggttggcgaggaggaggaggtggtttgttcgggctcactggttgcgaaagctgtcgagtgcgacctgcgctccctgatgcttgagcatggatggaggtgtcttggggagagcgtgtatgtcctttcgacgtttgctgatactaaggagagaactgaccaatgcacggtgaacgtggtatcgtaaatttctccctatcagtgaagcaaccaatgtccaaaaacatggaaaaatatttacatttctataatgctgcatgttagtcctttcatttctctccaaaaagtgtcatgtgatttcttgatatgaccatgtgattggatatgtgaagcaatggaggaaaacagtaatgcaaaaatatatcacaaatcatgcaacagcaattctggtcactttctttctacacaagcccatttgcttgacttcagcacagtttagagtaatcttgatgcaaatcaattaaactgactttgtagctaattcagcctgtaaatgtgttggaataaatattaattatcattattttaggtattaattagagttgtttttgtaggatagttttgaatatgttttagtgcatcacataataaattgaaatgtacaccctatctccatgatatgctcatgaaaccatagttgccacctcattgcaattgatttatcaaaacactatatgctctgagtattaatccatcatacatatgtactgctgtgccacatcaggggtccaaaagcccaagtccttcttgtatagtttatttcagtgaaacaagccatgtaaacaatgtaccaagcaagctgtgccatatacccatatctgtgatccgaaagcccaagtccttcttgtatagtttatttcagtgaaacaagccatgtaaacactgtaccaagcaaaaaaaaaaatacagagattatactgtgttggattacaaaataaaaaatagctgccatgccttttgcaccctcttttttcttgcagttaagctatttaattattcggatccactattttctgtcctttatcatttaccttgatgacacaaacttgtacatttgttggtcgaatggttgcaggaagtcaagcttgggagaaatgatgatattgaatttgctgtctcaccagatgcacttcggtttacaacacctaaggtattcttcatcttttacttcttttgccacaacagcagaaaaaaaaaatacagtgaacttacacgttttgctgctagttctctgattttgttagctctgatgagatggaaacatttgaaaacggcaaggaagtaattttggattattgtaatttccgaacagcatgtactactcttccaacccttcaggaaggccatgtgataggtaagctaaacatttttgggactattattttttggtgctaagaaacatttataatttgtcactaattgagcatttcttctttatgccattcctctgtcaagccacattttatgtttaccactgaggttatatagtgtgatagatttactccccccgtgccttttttcctcaaaagacaagaatgcatctgttactccttcctccggccattgtcttcaccactctactgcacatgatcagtgatgtgagaagcaccccacagcgacgccaagcagagaagagcgatgccagaaagttaaaaggaaaatacagcatccatccctgcccagcatggtggcattcgtagctttcacatgtagtcacgcagatccaatcagcatacagctctgctcagctttcatagcttttagatccataaaagcaaaatgactaaaaacaaacaaatgcatatatacacatgatccttgcaagctcctgcttgtgacgagcacactgaaacacaaggctagataaggcaggcaaacagtaccaaagactttctttttgcttaggcagtcgagcgatgcagaagaacttactagccatcctctctctagtggtgttattagacatggattagccctggggtccaaccataaaaaactgaacccagcgcttgagctggtccatggaccgttatttcttctttttccaaaaatggaccgttcaagcagttgaccagaaaattttggcttggacagatggtttctcatccaactgaccaatgtctgtttcttcttttttccaaaaaatggatatgaggctgtggctcaaacccaattcttcattgctgttgcttgcagtcaatgcaatttaatatagcatcgcgtaatatatggcatctgcagtccaactggtgacccaacagttagactgttgaccaagtgaccaagtaccttatcctggtcgatacccaatcagtaagtaataacactgctctctggcgggggggtggtggagaccaggttgccaggaagtggttgtgcccatggcactgtcagaggccctgaaggcctgaacaatgagaatggagtgttgggatacgcgtaggctatgatagcataaattaaaaaattttctaccgcgtaaaccaggaaccatgcaagtattagatcatagatcgttaccactcgacgtgctgtgcagcggaagtaagcgctaagaagccgaagaaacgtcggggacgtagcgtgtgtcgatgtagaggaagtagtcgatcgcaacagcccaaccttctcgtgcgttctcctcgccgtgttcttacgccgatcagcaccgccagacagcggcgcctctgtcggtatccacacgtacaggggcagaacgccacgcgcagatgtgctagcacccgcgcgcggctagggttttgctcgggggaagtggcagctagggtttctcacgtgatccaatcaatccgccggtcacaccccctcataaatttataggatccatgaataggcctccaaggctcgtaggactcctgttaggattcctatccgaattaagcttatattggattcccatccaatccccttattccggcccgttaagcgtgcgaccttgtaggtttatgtacactcggctgtaactcgaa

SEQ ID NO: 2863 - DNA, 515 bp, Oryza sativa
ccccctccccctcggttccctcctgccttgcgcaacgagctagcaccgccccccaccaaccttggtgccagaacggttggtgtcgccccctcccccttagctcgcttcctgccttgcgcagtaggctggcgctgccgtcctctccccttggctcccaccttccttgtgcagcgacctccctccctcttcgactcccctgtcctgccttgcgcggtgggctagcgctgccccctccctccttggtacgtctcgtaggacataaatgggtatttgttcgaaagagaaatgagaataacgaggtagtgagatacaaagcaaggctagtagctcaaggtttcacccaacaacctggagtcgattacgaagaaacttattccccggtcatgagcggaattacctttagatacttaatctcaatggcagtaaatttgaatttggaaatataattgatagatgttgtaactgcctatctctatgggaacttggacatgaacatttgcatgaaggtaccagaa

SEQ ID NO: 2864 - DNA, 885 bp, Oryza sativa
tatggcaatgtgtaggtcgctggaactgaagatggtatcaaggagccacaggctacattttctgcctgctttggtgcagcttttataatgctccacccaactcggtacgctgccatgctggcagataagatgaacaagcatggagctaccggatggcttgtcaacactggttggatcgggggaaggtaaattaaactgttgacttgtttttctgatattatgtttactatgattactcaactaatttgatgtagaggctggattgaattccattaaaaaaaatcatcaactaattagcgagagtaagtacgtacttcgagaattgtaaggatgacgcttgtttgaattgcaattagggatttatatctcaaaatttcaaacttgtgatttaaataataatttatagcactcaagtaggacatataatgtatggtctgacaaacctaatccatttgagtatagtaatattgaaatatgagctctgatctatggtggaggtagaggtatatggtgttattaatcatcaagagatataatacctctactaaaaggtatatacgtacctccaaagcacagaagaaaaacttgcataatcttggcctagacaaacttacccacatactatgtcacactttgtggttgttcagttatggtgtaggtgagcgaatcagcttggcctacacaaggaaaatcatcgatgccattcactcgggtgagcttttggctagaagctacaaaaagacagatgtctttggactagacatccccacaaaagtggaaggagttccatctgaattgcttgacccaataaataccgtaagtccataatttcaacattatatatttttgcatgggatttatgctgcagcttggccaaccattttc

SEQ ID NO: 2865 - DNA, 18280 bp, Oryza sativa
cgcttttttcattgaatgaacagatatagctgaagtcaagaaaagaattattgctaaaataatataatagtatggaataatatgaaatacatgtaccctataattagtactccctccgtcccaaaatgttagcatttttagcatagttgcaaattaaacatttttaattttgactattaatagcaaaaaaataaaaaagatcaataatgtaaaattgatgttactagatttatcattaaagaaactatcataatatgtaaattttttttatttgaaacatcttacttttatagatattattggtcaaaataatatctcggagaccgtgtcagagtccaaaaaatacttatcttttagaacggagggagtagttcttttgtgttccgataaaaattgcttgatgtgattgccagtgacatggcatgaaaatgatggtatattaccaaccgaagaaaggaaaagctaggcgcaacattcaaattttcagaaataaccctcacactagagaaataaaactaaactgaattctcatgaggaaataaaactaaactgaatttcatgagggaatatttctacttttataccttgcaagagggaaaaaaaagagatcataaaatgaatgacaagctgaccggtgtgctctgccaacattttaattaactgcaccaccacttttatggtttattgtgtgttgtacccatagtaagtacctttattacgtggtgctcctttccaccatgtaatggcccttggtgaatttttttgtcacatgtaataccatctctcgtactaattgattatatcaatgttgtcataagtgtcttactcttagtttcaataaccctttttacctgcgatgcatgtctatctttgtattatctttagagttacctcgtaaccattagtttgtgtcttgccgctgaaagaattgtttttaaagaccctaactattactccctccgttttcgttttagaccataagtcgttttgactttgataaaaggcaaactgtttcaaattcgaccaagtttatagaaaaaggtagtaattcaacccaagataaatatattaggaaaatattttttaatcattgatttttggtggtgtaaatattattatcgttttagtgtgtctagattaacaaaggcgttcaacatttcaaatgctaactgtccatcgtactgtttatagctctacctttttgtacgctcctttctccaaagtttgttgatggtacaaaaatctagggatatatagttttaaaaaagagaatataatgctttgtattggctagacacaaaatgttcacaggtattatcgtgagctaataagtcataaacacaacttctcatatacattactctgaaaccttttataatatatatatgtcaccatcctcaaaatgggcattttatttagttttaccgtacaagactaggtaccgagagatgccatattttagtgttaatttacgatacgttttggtactttacactggagaagtatcatgaggtatcaaaaatttacactaaaatgagtggtagcttgagatacatcctcgagtaacataaaaaatcccttttatttagtatacattaagacatgctactactattattcaattaaaataagaaatttggtcctgcagcagcaatctcatcagccagatctctaacaccacctttcttgtaatttgcaaataccttgaaatttctcttgaacagatctgccaactttagcagtatcaacttgttctcgccagaattttgctacgtcatccgtatttgaatcggttttaatctctactattatttgaagatgattctgtactcaattttcgtctgtgcctctctactgacgacacatataaaataaaccggactgtgacttggttcggactcgaaacatacaaggaaaagactaatcaagaaaacactaattacttttggtactctagccgctaatgactctactaataaaccgtgactaacctatcaacactggaattaaaccaacatatcttataactacttcaaaaattaatttcccgttcttcacatcatttttttgtctgatgagtccaatcgaacgatggcctccgttcccacacgcgcgagtaacacatcacgtatgatggataaaacacaaattcaaacgtagatacaaaatccaattggacaataaaaaaaaaaagaaaaacaagaataataataataaatgcacaaatcttatcttaatcttcattgtcgcctgatctgcccgcggaagccgccgacaccactgtgcccatcggatccgcccgcgggaagccaccgacgccgcctgatccacccatggaagctgcgggaggatgccgtcgccgccatcgccactgctcatgctgagggagggcaccgtggccgctgtcgctcgcagtgggggagggcaccaccgctactcgcggtggggaagggcgccaccgccgtcgctcgcggaggggttgtgcggcaccgctcgcagtgggagagaaggggaatgaatctatggttagggtttcaatagggcaatgttttagtaaatcacgagtgatcctaaccgttcgatcaaatctgacggctctcagcacacctacgccgacttgaaccgtggccttgcacatgggccctgtgcacttaacatgccacggtgtggaagagagataggcatccttctaattataggtctaattatgtttattttttcttagccgatttaaactatttctcaattaacaaacttagtttaagctccatttcgagccattaaaaattggtgagatttaatatagtttttcattcttcatactaaatatttctagctaaatggagtcaccaaaaaatgtaattatttatttgtcatgatattgaattagaattaggtatagatttgatacattgtttatgtctgggagtatcccatataattcccatgaaactataaaattaccataatcattatcataactttagttttttcctttgcaacgcacgagcactttattctaatataaaaagcagcagttgtacttttgctaggtgcacccagggaaatatacacaaaacatcatcatcccattcctcagcaatcccatctatttatctaacggctgaaaaaggatgagggtgtcttctgtcttacagtgctaacatgaaatcaccgatcgattacccatcccaacccatcgagccccaactcctcattgcgctatgtacgccgttgcacctccggcctcgcacctacggatccgaagctgccggcacactacaaatgaagctgcgcctcctacctccttgccatgggtcatgagccaccggtggtggcgccagcctgctggcactttgtgcctcgccggggtcactgccacaaaaggcctcactggtctgcaactgtcggcactccccgaggcccaagcgaatcacgccatctccgtgattggcacctcctcgccggacaccgcgtgaccccctcgattcacgcccaaactccggtcggcgatctcctcttgcaacctaagaacacgcattggcatcccctaatgattcgctcccgtgcaccggtaactccatctcgatcctcttctcctccgtgattccctcatcatcaggactgcctgagttgccattgttgcagaatgacagatcaacgccaccttctccaacggtacgcaccatcttctcatctaccgccgatgcaccctcaatctacatggccacggtcgacacctgctctccatcaagaaaccaccggccaactcatgtgagtcattaaatttatcttgctgttttcatctttgtagtcgactgctacgaaatttattctaagttggtattgctaaccatgggctatgtggaagaactagattgattaggaagcgttatcacctcccgtgggaggccgcacgaatatattgattgagccggcaaaacgcggcgagagttacagggagtttgttacataggataagcaacacaaaagataagaagataaccaatctaatcctgaaacttatctctactctaacagcccccctcaatcataactttgacaagttaagattgtgctgaaattcgcgaagtttctgaacactgagcggtttggtgaagccatcagctacttggtcattagtagaaacaaatctaacctcaagaagcttctgcgcaacccgttctctcacaaaatggaaataaacttcaatgtgctttgtccttgcatgaaatattgggttagcagacaaataagttgcacccaaattatcacaccacaatcttgccatggacggacattgtataccaagttcctttaacaaagtttgcacccagattacttctgctgttgcattggccaaagccttgtattctgcttctgtactagatctagatacagtagcttgtttgcgtacactccaggatataagattacttcctagaaatacagcaaacccactagtagatcttctatcatcaacacatcctgcccaatctgcatctgagaatgcatttacaagcatagactgagatttctgtatcttgagtcccataccaacagtacctctcaaatatctgataattcttttaacagcagaccaatgtgtcaaagtaggagagtgcaagaactggcataccttattaattgaaaaggcaatatcaggtcgagtcaatgtcagatactggagagctccaacaatactcctgtaattagttgcatctccaggacctaaaagactcccttcctgtacagataatttttctgatgttgacaaaggggttggcgcaggcttacaggtcgacatacctattctcttcaatatatcatgtgtatatttgtcttgagacagaactaaaccatcacttatcttctttacttctatcccaaggaagtagtaattaagatcacctagatctttcaaggcaaaatccatcttaagattatgaagcaaagagctaacagcatcttgtgacgaacttgcaacagttatatcatcaacatataccaagacaaagatagtcacactaccttttctatagaaaaataatgaggtatcagcctttgaaggactgaatcctaattgttgcagcttcatgcttagtctagaataccaggctctaggggcttgtttcaaaccatatagggccttgtcaagtttgcaaacatagtgtggcttagatatctcttcatactcaggtggttgtctcatataaacatcctcctcaagaatgccatgtaaaaacacattcttcacatctagttggtgcaaactccatcctctagacactgctattgataaaactgttctaatagtggttgcctttaccacaggactgaaagtgtcttcataatctatgccataacgttgtttaaaacccttagcaactagccttgctttatattgaagatgcacttaaacccctagtgggttttggtgattaatgacaaggtggttaaaggggactaacgtgtttatcaagtttattcacaggagtttagtcccaaagcaagttgtgatagctaagaatgcaaggagaccccccaagttggatgttcctaagtgcgaaaaacatcgaaggtgattagactaggtttttctctttcgaaattgagtttaagaaaaaccgtactattaagaggggtttcaagtgtggttctagggtatacaaagtgctctgagtcatatccatgagtctaaaggtttttggaatcttttttttcttggaaatgattttccccgggacagagaggcttacccggaggttctggccagacctccggacaccaaagtttattttctccccgggacagagagggctacccggaggttctggccggaactttcgggcaccgaagtttagctagatttttttttcctgcccggaagttcctggcacttttgcccggaacctcctggcaggtttccagttcaatcttgtgagtaacggctagatgacgtcacctagccgttatatatatggatttcgtccccaggtcaccctttggccattccacttcagttctttcatgttctaggttttctagccactcccaagcttcctttgcttcctccactcaaatctacagcctatcttgtgagattgagagattagatagagtgtaggagtgttttggagatggcttgaagattatgtttgtttgagcactttggataccttgtgggcagtcacttgggcttattactcttggagatcttctcctagacggttaggtgttgcccgtgagcttccaaagatcttgtggatgtcccgggaaagtttgtgaaggttttcctcatctccgcaaggaaacgaggtaagtgagtaaagattcttgtgctgagttttcagaggttgtcctaggtagagcaacttgcacttgtggtcttttctagaaggaattgtgagttggatcttggtggtcactcaattctagaaaatgacctagaagtgttgagttgaaggctgtggacttcttctgggatctttgcataagtgaggcaaggggttaatcgagacccggctctttgagcacctcaacggagagtaggatccgtgtgatccgaacttcgggaaaaaatcgcctttgtctctcttgtgcatgatctgtgtttgaatctgctggtatcttgtgatttacatcttgtgcaaccttgtgcctaattgtctatagctaggacctgttttgcctccccaaattttgattttctctgttgcccggaagttcctggctcaagaactccggaagttccgggctgctcatttctgccaggaagttccggtgttcttcaccaggaggttccgggcactgttaatttaaccgctgcgattgttgagaaaatttcaggaaagcctattcaccccccccctctaggctacatctctgcgcgttcatatatctatctattgtgccatctgcttttcttttaaccttgtacacccacttgcaatcaatgagattactaccatcctcaggtggaactagatgccaggttttattttgtttaagagcatcaaactcactatccatggctaccttccaatccttatgttttaaagcctcttctagactttcaggttctccagtagatgtaaagcagccatacctgacacagccatcagtataaactttgggcttgtgcacaccactttgtagcctagtgtgtggtcgagggttgtttgccgctgtatcctctgccacagaggatcttgaaaccagctcttcctcatcagtgcgcgtaccagatggcgagctcacagtggtcgatgcggcatgcggtgagggaggtggcgacggaggattgggcgacgctggtgcagaggacggcgaggcgagagaatttccccctgcgctccacacgtcagctgctggatcatcggtcgtggcagacgatgattctgacgtcgattcagcacctgcaacggagttagtagcagccgaatcggtctggtgctccgcggcatctattgctgctgatatttcatgtgaaatctgcaccgaatcatcagcaaaactcgcagaattttctccattagacatattttcaggcacagtattttgattagcattattaggcacatggtcacccccagaaaaaggaagaaaaagactgggagtaagatcaatttctttgcgaagaagtgcaccagcattaggatgaagctttgcaaaggggaacacattctcatcaaaaataacatcccgagaaatgtagatgcgaccggtggatacatgtaaacatttaaatcctttgtggagagggctatagccaagaaacatgcattgcgtggatcagaaggcaagtttctttgaattgtagggtctcaaattaggccaacatgcacacccaaatgtgcgaagggaagcatattctggtttttgatgaaagagacgctctaggggcgtatcaaaattaatcgtcttggccggagtacgattaataagataggtcgcagtgcaaaaggcctcatcccaaaactttagtggcatagacgcatgagcaagcaaggctaaacctacttcaacaatgtgtctatgtttgcgctccgcagcaccattttgttgatgtgcgtgagggcaagagaccctgtgagagattcctattttagtaaaaaaagaatttagtttttcatattcaccaccccaatctgtttgcatagcaattatttttcgatccaaaagcctcccaacaagactctgaaattcttgaaatttttggagtacctcagacttgtacttaaggaaatatatccaagtaaatttgctaaaatcatcaataaaactcacataatagttctttctgccaactgaatcagtggcaggaccccagacatctgagtacacaagttctaaaggaacggaggaaatactgctagacttaggatagggtaattggtgacttttggcttgttgacaagcatcacacacagtttctttattggactcgctagaacacaaaatattatgcttcttaatgacttgttgaagaacaaaagaggacggatgccctagacgactatgccactttgacgttgagggtttgatggcaccatatgcttgcttccttgtatccacggatccgggaggaaagggataaaggccattcctacactttccttgaagaagaggtctcctcgttgttttgtccttaaccaaaaagaatttatcatgaagttcaacaaatgctctattgtcagatgtaagacgatgaatagaaactaagttccttttggcttgaggaacataaaggacatcattaagattaagtgcccgaatggaagtaggaatctgggtgtgaccaatgtgactaatatgcatacacctgagccacttgctgtatagatttgttcgccatcattgtacctctcacgcacggagagcttgtctagctcgccggtgatgtggtctgtcgccgccgtatctgcataccagttggtatcgatgttgtagccatggattgctgcagctgcactcttctccggaacaaagtcctcgttgtaacggtaccagcagtcggccaccatgtgaccaactttgccgcaaagctggcaagttggacgattgcctcgcccgccaccattgctaggtggtctgccgccacggccacggtttccgccaccgcgaccgcgaccgccgccgctgcgcccttgttggttgcctcctcatccccgcgaagccgtgttcatggagtgttgggccgcccgacgactcaggcgctcctcaaagctgaggagttgagtgtatgcgtcggcgatcgtcactgctttagtgcgcccagtgatcaccgagaccaccgggtcgtattcttcatcaaggcctgccaagatgtatgcgacaatctcctagtcgtccattcgctttccagccgctgccatctcatcactaaaagacttcatcttgttaatataatctgtaatttttagattacctttcctggttgtggtcatcgccatctcatcactaaaagaattcaataatctgtaatttttagattacctttcctggttgtggtcatcgccatctcatcactaaaagaattcatcttgtggtaattttcagtctgggagcacagcatgttctctagagtcctccagagctcggctgcagtttctattgacaccacctgtgtcaggatctccctcgcgagggaggaaaggaggtagctcaagacttgttgatctgcaaccacccacttggtgtactctggattggtggctttcaccaccttctcgccttctttgacgtcgatgagacgggccggcggcactgtggtgccgtccaagtagcccatcatctgtgcgccgcgaacggccggaagaacttgtgtcttccaaagcaggaagttgtttcttcctagcttttctgccaccggttggccgaacagagaaggggacgccgttgccatgacggaggagctcgccattatcaatctagatgagtttgaggagtaggctctgataccatgtggaagaactagattgattaggaagcgttatcacctcccgtgggaggccgcacgaatatattgattgagccggcaaaacgcggcgagagttacagggagtttgttacataggataagcaacacaaaagataagaagataaccaatctaatcttgaaacttatctctactctaacagactattgtaatgcaattctccaattgagaaagtgagatgctgatggcaatttttagctgaccggacatgctggaaatctcgtggaaacagcaagcatggtaacatatttctgtcttttacccatcccgagatgcttcaaagctattcttttttttggattaatgcgatctctctacatatatttctgatgttgatcttcgccttattcatttcgtgctcttccttctactgcttggaatcaggtattaaatattttctttatgcacacaagttggttgatgaaactacccaatgcggacatgcactggaatgcttccctcgcattctacaactaatactgttgtgacaagttgggtgttgattattacaccaaatgggttgagtaagtgtactaacaaatggagacacaatatatgaggagggactgagtattctcgttcacgttcttttcactacgtacaaaagcctctctcttccctttatatagccaattagtgtaaggcccattagtgtgttgggctggccttcatgggccaaaagcccatgtttctcaacactccctcttgggctttcaccagccaccacatattgcttatgcttcattaaaacggctcaaaaacccagtgggaaaaattggagaaagagtacataacatatgttttgtgtgttgcacggattgcctagttaaaaacattgataagaaaccgcgggaaaacttatctatgggaaaaagagtacgacccacccaattattctttattaggcactttctcattctggactaagtttgacgagtgagtgaaattctctccatgaattttgcacttctctaagtcccatcatcccgatccctcgaatgcatctttcaaaaggggttgccagtaatgatatagtgaataaatctttgagattttaacgagacttagtatgcaatacttcgattttgtttgtcttatgcagttcatgagcataaaaggacttggggttgatatgcttggtgagattgcttttcacttaacccatttgtacttgtgcgacacacgctgcattatcttcatagataattgtaggggtctgggtggtgttcaattcacatgattgctgaatgtggcgaatcatcctacgaagccatacacattcacgagagccttcgtatagtgcaatgttttccgagtggttcgtcgaagttgctacgagactttgctttgacgattttcaggaaattgtcgttcctccacataggaaaacataactggtctgtgacttggctatgtgtggatctgataggaactatctttgtagctccagaatgtttcagtttatgttcctacctattgtctggttataccaagagagatctacagtctaatgaggctactatgaaatatttactcatgggtggggtaagctcttctattctggttcatggtttctcttagctatatggttcatctgggggagatcacaccgaggaatcctaccttccccaaaggtagaacccctctctctttaaaacactatacatttagctacccgaaaaacgaatggtatcccatattcgggctggcctcttcaaggggcctccgctcggggacaaccgaactccggtcttacctaccttcaagtccaatcttgggtaggcactttaggcatgtcctattccctggaccagatccgaatccaaaaatgcataattgatgtcagcttcgataactgatatatacccagcatctgcatatcctacttaggtgaggtcttggttctttctgtagaacagtcccatgtccttgcttcctttaagataacgaagaatgtccttgatgcctttacaatgtctcttagtaggctctgtgctataccctgcaagtaagttgacgacaaatgctatgttcggtctttgcacaatttgcaaggcacatatgtgctcctattgcactcaagtatggatattctgatccaaggacttcctccccctcttcccttggtctatacggatcttggtctacttggagtgacctttcgaccatgggggttttcgaaggatatgccttttcaaagccaaattgttccaacactttctgtgtataggtcgactagtgcactgagacccattcgggggtatgctcaagctgcaagcctaagcaatacttggttttacctaagactttcatttcaaactcagattgcaaatatgagtttgcttcttcaatatccttgactgtcccgatgatgtttagatcatcgacatatacatatattatgtaaaatccatcatgggatctctatataaaaacacaagggcaatcttcataattatttcccttttttctgaggaaattgctaaggcgattataccacatttcccctgactgttttaattcgtatagtgacttcttgagttgtacactatacatatttattcttgccctgtcttagtttgggacaaggaaaccttctggtaccttcatgcaaatgttcatgtccaagttcccatagagataggcagttacaacatctatcaattatatttccaaattcaaatttactgccattgagattaagtatctaaaggtaattccgctcatgaccggggaataagtttcttcgtaatcgactccaggttgttgggtgaaaccttgagctactagccttgctttgtatctcactacctcgttattctcatttctctttcgaacaaatacccatttatgtcctacgagacgtaccaaggagggagggggcagcgctagcccaccgcgcaaggcaggacaggggagtcgaagagggagggaggtcgctgcacaaggaaggtgggagccaaggggagaggagggcagcgccagcctactgcgcaaggcaggaagcgagctaagggggaggggggcgacaccaaccgttctggcaccaaggttggtggggggcggtgctagctcgttgcgcaaggcaggagggaaccgaggggggagggggcgccagccaatcgccagtggcagaaggggagccgaggcaggaagggtaggccgctctggtttatcgacgcatgaggggatgccaacgctgtgtcagaggggccagccaggggggaggacgctgtgacatggagaaggccacgatatgggcttcaaatactcaggagacaaaaatcgaacctaaaaaaacatacaaagtcactctcatacatgcacgtcatacttccttgatgccgaacaaatacgataacttttgtggatcaaaacacgagaaaagttcaatggcatcatcatcaacttaaagtctcaaatttaagtgttttgcaccatgcatggcatactcgtgcacatttcaatgcacaacattcaatactgccattattacatgtcttagggaatttaaaaatgtcctcgacctccaactgaactactaggtgcaacgagtgcattgcgccttgctagtggcctctggaccagcctccttggcatgttgtgccctatccacctttcccgcccgttcctttgcacgctcgttcttctccgcaaactcccttgccatcttcctaagctccctctcctcattcctcttcctcttagtgttctctatagccgcaagtctgagacgatgattgagctgttcctcttcctattcgtgttccctatgaatcatttccgtattgtggggatcaatctccgtgtcaatccatttcacaaagtcacacagaggaggcaatgtcttcggtacctgcacatttcacgatttaaaggatcttcattacaaaatacaatgcttttaggatcgcaacctcagaaatataaaaaattacctccaccgtcttctccacatttcttttctttttctttgccttaggcttcggcttaggcttctctagattgtacgcagagttgcgatacatccaattcctttggtggtgtgtcttgtgatcattgcaaaacgacattcgtcaccacaccaacacatgggacggttagtatccagtggaggtagtttcctagggcaataacccgctgcatccttcctgaacattctacaaaaccaaaattgtctcccgctacgtaaattacattgaaattttatcaatcaccagccttaaaaactaattaacttgacaagcactcaatacccacatatattaataaagtaagtacattaaatttgtcatttttcatacaaatttataaagttatatttaatttcagtaaatttctatcatgcgaccaaatttgtctatccttcatatagtacatagcaacaaatttaacctaaatcaattttttcatacaaccatctattcatgtctcaactaaaaattatcattaccacatatatgtacttgaaaaaaaatcatagcacgaacaagcacattgcacatacctaacactacaatcatcaaatccttaatttcaatggtcaaaataaaaaaaaatgggcaaaaaataggttctagcgttaccctccgatctacaaatttcatcgattaaaacgaaaaaaagagggatgaatggagtattatacctcgctcttcgattttcctaagaaatcccgcgaaaaatggctccaaattgagtagatttgaggaggagaggtgaggggagggggaagagagaggagcagagccacttgggcttggatagggaggaggggcgaatgggtggggagggctgggaggtggggcctgcgtggttaagtacgcacacccccctcggggggtgcacgcttttgacggtcgttatagaccagtttcgaccgtcaatataaccaaaataaaaggagaattggctatgcttgtaatacatatttattttagaataatatattttcactcatacttggagtattatttgtttgcagagattagtacataaatgaagaataaatgaaggaaaactcactcctaagcaagctcaaggataaaggagtccacaggtcaggtataaccgtcctgaaacccgccataactgccagaactgccatgaggacccacctatcagcccctctaccaaatctggaggcttgctgggccggcccaggttcggccgaaccagggattcgcccaaatcctggcagggccggctcagctcggccctccacgtggatgcttcagatgcacccccaatgatgtttgtggggcatttccgacaattccaactgccataaccgtaattgggaggttgtataaaggggtcacttccttcacttcatcacacactcaagcaagaagctttgatccctctgtcaagcttagtttagtgctctagtactaagtggaatagaataggatagttctcggagtcctcgagtcttcggaagatctcggtatggctctagtagcttttctttcttcttttgtaagacttctggaattaatagaatattcttctttatataccttcgacactttagtttgcccgagtactagttttactttagatttgtgccgatatagttgtgtgactggcctaccagagaggtgcagtggtgtgggtttaatgttcatgcaaatgattactctatattattctagagggtatagagtagtatttgataatgtaagcatggtgcttagattattagatattattaattgggcatatatgctgcgggacagtagaggtgggccgctgatcgtgatagctcagtacgggtattcctccacattagtatatattcctaagacaattttctgggtgggtactcctccgtatttagcctcggttggacggccatgataggttgtcgtaagaaactcggcaacccgggtggtctctcgaagcaccaggagggcgttgttaagggggtattggtcaacacaactgtatactagcaaatgtgaactaaagttgagtgtatattagaagtataggaatgactacttttctatttctttttccacgttagtctagaattatttaaatgagagaatctaagtccttctgcttcgtgtcaccctacccatataattaaagtaacccttgcatagattttgatatatatgtaatgtatataagttattagcaaagttctctcttataaatcttcccttgggattaaacaaatacgatatcttgaaatacttccgggtgaaatgctataatggtatatccgtgcgcttgcagattacttctataaccataaatataccagtgctatttttgcaccgttgctggaaattcatattcctagtaatgtcgttaagaaataccaacacacgccagcggtgttagtgctgtggtggaggggcggcgctagcaatattggtgccgtcctcctgccacgtcagcacgtggctgctgtgttggtgttgtccagttggaccacgcgccagcgactctagcgtcccaaaaatgattattcctggaataagttttccaggaatgtatttctaaaataagttccaaggccctcgatccgtgtgcttgcgcatgattcgtcagaggtgtgtttctttgcatactggctcatttcactttcactttattgtatgttccctacatacatagtatttcttcaagacaaatggaactacattattcaatacatatatatgtgtaagaaatgctagttcttcttttatatattatgattttatatattatggtagttgaatgtaagccgaaatcggtaagtagcgaccgccaacactaggttagaacaacatgactacaagtggcatgtattattgtttttaaacaaataaattattatggaattttaagaagcatccattattgatagaaaaacaatgatgataaaacctgcgtatgaggggatcaaactcagtccaatcggcatgctctagcagctccccacaagatgagctacattttgttcttggcttgtattttttttcgcaaacgcgtaaaaggattgcacgctaatataatagacgaaaagagtttaattacaccacgcaatcagccagaccagcttatgctagtgaaagggagaaaaagcaaaataaaaagctaaagctagagaaactacgacagctaagcacaaactccaagtagcgggaatgggcctagccacgctacactcccaacaagtccccaaaagcggcaacgctagctaaagaccacagatggccctccaaacggatggactccaggaccattgagacgaaagagagcgcggagtcgaaaactctagagttccgtttcttccacacctgccaagagaccaggagcaccagggagtcgaagtcggcgcatagatgctcaggtaagcaggccctagaggatagccaacagtcctggaaccagctgccacagggagagagagggcagcccagccagaaggcgacaacacccagaaccagatctgctgagcgaacacgcagtcgaggaggatgtggttcgctatctcaagatcctgagagcaaaagggacaggccgagtgactatcgataccacgcttctagaggagatcagctgtccagtagtgccactggaatgcaaaccaaagaaagaatctgcatttagcattaaaaaaaatactacattcgtccgaaaatataagaatcaaataccgatgatacgttttcctaatgtaacgtatctggatagggagtgtatgaagcctgtctagatacgttgtctcagaaatatcccgtccgatcctagaatcttgtattttgagacggagggaacatgagacggagggaatgtatgttttagatcgatattttttgttatttatgtttatgggtggaattgttggctgtggcaggttttgggtggcataattcatgtaccatacatatattttaaaattttgtttatgtattttacatttctttgttaaaaatcctactaaatatttttaaagtgaaaatatatctctcaaaattagcggcgggcaaaccgcgaacgttacaaaatactaaatattatggcaaagtccctaaaatcctagttgccgaaaaagcggccacttttgcgagtggagcgttacgcaaccatccacaaccaaaagagaaacagaaaaagcaacagcatttccttcccgtttcttcccccaatctccgatcgaaatcccttctactccctactagtatctcgtcgatttcgttccctagccaagcgctccaggtcgtaaattccacccaaattcgttgcctcccccactacccaaccggggcgcagga

SEQ ID NO: 2866 - DNA, 16092 bp, Oryza sativa
gatgccagggccgctcctggcgccgtacgaccaccaccaccgtgggggtgggccagcacagcggctgccaccacggcggccaccccagccgatccatgccgcaggggagttcccgcctgctatgctgcaacagcatccccactaccatggctggggtggaaacttctcgtatggtccacctacccagccgccggcgccggcgccgccgtatgttgagcaccagaaggctgtcaccatccgtaacgatgtgaatctcaagaaggagactctccgggttgagcctgatgacgagtgccctggacgattcctcatcaccttcacctttgatgccaccgtcgctggaaggtgagatttgtgatgcttgtttatttatatacgtacatgtgatgtactactccatacctatacatacatgttgtaatagtgtagcatataacatgatgagctgatgaccgtagctgtgatatctacagtttcttgttaccattgaaatgttaatgtttgttttttctctcatgttgaccttgacctacaatttcatgttggctccttctatgtgttttgtcaagaattttgatgttccctatcttgatgctgatgttttgtgagattcatctttctctatattatgtcacactcaccaagaaataatcgaactaaaaagggaactaaagaatcgttgtagaactgaagtacatttctagcagattcttgtagctgaacagcttaatttctaggggtgataaaggtcattgtggaaatttatgtttttatgggtccatgggcaccctagaattttagttggtacagtatttgtgtttgtgaaccaaggagagcccaacaaatatggaagtagagctgacattatactctgggatgctaaggaattgaggaatttgagcagtatgttcagatcgacaccatgtaggtggagtttcgtttggcttaattggcgaagtttattacaatggtgcctgattaagtgattattttagtagttccatgatgtgagttcgttaatattaagagtcagtttgagttttaatttgagtcggtggtctatatactagcagagtgttttagcaaatgggattaaccaaaggccatattattgtagcattattggacaagattcgcctggcctgctcggttatgttggttttctgcgtgtggttgggcctgtgcacgttggagtccatgctggcttggtctccaggcccaataagtctgctcatagtctttgtgcagagattagattagtttttgctctcgtgtgtttgcctatgtttttgcccatcgtgttgatgtgaaaagaaaggccgtacctgtgcattgctccatgacatgacccttagttcctgctggttccatatattggttaaagttttgcacttttgccatactactaattatgttggttctgcctactggagtgctagccacggttttggtttacttcgagtgctttgttgttctaaccttaatttgtgtcatatatatttatgctttttggactcttcacattgcatccattcagagtaaaaaattgctgctctttgttggtaccgtgaaagatagaggggaatagggtacttgctaccgggtgctcaccatattttgatgttataacttactgacaaacaaaaggatggtaacaataagtgacaagcggcaaagagaattacaacttccattatctttgaaccatcaaaagtgaatgttcacttgcatattgaattctgtttacagaaaattaagcccaattttttgtgggctgggcccttcatggaccacagttggccatagttattaattctttattatgaattttcatgtcatattataggataaatatctgtgaccaacatgccatattgtagaaatgcctaaatggtttcccagcataatttttttttatcaattcttgtagtttgtacgttcttaatatttttgtgggaacttaagatgacattcagttagaagaagtgaatttgtaatgtaggcgccattgctctatatcatgtgtgaaagcttgaactttggagtcaaccgtttacctaattttctggatgatctaggttttgctactgaaatcaaggaattagctgccccagttagtggtgaatgtaaacaatgtagctgttgtttagccaagggcagtgctaggatgtacagaatcatttaaagccatcttttgttaggctttgttcggcagcagttgattgggagaaaacccccttgttatccgtgccttcctgaactgctaagtggtgcattttttacaaaagatttctacaggaaaattgctttaaaaaatcatattaatccatttttcaaatttgaaataattaatacttaattaattatgagctaatggctcaccttgttttgcgttatcttttcaatcttttccttttcatctcctctcaaacacacacttagtcctcactttgttttagaaaaaaatagatcatgcttttaagctatcatattgtgtcttgttgagttattagtgtgcatcttttatggagtagtagaaaaatatcccatgcttgtagttagcaatggataatcagtatcatctccatttcttgctttgtagttcgttacctttagaaacttgttttctttcctgtttctgtcttcggcatcttttttactgttcgtttttctcctagtacctttgtagactggtgtctacattagattgtattttgaagatcaatgtgtagggacaggaggctttattttaattggtaatcactagtttattagtggtgctaattgtttgttcaatcggtataatatttttatggtgatcaaagttttctttgtctgtacattgtccattacatgagttgttctcctctgatgtctaaatatatatttttgcaggaggtgtgtaatcctttactctatctctatagctgtgcatactgtcgactgatttgaagttacttttagttgattttaacttgtgtttcttcctttttttaatgaattgtgtttctttgttgaacagcatgactgtttacttctttgcaaaggaggagctgaactgtaaccttacagcaacgaaagaagatttactcaagccagtcactgtaacatttaaagagggtcttggtcaaaaatttaggcaaccttcagggacaggaattgacttctcgttgtttgaagatgctgaattatttaaggagggagagatggatgtatatccacttgcagtgaaggctgaaacaacattctcaattggtcaattctcagaaggggaagaacaaaagtcacaaactccaaattcacagatcacccaggctgtatttgagaggaaggagaatggggattaccatgttcgtgttgttaagcagatcctttgggtcaatggcacgagatatgagttgcaggagatttatggaattggaaactctgttgaaggtgacaccgaagggaatgatcctggcaaagagtgtgttatctgcctatcggagccaagggatacaactgtcctcccatgtagacatatggtaagtcttgaaacaggctcttgagtttatgtttgtcctttattttactttatgctgaaattatgtcctacaactcttctgttcatgttttacatagtagatgcctagatcgtcatcgtcgtgaaattttcggaatgacaaacccttttgacattttccttatggtgcagtgtatgtgcagcgagtgcgcaaaggttctgaggtaccagaccaaccgatgtcccatctgcaggcaacctgtggagcgtttgctcgagatcaaagtcaacaacaaaggtgaagagcaacagcagcagcagataccacaaccaccaccacctccttcaaccgcgcctccgcaccaacagcaagagtcgcaagcgtgatcgcatttgaacttcatacatattacatacactacttgatgtctggtttgctgcctccatatatacaggagctccccttgaataagtggaaaacagggagaagacatgtgcgtttttagtatatgtgagcacaaaagcttgctgcgcgcggtggcttgcaaacttgcacttcagtgctgggtgtgctgaggatgggttagttaataccctgcatccatgaaaacaaggtttgtacataaattctctctacttgtactactgcgacagaaattctcacgatttgtattactgcggctgatggaagtggagtgcgtgtgcggtattggctatagttctgtcgttaacttgccctttgaggcaacagtatgcgtgtaattatctggcaattactcccatcaaacaagagctaaatggatattatttccccgtcaatggctatctcatgtatcagcgatcaaatatatctcactctggtcctgtgacatttcaagtgtcgatggaaactgatcaagagaaatatttgttgcgggactttacgaagactaaagcaaatcaaatcaaacatacaaagaatattgaattatagttaaaaaaaaggacagcaaaattatttgtggacctgctctattacagcccgtaacgaatataatgctaaaagaacgtatgatatgcaataaacactttggaaaggatcgccaaatttgatactatattaaattacacagtaattaatgtttgtaatgtacttcctaagctgtacgacaggaatactattactgtacgaaagaaataatatttgtattgcacagtaattaatgtttgtaatgtacttcctaagctgttcgacaggaatactattactgtgctcccttttctttttctgaaacatgcctagcttaattatattattcacgttgccacgtacaacgacttttcgtcaggccggcgaatacagctggccgaagtatattaagagaaaaggagaagctatacaacataccccaacaacgggcacacgctcgtagtgtgtcaaagcaccgcctttataaacttatttacaagggctaaagtctccctaatgagtacacttgggcctcggtcgtcggactaataaggccggccgacctccttgtctcctattcttctgccatggtcgcacgaagttgaggcaccatggaggcttttccgttgaacacccttgcgttactctatttccaaatcaaccaaattacaaggatgaccctgacattgcacgtcttgcaatcaattttagcaatagactttcaggtggagaaccaccagcttggaaaatctaaggacggcgcacataatgcaagtcccaagcaatcccatacccactcccacatttgctgcgttaaagagcagccctaaaggataagttggcaagtctcgccgtcgttcgagtagaggtggtatactagcgcgaggtgccacccacggcgctgcaggttgtctgcagttaggcaagcgctgcgtgcttcaaggaacataaagaacttgcgtctcaccggcacaagagacttccagatgatcctgccaagcgggcacgccgtccttccgatcgacagtagcgagtaggctagctgttcgcacagagaactcgccatttgacgccgccttccatacaaccacgtccctgctcgtagaatcgagggagattcttgcgaccatatctgaaagcaccagatactccccaagggcttgtatggataggccatctctaatgtctgcgaccgaggaatgtcatggagggcagaggcaaccgtaattacacagtacttgatgaaggagaagagaattggtactatgttttgcgctgaccgacccaccatcatgcagctatttatcctttcaacttgatgcctgatgcgaaactgtgcaacaccttttaatcggccagcggcgcaaaccttgtccacaagcactccggctgtgttcggcacaacgaaatccacatacaatgacttgatcagtgaagcaacagcgcaagctgcagcatgacaaatggcctgaaagtagataaataatgttgctaacccacggcataccgttggaacgacataattattagtcggacccctcagccctagtgcgcatggtggacgcacttcagcttgcgtgcatactgtacatcttttttgaggggaagcaattcacgcacactagctaactactactccagtagctagttctcctcaccaacttaatgtacgtgcatgcatgcatttgccatgggtgacatgacaagtgctcctcactcacacacccctagattatgaatgcctgtccttttgattgcacataactataaacttctctataacggcgtgcttagtcatttaagatgctgttgttatagctagactcagtggcatgggctgatgcctcactatcttatagtatgaaattttttccatcccaaaatatgactatatgtaatagtacctcgaaaatatcataaagtatctagcatgatacatgtgggtagtagatcaagtacatatccactttgatacctatgtgtactactaagtatcgtaaactatctagcatgatacatgtgggtagcagatcaagtacatatccactttgatacctatgtgtactaagtatggtatatgtgggtctgaattttaacatgtatgagtacgcagtctgatacctaggtatcacgtataatacctattagctctggtatttgttgtactaagcatgaaacatatatgtattaggctgatatatgtgggtacctacatatacttatagatatttttcccaaggttcttgtcatatttgattccttttttttactgaagaaagccggatgtagaatttggacaacttgtttattcaatactcctttctaataagttccagcaccctaacaccttttggtgattgagatcaaacacatccaccaacaaaaaaaaggaggggcgatacctttgtcgtagtcggcagccatggtgtcgtcaggggacggaggtatgcagcggtggagaggagctgacgcggaggaggcagcatgcgcaggtgtggggagtagaacgggaggtgcttgggaggcgcatgggtggaacaacgcggtagagcatcgctagagggataagcgatgcggccgcgttggaggtggttccggggagaaagtggagtggagatgtggagggaacgaccgagagatgggggttggggggtgggggaggggggacgcgtgcgtggcatggatcggggctgcggcagcatgcgaaggaagagaaacgcgatctaagccgttggatttggcgatccgacattccgtatttcatgtgtctatcaagtttcgagtcaccatcatcactacgttttttttaagtagtatagatattgtgacactgtgtgatcaagtgctttagtaggctcagtgtatgaagtacttcgctaaatggcatcattctgcattcaggcatcaacttctagagtttcagacatgacgccactgaagttgaacttgaaatgagtgaaatgggctacaagctacttcacaatttcttcattgtcttgatttgtttttcagtatgatgattttaactagaagatttgagctagcataatgtcaatagaagcacgcatgctatccagcttgcagcttgctgatggacgtatgaactagttcaaaagaaaaacaacttctaccagttactaacattgcgttgaaatattcttatttacagcaactccctcatcagtcttcagaacaaccagaataataaatgaatcccataaactaattaagactcgatctcgtcaaagttccatcgacggaataatacatgatactacgtactatcttagagtagttaagcaaaggtatttttttcgataatggaagctttattaaggctcagccaaatacaccaagatgatacattccaactgagcccaccccggcctctgcataaaatgcacatagccaaacaaaatagcaaaaaagaacatatctagaactccatcacgagaccgagatattaatgactatctattagatcaccacagatactcctgggttaaaaactcccgtgccacctggcccaaatgtcgcgattaccactgtaatagtatccgaagacccggtttgtgaaggatagcccaggtgcgaatccaccgggtgactaaagtaataacctataaaggagaagcaccaacttgttataaaaaattaccctaattctgcttatcaaaatggaccaataaatagctgttgcacccagtaaaagtagatttctcatgtctttaggaaacatgtaagccaacgcccaatcatatgaatcacatttcgtggaggttgtaagttataagccatatgaataaccgaccagaccaagcgagcaacatgacattggaaaaacaaatgttgaacggtttcgtccttataacaaaatcaacatttcgtaccacctttccatttgcgcttagctagattatccttggttagagttacaccctgacgtagaaaccaaaggaaaatcttcactctaagtggtaccttaatcttccaaatacgtctattgatattcgggatacccatatgaacaagagctatgtaaagagaattgactgaaaagaccccataggcagtgagaatctagcgaaattcatcttgctcttgtgacaacaccaaatcagctatgcgaggtcataagttatgccaagcgactaattttgctccgattaattctcatccccatgaaaagcttggaggattttttttgaaagatttgtgagatagttgactgtttatgcctagctatgttatagagacaaggataatgatctctcaagaaggcattacccaaccatttatcctcctaaaaccttatttgagagccgtctccaatacaaaaggacccaaacctaagaaaatcttagttggctttcataagactagcccaaaaaagagtatcccgctttccaaaaagcctgagataaaggttgtgatcccaaatatttattgcgtagcatttgttgccactttccgcctatggtgagcaatttgtatagccacttgctaagtaaagctatattctttattttgaggtcgtgaattcctagcccacctggatctttgggatgacatataatgacccacttagcaagccagtatttattcttatatccatgcccatgccaatagaatctagatcgaaggtagtcaagtttcttatgtacccctgtagatattgtaaggaaaggcatcatatacattgggagactactaagtactaaattaatcagagtaagtcatccttccaacgagagaagttttcttttcacccgagtaagtcaccctcccaaatctttcaaccacttctctccattcctcatttattaacttcctgcaatggatcgggatgccaaaatatcggaaagggaagtagacaagttggcaacccaagagttggttatattgatctttatattcaagtgcttcaccaaagcaatacagttcgctttaatgaaagttaatcttcaagcacgacatttgctcaaaggctagaagcaccgacttttgtaacgccctgaaattaccctaatatttaaatcgtgtcttaatgcattttctagaaattgtaaaagctaaaaagagcctataacaattaaaaatcaccaagattgaattcaaaatggcttgtgggaatttttcttaaattctcatgcctaaatattcttaaacaaattttacatgaattttcagagcactctaaacaattttaatgcaacaataacctttctcagagtgtttataaaagaaaaattaaaataaaatcctctcctcctcttgggctgcttccggcccatctctccctctctccctctctcggcccagcccagccgccctctctctccctctcccggcccatccagcccagctgccggcagtcgtcttcctcctccagccgaccggccgctcttccctgtctcccgcacagaagcgccgccactgcctcttgatctccttccccggccgattcccctcccgattgagtgcaaaaatcggttcctctcctcctcttcaattcccccataatttcccactccatcccgcattattcgcagtggattttgatggcgttcatcaatggtgagctccactgtggccggtgtcgatctccctccctggcgcccttctccctcccctccggccgataaaagggagccccaacccccttctctctccccacacactgcccgttctcctctccctctccacggccgccgcgctgttctcttcctacgccgccgccgtcgcgcaactccggccgcccctcgccggtggacggaacctcctcggagcccggcgtcgccgccatctgcttcgccgcttcctcctccttcccgtccactcctccgtcgagcacaaggaccacgggaacgacgacaacaccgacgacccgaagctcctcgtcgtttctccctcatcgccggcatctccgtcgagctctcgccgccgcgttcgctcggtgaggaccgtcacctcctcccctttccgtttttcccctttccgcactctgtcgcagcgccgccgcgccgttggccgtcgccggcgagccgccagtttctggtgccactcctgcccggctgtgcctgtgcgccggtgcgccgtgagctgcccttgtgcgctcggctcacgatggaccgagcggctggcaagtgggacccgctcgtggacccggtccatgtgcgctctctctttctgttgcaatagatcaatttttctttagaaaaataattcacaaaattgtaaattttcatttaaacaacacctaaacttcaaacggtcatatcttgaccgttcgaacttcgaatcgacccgttcaagtctctaatttttccctataatgttaagaacctacttttgtgccttgttgtactattttgatggtttctcttagcctagtttcttttcccttgtcgcgtagattccgttgtcgtgccggaagatctgttgttcgtcgcagtggaccgcgaagactttgtgagcaatcaaggcaagtcatatcataccttgaacatgttgaatcctaatgttgtgaaaattatattgttttactattattgcattgcttttataacctatatcgtttactattgtttttattagttattattcctattatccttgttatagccatattgatttgatatccatgtccttgagaaccctaggtaaaataaaatgactagtcaagtaccctatatgttggacttactagttactttaggtttatgcttagccatacctagattcaactttagaatttttggataatttgggatatagtaatctcaacttaaaatcttgattaagtgctagatcatcaactaggtagttgatgggtgggagaaatggtgttttctttgcgaaaactaaaactcgttttggggctctctcgggcatctgttgcgaagccttatcgtacaaccacaagtttgataggtaaggcctgaccggaagtttaatctgtctcaagatagtgaaactcaggagctatgggttgtgggtcggtctctgaccaagtggtgcccagtcgcgacggccaatcccatcctaaggaccaggggatcggtaatcaggaggcgagtgctttagtgggttccactgaagggtaaccttcaggagtttcattgtttcgaggcgaattatatgaaaggtcttggcatggtctccgtccgggtaccttcgagtatcgcggcgtatggtggacatgacgaggaggacgtgccttgtggctaaagttgtacacctctgatcagagttaaaatctattcgaatagccacaccctcggttatgggcaagcctagcaatgttactccaagttggtcccgactttctaaaacttgggaggatggattcatgatggttttcagcaggtggtttaacctaggctggttgcatgggctcgcaactttgtgaactgtataattatgacttagatcaggatcgtgttttaaactttgctttaaacttgtgaactattggaactatggctttatgcaaaatgaacaatattatgccattcctttgttacccttatgcattattgtgcacctccggtatggcttactgagtaccgcgtggtactcattcttgctcacctctacttcagaagttggatgctttggaggagaaggcttggactgctagctcgtaccgccatcaagtgcctgtgtggatgctgctttcgtagacttccactatcttttttgtttatctttgaatgtaaaggcctatgctcactgtttaataaagtactctatttatgcttttgcaagtgtggcttgtaatacaacaactttgttattgtaccccgccttcctgggacggggattaatacaatgagcgtttgggaaaatgggtgcatttttccgggcgtgacaacttcagattttgagctttctgtaggtcatggttcataaaaagcaccatgtcatcggcatattgtagtacggacaaccctccatcaatcatatgcggtatgagtcatgctttgagcatgtttatcaaggtggctaacatgtcagcaaaaaagttgaataggattggagagacagagtctccttgctgaatgccttttttaatccggaaaaaaggctcgaagtcataattgactttggccgcaacaattcccctgggtatgaaagattcgatccaagaaatccacttgggcaaaaaacctttcattcgtagagtttgtagcaaaaagggtcatttgaccatgtcataggccttttcaatatcaatatttaaaatcaccccattcaaccttttcttgtgtagttcatgtactgtttcatgtgtgatggctccatataggatgtttcacccacgcatgaaggcagtttgagttggattcagtacatggtttacttccgagataattcggtttgtggcgaccttagtgaataatttataactgacattcaacaaatatatcagtctgtactattggattcgatttgcttcttcaacttttggaattaaagtaatcaccccaaaatatagataaaaaatgggaagactgccagaatgaaattaattaaataaattcaacaaattatgcttgatgacatcccaaaatttttgtaaaattaatctgggaaaccatctggacagatagcttcctttgtttcttcctcttagaaaagggcagtaagaaagtcattttcagcttatgtaacctaaccatatcatcagatatgctctcatcaagtgaaaacaaattttcctcaggtggtccaaagagtttcttgtaaaaattcgtaatgtacgttttcaacgcatgaaccccctgaatttttccttcatcctggtctagaaagaagatcctcttcttcctatgtttgccattggcatcaagttaaaatattttatattattgtcccataggagtgcatccgagacttttgagcgtaggtaccatttaacctcctcttcacgaagtaggcttgcaagattatccctcgattaatcaagaagattgttttcttgatccaaaaggagtcgaacctctgtaactatgtcaagtgactcaatggcctgttgtagatgagcttttttctgttctaaaatgccattggtatgagcggaccaacctataagatgtctgcgtaaagcactcatcttattattccttcttcgggctacatcccgaccattgactagcctattccatacttcgataacacattcatggaaatcatcccgcagaaaccaactgagttccaacttgatctgcttaaggttaccattgaaggtcgcttcccctgtatcaaggaatagaggtgtgtgatttgacacccctctatatagtgcatgaaccgaaaccagagggtatttagattcccaatctgtggaagtgagaaccctacctagcttctcatatgttagtgtaggaagcaagtttgcccaggtgaattgcctgcccattagagtgatttctcataagtcaaagctatcaatcacctcaatgaagagaaaggccatcgagcgttgtatcgatcattgttgttttttgcactactttctcaaaatgttgaagtccacccccccccccccaaaaaaaaaagggtcggtggatgattttgttggcatgtacttctccaagaaattggatttaaatccaacttggactggaccataaacaaccatcaaaatccatttaaagttatcctcctattgttaagatgaaaattaacaaaaagaaatcccctttaataattaaagatagatccaagacaaacgcgttaattccaataagtataccccttgatctttctttaggtggaagacaatgccagacaaaatcagcacctccagaaaggctatctaaatttatctttgacattttaccctttcttgtctcaagcaatgcaatgtagtctaacttttttttctctaactatctctactgcaaacctatatttagccaagtttgaaagacctttgctagtccaaaaaatacccatcatgaggaaatcattgtagagttttttggatttttggaacgagacttccacaatttcctttttgaagatgatttggtttttccagtgaaaaccaataagtcacaaattatatcaatctccgaaatatcttttactaagcgagcgagtagggcgctgccaatattgtctccctcgtcatcacttgacataaaaggatccacctccgacaaaagaatattggtttgggtaatatcactagacttgtttgctactttagttctatctacctcaatatgtttcaaagcatttatcgagaaagaaacaggaacaatagaagcacccaaagtaactcctaaagatctaagattggcaacgacattatcaagaggtgacggtacagaaagtgaagggctagtaccaataccctgatgaagggatgcattatgggaggccgagtgcagctgagtagtctgtgccgatacctcctgtgcaacaaagctatcatccatattgtgccctcttcattgccttgaccagtgaatcctcatcccctctggccatgccatccaagttttcaaaattggatcgcgcactatagcagcggcgtgtggaatttgcaaccttgctaccccttgcatccatcaagcggggtacaggagatggagaaaagactttcttctgagaaaccagagaaaggacagcagtattccttgctgctacagctgcccctggtgtaagcgaatggaggtgtttcgaccctgttatcggcatgccaagttgctagggtggagaagggcagccgaccggtttaggtgtgcaagtttcaaccataattcttggagtaggcctagctgcaatgtatgctttcccatcaataacacacaggtcgaggtgtggtgaaggccagcactttccaaaaggagttaaaaccagctgcatggctgtgaccttagacgtttgctcctttcgagaggttgaatttttttagttctttgccttcttatgtgcctgatctggacgaccatcctttgacgagtcatcttgatcctcctgtgcatcccatcattatccatatgatcaaactctaagatctgagctaggcagaaattctctttcaccaaagtataagtaatagggtaacccaatttccaaagacgacatctgttgtgatcggcaaaaccacaccgctatgaatgagaaccttcatgcgaatcaccccatacgtctataggtgagcatgtcaacctcctatgccggaatcacattgtgacatcccggaccagggattaataggattaatagaatactcatatcaataagttgcaactttttccggaagctgatctcgaaagaactctaaggttaagcgtgcttggcctgaagcaattttgggatggctgactgaccgggaaattcttcctgggtgcacacgagtgaggacaaagtgtacaaaaaagacttgtgttggacttgtgttgggccttggagaggcggggccttacaaaatggtatcagagcagcctctcacggtttcacggccgcgtgtgtcgcacaaaatagtatcagagccgctgccagatgtaaatgggcctggcctgagagaggcggggcgttacaataagtgggcctggcctgggagaggcggggcgttacaaaatggtatcagagccgccttcacggtttcacgggcgcgtgtcac

SEQ ID NO: 2867 - DNA, 363 bp, Oryza sativa
atgaggtagtgcatcacactgaagaggcctttcttcatctctccagcatattgtgttcccaggatgaccatttctctccgcttaagatttaagtctatgctagttgacgatgtcatgtaatgcgtgtaacggttgcacgggaactgtccagcattgtagatggtgaagtcgggctcgccaaaattctctagttcctcgtatgttggccggatgcacctgtcatttacaaagaaaagtatttatatggaaacgcactaccagaatttgtactattctcaagtatcatgttgaataattggaatgacttgtaatatatagtaactactagaagcattaaagattgaaaattctggtagtactatt

SEQ ID NO: 2868 - DNA, 752 bp, Oryza sativa
ttccataaacctgtcactcatgcaccacaattttttttaaaagaaacattacaggattatatcaccaaactgcagccacaacattcaatattcatgaaggtgtgatagccctagcctaccttatcaagggagttcaagtagtcaacagctctctccctgttgatcagaaaggtttgctcgtccatttcaatgtttggtgatccccttaaataagtgaaaaaaaattatttgttcgctcaactttatattgtatggactataaatttggaaatagttttttaagtgtttatcatttgctctggtcagggatgcttacttgccccaccacagatcatctgttgtttcatccttgacaacacgcttgtccctaggtgatcgaccggtctttgctcctgatagcgtcgctaacgccccactggatgtgatgaatgaccctttctcatatttgattgcatgctcataaagttctacacagcaaagaaaaaaaaaaaaaaaaaaaaaaaaaaaccccccgagagagagaggttatgtaaagagaactcagcatagtaagatgtggattttctaaacctgtgtgcatgctaattagatgagacgtaagttgtaatgcatctatcattctatcaaattttcattgctgaaaaatatggattacatatagaagcaaataatagaaatagcttttacggagtaaagtgaaccgtttttaatattttaggatgtaaaataagccaaaaaataatttaggagtt

SEQ ID NO: 2869 - DNA, 5509 bp, Oryza sativa
caaagacgcactgtataattcattgtaaatatgcatagatgtcaatccatatgaaaatgatagccacatgtatttgttttacagaactaataaccacgtattggaattgattgaagtatcgaaattaatactttaagtataacagctgtatgcatgcttacatatgtatcgatattttcctcgtataaatgtgattcttaaaatggagaaaaattatcacaaatttcataagttcgttaagtcgcaatgaccacatgagagtcacaaacaggtactttctaggaacttaatgtgtgttactttagatataaaaactataacccttaaagaactgtgtaataaaagatataatggtataaataaattttgtgaaaaatcatcttatatcatttccaaataggaaaaatctaaacatgtgtacaataaatatcgtgccatagtttcaaagatattgcacatagttagcatatagttgacgaaatttaacaccatcttagaacatatgtaccaacccgtctacgcaatcaaccatttatgctatactatcccttttaaaaaaaataaggaagaagatgcaggatatagttctaaaatgtatgttgctctctagttagtactaaatggtatgttggggtttgctacttcattggttttcataagcacactttacagactataaatggtatgtgtttttacaaaatcatttctatataaaagttacttttttaaaaaataaatttatttttcaaatttacaatagcgtgtactccctctgtcccataaaaaatcaatctgaacatatctctgtccagattcgttgtattacatccgatcctatattcttttttttagaacggagggagtacttcattaattatatactaataatctcattttccgtatcagagaaaacagccccaacctcttttaaactcagccttagtcggacccaaatgatcatgcaaaacttccacgactacacaaccaattctgtacaattccgaccattttaaaccccagctcactgatcaccagacatacacccaaaaaaaattaattaacacatgtactgatgtacaattccattgatatttctaacaaaattaaatgaacggcatgatgtgcatgcagcaaacgggagcatcaaaatacatgacctgatggactgaagctgcagcctgtggcgatcctccactacctgaggcttcctctgcagcgagtgtagctcgtcgacagtgttcgccctcaccggtgtcgcgctgtcgtcgtggcacacgccgtcttcctccctcctgctgccgtatccgttcgtccccagccatgcttgcccgtctttcgcctccatcatttcgatcccttctgcaagagccaaaacaaacagaaacgaagcaactcaagaacagagtaatcgcttggtacaatcttatgatcgatcatatagtaatgggatgcttacagaaatggagcgagagtagagatgctgaagagagaaagactgaagttttcagaatgtggagaaagccatggttatgttggccttttaaacttgggaattaatggtaacaagtgaccaagaagctgcctgcggattctgacgaccagcagttgggttcttcaggcggcgcgcaccatggtttctccacgatgcttatcccctgtaccggtccttccgttggtacggatgccctgtcgttctgtgtgatgaaagcacagatgtcctctcgcctgagaaggggccaggtaattccggaaggaaaaggatatacgtgtaaaattataaaacttttacgaacaagctgtaagccttaactcccatatatagttaactcccacgtgtaattttttatgtacgtgttgtatgcatgcatattatgaaatgagcaccactacatgtaaacatgcttgaaaaaaatgtaggagaaattaaacgtcccccgaaggggcgggtacgcacatcctaactgaacactaaagccaagtctaccggttgaactaggtgagctaagtatatatctgtatatataccacctaaccattccgcgcaaccacataaaagcttatatgtgctggttgaaaatgggtcataggtgttaaatttcttagtcgacacccctcaagtggcactaataactttgtcattggtgcgtgctgattatagaatcggcacctacaatactagataggtgttgtttttaacaaagaactagttctataacccgactgttacgtggcagccatcataactgttgaatctatacaacaatcggcacttataatagcatataggtgccggtcgatggacggccttgaacatggcagcaactatagatgctagtaccaaaaaccgacacctatatgtcggcttgaaaaataaaaatgacagggcctactaaaaaaagataaaaaaaatttacccctagaagaaaaatacaatattttttaatttcattccatatatcagaatctaattaatatggcaagaagttaaacacaataatatatttattaacccagttggtacataatttatcatttatttaaaaccgtgcagaataaataaaatgaggattttatggtttacatgtaaattggaataacaaaaatgatatatatttaataatttaattactataacattatattacaccactctatactactctgtgagtattatttgaagcatctaataataaatattatgtacaaagccaattaatatcatgtcaatacttaatttcaaaattatcatgtggtcatcgaggatgaatctatggagtaattaaatgaacacaaaaaagataaaataaatttaactctacaagaaaaatacaataattgttttggttatgcactttatatgtatagcaaatggttgaattcaactgcaagagagaaatggagtgagaaataatgcaaactaaccttctagctgatcaatcaagaatgagaggcgtggtgtgaggtcatgtgtgtcaattcttaattagaatggctactttagatggcatctatgactgacggtcatcgtaggtgccggttttaaagtgggcccccaaacggctacttcgatgggacaggcctcaaaggtgccagttgctattaggaaccaacacctaggcgtcggatctccaaaatggcaccctgcggacgtgcactcgggtgtgaaaagtactatagatgtcggttctagtatttcgtatttctgacacctatccgacacctatagtactgtatttttttatgttatatagttgtgtgtggttacaagccgattaatggtctttcgttgctctaaaaccacataagctcatgggttagtgatttttttttgttaagtgcatgttttggataagtggattcatctataactttttatagaaaccaatccaaatgagatttgagagttttctatttgccgtataaatttcatcagaggccagtgacgtttcactggtatagaacaccctataggtgctggttgggaatctcacataggtgccagtttcccaactggcaaccgatgccactaaggcaaaactaatgaaatcataggtgtcggtttagaaattagcacctatgacgtccacaaatctaaaaggaaatctgagcagctctccattatccaaagcatcccgcatccaagaaaacattctttgacataactaggggtgaaaacggggcggatattaatttcccgcccgcccgactgacccgaggcttgcgggaggaatatgggagagaatgggatacccgatattatccgagttcgaaccggaatccgtaaaaaaatatgggttaggatacgggaagagttatatccgcccgtatctcccatattaggaaacaaatgtgaatatctattataaattcacctataaatatgataaaagattagttaatcactatttttataagctcacatgtaatattatataatttgttccttgatgcatcttttttagcactttaattgtcttcttacattaaatatccatgaattggacataaaaaaatatctgttcccgaatccgattcgaagaaagtaatatgggacaggatacgggatgagtgatgtgttatccgacactgcctgtacccgattctgaatttaaagtaagatgtgggttaggatatgggaatgttgtgatccaatcaccgtacccgccccgttttcacccctagacataaccatactaccatccatccaacaacaacacaaagaccccgagattgaaaggtttccaagaacatcgaagaacaaattaagttacataatcaaacatcataggtcaccttccaagaattcatatctagaaggacgagaacgacaccgccaccactgctcaccctagtgaagtccgcccccgaccgccgcttcttgctagtgtgacgaccactgccccccacccttggctagatctggccgccctcaagcttgtagctaccggatctagcagttgtcgagcttgtggtggccgtatctagaaggtcattgtcacgccccattttttgggattaaaaatcattaaataatgtatttctagaaattatattaaaagtaatgcaatttatcaagtgaagttaatgtgggaaataaaattttctttcaaaatcatggctggaaatatttttgtaatattctccatgccctgatatactctatgaaatttcccgtaaatttttggagctcaagaagtaatttcaataatacaaagttcattgaatcaattaaataaattgaaaacaaattagaatccttctttcattgtttccggccaaagtctactgttggtatttggtcacagataaatccgcaagtgtacggataccgctgtagcacattacctcagagtattccaaagatatcgaataagtgggaacgtgtgtatatctaagaacaggattcaatccaaggacaacaactgatgataggataggctagacaacaaacttaagtttaatgtaaaactctatcgaatgcttcaagcatcggccctcccttggtctgccaggctgagttcgtccttgagctctatgatatactcgaagagggagggatacaaaatactgacatggctatcaatacctgccgcctacctcactttctgtgaagcacgcaacaaacgaaggtaaccattaacctagacatcacacctaagttattgacttactactctagtcttgcgtagaaactttcttttttatctagagtcctagcactagactagttaattataaactaagcgatgaacccgtatcgatgagaatatatctcacttaagtaaactaactaaatggcactaaaaaatctcaaatacttcctttataaaagaaccatcgaccgaggtacaagcaagagcctgacaactccagtgactctgatgtaagaataccgacaaacctaaaacttctccgaaaattctcgaagagaacaacgataattttgggcactccttccaaagattctttttgaggagcgaaaccggtaatcactacgatcgtgcccacg

SEQ ID NO: 2870 - DNA, 676 bp, Oryza sativa
taaatcacttttaataattgactaatctttgatcatgtagctagctagtgctttgctactccgagtccatgtgctcgacgacgaagctgcggatgaggcggacgagctcgtcggcgcgctccgaccacggatccacctcgaagaagccgtgctgctcgccggcgaactcgacgaacgccacctccttcccccactcctcctcatccgccgcgcgtagtgctcgttccggtccctgaggatgtcgtgctccgccgccacgacgagcgacggcgccatcgccaccgcctccagccccggcgcctccggcccggcggggttcagcaccgggtagtccctcgtcgcgccgcccggcaggatgaggcgcgcgtacctgtcgctcatctcggcggtgaggaacgcgccggggcggcactccagctcggcgcgcgtccgcgtctcccccgccatggccggcatgaggagaacgtgcccgcgcagccggacctgcgggccgagcccggccttcccgaaccgcaccgccatgtggtgggtgatgttcccgcccgccgagtcgccggcgacgaacacccgggagaagtcggcggcgtcggcgagccacgggtcgcgcgcggcgctgtcgcgcacccacgccatggccgtggcgccgtcctcctgcgcggcggggaggcggtgctcc

SEQ ID NO: 2871 - DNA, 188 bp, Oryza sativa
atcaaatcgtcaacataggtaaacaccaccggaatcccaacaggctgaggaaggtcgaggtgatcagcccgccgatcaccaccgtcgccatcggcgagcggaagctggcatcgacgccgatgccgagcgcgatcggcagcacccggcgcccatcgcgatggtcgtcatgacgatcggccgggcccgct

SEQ ID NO: 2872 - DNA, 27501 bp, Oryza sativa
  unsure (1)..(27501): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcctcgtgcttcacatcgtcaaacggtcaagcgaataatgaggtatttgaatcatacacttgagtttggaatttggtattctacttcatcttttatatgcttgagtgattattccgatgctgattttgctggttgtagagttgataggaaaagtactagtggaacatgtcattttcttggtacatcatagattgcatggtcttctaaaaaacaatctagattgcatggtcttctaaaaaacaatcttctaaaaaactgtagaatcagaatatgttgctgctgctagttgttgttctcagatttttttggctaatatcaactttgaaagattattgtcttatttttgagaaagtacctctcttttgtgataatactagtgctataaacattgctaagaatcctgtacagcactcacggacaaagcacattgatattcgcatttactttttgagggatcatgttgagaagggaggagagaatccattatatgccactgactttgtcacacgtctacgatttgccgctgattttatcacgttctacaatatgccatcgacttttgcttaacttctacgatttaccatcgccgtccagttagcctccgttagtactgtacaaatttgtcgaaatgaccaaaatacccctaggacaaaaatttccaaaatttggataaaataatcgaaatatcatatggagggtgagctcggcgtcgccatgtcgaggccatgcgtcgaacacagccgacgccgatcactctctgtctctcccgcattcttgagcggtatgggtgagagggtatggtacgataataatggcaaaactgtcattttgtgtggtttctctcctatcaattgggtggcttctagtgtcctgtagcaaattatcgattttttttgagaattaatattatttttatggaaaatcgcaaaattagtggccatatgtggaaaatcgcaaaaataggtccctatcgaacgggggaggaacgacaggggccttatcgaactgccagccttcgattggtacctgtcgaactgcaaccattcgacaggccggcctatcgaaccggggttgttcgactgggcccaccacccggtgccgcacggcctgtcgaacatggggagttcgactggtcccgccgcctcccctgtcgaacaataggcgttcgataggtccctttatatcggcagcccgaacccaactttctctaaaccgattgaggaggaccacatcgccatcgtcgccattcagtcgccactgctgtcgctgtgcgcgccggagggagtgaggggagggtgtgggcagctagtgacaagtccggggcggcgccggcctggagggcagtgaaggcgacggcttgaagtggcgacattgaggtataaatttgtaatccctaagtatgaggcttacgattttttaatcttatagaagaagacttgtgatttgttaattgtttatcattctccaatgtgactacatatcatatgatatgttaacatttgtcagtgttaaatgtgagtagagatattaaattagtcgtatgctaaaattagttaagttagtaaatggtagtacatatatttaatgtttgatgtgtttaaataggtagaggttaatacaactgggtatgatgattaaattagttattctttaatattagttgtaacttattagaaggtagtgtactgttagttataatatcgtaattatcgacggcttaaattattaaacgtaagggtaagatatgtgtcggtcagtaccgtataataagacaatttataatgttttatcaggatgtcaggtgatatgcctattcgtctgtattatggagatgctcctatacaaatatgtcatagcgaagtggatttgactgtatatgccttccatgatactagtctgaatgcaccggagcatatgggtttgaacgacgtgttagggtggttgtataatatgtttggggtagaaccagtgctcgataaatttgtcataaatgtcgtgtggccagtaaggggtcaacatggatggcagtggagagtagtggaggttgcgtcaactgggagttggaggaagtttgttagtaaagtaagagagaaagggtatagcctggcaatagtggtgcacaagacaacatgtgttgatcgatcggggggagtcaagtcatgccgtggtggaagaaactccattagaaggtgcacaagctgaaaatgtttggcggattgagtaaggtcgaggggaagaagtagtagagggtaatacacaagcataggtcattgttcgtgataataatcgtgaggccgacgactcggacaatgaagagccggattcacctatgcgtgttgacgcagcagaggagaatgaggcggtagtggatcagatggaagtggaaaacgaggaatacattgcgcttgtagtggaaggagaagatacaacactgtgggacgacgaaaccaacatacctgatgattggatgaccatatcgatgagttgtatgaaggttaacgatggtttaaatgcccactggcgttatgatagtaagcaggtgcaagttgggcagatgtttcatgacaaatgtcacttaaaagttgcggtgaagaggtgggcatttgaccagaagcgtgagttcagggtgaaggtttcaaataggacgacgtacaaagtgaagtgcacacaggctggatgtccttggagagtgcatggttacaagccacaacatgacactttatgggtagattcgagggttgagcaacatacgtgtttgttggagaatactcgtctggtacataggaacaagacagcggcctttgtggcacaaatggtatattcaaaggtggttagaaaaacatctttgtcccttttcacaataatgcatgacgtagagaaagagtacggatatgagatatcgtacgacaaggcttggtgggcaaaacagaaagcactggagatgaggtttggaacttatgaggcccagaaatttaacccaaatttccagactattttgcgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggcgatcctagcgggcttcagctccactccacaggcaaaactcaactggggtctgagccttggtcctctaactccatcttcagctcagaagcactacacttctgaaaagggggaataatagcaagactgagtacaaccaccgtactcagcaagccacaccaacgatgcagacgtgcaaggggataaggatggtttgtggctatttgcataaaggcggttgtaaaacattttattgagcaaaacagtaaaacggttgagtaattaaagtaatattgaatctccactgatcaacgctacacgagtgaaattcttcccgggtccgccccctagcagcaggacaccagccctgtgccatgacatctcgactaccgggccgcagctcgtgtagccttcatttgtcctagagatgtccatcgacccccgacttcatccatctccatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccgaaaaacaggttttaggggctttgaaagaggaagagaggggtatgtccaattccaccataatccaacaattccataatgtccaaatgatatgagatttcccaaagtctaaagttataaaaccacctaatgttgcctaattaaccagcgaagcctctacctaagttcatactagtggaaccataaatagagtacccactagttggggttttgtttaacctagggtgaacaaggtaataataacaatagcaataataataaggtcataacaaaggtaaataggcatggctaaataaaacagtgataacgcgggaatttaaataaagcgataatgcaataatttaaatcagcataattttataaactgggattcaatatgttcaaggatgatgtgacttgccttgctcagagagaacggcctttcgaaccttcggcgacgaccacgaaccacgcttcgggaacctccggaacgacgaaagctacgcgaagcacacaagcaaagctacaagcctataaagaagcaataaccatacataaaaacaaagcacagggttctttaggttttaacaaacattaggagacttgaacgggtcgattcagagttcgtatgaccaagatatgatcatccgaagtttaatgctgttacatggagatttgcggattattgtaattaggttttgcaactataaaacatgtgtaagcgctagcctggaaaagacaggaaggctgcgctgttgacatgcggaccccacatgtcaacaaaaaggaccgcggtagaccgagtacacagagacggtccacgggtcgacggaagcagatcccgtgtgtcaaccgaggcgagtggccgacaaacggactccactagacaccacacgggctgcacacgtggaaaccacgtggctaccgagcgggcacactaacacggacactacacggtcaccacccgcacacgtgaacgactatcgacaccggtacacgggtaccggggtcgacgaccgcacaacgggtacggggcgacaccgaaaggacgaggacggggcagcgagaggagagatccttaccaccacgcgacgaggcgtgggaacaacaacgacgaccgggcgcggcggaggcggccgggaactatggagacgaacggggaggggacgacttcggcggcgatccttggacgaaggcgagacgcggccggcacgagacttgacgacgcggaggcgaggacgaagacgatgacgggggctgcagcgcgaggagacgacgagccggcgagacaacgacgaccggggccggcgaggagacgacgagggcagccggcagtggctgcacggaggcgaggatgccgtggaacgtgccgctgcgatgccgacgacggaggcagcgccgcgagacgacgagccggcgagaaggaacgatgacgacgaacaccggcggggttcgatcgaaggggaggcgaggccgagggcgaccttgccgctgcgatgccggaggggaagatggcgacgtcggccggcgcacgggcacggcggaggaggctgccgaaggcgacgtcgacgaggagaaaggagaggccggcgcgggcgacggcgttccggcgaaacagaggagcagctggcggtgaggacaacgctgcgacgtcgacggaggagatggcgacgtcgatcggcgtaccggcgatgtacaggagccgaccggagaccgggaggtactggacgcagacgaggaggccaccccggcgagcttcgggcgaggaggaggtgatgccggggaaggaggcgatgccgcggtgtcgacgaagcagacggcgacgtcggccgacgctccgacgagggacagcagccggctggagggagtacagtggcaccaatgccactggttgccggcggggacgcgtctccggcgatttccccacgaatcggaggcagcgccggcgaagaggaggcggctgcgacgccggggaaggtgacggcacggccgggcggcgctcgggcgaggagggagaggcggctggaggcggccggcgcggaggaaagagaagggcgacggcgggaacgcgcctccggcggtcaccgcgcgaaacggagggtaggccgtgggagaggaggcggctacgatgctggaggaggcgacggcgcgaccggacggcgctccggcgaggagggagaggcggctggagacggccggcggcacgggagagagaggaggacggcggggagatggctagggaccacggggaggctcgggatggggttaaaacgatagaacggaggatgaggatcccattttatagcggagggaaacaagccgggcatgggagagggcggaacggcgacgggaatggcggccggcggccatggaagttggccggagttggcgcgggcgttcccggcgattgggggcacgattcaagggggaaattggggggaactgaagaggattcaatggggattaattccccccactcaatttggaaagaagggcattgattcgcgtggatttaggggaggaacggcgctaggtttccggggagagagagagagaggaggccggctgggggaggaagacgaccgcacgtgctgcgcgcgtgcggggagcagctcggcgtgggccaggtggctgggtggcgcagcttgggccgggcgggaaggagggaggggaggggcggcccagaaggaggaggagaggagggacttcgggctgggcttcgcccaaaggaggaagaggatttatttttaggtttttctttttaataaactttgataattgtttttgttgcttaataattatttccggtgttctgaaaattcaagtaaaatttgagggctcctttttagaccaaggagaatttaacaaaaattctccgagccacattcgaatttttcttgtacgtattttagtgtttgccaatttcttttcgaattttaattaattttattattccttttggaaaatgatttttatttcgggatgaatttatcaggacgtgacaactccctggatgcccgttgctactcatgttgtgggcgcacgagcacttcgacattgggaggcctcagctggactcgtatgcaaactacggattgcgagagatgtacaagtccagggttggtgacctcgacgatcgtcccactatggaatccttgcggacacaccgtgagataatttttgtttaattcgtttgtcttctcattatgaccggttcaatactagttgaataatttcctgatataactaatcataagtactatcttcttgttgcagctgaagtgggttagcgggacgacgcgtcgtgtgtacacacagttcgtagctgactttgatcagcttatgcctgaccgtgtgcggtggacttcgtacacacagcacgatgtcaatgatcatgcaccgcactgtctcgcggacctttgcacgcgggatcaagaactctggaggacgacttgtcacctcgtgctggacgtgcacatcgagccacacaatgtccacagggttcttaaacagttgggcatgtatcaagagttccctcccagagttggtcgtgctttggctgatagtcttcataggttggtacacattacatttgcttaatccaattttaacaaaaaatatgtgtatgtacgatttttgctaatgtgtccatttcttgctgtgcaggtattcccgaaaggggctcgggctttcctacgagcttgttattgtgaccacggttcatccgactgtacaagagtgggagcacgcagctgataacttggcactttagacacctccagacgatgggagttactatggggcttaccttcgttggtaccgcagtgtcacacgatggaggtgttttccgccacaaggagatagcaccgttcctcaccaggcggcgattactgacacgtttgcccctcagccttgatcagcttacaactcaatgatatgtgtttattcgtggaacatgcggaatgtgagcaactagttcagtatttctaataaatgtgcaactagttcaatatttttaataaatgtgcaactagttaagtatttcttataaatgtgcaacttggtcaatattcgtaataaatgtgcaacttgttcaatactttgaataaatatgcaactatatcataattttaaatgtcttgcttatttgtggaacatgcagaatgtgagcaactagttcattatttctaataaatgtgcaactagttcagtatttctaataaatgtgcaactagttaagtatttttaataaatgtgcaactagttaagtatttcttataaatgtgcaacttggtcaatattcataataaatgtgcaactagttcaatactttgaataaatgtgcaactatatcataattttaattgtcttgcttatttgtggaacaggcagaatttgttgagcacgttcaggtcgagtcagacaccctgctgcaaagactagagacgagacctccagtcgtcagtcctgacgacgtggcgagcgtccttcgcaacttccgtgcccgtgctgccgcactacttcgtcgtgtctcctgtcggagcgcggcagatgtggtgcagccgtctgcccgtagggcatcaccaccactaccccgacgttccagcgtggatcacagtgctccctcctcgtcacgccgcgggtacgaagcggcccggagatctcacagtcgtccttcctttcaacacaccccagcaccggagtacaccagggggtcagctggatcaggggtacccccgacgagcacggcacagccacgtccccaggcattccaaactctgccttatgttcaccccacccagggagcatctgggtcgggacacttcccttacatgccaacaggggacaacgtgttgaacacacctgcatggagacttcacgtcactccgcgtgcgccagatcaaggccacacatagcacacatgtaagtcattttaaataataacacgctttagtttcaaattatatgtatcattactaactatgtgattttttgttttctccctcttatgcaaacagacgatgaatacggttcagcgtcgacgcatcatggaatgcctgcttactcccctcgcacagcattcgttgaggacttcttttccactgagcctcctcaaggggaatcagggatggattactggcacgcagcacctcaggtgacacagtcgacgtaggagacggggccattcaggctcccgatgtgacaccacagtaggcagcaagagagaggcacccccctgataatttgacttatcccactgagcagataagacgtaggaagaagggaggacctagcaagcgtgcgaagggcaccgatcgtccttgagttatctatttctgttaaaaaaatgagacatttatgttgtgtccgtactatttgtgaacaatttattattaacttagtaactatcagtactatttcataatcttgttcggatgattgttttttcataccctttccaacgacggagtacaaaagattcgcgaactttgcagcgcactatacgacacacgcgtaaatgcatgcacgtggtgtgcaatctactttcggcgcaaatgtcactctgtggtccaccccattttcaactttatcgactacagagttatgaaaacgaccatgcgagatctcgctcgtgatcacctttcagtacagacccctcactcgtgcccgtgaggtctatccacacatcaagcctatcttcaccactatgcttcctgcagtcgttacggcactataaatacataccttcaccaaacaatagctcaccaatacctttcctctttacatttcccattgtcttcagcatagagttcaacacaatggaagctccattctgcgagcatttagattggcggagagatccactcgtaggtccatttccaccatggtgcgaccgcccaatctgcgcatgcggtgatcgatgtatactcatgacatcacttactactgaaatccgcggtaggagatttttccaatgcacaaacatttaccaggtatctgttcaatgtattgaaatctcaacatttgcacatgtttaacacgtacatcgctaaccacgtgtctacaatatctcaaaattttcagacttaccgtagtttgtaagactttgttgagtgggttcatacgatgaatccacaacgtgacagggcacgcccatatccatgcagcgaaccattatcggactacctaaggaggaatgatgagtacgaacaacgaaaaactgccaaatccttaccatggcaagtaaatccacttggacttcccacttggcgagatcgtccagagtgtaggtgtggagaccgttgccaggtgataaggtctgttcgacaacaaactttaggacagagatgcttcgtgtgtcctaacattgtcgatgaagatttcgtcgtaagttccactaatttttcactcattcccattacttctgccatgtacctactgtttacacccaaatttggcacctatggatgaaatagaggaaaattgccaaagtttggaaagtttcgggtttccttcacagggccggtcagaccgcaggtatatgggcggtctgaccggctagtagggccggtctgaccgcaggtatgtgggcggtcagaccgtcagggtccgagtccgagcctattttcgtcgggtctcgggtttccttactcgggaaggcatgtttcgtgtttccattggtttctatcccgagttgaatgtggaggagggtctgtagaaggcaagaccaacccctatataagggacaaggccggttcattgtaaaacccctgaatacaatctacttgaatcgttcttttaccatgttttctattttaccctagtttagtccatttttgtcggtttgcaccgtaaaccgtccgccgccgctgcgagagtgcgacacctctttgtaggtttgtcctgaaaacctttcgttttgcccacgagacgggtagttatcctcatatcaatctaaatcggcctagaggctgattttgatctctaaatcggctccgctagccaatttagcttttctttttgcaaaacccatcttgatttggccctttggctagatcgaggtggttggcgactctgtatcatcgcaaggcgtttaggtgttgcgatcgtgcttgtcgacttgtcaaaaaagttgccaacacgatttttggcaactccgctggggaacgatctaatcggctatatcacggccgaatttcgtttaatcaagtagctaccgtttcgtcaaatccaagttttggctaaacggccgaaattaatctagtatcgccggattaatctaatcggctccgaggttatttggtcgtcaccgaatccatgtgaacgtttgccgtgtgtactgaagatcatcatcagggagcagcggccgactcggcaacctcctttccttttgtttcacacggcaacagaggaaaagatcaggctactagagccgatctgccgagagacaagcagcaggagcattgtttccttttattactgtatacgtgcatagataaaaaaaaagatcaggctataccagagccgatctacagagagacaaatcaaagtttatttgttgattttggtgaaattgattagtgcacgtattactcatatcgagagaaaaattaaagaccgtatattaatttactcggtcaacaatttcagctatgagctatatggccggatttaatcaaggattttcttcatcaactatgacgagcgggaacaggttcaataatattgctacacaatacattagaaccgatcaaggcgtcgcgagaggaaacgtgtcacgcccggaaattcactggtaatttccgaacttatttgtgcataaaatcctcgtccaggaatcagccaaggtacacaaactgacaatttaatatacaaatccatcataataataacgttacacacttacaaaagaaaagaaaacagcagcggaataacggtctagcgatggcttcagctccactcccacaggcagctcaactggggtataagccaaacgtcttctccttctgaatcctttttcttcaactgaggttgattgattattgcaaggtgagcatatgacatactcagcaagccacacagcaaatatgcaagtgcacaaggataccaaaggatggcataatattggctcatttgcaaaagcagcatttagcaaaacatttaagagaagtaaaacagtggagtaattaatcagaaattttaatcaacactgaacagcacacccatgctgcacaggcccaaccatcctgaacaaccatacccggctgtacagatctaatctccaaaccaggagctaagcaaattattaccagatataacacctataattattgtgagaggtgtgagactaatcacgaaaaacattgctcaacccgcccataaccgcgggcacggctattcgaatagttttactctggccagaggtgtaccactgtacccacaagacacagctccacaacatgtcaccatgtgcctcagtactaccacggtacctcggaaaggagctgtgacattaccccttgcataacacaacccaccacagtgcaccgttcccggatcatagtcacccccttataaacaaggcatggactccccagcgacccccatgggcttatctccgccacttcttagtttggtgctccgcaatgaaccatgctatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatctagctgaaccaatatataaagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgatcacttccgacgcactcacgaaccttcgcaacgatgaaaacgacaagctaacacgcaaaataaagaaaaagactaataaaaaccaattaaacaatacatataaagtaaacaaacatgtagatcacaattttagatgaattatgagacttgaacggcctcattctgacttcatatgaatttattatgaattttacaagattaaatctaattaaagcccatttaaaaagaattaaataaatttaattcaatttatggacaattttaatatgtagatctttattttatacaacttttgcaacttgaaccacattaaactgagttacaatgaattagttatgaattttcaaagattaaatcggattaaaacacttatatggattttaattgaattatgacgcaataatgaattatttttgaaaaggaaaagaggattattgcgtcagcggctagggtttgcggtggaccgggtgcacggcagcggttcacgggaacggacggccgagatcaaccctatccaaaacggacggccgagatcgatcggatccaccgcggctcacggacggacgacgacgatgacatcagcgactacgtcagcgatgacgtcatcaccggcgacggctcggcggctcgggagcacttgctcgccggcgaacgacggcgcgaagacgcgagcggagggcaccaacgggtagagggcgacgcggcgaactcaccggtgaccaaaaccacggcggaagagcaacggacggcgccggcgacgaggaagaagcggcggcggtcttcgggtcgacggtgacggcggtgctccggcggtcttcggcggcggcgaagcggtggacggggacggcgacgacctcgcgatcccgatggtggcgacggcgaccaacgacgacggctgcaacggcggcgcggcgcggctgaaccgacagcaacgacggcggcgactagggctacgcggaggcggcgctagacgcgacggcgggctaaggcaaaggtggcggcggatagaggagagctcgggggtgctttcaaaggggctagcgagcggcgacggaggcccacggcgaccggcggcgagatggaaaggtagagcttggagagagagagaccgatccgaatcgacctcgaatcaaacactttccaagcgattttagccggtgattccaaaagagaaaaggtagaggagatctcggagattatttcccctcaatcgatttcaccggatcgggaaaggagcggccggatttggaaagagacggcggcggcttgcgctagggtttcggccggcggcggcctgtcagcgacagcgagagagagaggagagcggcggctcggcggactgggccgactgggccggggagagagagagagggtttttgggccgactttcggcccaaagccaaaagaagacttttaaaaacctttttcaatttaaattattcatgaaatgcaattccatttattaaaaatactttcttggctcaaataaatcccagaaaaatctaggaactatagaatcaagtaaagtatttaacaaaattttatctagcccaattttatattgagatttaacaaattaaaattagatcttctcttttatgcttttaagatcatttctaataattccttttaaacaacaatttataatttaaggatttttaaacaagaaaagctcttaacaattataattagatcattaatgatcaaataattactgaactgttctttgtatcatttaggaatttagctctgaaaaatccgagaaaatttcagagagtgaaattaatcatggagaatttaataaaaattaaatccatccatgctttatatttaggaaattttatttcccacatgtaacttcacttgaaaattaaagatcatttaatataaattctattattaatttattaaataatttataaatcctgaaacaaaaatcaagatgtgtaatttcaccaaatgtaaccctcgattcgcccaatccgtcctttgctattcaaaatgttaataatcattgtgtagatgcatatgctacgtctaattttgctcctatacaatatgcttataatgctagggggggtcaatgggtgattatacagccgattacacaggaatcggctatatgcaaaaccgagctgacagtatgaccggtcgtgacaccagtctaacagcatcctttgccggtcagaccacgcccaccatggccggtcaaaccgtgcctaccatagccggtcagatcgtgccctatcctggccagatcgcgcctcctgtggccggtctgaccgcaccactgaccaccggtcagaccgggccatgggccgatcagaccggttccgtgggagtttctccaggttttcataccacgactagtagtactgattttaattattatccatcacctgttaatactgttagtcatgctagtccacatatccgtaatgcctacaatgatattaatagggggtatcctcccgatactagacaaggccaatataatcatattgcttcacaaacataacctattaggctaccaaatctaccaccaaatcaacatgggcctaataatatggaggagttgattagtgccattatcagggctacatttggggttgaagcgaagaatcgtgctagggagaaccaaaagccgtattctgatttttatgacgttgtcccatatcctcctaattataaaattcctgaatttactaaatttagtggtgaggatagtaggactacatacgagcatgtatatcaattcttagctcaatgtggtagggctagtagtatgaatgcgtgtaagttgcgcttgttttctttatctttgtctggtactgctttgatatggtttacttctttaccggcaaattctattgatacttgggctcaattagaacaaaaatttcatgattattttcacactaatgaaactgagcttaagttatatgatttaacatcggttaggcatgaatacaacgaatctgttgctgattatattgaaaggtttagagatgttaaaaaccgatgtttcaatttgaaaataactgacaaagatttggccaacattgcataggatggatttcttgattctattaaagagaaattgaatggccagatatttcttgatgttgatcatgtgttgcatgaagctctggctcaggaaagccgagtggatgacaatagtttaaatgctagtttagatgaaagtgcaatatcatgtatagccgaaccaagcgatggttcggattgtgttaataatttgtgcaatgatgccataacaattatagccgaaccaaatgttggttcggattatcttgctagcttggataatgatgcaacaaccattatggccgaaccaagcgacggttcggattgtgttattagtttagacaatgatggaatatccgaaccaagtgacggttcggattgtgttactagtttagataatgatggaatagccgaaccaagtggtggttcagattgtgttgatagcttagagaatagcatcattgaagatatagccgaattagatgacggttcggattgcattacaagtaaaagtgaaatagcattataacctaagaccgaatcacaaatcgatcatgtgaatgttggaaaagataatgacaatgtcttgcgggatagtggtgaaatagaatccaaagtagctatgcatacatatcaaaggccgtatcctgaacatgtagattcggtcccatatccgcaaggattcgaggtgcccaacttcacaaaattcacaggtgaggatgctagaacaacaatggagcatatcggctgctttattgatcaatgcggtaagcccggtagcaatgatttgcttaagttaaagttgtttcctctttctttgtcaaactttgcatctacatggtatagtttgctttctcctagttcaatttctacatggtcacaaatggaacatgagtttcatgattattttaaagatgcaagcttgatgaagcaaagaccgattgataattcatcggtcatttgtgatactatttcggttacacctatgcctaagaccggaattgttagtaatcctctccctgttagtcctattgatgttgacaaaaaaaagggaaaagtgttattattggggatcctcggcccaaaaataggatcaaaaatgcgaaggccgaagatcataaagttgcaaaggatgagtcatctagtatccaaaggaccaaaaagccgaagctcacttttgagatgcttatggctaaatacaagaaaggattagccggtcaacgatttgataatcaaactagtgattcaaaaggaccaagatcatctcgtaggaagagatttggtcaaacatcaaagcaatcggagccatcaactataccaactccacacaaacctccggttgtgatgccatggtatccatatccaatgtcactatatggttatccttttatgtattgcatgccttggatgcatcaaccacctatgccgtattaccaagagtggaaggaatcacctaggtcagtgccaaatcattcatctaactcaagacaagaccgtttcccacaaaagaattggtccggtagatcaaaggtgaaaaatgtgaagaaggtgtgggtgaggaaagaagccaaagctccggaggtcgttgttatcaatgaggagtctcaagatgttcatgtacctactggagatgcgttggaaaccatacaagcgaagaagactgaagccgacgccgttgctgtcgacatcggcggtctgaccaagacagctggccggtctgatcgccagactatgtccggtctgaccgaccctcctggccggtttaaccgacggcttacagccggtctgaccggggagcattggagaagagtgagaaaattaaagcagcacaggggcttccacttcgaccaaaaatatgaagaatcattgcttagctcctggaaaacaaccacagccgaagtagataccttctggcttatctcgccctcaaaagaggaggctacaacgtcttcgggccataggtcaaaaagaaaagaaggccgaagatgtggagaacaagacatgcaataatttagagcctcgaacagcacctaggcaagtgtggagaaccaaagaggtaaaagttaagtgatcggtgatttcccatagtagagataaatccaatttgatgagagaagaatcatcggtcattagagataagtctccttcacatgatgctatggatgttggtgcggtgttcgtcttgccttcgaaatcgcgcaatctagaaagccgattttgctcggggggcaagacattaatatgctcatgaagaaatcaagagagatgaatggcgatggatacaacatcacatcttttgagccgccgtttgttggatgttaaggcaaggtatgagtttattgtgtttaccgttatatgcctatgccatgttagaacattgcttgctatctagcacatgtgtgtttttacttatcaaattgatattatacatacatgttgcaaatgccagttctaggtagtagaattggtaggttggcatataatttgtttgaattatgatttggctcatgactctttgatatttatttaaagccaaatcatatgtgtttttatagatcaccatataagatatagatttcatatttattgcaccatgaaagtttgcttactagtaattcagctaatgtcaatggtcaatgtgatgatttgctctagagtggttttctttaggaacattggcattgttaatattttacatacatgttcaagttgattacttacatttgtagtttattggaatctatgcatgtgacacatatgactttggtgattcattattgatcatacttcaattggctaagtgttttgatgccatgatgattattgtttcaaaagccatttgaattagtattcatctagacatattagttggatattataatttttttcatatgtctagagagaaggaattttggtccaataatttgatacaccaagcatctggctattatctgaagaaaaattatatattaaaggccgatgcttgatttcaaaagtttggacgaaattggcaaagtcatagaccaggggctgtctgaccggcattgcacggccggtctaaccgatggtaccggcggtctgaccggctttgcatagccggtctgaccgatcccaaacaggaggctggggagcatgttacaattgattaaaaggccaaattaattgtgaattcggacatttgtgcccatgagttagaaatggcttggagatttccttcgattagatatttgaaagatcctacacttaaggttgatcggaagattcggcggcaagcgcttaaatattatatcgccgaaaaatagatggagtattacttagataatgatcaatctaaagttgctaggagagtagtacatgaaggattcatgaaactcatcaatcggcccgtaagataaattggttgcttaggagagtggggtttcattggccgaaaataattgatgattgtttcaaacgttatagagggagtgaagcttgttaacggatcggcaatgttcaattagcgcctaccgctgtgttgaatcctatcattagactatggctgttccgaggttgggctttggatttcattggtcaaatttatccttcgtcatcaaaagggcattggttcgtgctagttgcaatggattacttcactaagtgggccaaagccgtgccgctcaagaatattacttgtacggaggtaattgattttattttgaagcatattgttcataggttcgatattcctcaaatgttaaaggagtttcttttatgtccaaggatgtgagaagtattgccgaatcttatgatattaagttgttgagttcttctctttactacgctcaggctaatggataagccgagtcgagtaataaaacattgttgaaattgccgttttgccagttgaggtaaatcttggctttcttcggtatttcaagcaagacgacttgtcggttgaagattacaagatcttgatgggaagcaattttgaagacgtcatcgacaagcgtttgaagactttgaaggagatgaagacacttcaagacggtgttttcagagagcaattaatgggaaatacttgaagaaatatttcccgagcatttggcaagatgcttaggaagtcctatggccagtaattggactatcgccctaagacaacatgttccatgcttttagattcacggtgttcatcaaaaaggtagggggcatgtgtttacaaccaaatttgacacctatggacgaaatagaggaaaattgccaaagtgtcgggtttccttcacagggccggtcagaccgcaggtatatgggcgggtctgaccggctagtagggccggtctgaccgcaggtatgtgggcggtcagaccgtcaaggtccgagtccgagtctgttttcgtcgggtctcaggtttccttgctcgggaaggcatgtttcgtgtttccattggtttctatcccgagttggacgtggaggagggcctgtagaaggcaagaccaacccctatataagggacaaggccggttcattgtaaaacccccgaatacaatctacttgaattgttcttttaccatgttttctattttaccatagtttagtccatctttgtcggtttgcgccgtaaaccgtccgccgccgctgcgagagtgcgacacctctttgtaggtttgtcctgaaccgttttgcccacgagacgggtagttatcctcatatcaatccaaatcggcctagaggctgattttgatctctaaatcggctccgctagccaatttagcttttctttttgcaaaacccatcttgatttggccctttggctagatcgaggtggttggcgactccatatcaccgcaaggtgtttaggtgttgcgatcgtgcttgtcgacttgtcaaaaaagttgccaacacctacatatgccaatggtcattaatttctgcacacaggaagaagaccgcaaatgtagctacgtaaagtggatcgatatggtccgaagaacttccatagcttcaacgataactcaacctgagacgaccacacaattcattcaggcgtggatggagtacgagcgctaggctcagtccgctagcttacactggagatcaaatccattaggtatacctgaatggtctgatcgtcccaaatgcggttgtagagatcgctgccaggttgcaacgtccttctcacaacatacatgggaggcggtacttcgtatgtcccaacatagatgacaacttcgttgtatgtcacatgcttaattattactttacatttcgcttcacgttcccataacatttatttcccgtcatctaatttgattgattcttcaggggaatccaaggatgtgtgcttttacttcatggatcgacatggtcagcccgacgtacgaaggcggaagagtaactgaagctgaaacgcaaacagagtataagagattgaaggatcacgaagttgctttacgcacacaatgacgtagaaggggtcagtagagaagcttaacgccgaatcgctcttgttcggatttctgttatgttatgttgtcctatgcgtcaatggattatgctcattcctgcttccgctgcaatgtcttcaatcccgtcctattctttatctgtcgttactaaataaattgcgaccaagccatgagaccaaaaatatatacagataatgaaactacaatttcccaataatgaaactacaagaatgaaaatataaactcattcatcctaatattttaaccaaaaaataaatattacaatttcccacaaaatattatttaaaaaataatattaattataaaaaaaatcctgaaaaaaattcacaaataatcacaaataaaaaatcgacctgaggacaagtcaaagaacaggtgttcgacaggaagcctgttgaaccgacggtgttcgacaggaagcctgtctaaccgacggtgttcgactggctcctgtcgaactgcccttgttcgatagggcggcagtcgaacgacctgttcgacaggtcccagtcgaacggcagccgttcgatcgtctcttctatcacggtttcgataagtcgcctatcgaactgcacttgttcgataggaccccatttttgcgattttccacaggtagccactagtttcgcgattttccataaaaataatattaattctcaaaaaaattcgcaaattaccacacttttaaactgtcctcgggtaaattcacatctttgaggtgtcccatagctaattacacatttttgagtgtcctgtagcaaattttgcctttcatcaaaccattggattctgatcactttgcttttcttcgtggagaattgggaataattcatccttttggcatgatttgagggtgagattttgtacctcatggttttatcaagcaaaattttgacaataagaaaaattgaaaaagagagctttgtttgattcatatggtattttcttgtgcatgctagcaatactatgaagatttatttgtctctagcatagcttgtatgtattctagtctttttgtgaagcttagatattgcttttatgggagatgatgcatgacacttaaattctatacttgaattaagcaagtatgcaatattgatactagcatatggtttgatttatcaatgcttatgtatgtgctttattaagttgttattcctcaaatagtttttaattgctcattgtgcaagagaataaaatctatgagagaaaaaaaatgaataccgaatccttggaaacagtcttgacaacaaggacgtattcatgtgagcaaaaataatgggtcccgaacccttgtaaacagtcttgatgacaaggacgtacctggaataactgagagaaaaatatgaacaaaaagggcccaaataaaatgttaaaaagtctcttgattgtttttcttctaaagttaaatttgagaaagagtgataaatgcaataggtatatatattgtttattcttcaacctatgtgcttgcaaagatgttgcattataaatcacatgaaatcatgaattcttattgtcgatttgatcttaattgttatatctttgatttatgtttaaactttagtgcatgcttgctatgatatgatgggttcatcttctttttattgcaacacataacttgatgtgctatatatatgctaagctctagaacattaatgaacttaattcctatgcttgatcaaatcattgtcaaaagggggagaagagaagagattgtgcatgttttcggtcaagggggaatttctttgtttttaaaagtgagagaagttttcttttgaattttgagcacgatgtgtgcgtttgcactaagtgtttttttgggtcaagggggaatttctttatttttaaaagtgagagaagttttcttttggattttgagcacgatgtgtgcgtttgcacgaagtatgctttttaccacttttgtttttatttttccaaacaacaaaacatttttgatgggtttgtcaatgtgttaatcaagggggagattgtaaaatcaaagtattttttattcttattctgtgatgaataattagcatatgtgattattggttttaatatttggagatcattggcgaagtggttttggagatgattggattttataggtgttaacaggtgctgctgcttgtcgggtccggtctgaccgggcagtggttgccggtcagaccggcgtgtgttgcacagtcagaccggccagcccgcggtctgataggccgactctgtgtcggtttcggtttcgagttgttttattggatatccatgattaatatgtgtttatggcttctaaatggatactatgcgtatgtaatattgttgtttgctaacaatgagtcaagttggagatagcttggtcttggaatatggtttctttggttgattcatgtgtaggtgacataatgcctcgggagagtattgccggtgatggatcgggagtcgacttggagataaggcgacatccaggacaactagttatgcttgcaatgcatatccttgttagaataataatattccactagtatttggttctctaaccttttgcagagaataagtataaagtgaaggagaatcgacatcaaatcagacaataaatcaatcggacgatgtcgagaatcagacttatgtatgaatgggccaagaactctgatttgacacgatgaattgggccaaaattcacaagtccgcgaaagagagcaatggaggaggccacctattgaatttgggctaggttgggctggcccctagttcggctgaaccaggaggtggttcggccgaacccccctggcaccgttggatgcatggttttttttggacggcatgaatcactccccaacgacggttggagggcaattccgaccattccaactgccacaaccgtcattggcagcctatttaaagagctcctcttctcacttcactcacacacctcaagcaaaggtctctcatattctctcatgtttagtttattatctagctagtggaataagaatagagtagaaatcggtgtccagaagcatttggaagagttcgggtatggctatagtagctcttctcttcacttttttaagctttctactatattagggtactcttctttatacatttatggtattgaaatactttccgagtatatgaatgccaactttacattatgttcatgctatactgaatatactgctagcttatctgggagatgctttggtgcgggtataatttttgcatatgcaattactctatgtcatgacgatgatattagaatagtatctggtagtttaggcgtggtgtctagattacgagatatcattatttggggttatatgctgcggatgagaggtgggccgctgatggtgacagctcagtacgggtattcctccgtgcgtgtatatagtcctaagttaatttccttgggagggtactcctctgtatttagccccggctgtatggtcatgacgggctatcataagaaactcgacagttaggggtggtttctcgaagtaccaggagggcatcggatagagggtattagctagtatgtcagataactaggatgtatgtatactatgtatactagaagtataggaatagattctctttctcttttctttccacttagcttagatattttatatgagaatgagtagcttcctgcttgtgtgtcactctacccttggattatattaacccctgctaagggtacgattattataaataatatataaattattagtcaggttctcactaccatgatctttccacgggattaaataaatacgacacccttggaatacactcggtgaaatgctacaatggtatatccgtgcgcttgcggatgaactctgtaaccataatataccaggagtatttttgcgccattgcttggaattatatttcaagtaatgtcgttaagaaatatcaacaagcattttctggcgccgttggcggggaagattcataatagagattactagaactaacactttatatttacctctatataatcactgccctttgcaggctaaccttggttgttttcacttttgttgtggaaacagggtagtgtttcaatttgccagaaaactttaaggaaaatccagaagctttcttccggagcatcaagccacgagtcgtcgctccacagaaaactctcccgacaaagaaaccagccataccagcactaccaaccttcaagactatggctgacaagactctccgtgaattcgctactccctctgctgacaatgtggccattgggccacagatcaacatgggagacgtggatttcgatctgaaatccagcctcatcaagatggcgcaggctagcccattctgcgacaagcctaatgaggatgccaatgctcctctacagcagttcctggagatttgcaacacgtacgccataaagggtgtcagtccagacgccatcaagttgcggctgttcccgttttccctcatcgggaaagcgaagcggtggttttatgccaaccgtgctatgatcaacacctgggacaaatgctccacggcattcccctcaaagttcttcccgatgggcaaaactaacgctcttcggggaagaatttcgagtttccagcagacaagggacgagtccattcctgaagcatgggaacgacttcaggaatacgtggccgtctgtcctcatcatgggatggacgactggctgatcctgcagaacttttataatgggctcactctcatgtcccgtgaccacctaaacgcggcagctggaggagctttcttctctaagacggttcgaggagccattgatttaatagagaagatggtctccaatatgggttggagcgaggaacgactccaaacccatcagcaaggtatgcacactgtcaaggagacggaaatgctcgctgccaagctagacctcctcatgaagcgattggacgaccacgacaaacggccacaaggcaccgtcaaggccttggactcacacgtcacgtgtgaagtctgcggcagcacgggtcattctgggaatgacttcctggagacccgtgaggaggcgatgtacatgggcagcaacaataatgggtaccgtccacaaggaggtcaggggtggaaccagccacgcccatattattaaggaggcaacaacaacggtaacttctctaaccaatgctttaagcaaaaagctagctgccaatgacaaagtcttagagaatattaatgtcaagctagatggctttgcttctgcttttcaaaaccagctgagcttcaaaaaaatgatagaaaattagtttgctcaattggccgccttagtccctgcaaatgaatctgggaggattccggggtagcccgattcctccattgaaaatgtcaaggcgatcacaacgagtagaggtaagtccactcgtgatccgccatatcctaacccagcagaaactaacgggattgccaaggaagcgccatctagtgaatcggctgacaaagaggtttagccagaaaggctgtgccacaggagtactacgacacacgattgcttccgtttcctcaacggagtaggaaactgtcagtggacgagtagttcgctctttttgttgaagtaatccagaagattcacatcaacgtgccattgttggatgctatgcaagtgccaacatatgcccgctatctcaaggatatcctcaacaacaagagaccactcccaacaatggaggtggacaaactgactgagcaatgcagcaatgtaatactccacaagctcccggaaaagaagaaggatcccgggtgtcccatgatcacctgctcgatcggggcacagcaattcgatcacctgctcgatcggcggaagatgtgccggtcaagatacgggatttcttcatcccggttgactttgtggtactggacatggacacaggaaaagagacgccactcatcttgggcgtccgttcattagcaccccaggagccaacattgatgtggggacgggaagtatccgtttgggctgcagga

SEQ ID NO: 2873 - DNA, 8197 bp, Oryza sativa
ggaaatccgcgaataaactggaagaggtacggtcttgcacgtcggacttaaaatgacgcacccttcgccaacaggtaaatggtatgtatctgcatatttgttttccacaattgaaatttttgcatcaatacatgtttgaatttcaaaattgcatttaggatctttgaattttgaggaaattcttcaaatgaaattttcagagcaaaccaaaataaaattttcaatgaaaattgtttgtttcacgaccacactgaccgttggaacccaacgaccgaaagtggggccggttgggcccaccaggggatcggccgaaccccctggttcggccgaaccggccaggctaacggtcaggtgcctctttctttgaggcaacggctagtgagcccaacaggtcagtttatccgttgagggtgcactagttaagccaaccggccgggagagggaactccaccccatttcaacacatttacattccctctccaaagtttgctctcaagttcattcaagctttgatagtttccctcaaattcaaaaacttagttgcatatatacaagttgcttaggtgaaactaatcggcgggtgaaactcgtgctatttctaacccccgccgagttagtccgttcttgctccattgtgcagaatgaagaggcgactgtctcgtctgttcaaggggtccggctcttcgtcaagtcatcatgacgagtctagtgctcgttcatcagccgatgtctcgatggaggatgccgacgctccgcgacgtctcctgaacgacaccgacctcgaccttgtcgatgatcatgaaagacaagcttactacatgctgagtgaccgggagtatgctcacacgcgaaagtactcaccagagctgctgaaaaagataggtctgtatgttgattttcgtgctatttggaaagctgttggttggcagagatttgctgtggtagatgagcctggttctcgtttgcttactttgcaatttctgtgcactttgaaaaaaatagaagatggaatttcctttcgctttttccataaggaatacacacttacatggaaggattaagtactcttcttggttttcactattcctgtaaaatcgatctccagaaagaaatttctgggttcaagaaaaataggttttgggaagacatttctggtgctccaatatgcaagaaacctaggacgaatgatatccctaatcctacacttaggctcatgcacaaatggattgctatgactctgtttcctagaggtgatcttagacccattaggggggatgaattaattattatgtttgccatggttagaaagatcaaagtttctcctgtgaaatgtatgataagacaatggttagaaagtataagattttctgctcctgttgagtgcacttctctgattactcggatagcaaaagggctaggggtcgttagtaaccagattgctttcatctcaaccgctcgtccttgtattgatgagaaatatctagtgcaatggcacattcttaaacatggagtagatggatctttgatatactttttccccgattgtacaaatgaaatcccgttgccaaatgcggggtatcatttgtacaactatcatgaactaaccattcccctgcaaaccatagaagaatcttgtgcatgtggaacatacagggagacacacataatggcaaggaatgtacaaaatggcaaaatgattgaaccatgtacattttggttacttgtcattccattgaactttgtcaaattcttgtgacttgtgtagacacttctcatgccctatgatcaagattatacacccacatatatgcacgtgctaaactgctacactgggagctagcaatattccattccattccatttccatactaccacaaaaataaattctccatgctttcatgagctttcttctctaaaaaagaaaatcctttctgaaaaaaaaggaggaaaaggcatggttatgaaaatatatatatatatgaaggagggaaaggcatggttatgaaaaaaaggagggaaaggcatggttatgaaaacaaggagggaaaggcagttagaccgacggcatcgcgtcagtcagaccggcggcgactttagacggctgcagcttcttcggggcggttagaccggacgatctactccggttagaccaacgacttccaggtggtcagaccggctactctactttggtcagacctcgatccgtcaaattaaagggtaactttaatttcttctaaaagttttgtttttttggttacactaaccattcacccccctcttattggcttagttctttctagtcgatcctacaggacgtgctgataccggtagaggtgcttatcaagtatcaacgtgggaatacgaggaggcgatcaggttgttgtaacaaccctcccaccagaaccgcgcagcccagtccatctgatgggtgggcccacttacacattgcacctcacttgtagtttcatccttacttcgtgtaaaaagattaacccaggagtagtatggttgaagggacaaactcttataagttggttccatccttactaacccaacaatgtggtactccctccatctacttttgatagtcatatttccaaatctgaaaaatttatttttgataggcatatttcaatccaacaacctatcatcttaatgactttctcggatttaatgtgtaactcttcattcttctacacaagattggctacatgggcatcgagaaatgtaaatattaatgaatcgcttgtttacgagaaataactagtagcatatttaaatggatgataagtagaattacttatccttggtctatgtgccaagatgaaatatgactattaaaagtagatgaagggagtaataaacatgacacagcactcatgaaccacattaccacacacaggtcacgtcctaattggtctaggatgtcacagttgttatcgactacttcctctacaccgacatgcggctacgtcagactggtcttctctaactcttatttcactgcttagcacgtcggatggtgacgatccatgatcccttactcacatggttcctggtttacgtggtagaaaaattttgttttatgctattgtagcctacctgtaaccttataaaggctctacacactttgtctttacgtgctttagattttcaagcttagggcatattttgggaagctttagatttagagagaacctcatgagaatctagttggtaataatcttgataagccggaaaaccaacatgtagtttctagtttattttgcggattctacaactatagtttctcataatttggacgagactagactgcttgaccttgctccaagactctacaaggaatctacgccccggcgttgattttggtaattaaatacaagcgctaattgtggaccgctatttcatatttaatttaagtgagataatttgagttaggaatttcatattttatatcgatacaactgttgctcacatcatagctgaactgggagacatcaaaatcaagttgtccaagttttgaaattaaattcggtcacctgctacgttgctaacttcaaacaaccaccaaatatgcacacaagctcttggattacttgatggaaaactcttggagtcatctttccaacagatccaactttatcaccaaatgcctttatgcaaatagctacaaacctcccttgtctccctttgcatgattgcatcgttggtgtggcttgctgattatggtggttgtactcagccttactattattctccattttcaaaagttagtgcttttgagttgaaaacgaagttagaggactaaggtttatacccctgttgagttttacctgtggagtggagctgaagccccactagaatcgtctttttccgctgtgctttcttttcggtgtgaggaataagtgtctttttctgtaagtatttacgttttacttatgtttgaatctgtatattaattagtcgttttgtgtaccctgacttgatttatggtcaccaatttatacacaaaattgtctgaaaatttgggctaaattgttaggcgtgacatttggactcaaaaatcaaagagaaatgtattgagtaaaaacatacttaaaaaataatcattgcacaatgcactataagaacattggtcaagaggggagtggtatagagcttttggaagtgcgtgagtagtgaggaagagtgtgtagctcaaccactacgggaccatggaagcacgagcctaaccaagaagcaaatcatctacttccttcgtcctaaaatatagaaactttagattagattagacatatccttttactaggaatctgaaaactatatatgttcagatttgtactaactggtactagatcattatattctggaatgagtgatttgtaggatcgaatcacaataactaagccaattagagggggggtgaatggttggtatacccaaaaaccgaaaacttttagcggaaataaaagttaccctcgaattcgacggatcgcggtttgaccgaagtgtgtgcaccggtctgaccgcctggttgtcatcggtctgacggatgtagatcgatcggtcgaaccgccgtgatcagccgctgcttgctatcgccgtcgccggtctgaccgtcggtatatcgccggttagaccgccgaaacccagtgaaacagaaatcgaagaactcttaaagtagatgacgactttattgattctctctgtgtttacaaagtgcaccaacagcactccttacaaaaatttcgactaaactcgaaaccctaactcaaaactcaactcaattgctctcaaaagcgatatcaggaagcctcacgctccccctctatttatacccgaggtaggcagcctaaagccacgaaccaaactcatactagacgtcctaaacaccttacgaaaccctctagtacaagaaacaaactttacataaccaatcataccaaatttggactccttccaaattcaactccgcatcccatactcacacaatacctccatcgtatgccatatgaaatcttcaccaaccacgtgcatcaactctagcctaagtttccacatgatctctgaccaccacggacgtcgtcttaaccccaagccgactcccggtccatcaccgcaaatactctcccgaggcatcaagtcacctacacatgaaataaacaaagaaaccatattccgagaccaagctatcaccaacttgactcattagtagcaaacaacagtattacatacatatagtattcatctagaagccataaccatgaaacaatcacggatattcaaagaaacaacccgaaaccgaaaccgacacagcgtcggccggtcagaccgtgggctggccggtctgactgctaacacaagccggtctgaccggcaaccaccgcccggtctgaccggtattcatcacctgaaaatcaattatctctaaaacctcttgaacaataatctctaaatatcaaaaccaataattacaaatgccaattgttcatcacagaataagaatcaaaacacatattgatcttacatgattcaaatcctctaagaggtggattaggtggtaaagggtgcaactgtgcaagctatgtgcatcatttcgtggttgaccatacatccataccatgcctttttctgggatatgtactttgtgctcgtttcgtgtaactttttatgcaatagttactacactttgctagttttacctcctgtttgtgaattctttctatacgactatacctatacaaagaaaaagggatagattatctagcttttagccacttttaccgtactaaaatgttgacatgatgtttggtcgagcaaactgcttttgaaaagagaaaataatttaatgaacaacatgaagtctttgatttgtatgcatggatgaaaccaataagaaaatttaattgggtgctgatatttgaagcatggaccttgaaagcaataagtataattatctattcatatacccggcacgtgaagaaacaactgccagattacggaaccgtggatagcttggatgaggcctactggccttgcctcttgcgagttgcgacgcgatgcatacgtttagcaaaatcgtttgcagaaaacagcggacaagtgtcctcgcatccaaaggaacaggcaaaacaattcagatatcctagcaatgtcgttctcatgttttgtctgcaactaacaaaccattggcgcaagcagagtaatgagcatagccagcctacaagatacgaaaatagtgacaacgataggtccctcggacttatgacatgtttatttaaaaaacatacatccttcgtaaaaaaaaatcaactctaactatgtatatgtataaatgtctatcaagttcatagttagaaatacgtttttttaaagatggaggaagtaatcatgtgcgtagacctaacacttcctgaattatatgctctgagttgctcacttttcctgaagtccatggttttgagccaatctagtctgctactgaggtgatagcctacttagcgacaactctatgtttttgacattctgagaaaacaacacttacactaaataaactaagtgaactgggcaccagtttcaattattttctggcagtgttacatgtaattaaaaaaactctcagagacttcttaacacacaaaaattctcaaccatttggttgatgcagttggaagttatagaaaagtcaatcgcagtacaccccggcccccttagcattagtaaaaagttttccggtgtagcttttccttatcagtttccccttactcccttcggttttatattaattgacgttttaaacaaggttgaggtcaaacttttataactttaaccattaataactttaaaaatatttagtttaaaggaactagaacaacatatatagatttgtcttttaaagcactataatataactaaacatgcatttatttattatatatattatagtagaaaaataaggttaaagatatatcttgtagaccgtgtcattgtctaaaatatcaattaaaatgaaaccggagggagtggttctgttactctttatacgggttagtgaggttccaaattgccatggataaaatattattaatttttttcttttggggtaggtagttttgaagtttttacagctttgttatttattagtcaatttttatgatggcttcctaaaattacacaagtcatggcttaaatttgcacaaacagaaaaccgtaactttcgtacaaacttgcacatattaaagctaaggccccgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcttgaattagcttttatttatgtaattagttttgtaagtagtctatatttaatactctaaattagtgtctaaagacagggactaaagttaagttactgatctaaacaccacctaattcctttgtctggtaatgtcaacttaaaaactataaatgtctgcgggtgggcttgggtaaatagccatctaggttcaacgaacctaaatacgcactagtccatcgtacacgtcccaatcccctgaccattacagcggcacattgattggtagtccctgaataaaggcctgtttagtagtacctacaaacaaatatttattacgtgtcacatcggataaatgaatacataattaaagtattaaatatagtctaataataaaacaaattacatatttcaactgaaaattacgagatgaatttattaagcctaattaatccgtcatgagtaaatgtttattgtagcaccacattgtcaaatcatggcttaattaggattaaaagattcgtcttgtaatttatacgcaatctatgtaattctttttttctacatttaatactccatgcatgtgtcaaatattcgatgtgatagggtgaaaagtttttgtttgggaactaaacagggtctaagtagacactcaaaaataaattattacggaagaaaaataacacatatggctctcactactacacaaatcatcatttttctgtcaagggggcattaggttgcaggctggcc

SEQ ID NO: 2874 - DNA, 644 bp, Oryza sativa
  unsure (1)..(644): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaataccgttcacaaacatctgactgcctggcgcgaggctcgcccggtggcggctgccgctgcgccggaactgcctcaggcattgacggctgctattgccgccgagatcgagcgcgcagccgcccaagcccgcgccgagatcgagggccgcttggtgcaggcccagggcgaggccgtcgagctggctgccgctggtgaggtgatcgaggccgagcgcgatgctctggccgagcaggtggcagaactcacccgcgagcgtgacactctggcgggcaaggccgagcagcaagccgccgacttggccgaccaggcgcagcgcatcgagcgcgagcaacaggccgccgaatcggcgcgggtggagctggccacggcccgcctcaagatcgag

SEQ ID NO: 2875 - DNA, 39976 bp, Oryza sativa
  unsure (1)..(39976): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggctatgacaataggtaaacaccccatagaaacattataaaacaatgcaatatttgaaggaaaacaatagagcatttgcgatataggatcaacatgttcaagtgacaagcatgacttgccttgctctgctgctggaggaacctcggcgactatttcgaagtacaccggagcgtcggaggaaccggaatctagcgacatacaaggtaaacattacaaacaggctataagactactgaaacagggaacaaaaccatttttaatggattctacacatttttcttgatttactgagacttgaatgggcttaaacggagctcggatgaattagttatgaattttagaagattcactgtgtttattactataaaagaaaaaccttaaatcatttattgcgcaataaatcccagggctgatgtcagcacgggggggagaaggcgcggcgccgacatgcggggcccaccggtcagcggctcgggagagggaggaaaggggcgccggcaagcgggcccactcggcagcgactcaaggggggaaacggttcaccgtggaccgggaccacgcgggtggtccaccgccggtccacgggaccgacggcccagatcaccctcggggttgatcggatgggcggcggcgacccggctcggcttggctcaaggccggcccaccggccacggcgatggcgacggcgcgcgcgcgcgaacgcgttgccggcgacagcaaccggcggcggaggcgacggcgcaaaggcgacgcgaaggcggcggcgctaagcggcggctaggaaggagagggaggggaatagatgggagaggaagcctcaccgagggtggccggcgcggaggaagacgacggcgaacggcgacggcaagccacgggaggacgacggcaaccggcggacgggcttcggggtgccctaaggaaggaagagagagagagattagagagagggagatgaaccacggcgaccggcattcatggccgaaagcggcggtagaggttgaacttaccggagcgcgaggggatgcgaattccggcgacgaaactcaacgggaaaggggcggccggggtggagcttagcctcgcgaacccgacggcggcgacggcgcggtgcggcggcgaccctagcggccgccggagtaacggaaacggcggcggcgggtggttgcacggcgcgggagcgatggggagcacgagggagttcggcgaaatggggaaaaagcgagagggggcgacggggaagcctaaataggggaggggagccccggacgtggccggtaggggcgagatttcgccggccaacgtggggagtgggggaggagagagaggcgggattcgaaaatcgaatcccggccatcttgggcgcgggcgcgggcgcgagagagaggggagtgggcgcgggggacgcggcgcacgcgcgggcgtggctgacgtggcccggaggaggcggaggcgtgggcgcggcggcggtagcgggcgcggtggcgccggctggaggaaggagacgggcccgacaggtggggcccacctgtcggcgtcccggggagagagggaggggcggcttgggccggcccacaaggaggagggcgcgcgcggcggggtggactgggccgacggcccaagaagaggaaaagaagggaaaaggaaaaaaaaagaaaaggaggaaaagaatttccctgggatttaaaatattgcatgctcgattttaaatggttaaaattatttcgagagctctgaaaattccactaaaaatcttgttagtgaatttcgacatgtagaactcaagaaaaattccacatgccaattccgattattatttgcattgatttaatagggtttactcttgctttgcaccggtattttcttagggtctcttattaattcaattttaggcttaggaggagaacttcagggtgtgacaaacaccaccccggcgaatccacatgtctcttagcatcatggctcccccgataagctagttactcagccaggggtgtcccattccacccatgtggtcgtacttgtcttatgttcggatgaaattccaaggaaacggtccttaagtgcaagagcgggaaatcgtacacccggtacgttccccggtccgcggttttggaaattcatttagttcgcaagcaccgacccaggtgtcgggttttccaattgtgaatattggtttctggtgtatgagaaacttaaccaaatggtctctagcgctactacatccgtttcatattataagggcaaggtcaatatttattgccacaacatagcattaaggtggaccctatagcaattgaccatcgttgttagtacatcaccaatatatatggaccaactagtcatataaaatagaactcacacaactggactcttgttatttcaattttcacaatgtataaagatagcacactataataaaagaactaatccaccaaggttatttcttgttgtggcctagactatattcaataccataattgttatggttcaccttaaagaccttaaggctacttttttgcaacagtatggttgctctaagtcactttgacttttttactattcaaatatttttaagtttcatcaagtttataaaaaattacaacaaaatttttaatacaaaacaaacatatcatattattgaaatgtatcaaatattggtttctataaaactaaactggtgttgtagatgttgctaaaattttctataaactttatctatcttaattaaagtcaaaataacatgtaatatgaaacaaagaattagtaaaattactttaatactgttactttggaagtttggatgaatgcagagcagcatgaggagaatcgttcattccgatctcatcggcagcaaaacagcaaaaaagtagaataaatgaagagaggaaaaagaactgtttggaagcaggatctcagcttaattatgatgggcaggcaataaattgtctaaatctttttctgaatgaggaccgttgaaatcaattaaaggagggatagcaagtgtctgcttgatttaattctgaataaatgaaatagatctgtttgtccaagataacgcaactctcccgcatattctcttggaaaaaatatgagaagaaatattcaggaaatgaggaggaggagcacatgtttcccagacatgaacagttgaagagctgtgtatcatgggtgcggttgtgcacttgtgctagtggaagcttcatccgctgtagcgagcatgtaatagaatattagcaagcagcatctcataaacaacatttaggaacagagtgaattgtgaatccattgtagataattcataagagcatatgcaacaattagggtatctgttgacgtaggaatatcatctatagaaagactacactagacagctataaaacacatttctagcatagaaaaaaaaaaggagagttacattcaaattgtttgaaggactatgcctaaactgcccctctttcactcccttaaaaaaccatccgaaagtccaaagtgaactaattagagtcgatcaaggattaaattttgtctgcactcataaattttagccaatctcttctgtactatcatgacttaggatcacgagtaccatcataagatatacacattcacaatattgcatacgcatgtcatatattggcccccacaactagcttatcaaggccatcgttgcaacaaaaaataaatgtccaagggacacgttgactccttttcagttgagctcatccaaacaagatcaatgtgctactatgacatcaagcacaaatgataaaagtgaactacagaaaagagttgacaaaggaaaagggttgtaaaacccaggatctgtaatgtcatagtttaaggggtcactttcagcaatcaataccaaaggtagcaaaacattcgagtacaccagaataatgattggcaaatcatgaggtttggacttactcatgtcatttcccctctccttggaactgtttacacattctgaaacctcagcgttttttttcctgattgggtaaatgtttcctctgaagtctcagcatgaatctggagtactgtttgaacagtcaaatggtcctgagttcgcatgaatccaacattcatttcaagtgattctgcttcagtttctgagcatgaatcctctgctttcttcaaaaacatagttcagtctgaagtgaatggtcaagtaaccaaatactgataaaaagcaggaagccaatccataaaaaaaaatcaagaaagacatgtacaatacctgaaaagacagggaagaccgacatggaagaaatcgatatgtgtttctggcaaaaactagagaactgataaataaacctggttaagttctactcctaagctactaggaactgcaactgcaattcgagatgcaacacagaattaccggattgaagccaatgccaaagatttcataccacccagaattaacgaagaacctatcatgtatccatgtctcacatccagaaatcaagagtttgaaattctttctgttaactgtttccgaactaggcataaaagaaagaagagtttgcagaggcttcacgaaagcgagaagcaaaaccccaacagtcaggtaaaaaactacacaagattcatcatcaacagcataagcatggatgcactgaaacaattctgactgacagtctgaatctctctctgtctataactacgataagccaatggttgatcttgcttctcggaaaatccatctcctccttcttggagcaactcagaatccccccttctgcagcagttcaggaatcagaatcgaattcaccaactcgaaatctcccagaaccagtggcgaaagagatgaaagatttggacttttgtgcgtacctcgttcaccttgtagcgatcgcggctcacctcccagagcgagttcccagggcaaatcgactgcggagaagagaaagcagggaagtgatcagcaatcgaaagaagaagtaagaagaaggagagaattcgtgggtggcggatgaagaaatcgtgctccatctatggctgcacacgcacgtcgacttgtcgctggacgctcctgggccgcttcgccggcttgcgcggcgccttccggccggtgatcgcgaagaagtcggcgtcgatctcctggcgcgtcagctccaccgagaacccgcggctcgccctggcgccgccgccgccgccgccgccggcggcttccatgttccagagcttcttgttctgcagcgcgtcctcgccgccgtcccgcccgcccttccgataccgcaggttccactgcttccgcggagcttcctgcgccgccgccgccgccacaggagcgtcgcctcctttgggcggcgatcgggaggcgttacgcttgggctccacggcgtctccagcagcagcggcggcggcggcggcgttgggttcggagccgaccaaggcggcggcgtcaaggtccctgcagaaagccatgggcctgcggcacccccaggcggcggggaggtcgaagcttccgaacaacccagggtccctcggcctcggcgccgccaccgccggcgcctccgacattgctgcggcagccggggtcaccgtcgccgccggcgaggactccattggcaagaaaaccacacgcgcagacaaagagaggggattaaccagaatgcgtgttgtgtgccgcggagcagagcagcttaggtttgcgattgcatgaggcggctatatatagcgcggattaaccctcttctcttcgcttctcttcttcgattggaatgaagaagaagaagagagagtagagaagggtgggggaagagaaaggaagaagagaagggagcgaggaaaatgccgtggtttccttttggttttggacgcgactccgactccctccgctccgccgtgctcctgcgccgcgccgcctccgtgcgggagttcggttcggttgcccccgcggattctggtcgccgatttgccccgtttctcgagccacatggcccgtgtggaccgtcggattgtgatccggtggccgaggaaggggttgcccacaccggtttattttgcctttttttttctctctctccttttgtttaccagtttttatgttcatctttgttaaagaaaaaagatcggagatatttgctcttgtagtatgtaagagacatgtgagtagtatgaacatgtatttacctttcttgtcataagattaaatcagacgaaatgtgtctacgtatgcatccgtatcaggtttatgatgttcgtaggcgtgtcacgtgcctcgtcggtcgcctgtatcgtcagcgtgatagccttttttaaaggctggaacgacaaacacttacgtttcgagttgagttctaaaagataagaaaaggaattaaaagaatggcatctccaggatatatttggatacatgacgtgtacttttatttgcttccaatttatctatggcgttaactgagctaaatccctacgagctttaattgacgtgtctggcttccatccttatcttctagacgtccgtaagagtaaaataagcaaatattaaagcactctttacgaaaccatgtaacacataattacaaaaagtgcgagtcaacattggggccaccaaaactgcccggtgccacatctttcatgcattgcattttaaagaaaaaacaatttaaattgtacaatcaaaacttaagatatgatgtcataggcacaatcatgtgttacacatagcaactcatagccagagaatggtgagtatgttatatcaacatccatatcttttcggttgtaactctattacaacatgaacaactttgatttagctactgcttgtataaaatggctaagaatattgctcttaacattgtgatgaagcatttggttcatggccacaaaccatgattgactacggtttcttaatcaacatagcctggttctcatgaacttatttctccacctcgaattaccatgttctaaagaaacatttgctagtatagaacgccacactttgcttaagactttatgggagttctaacctcacagaacaagccattagaacttgtaactatgaaatggagtatatatatagtgtaacaatgagtaccatctcgacaacagtagaaactggcatcactaaaacattacttcatttttcaaaaaaaaaagaggcaaaacttgtcaaaggttcacgttcttcatacatagtcatatgccccatcggtcatctgtgttgtccgcttggtaggcttttgtaaaggtcggaaatgatgaacacttacctttgaattcaacgagacaagaaaaagaacaaaaaaggatgacatctctaggatacatttagatacatgacgtgtgcttttatttgcttccaatatatctctagcgtggcgttacctaaactagcatccttacaagctttaatttatacgtctgacttctatccttatctttcaatcctccataaaagtaacataagcaaattaaagaattctttacaaaaacttatacaacacctaaattacaaaaggtgcttgttgatattgtcgtcaccaaaactgtgtggtgttgttaattttttgcatggcatattttttaattgacttgattttttttttcaaaaagcaatctagactatagaaccaaaaacttaagggcttgtttaatttgttgccacttttagccttcttactactttaaacatacttcaaccattactactttaccaatttttctgcagttctagaagcttcctctcttagaactatacaaaatttggcaaatacatcaaaccaaacaaagctagttctaccaaaaatttggtaatgccaaaatgtggtaaaatttggcattaccaaaatttgaaatggttaatttgggcaacaaagtgaaaaggccctatgtctcgtgatgccaatgacacgatcacgagtgttgcgcatagcgactcatagcatcgagacgatgagtgtattatagcaacacccacatcgatagtagtagctccattacaacaagaactacattcttttagctaataacataaaatggttgtaataacaccacaatgcaacatttgattcatagcccataaccattagggagcgaaaccaacatggactaaggctagggctggcccattatgtatgttgggctgcacatctgttttacacgataaaaatctataattgtccattatatgtttaccacaggtttggggccccagaccgtgacccaattgattgcccatggcctaagtctgccttgacaactatggtgcgctgtactttcttaatttgttagcttcttgccgtgaactcattttgatctccactttaaattgccatagttctcctcaactaatgtttagaacaccatattttgcttaagattttacgggaatggtgatctcacccaaataaaggcattatagctcgtaagttgtatttgtaatgtgaactaccctctccgtcccaaaataagtgcagccgtaggaatccgtgttcaacgtttgaccgtctgtcttatttaaaaattttatgagaaaattaaaataagttagtcacacataaagtaatattcgtgttttatcatctaataacaataaaaatattaatcgtagaaaaatttcaaataaaacgaatggtcaaacatgagacacaaatagtgcaaaactgcacttattttgggatgaaggtagtactttgttttgaaaaagaaaacgcgggaaaacctgttttaccatgatttattatttttttatacaatatagaaaacactataccaaactattaacagtaagtattttatagaagagaagaagaaacactaagcgctattcaaaagaaaaacatatacgtcacgtacagcaagccagccgaacgtccctaataaaaacaaagaagctagccacgtaagataatccgcgcaataagtcagataaccgtctgttgcaacgcaatcgtacctcgttgacagcaggagcaacccgaaaaccaccgaacctctgacgacgccgacggggccgcgcgccgtccgccccctgctcgcgccgccccaaggcgatcacacgacgcgctcccgcacacgcagcggctgcggcgcgcatcaccaccaaaatcgcggccccgccgctgcacccaaaaaccgcctccgccaccgcttacccatccacggatccatccgtcagaatcacacgaggcgccgagcgcggagacggggaaaaacccaaaaaaaaaacgcatacgccacacgcccacacgcccacggctcggctcgtctcgtctcgtctctccctctctcttttttaaaacctgacccgcaacatcaccctcgccttctctctttcttccggcttcctcttcctcttccctcctcgcacccacctcacctcacctccctcttctcatggtcctcatggccgcctccgcctccgccgccgcctccgaccaccacacggcgcaggcgaaatcctccccctcggcggctcccccggccggctccgccacccgcactcgcctccacagcttctccttcccgaccaccttcggttggggcacccatcgcctcctccgctgctccaagaacggggactccgctcccgcctccgcctcgcctccgaagcagccgcacaccccgtcgccggagaaggggcaggagacctccgctggcggcgcctctcggccgtcgcggccttggaacctccgcacacgccgctccgccaccgtggcgcccgacgcgtcgagatcggaggccgcggggaagaaggcggcggcggcggcgggaggagggcaggcgctgctgcacccgcctgcgccgttgccggtggtcgccaagaagaggggcttctccgttgcgctcaccagggaggagatcgtcgccgacttcatcgccatccgcggcacggcgccgccgcgccggcccaagaagcgcccgcgcgccgtgcggctcgagcttgatgtaaggattttggagcctccgcgtgcgcttcatgattcctaatttttgggtctcgatcggggggtgctcaatttttgttcggttttggttcgaattgcagcggctgtatcccggattatcgctggcggacgtgaacctggattcgtacaagatcgtcgaggaggtgagatatcgctcgatacgtttgatgtgttccttcgcccaaaaaatttggttcttttcttcatgtgtgttttcctcttgcagaggtgattggcgccagcgcggtgaagtctgcaaatgagagcaacttttcagatgttcccatgttttgcttttttttcttctgacggctaacatgtccatccaataattatgttggttcttctagatcagaggatggatatagattttatggttgattgtgaataggttttctaattagaagaaaggtggaatcgtatgcgatgtttgtgccctgtggcatatgtggtgtgatgtttggttagctgtcatgttatgtacatggtttcagtctgtgaaatatttctttcggtgcaaatcgcttcaactctgcaagttgttggctgtgatatcactatgtggttttgtagtgttagtgaggatgatatttccttgtattaagctctactttctgcattgcatagatagagggaaaaagatgcagctttggtttctctgcagggcatatatcatgtcttgagttggacattgataccgaagaaaatgaaagtgtacttggggtgcaacaaagtggtttgaaaagagaaaaagaaatctcagctagtgaaattcaggtaggaaatcaaactagttatcaagggtgcgctttgttataatctcctgcttgtaagtatagcttgcattaattttttttaacagaacggcaaaatcattgccaattttcaattaagaaaggtgttagctggcattaattacctcttccagaattagttgttcatttttacatatacctttgttcaatatatttgttcattttgcaatattctgttgtttgcaaaagctggtgcacatcattcttgcttctcgaatgctgatacttctgtttttcgtctgatctctgttttgcacttttggaggagacgaagtgttcactagtcatatcctgacactgcttattagaacgatttgctaagtgcattaataatttgaacttctgcttatcgttcttgacatttggaacaccagttgtgtacctgtgtgcactatgcaggagctgaaagactgcttgattgttgcattgcgtcctttttccatactcacttagcaatctaattatgcactaatttagtattctgatgacatccatggtgagtcggtaatcaggtttttaagttatgcacggttgtgttcggagctggtgttattggattatttgattgacagtatgccctggtgtttttaggctgcaggtgagtctgggacttcaattttgtctgtctgatcatttcctatgattgattttttattttgtaaatcaagagttaaaacttaatagtgcttcatgttcacgatttacaattttacatgttgcacataattggttgatttggttccagtggtttgcattatatgtctgatgcgggtctccatccagcctgtagtgtcaatgttttactcttgcagacgcagaatggtggtacaagtagtcattttacttctgctgtggtcctgtggacatcaaatttcagaaattccatgttaggtttatgagttatttttcaggtaaaatgcttatcttttttggctgaaccatcagtatctccaggctttgttcctgacaggtagtgccgtttggctagagctagatgatgttcttcactcttgagtggcttgatgcatgatcagtgcgcccttccagccgttccagttctccatagtccagatttgcttcttgtggctactgactaactgaaactagtaattattagcatacctatatactgatcatgtttaaaatatctgctggattaattcatatgaattttggcgaaagcaatattgttgagtgccttttggacgtgtccgttctcttctttttcatggacatgtcgctggtgttgtaatcgcacaagagagtgtgtttgttcaaactagtgcagaactgcgttgatgagatagtgtacatttgtgccaactccctacccaattatccttcgaacgtcttttgtcatcctcgagatgtgactttactgtactttctgaatgcctcatttggtgatgtgagaaccttcaaaaaatccaacatggggaatgtttctctgaacgtgtggcatgcagcacacgacatcaagatcacactccaaggggatagcctgaccaatctttcagacacattgtaatttttagaaatccattgactatcttaagcttccaaatatctaactcctgcaattggattgggaagaacagcacaaaacattccctcagatgtacaacaagtgttctgtaattacagttgatgttccacattgcagtacatgaaaggctggggatgagactgagaggccctttcgttagtctggcccataccttgactgtctcatccagtacagcaatcctgcaaaataggccggaggcaaagcctggaagtgatattgcacagtacgaaatttgatcatgtcaagaaacagtgacgagttctgatatctgaatccttcatgtggtaaagttagagcgtagcttgaacactcttgtgaacatcctttcctactattggatgagacgatcagaggatatgaaattgttggccaaggctgacgcggcccagcacacttaaactgtctgatactctgtcagtctattggctcaaataacggtgcatttgctcgtcagttcttttttctttttcaaactaaattggccaattatatttcaataagcagaagtaaaaatgcaaaaagctaatgatgacggagcccaaacgcaggtctatcattctgttgttaaccacaactagtagtccggttcaatcccttctgactagtaaggaagtactccttccgtccgtgaatataagggattctactatttgtttttacaaaaattaagataatagtaaaagaacaaatcacgatacaaatggttggaagaacaaagtagtaaaaaagtgattagacgggaaacccatcaatacaaaaggtgataagtgaaaaataaactatataaaagatgataagtgaggaataaagtactgtcttgggattacaaaattacttatattttcatataaatttaaagggtataattccttacttcctccgtttcacaatgtaagttattctagcatttttcatattcatattgatgttaatgaatctaacatcaatatgaatgtggaaaatgctagaataacttacattgtgaaacggagggagtatattttaggatgaaatgaaaggagtagtgaaatagccgtatgacagcttgactgcagttgctgggcttctgcagggttgcgatgctgcattctatttgggccgagccgtccccaagaatctacttacttgcgattatccaggagacttggcattcgtatactgcagcgatgatacaggcaaaagtactggactggagtatactgaaatagggagtacagtaccatagagcagtggtatagtactgcgacattatattacagtagaaccgcttcgagcaaaacacagtacttgcattgctgctaatcatggcgatttgagggcaggtgatcgatgactgtgtataaaaagcctggcttatgtcggacgtgtcgcctacaaggtatacatacgcataaaacaatgtacaactctgcatacaacgtacacatacgcgtaccaaccgaccatgtgaagtgcaattttttttgaaaaagaaaaagaaaaaaatgaccagaaacttctggaagcgagtatccaatgcctgaagtccgcgacagtataaaacgatgctgaaaatctgatgcggtagactgctgctgtagaatccaaacaagaaagaaaacaatccaaaagagagtgaaaatcgtaatgccactgaattccagctctttgaccgtacgggaaaactggagaggaggggtaaaagaaaaaaaacagaaagaaagaaagaaagaaagaaagaaagaaagaaaaaagagtaggagacggggacgaatttgtttgttcctagctggcaacagcaagaacaccaggcaccaacccacacgcccaacacaatccttctccccctcgatcagtaatcacacactaagcgtggcattacccatccaatcatcccaacaacaaccagctggaaaatggatggaacatgtcaagcatccaccatggcattagccacctcaaactactactactagcagcagcagcaggaggaggattaattaaacaaacaaaacaaacaaaaccaaaccaaaaaaaattcagctccggaaatagagcaggtcacccgttgcactgcaacaaacactgatgaaaaatcatatactagactgtactcattatctgtctcaaaattctgaacacggtggataattagatgattagtactactcactacatacatacagtgccgcggttaggaggagagcgatgtgatgaatcaccacctctccaagaaagagtacacaaattctgctgcaatgaagaagaacacttctcatcagttgcatagcttagcttctctctctctacgttaattacctttgtctcttctttctatgtcactggctactttttctgggcccaccgagcagtgtcagagaagggcgccgccgggacactggaaaattggcggcctaaaccctcgaacccccaaaagccttcaatgaagtgactgcggcgccgtgcggcggcggcggcggcggcgagctcaccccaccatgtcgcagtactgcatccgcggcaaccggagcagccgcggcggcaacgtcggcggcggcggcggctctggttccgtctccatggcgtacaggtagtcgttggtgccctcgctgcgcggtggcggtgactgatcggcgaggaagctgcggatggtggcgaggcctgggccgcgcacgtcgcgctcccaggaggcggactcggcggcggagcccgcccgcgtgagcctggcgcggactgtgtcggaggcgtcgaggcggtggatgggccagccccaggcgtcggacatgcggcggatcttggacacctgcgcggcggcgaggacgcgggtgttggctttgatgtcgtcgatcgcctcggagaaggtcttgcgcccggcgaagtagtcgccgagctcggggacgccgatggccttgcccagcccggagtgcgcggcgcgctccgcggcggttgtcgtggcgaagtactcccggagctcctcgaccatgccagcgtccaccatgtcgtccacgcggcggtcgaggtactcgtcgaggagcgcctcatcgacgtggacccagagcaggcagcacgggaaccggagcgccgggcggtagtggcggaaggcggcggcgggggagaagggatcgccagcggaggcgtcgaagtggtcggcgaggagggcgtggatgagggagttcgacccaccggcgatgaccggcacgagccgcctcgccgcgatcgacgcggccgtggcggcggcgagggaccggaaggacgacggcgggagctcgccggcctcggggcggatggctccgaggaggtggtgcggcacgccacggcggtcggcgaggctcaccttgttggtggtcacgtcgaggccgtcatagagctgaatcttgtcggcgttgacaacctcgccgccgatcaccttggcggcgtcgatggacagcttggtcttcccggtgcccgtggcgccgacgatcaccaccatcctcgtatcctcgccgccgggccggcggtggagccgcaatggccggctcgccgccgccgcggcccgcacgagcgtggcaatcctggtggcaacgctggtcatgtaggggaaactagaaagggagactagacctctcctccaatcctgattaggccgccttatgaccttgttttgtccgttcctaatcacaaaacgctcatgtgcttgttgcttccgtctcacatctcccaaattctctctctctctcttacccccgggcttctctttgtttttttttttgcgcgaaactgggtctgatttttgtttctacccgcctaaaaattctctttggcttgtgcgtatacgcggcacacgcagacgcagggcagtagtgggtcgcttggcttgtgcgcacaacggcagtagtagtagcagccgaggagactagacatggccgcggcgtcgcgtgcttaaataataagccggaggcggagccaagcacccgtatcctggcgcgccgggacgtgacgcgatcacgcgacgcgacgaccgggtggaatgcaagtgggggacccggcatacggcgccgcggtggtgtgtgcaagcgttggattcggcaaagccacaaaccggcgcgcggctggctgggctgggttggtcgtccacctgaagggggagttcgcgcggggtcgtggtccctgtctcaccgtgcgcggggtcgcgggctctcgcgcccgcgggaaacgcagaattctcctgtattttcggggttttcccccgcctttcggcgacgcaggccgccgcttcgtgtggcgcctagactactggccggtgacggtgagtgcagccaccggtgcacgctcccatcccggcaagaaaaaaaaaaaaagaggagacaacccgagcggctggctggtcgcgagtccgcgtactactactactactactggtagtacgtggtagcgacctcggttcggtcggtggacggtgatacgtttttttgacttttggcgatcatcggcgacgcttggggtaatacgatcccatgtcgttctcttttccgggagacaaagcgattgatacgcccaggttcgggtgccgttgaaaatcccggacggtgctgcgtcgtcgtgccactgcgccgtgggaccctcgtaaatctagcgattgccgctgcccctccagcgtgcggcagccacacgacggacggcaatggaatggagagaatttgggggtttggagataagcctcccagattggtgctaacaacgtctgtacccatcacttgcactctcgcacggtcacatggctatactagcgcccatggcagatcggcagaggctagtacgtagtacgtggccagggctatatatatttcttccccttggcttgtttgcggcgatggattggctcggacactgtcgatcgactacagctactactacagctacagctgcagctgctgggatctgtgcagctgcaggattgggccagcctttctttctcgcgaggctctgaattctgatctgatgaaaagatgcctcgaggaatgactggctcatcaaagagcacgcaggttcttggcatgggtttcgtttcgtttcgatgagggtccatctgtactcgcctgcggcctgcaaagagctgctgcccacagtactgttccaagtagttttattgtgctggaaacatttgtgtactgtgacttgaatgtcctccaagtactgtactactgtgcgtttgaatgtggtcaggctggttagaagtactacgagtactcctaccctgcagtagttttggagatttcaccggtcatactccctctatccaaaaagtttaggtcacaatattacaattttctcattttctataatcaaaaccatgaaaaaatcaactcaatgcacatgtaacaaattaaaaaaagctacactaatatatacaacatataaatatatattaagataactacttgggttcggatcaataatttaatttagcactgcgacaatatgaaaagataatctctacatttaagtcttgaatataaatatgaccatctcatttattaaaaaatataaaaaatatgcttaagacttttaaatggagggagcagatcataacattaattttgcgctttaatttagcattgtgacattatgaaaagataatctctacatttcagtctcgaatataaatataaccatctcatttattaaaaaatataaaaaatatgcttaagacttttaaatggaaggagcagaccatatcattaattttaggcaaaattggttatatagcatcgaaagttcacgtttttggttttatagcaccgaaagataccggttcactttaatagcaaccaaagtttaccctgttcccatttttagcacttccgtcaatttttccgtccgtcttgatcgttattgacctagctacgcacacgatatgacgtttctacccctcattaacatgcattctacttgtacttgtgaggggtagaaacattatattgtgtgtgtggctggatcaagacggacggaaaacgatgtgacagattgacggaagtgctaaaaatgggaacagggtgaactttgggtgctattaaagtgaaccggtatctttcggtgctataaaataaaaaacgtgaactttcgatgctatataaccaatttttccttaattttacgctcctctcaaaattttgtcaaatagcaacgtccaaaaaatgccattgctgttgtaggaaatattcccttatttgatatggtaattttatcttaaactatttttcctatattttttttatgttttgaactaatcagcatcaaatattaagggataaatgtagtgttataagagttcgtgggtataaaatggagatcttatatgagccatgaaattgactctagctaggtgaatggaaatgtcacattgcttggtcacatgactcggtcacttgaaaggtgactccatgaccaaacggaggaaggttcgaaatataagatgagaaacaatctttagaggaagagttagtaggagtacgtgattattttgtactccgtcgttgacatgcatatatattgttgcgttgctatcaagcgagaaaactgacaggtcagctcaccatggccgtaatatttggaacggcaacgaattgtttccctttcaagaacaacttgaactaattttgaattgtcacttacgtgtgtgagaaatttcgtcatcgtatcacatgaattccctctaaaatactactgctttctgaaggttggcttcaagcgagtgagagagacccctgctttattcttacatatacttgccaaatccttttgcattcttccacagagaaagggtggaagagatgcgcgaggacttggggcttgtttgacattttgattgtgacactagtaaattctgctgctaaggcccttgtttgtgataactgaaatcgatggattatttgatttttatggtaaccatttgaggatatatacagatgaataaattaactgctatagagttgaaaaagttgctttaaaaagtatcccatgaaaaatttgcatactctagtattttatatgaaacgtatcgtttagtagctttagaagcgtgcaaatgaaaatctagaatccagaatcagaaaagaacatggccgaattcatgcacttgcacctggagcatcaaagctagagtataaacaaagaacattgcaaaagtttttggttggcattttttatcaacttccaaaagcaaaggttggattgacaaatataatccgatacctcgtctgtgcacgcgcttataggtcagagcccataaccttgcgctgcacatatcctttgccattaggttggcatatttcggctgcagttggattctcatatcgaatcaacttgttctcactgtttttcatcacaaaaaaaattcttgattagaaccaaatgaggaaaatctgtggcagtatcgagatctatacgaaccccaattatttaggcgatcgaatccctcaaaagccatgcatggcgtcaaaagcgtccgttgattattaaggatcgatggatgcatgcagagacgactgcgtacgacacaagtgggttcacatcctctatcataatatcactgtcactacaactatcactacagacactaacgtgtagatcgaacaataagagagtatgactcacaaccagtgactataatagtagttatacattatagtagagaatcctcaccggacaaaaatgagctgcaccaaagcaccagatattatgcgatcgcggccacagtttggactctgggaggatgtggtgtacgttgttcatcagcaagagaattttgtgtgaaatggtactgatgcacatacatttcggtacctttcttttgctacggaaagatggagggtatattgatcgggatcttgtttcgccaaaaggaagtactccagtacgtacagaaatcgatacgtatttgttacggcccttttgatgtgcccggccacttactccagtggaatcgaatcaagatgtggcatgtcttctcgatcagggctgtccgtcctcgatcgcaagatggtcgtccatgtgcctgtcgttggcactctggttaattccatgtgcccaaacaaaaaaaaaacaaataaacggcttatataagagtaaaattatgtgggcggatgcatttcaataacaatttagtgagttcgcagatttatcattatcctcgaatatgtgttgtgcatttcataataccacacgtatattgtgtgcaagtgaatgttgttgtatgtatatgtgtatcttcaacaaggacaagaggttgttcggtattcttgccattgcttgggaaatctggagaaaaatgattgtgggaatctttagagggaaagaggcaacaatccatcaaataatcaatcgcatccaataggagttgggatggtgggactcaccggcataaagcacatcaggagaatgttgccatgaggtgtaaggagagttgacgtgcaagtttgtttgcactcgaatttgtactttttttttcttttggcctttagctgtgtgtacttaaactcccttctatcaatataagacaagtctaatcagactgaccgttcaaaaagaaaaaaaagttgttcggctatgatttttagagtagtaagccatgtctaccagggtttacgttaccgccggtaaccgcatggttaccgcgggggtacggtaatataaataccacggtaacctctttaaattcaaataaattttaaaaataatttgaatttttgataaattcggtatggttttgtacggtttttcacggttaccgcgattactgtgcttaccgccggggtacggtaaccccggccccggcggtttgggaaaccctggcgtctactactcacggctatacccgcaaccacaaaaataacggccaaacaagcacaatgttattagcaaaactttctataccgaaccaccaagtttttaggcaaaaactgtcacagaacagtactgttttgtccgactcacctcttcaacgacgtcgttgcatctcccatccacatcagacgagcgtatatcggatcggagcacgggaggccgccgcaatgcgcaggtaacagcgcgagtgcaaccggctttctccgcgtcggttctccgccaccggtggtgggctctgcaaaccgcgtcgcgtgatggatacagacacggcaaaatccggcgtggagcctgacccaacttggccaagcgaagcgcggagttggaacttggaagcgagcagttcgggcactgagatcgatcgtgagaccccgacgaggtgtgctctaattgatctgtgtaatttagagttcagctagctttgtccctactttatataattagatactccctcggtcccttcgttccataatataaaacacaactacttttttaaaaatgttccagcatgcatacatgcatacaattaactagcaccttttctccattaaattattacttttttaaatcattcacgctcaagatctctaattctattggatgcatgtattatacttcctccatctatttttgatagtcatatttctaaatttgaaaattttatttttgataggcatatttcacttcaacaacctatcatcttaattactttcttggatttaatgcatgactcttcattcttccacacaagattggctacataggcatcgagaaatgtaaatatcaatgaatcgcttgtttacgaggaatgactagtagtatgtttaaatggatgataattagaattacttatcctttgtctgtcaagatgaaatatgactatcaaaagtagatagaggtagtatttattagggtgatccaaactaagagatgataataattgtttttcttgatcttttggttaagggtggttgtgccttatactctcttcatctacttttgataggcatatttttaaatctgaaaaaaaatatttttataggcatattacaatccaaaacctattctcttagtgactttctcggatttaatgcgtgactctccattcttccacacaggattggctacatgggcatcgagaaatgtaaatattaatgaatcgcttgtttacgaggaataactagtagcatatttaaatggatgataagtagaattacttatccttagtctgtgtgctaaaatgaaatatgactatcaaaagtatatggagggagtattttggaacggagtgagtatctcgcaatttcagaatctccagttctccaaatagcttagaatcttatataggagtagttttttaaatcaataattctagaattcggcatatgaactttagcaggtagatattggaaaaatcaagttttctaaaattttcgtccgttgtttcttataattttgggcttctaaaacatagccgaagtatgattcggggtaaatgatctgaggcccctttttttttcaataattttgaacaggctaggatttgacacgaaatcatgccttttttccttggatgtgcactggattgggtggtcaatttctatgcaaatggaagccggtccatgcatggcggtgcattgatgcccattggaccatggcgtccatcatcctccatgtacatactacacaggaggattattccaacttccgaagttaacacccaacctgagattaatttcgacgtggaattaattaatgaagccttctcccctgcggcggtgcagccatccctgattaattttcaagtggagatcaatcgataaagacggacgacgacgacgacggcgacggcgacgtttgcatgctccatcgtcgctgctaattaagagcaagtttaatactatagctaactactaacttcaatttatctgtagccaatctaatagctcatttatataatatttacatactacactattaatatttggtcccacctattatacatacactgtgtcttaaagtccgtgctacaattggctacatatctgtagtccgctacttttctctcttcttatttatcttcttaaaatatgtttatagctggcttgtagcgtgtcactgtacatgctctaagcaggacgcggcaacgccacacgcgccgcgcccacatgggtcccgacgtcgacgtggccttgtgtgtgccgcggtggtgcaggaacgagttggacacaggacacagcccatgctgtcccttggaaagatttgccctcaatcatgtgttttaggcgaaaagttctacaaatccaggagttgtaaaatttacacataggatatgattctactttgcatttcctttttcctttttcttttgtcaaatgttgcattttaaagactattgatgcatttacctcactcgttgttttcttattggcttgtcagccataaccaaaacttttatttcgaaacttaaaatttgaagctggttttaaggttttctttatcgtactttatttttcaatattagttttcaaatcattgaaaacacatatataaaagtcatagatataaagcattttgattatttcattcatttttcacttgattatgggtcatagagcgaacgatgagttaggtaaaacaacagtaaccttttatgactgccctgaataatctcaatgcttcttttttttagataataatctcaatgcttcttgtatttaaaatataagcacttgaagaattaatttttttatcaaaatgtaaacacttataaagtattacttgtccaatcaataatcaccctcattcaatttacttccagtcttatcccctactaaactcctacccccaacaaatgccttatttaacaagaggcatataccttgttcttgggtaaaactcccagaagcacttatattttagaacatagggagtgtttgttactcgaaatttgagcactcggtcttttttccaaagaatttataaaaatttggaaagaaggcgtaccaagtatgttgcatcctaagcataagcttgagttttttaagttcatcattgtataaccatctaaaaaaaatattattggtggtcaaagtcaaaacaatgccgatcaaccgcgaaagtttttaggaatggatggagtactatacatggagagtgctattagagcaggtacaatagcagactattagtcagctataaacatattttaatgagataaaagatgtgagagaagagtagtgggctacagatctgtagctagctgtagcacggactccaagacgcaatgtgtgtatgacatgtgggaccatatattaataatatagtaagtaactattgtatgaattgactattagattggctataaataaattggagctagtagtgggctatactattaaacttgctcttacgccgctccacttaatttatttctacgtgccacgtctccttaaaaccatagtcatcaattaaagcacaaaatcctggataaaaaggcccagcctatatagctaggtacctagtagcagagaaaggagggaagggtgatattgatataccacttgcttccaataccttaattatttatcccttttgtggtgtggaaatcatcaacgtcgattactagcatcattttactctctgaatattatgggtatataactatatatatatgtatcgtgtatcgtcagaataaatcacacatttgtgatcatttgcgatctgattcaacgcaagccaatgttttattaaagtgcaactagccacagcaaaatgcaatgcacatagctaaaacgtatgtatgggatgggtatattccacgtagcgtgtgtcttccacttggcaaaagaccttgtcacatagatctatccgaagccgaccaatagaattaaagccttatggtcttctagaaattagtactattaactaaaattctcttgcagttaatgtctgtatcgattattaatgtagcatgcgtcagacagtttatcaacaacgttaaaacgataggttatgtaagaaatgttaagatatacaaagttggtattcttttgtgagttgttttggctgtgtgcttggatgatgagcttatcactggccataatgcctactgcagtttattccatttgcccatgttttatttgtttgttatttttgtcagtaccatcatggcgtcatgtgtctattgagttaatgaaaattttatctgccaagtgtctgtagttttgtgcatcgatgcatgaatgtgggagatgacgaacatccatgtaaggagtatatataatttttttacttaactcaattgacaggactcaaggatgacgatcaagtatcgatctggatatcaaaagtttagcactatgaagagctagtaatgacaaatttatattgtaaattgcagtgatgttaacatgtcctcaccacagctgccagccaacgttcccaatatactagtcttattcatcgtaagttatcctaattttggtgatgttaactaaccctccgctatttatctcagagatttcgtcgaaggaaatactacttttctcaatttgttaaattctatagtagtgaatttactcgtaaaaagctaggggttgttcagattgtagccaaaataaaccttactggcattttggcaatattaccaaaattttggtaggatttcttatatatttatcaaagtttggtaagaaacaaaatggatgcacatatttgacaactttaccgaaaaaatgatagggtttgaaatgaaatcaatctaaacaagcccctagtcaagaatgagggttttttttattggttctacataggcgcacttgcgctgacaggtctcccccagacggatattcgtacattttcatagtgattctatacaatcagaatagtctagcttctggaatagggtggtacagttttcctgagcaacatcgcgagttgatatgattacaatccatatgttctaatgcttcagagtttgattaatctttacattaatactacaaacaaagaagatttggataatggaaacaatttctatcctctgcaaactggttgcttagtggtggggaagtgcactatatatgatgcattatagagctaattaagaccatggtcaaagctatatagcatctcacaataatgatcctaccccccaaaaaaaacaatatccttaagctatgcaagtgtctaactaatctccattcaagagtcccattgaccttcaaaagaaaaggttcttggaaaaagaagaacaaactaaaaaaaaacattaagtgaagagttggagggaacaggtcaactattatcctggatagaaggtcctaatatactatattagtctcagcaaagagtggaggcagccgtcaccttcgatgtgttggcatgtctccggttttttaagggtttaaccctgcatatgtgcggctgaacataatacgtccaaagttggagggttgaatggttgatgatgaggagcagtccaagtgatctgagcagtagtttaagccaccactacaaccaaagcatgtcttttagcagagagacgttgctgagttgcttctacatgcttggaccattgtctttccatgtccttttgtgactgcttatcaacaactactatcttgttagcttctctccagaacaatactagtactagtatatcacattatattctaccatttggtcggtggtttactgggtgtgtgctcttgcagtcaatcagtcatgtggtttaccgtcctgctgccctatcatttggcttattcatggcatatttacaaataagaaaataatttataaattatatatatatatatatatatatatatatatatatatatatatatatatatatatatatatatatatatatatatttggtgctccatggtgcccgggaaccattgttgaaattgagtatatacccaattcaaatgagtatgaaactttttcaattacttagttattaacattaactactttactaactagttcaaagtaagtttgaactgaatttgaacttgttttcgttagattttgattctagatatatagcatccatacatataattagttaggtatgtaatcatggattgtgaaataaagttaaatttgagttgttttgttgataggtataggtatggatcgaattattataactaggtatatactcacaatttaaaaaatttaagtgactttgtgcattagataccatggtgcccgggcaccatagtgccccatatgagtgtcacacacacacacacacacatatatatatatatatatatatatatgtgtgtgtgtgttcttagcagtttaaagtaaaaactgaaaaataaacttcgatgaagcaaccccaaaattaactccaaatttaaaattgaaaattcaaattttggcttatacataagcataagcgaaaatatgagacccctagagctaatgctgaacttttttttttaagataatggaatgtaacattccagcctttaataatgctaaaaacttgaaagtagaagagcacttgcagttttctttgaggagagaattaaagcatcgccaatggatgtttaatatggtttttaatcctaaaatttaatatttttttaataaaaaatttggctctaacaatttatctgattactttccaaaattaaaaatacccttctcgtcattcttgctctccactagtgggaaagcgcccaggttcctaatccgcctcccatgcacgggattgagtgacgcatgggggaggtatcatgcgctaggaggggagggatcgtgctcgctgaggaagggggtgagcaattttttttctatttctgttggtagtttggggttgattcactttttattattattatgagtcaacttatatatatatatatatatatatatatatatatatatatatatatatatatatatatatatatatatatatatatatatatatattgaaaagaggaatcttacacctcaagaatccgaaaacaaaattttggagataaatttttaggcatatattgctgatgtgcttactgagactcgtagaaaaaaaagggagaagtggttgatcatttatactccatctgttacgtaaaaaaaaaaatcaaattctgtgtaggtttttacagcacagagggagtatgcaggttttgcatgtaccctagtttggtcagtgactcagtgttatagttgtacttgtgtgtttgcatgtcttgtggcaatataaggtgcggtgtctctacgttttatttttaacagattttacattctcgttcttgtaacaataggactgtaatatgctcttattaacatatttggccatattttttttaaaaaaaagacttacagaagaagatgatgatctctttttatccccatcactgcatttaaagatgcaaaaagccatactgattatcgcatttttttttcacaccaaatatagtagaaaaatacaacaggctgcaaatatacttatgaagtactataaaattcaactcgtaccaatccaattgctaatgttaattagtaagtgccatgctgcgcctcagaaatgggaataggtgacgacgtccaaggcattactttgatcattttgctccctcattatgggcctccggtattttaactcccaaatcaagttgcccaaatgcccaattaataatgtggagttaaatgcatcgtgtcatctcctgctcgagtggcaagcagcaatacgagctgtactcccataaaacaatcattgctgatttcacatgaaaaccttcatctgaaacctaccaagttggatatatatgtattaggcaccaaaaaagggtcaagataatggggcagttgttgggaactaccacttgtgtattgataaaaaaaaaatgtttccaaccacaaatttcagtgcccagcaaaatgggaaaggaatgtgacaaattgccaaattgagtgtcacaaatttgtcataactccattgtagtaatactctccagatacaagtcgttttagacttgcatgtgtacaggagtaattaaacagttaacgtgacattgttgctctgtattcattgcacattgaaactgaaaatgagatcctattctttcacgaaaataatactcgctccgtcctctttaaaatatactccgcaaccaccttttcgatgtttcatagtaatataaagcgcgcattcatacgtgcaattaactagcatctccccctctcctttaattcttttctaaaactttcacccttaagatttttaattttattggatacatgtattatatttattgacgtgatccaaacaagaaagtgatagtaatttttcttggttttgtgttagtggtagttgcgcattatgtttcgggacaggggagtatcattcaattaacaacgagaatatagtgaataaatgtcttagaaactaaccaacttagattaaaaagaaagtgaaaaacaacagcaacatacatttaaaatcggagactaggctgagttttaagccacttctcggcttaggctactttcttgaattgctaaactgtgcgttccacgaaaaactttttatataattttttaataaataaattaattcatttttcatgtttagttatgctactcaaaatatcattcccaaacccacaaacaaacgcagcctaccaattagacttatatatcatatatcatgggggcacctggccaaacccaaaaagcccaagaaaataagctgacctgtttgtgtatttctattttgtttggaataataaaatgttatccgccttgtgggctgcgcccgagatgttcgaataacgaaagagaccgcgcgacggaaatgatcaagctaacaaataaacaaaacaagaaaaaggaacaaaagaaacaagccgataacatccagatcaacgggccaggcccaactagaaaattagcagccctgctggttggttgctctctcctccccacctcccgtccaccggcgccgacggccggcttgccgtcgaggcgtcgacagccgagccgccgcatctgttgcgctgtaagcggaatgtatggcggcgaggaactctaccacacgggagccgagaagacggtgttcgagccgctactaccctgcctgcgctggtgctctgctgcctcgtcaaaccaggaaaactggtggtcggggaagaaaactccgaacccctcctcctcactggagaaaaagtggaaaacagaacaagcaagccaataccttcagccaccgatcaatagtgtttttatgaaccgacatgctgcacgaatcgctcccgcgtctcctacatgaaacagattggtgaactagttgatatactactagtatgataggcagataaacactgacacagttgtggaacagtaaagaaggccacaggaccgaggacgatgtagaactgttggtacgaacaacaaaacagcgatttggagacaacaaagcaatggggatatatagagtacatacatcgaagttatacgttgtccacaaaaaaaaaagacacgtgtaaacagaagcagcagcaatacagttgtcaaggtctgccggcgatcctcttgcgaaaacaggggtcggagaagaaaactccgccacctcctcaaccgataaaactgaaaaggaaaaaaaaattacatcagattaacgggctcggcccaatgcaaactagacctcccttacatggcctctgccgtccaacggcgtccgacggcatggctcagcgtctacagtagagctgccgcatctctttatatagaagggtatgtttagtatttgttcaaaatatagaatgggttatttagtaatttgaagttgagatttatttgcaccggggggagttaatctggaaaggtttgcttagttggtatttgttttggatctcgtcgtccgttcgacgagcagcggcgcttcttcggaatatatcacgcggggcggcggatcgaaagattcccaaacaccggcacgccatcatccagccagtgtccggttgtgcgactacgatgcttgtatacatgattgatcgaaacgaatatcagcatttgctagcacatacgaagttacgaactctaaaagaccctatgaatcttcgactgctttcagaattaatttgctgacgtttcattgttttgctgcgcgtggcggcccttgatcgccgtggctgctgggggcgagccagggacgcgtgcagcggctgtcaccggcagcgcatgggactagcccctttctcacgatccgatctgactaaagaaggaatcatgaaaatacaaaaataaccttccgcaaaaatatagaaagacaaatataccctacataatttatactgtaaaagaaagatcagataaatccacaccgttagattgtttatactataagtatatattacaagtgtagtgtattagattgtttatactacaagtatatattacaagtgtagtgtaccgtaaaagttctcaaactctgaccacctcctcaacaagtaaaaatgaaggaaaataaaacaaacaagccaatagccaccgatcgatagcatttttgtgaatcgacatgctgcacgaatcgacaagccaaacgtgcagggtttatcttttcattttcgatgtgaaaactagtaaaaaccgatgagtttcggtcaacgcaccaatatctttttgttttgaagtggaaactagtaaaaagtgataactttctatcaacgtcatatgaaatccaataccggtcggctttcaccaacaaacagattgtatgaaaaccaaacagtcgaaaaccaataaatttggtgaaacttgttcacgtgtcttctgtgcgaagcatattgcacactcacttttatttttattgtttgacgtacacttcagtagttgatacgagtagtacttagacagacagataaacaatgacgttttacggtgaaaaaggccaacaggactgaggaagatataagaaccagatcagcattacaagaacaatcaccttaaaacttacaaagaacctaagtataaacatgtcatgaacaatgcgtgcaaccgtgcaagggagaaaaaccaagtatattcaacattcttcgtgtcctggaatatccggttatacagcagaagaattatacagtgctcgtgtgctagtacattttgggggtggaaacgtaccttctacctcgagcctgcttaaataattgttacaaaatgagaagtatgagaagacatcgacacaagattaccatttacacccaactcagcttttctaaggcagatcccagcagccaatttgcaaacaacaaagcaaatgggatatacagagtagagacatgcgaaagttatatgcccttcgtccaaaagaccatgcgtaaacagaagcagcagcaatacagttgtcaaggtctgccggcgatcctcttggctcctgcaatgtgccgatatttcaaagttgcatttaatgctgaataacagtaaggattcacaaaggagtacttgtgtaacaaaaagacctaagtgaatagtacgggagaaaatccattaatccatttatgctggtataaatatctctcaaataaaaaaatggaggtggtttcaaaatctcagaatctaagcccattactaacatcaaaatgttcttgagaaggacatcagaaaagataagccccttacaggctagtggttgattaattgatacagtaacagatgaggtgttgatataatacaaaccaactacaaattccccagtgttcttaataaaaaatctccctaaaatacaaaccgaaactgcatgattaattctttgtacctatatggttctgtatatgctatgcatgaacctattgaggtattggtagaactccaaaacaaaaatctttgctcttaccaagaatgtccaaaggattgcaatatcacctccagagataaacatcactctacatcgcaaagcccagttccatattactagctatcaacgccttcgtcatcgtcatcgtcatcatcttcatcataatcatcatattcatcttcatcacttgattcatcaaaatcatcttggtcctggacacgttaaagggaagaatggattttatggtggttctaaaacagacagcatcagtttcaaaagattggatacctcgtcgtatcttgcagaggaaactgcttcattattctcattttctgaatctgaaccgtcctcttcatattcctcatcaacctcaatgccctattttgttttgacataaaatcaggaaagcattcatcaatgaagacattaactaaaagacatatatgatcaatttatcactagcgcaccaacagatatatgcctcactgtcaaaaacatctctgctgaaaaaaaatgcagtctaagggaaagttgttgccttaataatgaaatgccaatgaataacaacatttgtttttttgctaaaacaataggtaaatattgtggaatttaaaggccatttagtgggcagaggatcaactaagatgcatgttaatatgtttttactctgatgcaaatggcaaaaattacaaaaggcatggcatcatattacattttaagcctacagaaattagttttagtgctgtataatgagaagaaaaaagggttcgttatgctaaatgtttgccttaattaaaacacaactacttttctgtaatatgagaaattacgtaccaaatccaacttcatctgccttatattgttttccagttcagctatatgctgactgagggcctgcataacaattcatgagtttaaacaatatcagaaggatgctaaagttgtgtacaatgattatcataaaaaaagaaggtactgctcttgcttttttcttttgtagcaaactaacctcatgacgctgcattgcaacagcacgcttcaatgcctttgcttttgttaaaagattcctaggccttatgttaataggcctcctataattctttccacggtaaaatataagtgcatagccctttgtaactctttcaatggcgactagtataccgccactctcatactctagaagccgtgccgtctcctcaacaaagggcagagtcttctgctttgttatcaatttgacaacttccctgtgcttccaatgcaagtgcatattttcaatgacgccatcaaagacaccacgaattcctaaaatggaagggggaataatcaatcaatagaaatagtatagaatgctctccaaggttattgttcaagaaactcaccaacaggcaagtatgccttaagacgcaaaccgattctacggaaaacagatctttcctcatctgtaatcatttctttatcatcagatggattagcaaggaccatagaagcttctatctttgatagtaaccgctctgctctatgtatttttgcctgtgcctgaacaattgaagaagaaataaagaacatgcataacaactgatggaaataaatatatgtcaaataagcacactggcatacctagatcaacggcataattaaaaaatggcaatacaaaataagacaagttttatcagagaacatgcagaaaatgcttacaatggaaagtttgtgctctagtctcttgaaaagcttttccttcactgatctagaagatgcttctttcatttcttcttgctccttagcagttacttcccttccccaacgagcttgagcctcctgaaattcagcaagagtacccgcaagagcatgcccatctaaactgtcatccattgagtgcacaaccggaatgcatcttttctgctcctctacattctggatatcttttgtcaactcctctctttcagccaaagcagctgcaacagatgttggaaggaagtcttttccacgatatattacaatgtagtacttatttcgaagaagcaaggtgccccctgttagattctgaaataatgttaaaaagataaggcttcactgattcagaaatcctatacaggttaaatcaaatatagtgcatgaacagttgaacacagttgattcatggaaacacacctttggaactctatgaaagttcgacaaggaatagaactaaactatatgaagctgtctccatcatgatcttggtaaagcatgattgtctatgatggtgtttagacaaataaaagcattacattaagcaagttatattcattagagcaagcagtgcagcacaattttgttattattttccgaaacccctggtgttgctttggatgatttaacaaatcatggattttgtaatattcacaggacaaatatggacttcatcaaaacctactgctgagtaagtgagtactgagtattccttatagttgccccttttttatcaggatttttagttgaatttcttcatgcctcaaatacgactagatatatcatatattcagcttagctatgacaagcaattgtatatttagatataatctggcaattaccatagttttcaatgttccttggcataaattctgtgaactgtgaagtaagtaggtatgccagtcaatgagtcaaaacagcaacagcatggtgtccaaacctttatttcttctgacattagcttgttgtttgtattctggattccacgtttcacagctattttcaccaccaaactcttctcccagagcttaacaatagctgctgcaaggccttgatgattccggtttctcccttaaatgaattttatcaagcagtagtcaggcgtttgccaccaacaaataaaagctataataggggataaacaatatgaacactgtcgaaataatcacctagagcaaaatggcatggaagatcccttgctaacttccgcaaattagtcagctctgcattggttagggtcaaacgcattccagttggaagaagtctaaatggtgttttataaccaggaattgtttgaggcaacaagtcggcatccacaggtaaaatgcctgttccccaccaatccacaaaacgagggcccaactcatcaagcatttgattgaactccagctcctcttcagtcatgtcctcagtattctgcatatttaatctggctgcaatctcacgttgggtgtttacatccttcccctggctatcatgctctgtggggcttgatgcatccgggatgaacaatgtaccgtctgcccctttcaccgctgatgagttaccatccaatgtttcagatttcaaaggccttttgtaattgctccctctgtaaaccaccataacactcccagacctccatatgatcaatcctcctgtccgtcgctgatcgataggcaaacgtcatgtaagtaatccatttatcatggcacaactaataactcatcgaaaacctcgaattcacagcaacaaacataataattcaagttcaattgccactagaaatcactaaactgaactgatatccaaaaaaaaacataatagattaaacagttacaacgagcaagctgccaatgctgatagaaagggctaatatagcacacacctcgactagctcatgagcagttttcatgtcgtgcgcgaggtcctcgtggaacttgagccggaccaactctgatttcctccaggcgtcgtggatcttctccgtgacggcttgcgtgacgcccgccttgggcacggtgatgcggtcccgaagagtcatccccagccgccggaggcgacgcagctcctcgtcctcgatcgtgagctcggccagcgagggcgccctaaccctcctcctcttcaccccgtcctcctcgttctctcttcctcgcgcgacctcatccctctcccaggggaggacggactcgtcgaagctggaggcggcgaactgctggtcggggcgcgcccagctgcggtcgagcaggtcgctgaggcgctcgttgccgtcgggaggcgcggtggccgtggcggcggcggcggtgggctcgtcgtcgtcgctggcgaggccgaggttgcggaggcggtggacgattcggtcgatggaggaggtcggggagggagccggaggtggtggcggcggcgcggcggggtcggtgggcccccacttctgcagccacggcgcgcctcgggttggatttggagccggaggggcgcggttgccgccggaggaggaggaggaggacgcgtcggcggtggtggaggaggaggaggaggcgtggcgggaggagagaaggcggagcgggaggaggcggaggtgggggcgggaggagaggcggaaggagtggtggagcgggagctcggagagcgccatggatggagtgtggtggggggtttagcgcggtggcgccatggatgggaaggatgagatgtggaggtggggttttgggtttggtggtggcggataaggaggggaggacgaagggggttgggatatttcttcgcgggtttgggctttttggattcaaaccgttttaggcctagaatcagaaaatgaattaaaagacacaagctgacaaacctaaaattttcatattctcaaaatcttaaattctccaaacatgcccttaatcaatggtctggtttctcaaaccgagctactagtaattttaatgacagacgctactggtttaatattaagattgtgttcgaaactaattctgaaaacgtaatggtgagttagcacataattaattaagtattagtttaaaattttaaaacaataaatttatatgatttttaaagcaactttttccatagaacgttttaaaaaacacatcatttacggttagaaggtgtacacgtgaaaacaagagagtgaaggttaggaacataaataaacgaactacaatatggattgcagcctaggtaggggagtaaaccgtacacaatcaccaagggtgaagagaaaaaaccaaaaaagagaaggaaaacaaactacatcagaggacatggtaaggcgctattctcgttatatctttcgccccacatacaatttattttatttttttgtcactagttgtgatattgaaagttcgttgcttctgaaaatatgtctattcttttcgcaccaaatctcctaaatgagaagcatgtaaattgaatgtgtcccctttgtttggctactagtagtagtacagtaaattattagtagtaataacgagtagtactagtatcgtccagcctttttcgttatttttagttttttttttggaagttacagtagcttcagaaacttgtatactgaaaatgaaggaaagaacaaagctttatatttacaacgcgtgatcagctgcgaatgctagaactggatcagtaaatcaaaccaactgcttgcacttgcagtcgaattatcgccaaactgaacttattttattcacacacacacagacgagcagattcaaagtctcaaaccacttcacttgctatgtacgagtagtagtagtagtagtaaacgacggcgcggcttggtcggcgtaggaccggctttgccgcttgcgttgcgtcgcgtacatgtcggtgggtttttaagccaaagccggcgcctgcgcctgcgccggcgtccgggggttggagaagcgatgcttcagtttctccacggcgagattggcagtagttgcaaccgggaacaatggctgcgcggcgtacggggacagcagcagtgctatcatccccagcagccaaagcaggaagccggcgagtgcgtgcccggcgtgggcggcgggcggcttgccggcgacggaccacaccaccaccgacgcgccgagcagcgcgagtagtccgtagagagcgtgcgcaccgcgcggcatcggcgccgccgctggcaagcgaagtctctccgactgcgccggcatcgccgatgggttcccccgcgctctttagaagcacgaactacgtagtacagagttgtcaagtgtcgtgcgcctggatacgatcggtctcgatatatagacacgagacgtgccaataaataaataataaaaaaaaactatcaccgttctctccatcggaaaaatcaacaaacatagcatcacgaatggctagtcagctaatgtaaattttttagtactaccatattccacttgatcaccaaaggcagcagcaaatgtaaacatcacatccacatcaccaaactacttttgcagccaaaggaactactcctacgtgtataattgagcttttgcagctatccaaaggacaggttacgttgacgaacttttgtaaagctggagtcacattccttttgtctgcatatagcaactgtttagaattaataggtgatgtttggttggagggacaaatccatcccttcagtatattcatttgatgactgatgatggtttacgtacctacgtcatcgatagtcggaacaaaaggctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2876 - DNA, 482 bp, Oryza sativa
catttttcttctcttgtgcctcagcatgttgcggaattcgacccatgaaacatttgctgagaagctatatcaaaaatttaaagacaaccctcacttcagtaaaccaaaattttcacgatctgatttcacaattcatcattatgctggaaatgtaggtaacatatttgtgatgtacatttagataatgaaattgttttgtgttatgttttcacagcggtatcaggttatctggaatcatggtgtttgtatggcataactagactttgcattgtgatgcatgtactcatgaatctcaactatacacataagaatgaaacggcgataaaaaatagtctacttgctaacttagatgataccatggcaagatcatttccaacacacctcatactcaattatctacctcctagtaattcccagttttcatatgccaagatgatactcacggctaacatcctgtatgtgaattacagtagaattcattc

SEQ ID NO: 2877 - DNA, 4031 bp, Oryza sativa
attagtgccaccgctttggtgttggttaattaaaataaatcacatggtgggctgtgggtgcatggttttgctggtcgcaccaatggcagttaaggaccggttcgcgggatgccctggaagaacttatcgtacttaccacaagccagcgtgggcaacggctgggcttgtagcgtagctttcctctagccgacgcatccaggcaagggtgggcatgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaatggtcctgtcacggcctctttccggtatgtcgtggtggcatgtcggcgcacggaaacgtttcgtggggctgtgtcttgtgggtacagttgtacacctctgatcagagtaaaactattcgaatagccgtgcccgcggttatgggcggtcaaccagattcaccgtgattagtctcaccctagtgtaatcttttgaatttggatggtttagttggatggttgggcctgttgcaacgtgggatagcgttggacagtggatagttaatattaattaattattaccactgtttaaatctttcaacttctgcttttaaatgctcgctttatgcaaatgaaccactctagctcttctttgataattccctgcatcatacccctattccggtatgatttgctgagtacagtgggtagtactcggtcttgctctacttttcccaaccccagagtacgagtatgtgtcagatggaggtttctccgaggagtaggcttcgtccgtgccgtcgaggatgcctgtggagtggtgttcccgctgcagttctagtcaaggcttagctcctgttgtctttctttttttccgctgcatttatgtaagacttttatgatgtttataagacgtggatctgaatgtcaacattgtcgtttgtgtaccccggccggtcctggacggggattttaatgcacattctgtttggaattctattcgggaatttctgggcgtgacatgtcggggaggacccctgggcttcctggcacagtatggtctgggacctaatctggtgttggtctgggactcctctcgttggcatatggtgaacctatgtcggctttcgaaatgccttgtcatgaaagccttaaggtctctagtcgtggccgttctgcatggactggatgatccgggttagtaatgtcgtgtgggtaaagtgtaccccctctgcagaggttattaaaactgttcgaacagccgtgcccacggtcatgggcggatgtgaggtgattcctagcgtagttttgtttgactactgccttgtgaaatttgctgttgtggaatgggtttgatgtttggaaaatctgcggctgatgggatcagccaggcccgggtggccgtttgaaagctgttggccgggtgccaatcttgatcaattcaaaagactgaaacattgcacatactccgaccggacgagacgcactgtctcatccgtgtcgtttgagaagcactcccttagttgtttcagaaaagagtttaaataaaatcaatcgcaaaaacaacagcctttctttgaagcctgcattaaacacttatttcccatggcttgctgagtactcctgtactcacccttgctctatataaataatcccccccagttgctgaagaagatgaagcggatcccgctgacgaggagttcttccaggagcaagccggctacgatgagttttagggtttcggcctagttcccaagtcgcgcctgtgatgtgtggtccaagtcttggcttccgtttcccttttgtaatgcagttgtgagctcgggatctgtccgcagtccaacatgactgtactcctactctataataaagagacctctgttgctgtgatattctgtcttcctgtgataccagcactgtttcctgggactggtatcgattaacaggttaatttggagcgtcacgggctagttccgctcgggactagttcggggcgtgacaacaatactgctacgatacggtaacggtaaccacgtggtaactcaccaaattcaaacattttttttcaaaaacaaactcaattttttgataaatcttgttcagtttaatgtgagaaaaaaaaagaaaatgagagaaaagagaacattttgaccagagatgacgcggtggccttgcccgggatatactatccccgttgaccgttcctccttcccgtgcacgtgttagtatttcaccaacgaacatgcaattcgccgatcgcccaaacaagccaaagctttggaaggttgacgcttccacaattcaccaccatcgcgacgacaactcgcacccccatcccataaaacctctcgtacgcgacgcttttcttcccttcaactcctcgtttcaggcgatcgatcgatcgatcaaccggccgtgcggctgtgctgtgcttgcagattggtagtagtaaaacatctgaaggaattcgcatttgaccggagtacgatctacctgaggttagaacaatcctctcttcatactgagctactactagctggcatggttcaatttaagatactgatagtacaccacgtactcttcgaaaattactcgtgctactgttcaatcgggcaagtacgagtatagggagtatggttggttaactgatcaattcaatgatcaaaacatcactttcctttttttaaaagaaaatgaaaaaaaagactgcttctgattatgaatatgaacataatctatattttcttattaaaaaaaatgaacatagtctatatttggttttgtatttattttttatgaggccgagagtgtacagacccatcgtttctcttaataaacgaaacaacatttcgcttaataaacgaaacaacatatttgcaaaagaatagtaatttgtaaataaaacttttatatacgtattcgtagcgatctaaaagtaaaagctggaaaataaattttgatgaaaaaaaattcaaatttaaggttaataatttaaattttggttgacaatcataggcctgtaatctcattgcagtgtgactagcagtgacatgacaagcgtgcaaagggtgccaaaaagcttgtgtgacttgtgggcagcaacaagcaacaggactagagcatccaggagggtcggagtgcagctagcgcagtgcagtgttgtggctgctgccgctgtcactggccggtggggtcccgcaccgtttgccgcgccggggaaagagtagaccgagtccaggagcacagggccggacggcgtgaaaccacaccatcaaaactgacacgccgggcccacaccgaaaatccgatcgtacgaggacccgtgccgtgctgcatggacggacggtccggtcggtccctgacgcggtgggccccacccccaccccccctctcgccctcacggacatggctaacgccagtttccatccccgtttggtgggctggagattggcctcctcgcccgcgtggaccacacgtatcgcccctccacgtcgatgacttgtgggaccctggtgatctggggccccacccgtcggtgggagtaaaagggtaaagcgggtttcggatggcgtaaacctcgggcgccccgagtccgtggcatggaaatgacgagaatgccactcgggcaccacacgccacttcggcgctgcgagcgacggtaacaaaacgcgagcgcgaccccacctcctgtggcctcaaaaccttctctgccttttctctctctctctctctctgccgctcgtcgactcggccgccgccgccgcctctccgagcagcgccgccgcggctggtgaagacaagcagggccatggcggcgacggcagatccgcgggcgaagccgcccgcggcgacgtcgacgcaccacctcgagccgtgggggcagccgccgccgccgccgccaactcccgcgcaccgcttgccgccgacggtgctcccggtggtagcgttaccggcgggtggggacgccgccacgcgcgatcg

SEQ ID NO: 2878 - DNA, 10865 bp, Oryza sativa
  unsure (1)..(10865): unsure at all n locations
acttgcccgattgaacagtagcacgagtaattttcgaagagaacgtggtgtactatcagtatcttaaattgaaccatgccagctagtagtagctcagtatgaagagaggattgttctaacctcaggtagatcgtactccggtcaaatgcgaattccttcagatgttttagtactaccaatctgcaagcacagcacagccgcacggccggttgatcgatcgatcgatcgcctgaaaagaggagttgaagggaagaaaagcgtcgcgtacgagaggttttatgggatgggggtgggagttgttgtgcgtatggtggtgaattgtggaagcgtcaacgttccaaagctatggcttgtttgagcgatgggcggaaagcatgttcattggtgaaatagtgacacgtgcgcgtaaatatgatcggtccgccggcaggcggtgccggtgccgtcgtcgtcgcggcgccggaagcgcgagccgttatcggtggcgctcacgccggaggagatcgaggaggacatctacgcgctgaccggctcacggccgcggcggcggccgaggaagcggccgcgcgtcgtacagcggcagctcgatgtaaggcgaattccccacactacccctccccctccccctcccaaaccaccattatttaattaatcacccaattagccctcctcttatttattccctcgatacaatacagctttaagcgtatgcttagacttaatattttattaaacctaaattgttgtgtgcaagaatggcactcctgcaatccaaactcaaactcacagtggttgctactgtttcatgtgcagtcgctgttccctgggttgtggctgacggaggtcaccgccgacgcgtaccgagtgccggacgagtagccgccgcttgctccggcacgacggcggcggccgccgccgccgccaagatcctccaaactttgaagaccccacctacctcacctcaccaccacatcgcggctcaagatcgagccgcgcccggatttataactgctaggactactctgtcgcgtcgagccggtaggtgctcgtgcttttgtcatgtctcaacttcagttttttttttcttcttccttcttcttcttcgcttcagcatatgttgttttcttttctcttctttttgttttttttttgtacagcggtgtgcttgttgtaatccatctgctaattcatcctagtacctgtacttcttctcatcgatctgtgtcgctctcgttatcgatcagttcttcttcagctctggctgtgcccgtgctgctgtggctgcttacgtggctgggttttgcgggttctggtccgggtccatgctttttcttgggggctacccaatggataaaaatatccggggagagagagagagaggggattacgtgacgtatttaggctcttttttttcagaaaagaaaaataaaacgagagaattaggctgatgggccgggcattttttggattctttggacccctcactctcctccactggggtcgacacggcacaacacacagtagcagcagtagtagtagtatcatcaaatatcaaaggcgagcaacgctatcattgcagactgtagcatttcaagtggagcgaaattagctttgcgttatgtacattattagttagcataggccgctcgaaaagaaagggattagggaaagcctttagcatcgctctttctgatgcaatcatcgagctattggtgcctacttccagcactgctatctagcgatgctattatttgtctttgttgacatcctaggtcaagagacgcctccatgttttgccttttaacttatcagccacaaaaaaaatagtattaaattttaaaacttaattttaaacttactttaaatctgttatcattatttgttgattttcaacgttattccctcagtttcatacttataatacgctttgacatcttttctaatcaaaccattttagttatgattaagtttataaaaaaattaataacatctataatacaaattagtttcactaaatctaatattaaatatattttgataatatgtttattttgggttcaaaatgttggtggtattgtcttttttacttaggagaaaatcaaaacatcttataatataatacagactggtactataggcaattaagcaattaagtacgtagatataaaatgtttacatataaattaattttagttgctgctataggccgaacgatcagaccggcctttcgctcactgtcacatcgtacaaaaacgcacatgtacatgcatgaatgtatactcgagtccgtacacatatagttatatacatggtcgatcgatcgatcgatcgagtttaaacgcaacattatgccccattaaaagggaatcaggatgtgtactttgtggcacgatgttgtcgggcccacgtgtcagggttaagccggtacgtgaatggcaggaggaagagatacgtgcaggcctggccgggaagggggagatgggcccgcttgtaagtggcagtttgctcggcctgcacgaccaacgcaggcttttgaggctgcatccaggcccaccccggaataataggagcgtccatgcgattcaaactgcagagagcgccctaatgtgggtctgacggctcgaggtcggcttagcaaccgttcatcgcagatcggacggccgatatatgccggtcaacttttttgcatgccttcactttgttttttgattcttggccaaattggcccctattcatttttttccaatgtggttaaattgatgaatgatttggaatatttgagtgggatgaataaattaaatattacaaagttgaaaattagatttaaaacattttcataagaattcatttatataaaaaaaattataaaaaacatcgtttaagagcctaagaagcgtgcgtattcatacatcattccatatttccattccttcaaaaagaatagacagtttgtatactactctcttggcaggcagtcaataaagttgtcaaaaaaaacctgctcgtgtgcttaattgtgaaaaagcaaaatttgaacaccttcctccctcttctactgattttcggcaatgaatttttccgagatcctctctctgatcactctttgtgatgaatttgtaatttgtaaatggattataaagtttgttaatgaatttgttgaatggattatgaggtttgtgatggaagttgtgattggtgaatggattatgggtggtaggggattttggaggatttgctgattttttttcgtgccaaaaatattttgtgtcgcaggtgggttaagcatttcgtctgttaatattgattttggcaaatgttgctttttagatacctgtcagtaaaaaatatagggagtagctatatttatggcgctatattttttaccaaaaaatagtcagtatgtatttatattgtaagtccataaattacatatataattttagtgtatttataatgtaagtcctaaaattacatatgtaagtctctaaattacatatgtaattttagtgtatttacaatgtaagtttctaaattacatatgtaaatagtatgtaatttaagtgtaattagtatgtaatttcaattcaagccaaaatctttgctcgatcagttggtcagggccgctggacaagtcagatcctaggttcgattctttacagtacaattttattttcgtcaaccaaaatagcacgaatcctacagttgatctaatggatcagaaatcgacatatttctaaagaaaaatgtgtcgacagttttttagactttccgaaaatatatttttgcaagtggctaatccttgcttgtgaaaatactctattttcacttacctttggccaccagtgaaaatatgatttagccgctggtgagtagtagctttttttaagccacctgaagcaccacttggagtgccatcttaacacatctcctttttttttccaatgatataaatctatccggtctaacaaattacgtactctctccgtattttaatgtacgacgccgttgacttttcgactaacgtttgaccattcgttttatttaaaattttggtgcaaatatgaaaatatttatgtcatgcttaaagaatattggatgatgagtcacagtaaaaaaatgataattacataatttttttaaataagacgaatagtcaaacgttggaaaaaagtcaacggcgccatatattaaaatatggaggtagtacctggtaaatcctaacaaattgtccaagctatacaacagcaaattacttcggtacatggaattcgctgtttgtaccgtaccgcgtgccgtatgatggcgcaccgaaagcacgttttacacttgggccctgccgatgcggaggcctttttgcggctgcactgtgtcgtacgtcgcgatacgtacgacgtacgtggccaagctgggcccaaagaaagaaacgagacgcggacgccatcgcatcgcctcgctttcaaacgtcgtcgagccaccaagctcgtaaccaaatatcgataattttggtgatttttacgagaaaattgacattttgccactgtcaaaacggggtttcgctggaatgacactcccaaaagtggtttcgttaaaatgtcaccctcaaacaggggcaacatgttacaatgtcatttcatccatttcttctcagtttaatgattttttcttgttgagatgaccaaaatacccttggatcctatctcatctctcttctcctacctcttgctctcttcgttgcagatggtgggcggcgccggcgcagctcaggaccttcgctgaaccgctacgggatgagaaagctggccacgccggggatggcaccgacgccgcccttcggcgccctcaccagctcgacggcgtagctcaccgggttcgcgcgtaggtttccggcggtggcgatggtgaccgggaacggggaaggcggcacggcggcgcgactgggaacggggaaggcgtcggcgtggacgaggacgacggttcggctcggcggcgtggcgcaccaagcgctcgacctgaccgcgcgccacggcgtcacttccttctccgatgagctcctcgacgtgggcagcgactcgcggcggagctcctcgtcgaggcaacctgctcgcgcgtgcagccgtagccagctccactccacggcgtccagccgcttgcccgctccaacctcgtcggggagagagatcgacgctggctatggtggagctcgccattgaagagggacttcaaaatccaccactgagttaagccgatttgagtgggatttgttgggggaattgatgaggaggacgagaggaaccgatttttgcatttaatttggggcgagagcaaccgaggagggaggtcaatttggggcatgagttcaccggagagagggaaggatggtggcggacggaggtggaagacgctcctggcaagtgggccccacggctgaggcaagggcatttgggtcaaaccaaataagcaaaacagtggaaaatatttgcaaataatcaaaattggttgaaatggcagtatggcaagatggggtcgtttgaagatggcattataacgaagccacatttggcgatggcattctggcgaaaccccaccctgagaatggctaaatgtcaattttctcgatttttaccccttgcctgcactgcactgttaatcaagcggctacgcggcttggctttggctgtgttcgcgccgttgcgtggcatcagcatcacacgcgctgcggctgcccccgagctgtgagaaggaaacgaaacggagctcaactcaacatggacgccgtgtttagttccaaaatattttttaaaactttcaactttttcattacatgaaaacttttctacacacaaacttccaatttttccatcacatcgtttcaatttcaaccaaacttccaattttgatataaactaaacacacccgaagttctctgatccccaacacgtgagtccaagggagaagattgaaggatgtcgcaccgctagtccacgcggcctctaggaaaaagagcaggtccctcaaacatgccgctttagcataccaatggctgcacgaccttgctctaccaacaaacgaaggatggacaacggatctgattgacgagctcatcactatttggagcgccgttcggaatgtacacttcacggaacatgaagaccagatcacctggaagctcaacaaccacggcgaatacacagccacctcagcctataaggcgcagctgttgggtacaacatcgtcaaattttgacacattgatatggaggccttgggcaccatgcaagtgcaagacctttgcctggctgatactccaaaacagagtgtggacatcagacagactagcaaccagaggctggcccaacggatccacatgccctttatgtcgccagactcaagagacagctctccacttgcttgcggaatgcagatacacaaggagaatctggaatgaaatcgcgcagtggacagactatgaacatctaagaccttctaactggcaaatatttttgacggtacatgagtggtgggaggccaccgtaagcatacgagaagcacctaagaaggcactacgcatgttagccttgcttgtcaactgggagatatggaacgaaaggaaccggaggactttccaacacaaggagttgctggtgctaactttgctagccaagataaagataaaggaggaagcaaaaacatgggggttagcgggtgcaaaaaaatctcgccgcctatagttagggccacggccctaggttttttttgttttctgtactttatccttttttacagttttcgtctcctctattcaatgaaactagcatgatggcccgcgcagattgcgccgctaacatcattgtattttctcttatataataacatatatgttttctcattatattattcaaatatattatgtatgacaacataattttaaattttgcaataactttacgaaattactaatgtgtaatattcatattgcattttatataggtgttagttattaattatttttaatatcaaattttagttatttgtaaattatatatattcctatatagactctagactcgtcttttaatatttctttttttaattctgaattttctgtaaattgtatttctatatagactctatgctcttcttccaatattattttttattatttctaattgtagttctatgtggactctaaactcatctttcaatattctttaatttttaatttttaatttcagttacttctaaattgtattcatatattgactttaaactcttattcccatgtttttcttaatttcgaattttagttatttgtaaattatatttttatacggactctaaactctacttttaattttattatgtttattccgaattttagttagttttaaattcctatatggactctatactctacttctaatattccttatttttaattctgaatttttattatttcctgattgtatttctatatggaccctataatctacttctaatctctactattataaaaatttaaggtgtttttgtctcaaattttagtacgtcgtcaatcggacgtcgtctctgcgcgaagaaaatccgcatagcctgatttatttccttcttccgtatctcgcacggtctttactgctgcggtagacgacgtgagctaagacgggccggaccttcctatgtcgaccgcaccatgcatacatagaatccgtaatccgtttcagtctggttcaagggacaacgatgagattataaacatcaatactgaactacctaactggctgttatcaacgcatgatgtgtataggttttacatggatgcaaaatcatagcaaagctcctattttcatcaggcaaataatggccagctccttgatcaatctcgagcttccttttttaagtaggatatcttgtagactgtgagtaatatttaagattaaaattgcttcaaccttttgcaacgtacaagtacttttttctagcctattataaaaattcaaggtgtttttgtcaaaaaaaattgcgtacatcgtccccaattggaaatagcgtattctttttttcgcacggtttttttagcgcacggttttttcttgtctccccaaaaaaaaattcgtgcgtcgcccccaattggaaatagcgcacggtttttttgtttttttagcgcacaatttttttgtctgactccccaatagcgcacggtttttttgtttttttagcgcacaatttttttgtctgactccccaatagcgcacggtttttttgtttttttagcgcacaatttttttgtctgactcccaatagcgcacggtttttttctttctcagatcgcaccaatagccctttttttttgtccgactccgtctccagatcgcttccaataatttttctcagatcgatcgtatccgtatcacccaaattttccatctctactattataaaaattaaatatgtttttgccggtattatgttacgtcatccgtgtatgagtcgttttttaaattcatttgcttttcgaaatacatatcctgagtcggtttttaatatcgttcacttttggtaatacagaagaaatcatataagaagtatgtttaaaaaaactcgcatgccaacttgagacggtcggactcctaactgcagctcatgattttctaaaaatatatatatccaagcgaactccaacaatgaattttatcttaactaaaccatataaaaataataaaattaaaatagatttcacccgttgcaacgcacgggcattttttctagtattccttatttttaattccgaattttagttatttcctaattgtatttctatatggactctagtctcctcttctaatattccttatttttaattccgaaaatttctatatggactctagtctcctcttctaatatttcttatttttaattccggatttcagctatttctaaattatatttctatatggactctagtctcctcttctaatattacttatttttaattccgaaaatttctatatggactctagtctcctcttctaatattccttatttttaattccgaatttcagctatttctaaattgtatttttatatggactctgcttgtttttctccgattaatgtgagaatttttaggccatgagagcgaacgtggaggctcctttttctattaatttaataatataatagattgacggcctggtcgattcgttcaaaataaaaaaaaaacacgcgagtccgtggattttttagtggagctgcatcaaccatcaatgtcaagctatggtgctgttcggtagagttccaggggtggcagattctgccaagaatccaggggggctgtgagagcttttatgccttcaaaattctgtagtactccctcccatattacttatcgttctaggttaattggcatagattaaagtttgagggaaaatagtatagtatcatctattaaatactgtatggttggatatatgagcgcggttgacagtagaaaagagagagatttgaattgaaagtgattgataagacaattagtactccaatataacaactattttggaataaaatgtgaatctgaggaaggagtatgtacttacttaagtggagtactactatatatgatagtgattagggctagggattcgtctcgtgattgagcccagcttaagttcactcaagatgaagataaagtcggaacacgtaaaaaacaaaagctattagcgcacgattgttttaaacttgaaaactggatttataaagtaacatatataaagagatttcacacaaaaaaaaaccatctagcagtttaaaaataatgctaacgaaaatcggattaaaattgatttcttaattagaaaaaatagtccaactaagcatgtgggacccacatatcaatgtcacattttcttcttctctcattctttattctttcctttttctttcatgatgagtcagatatccggttttacagttcaactgtatgaatcagattggagctatatttgagggagtcagagtggacatattccactaaatgtgtcctgaacatcagtgttctttttgttagaaaacgggccatagaacacccaaaactatagcccagcattttggaccttgggccagaagcttcccttagcaattctgccacttgagccgcataccattaccatccatgtcactttgtcagtttttcatttcactggaccacaaccacactccctcggttgtccggtcaccatctcgcaaccaaatccacacctccgaaacgggtgcacgcccagatcactcgcactttgcaggtgtgtgtgccaattattatgaaaaagaccctctttcaaaacagagcctgattttttgggaacggcgaccggggtctacttcgacttagagttttaaagagataaaggaagaaagataagagcagcgggctataaatctgtagtcagctgcagcacggactccaaaacattatgtgtgtatgacaggtgagaccagatattaataatgtagtaagtaactattgtataaattggctattatattggctataaatgatttggagctagtagtaggccgtactattaattaaacttgctcttacgtttctcttgtccatggcggtgccggcagcagagccaatcatctcattcttggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2879 - DNA, 31782 bp, Oryza sativa
  unsure (1)..(31782): unsure at all n locations
gggtggctgagcatctacctctcaaactcgataccagtatgaaaacccacatcaccatatgggaatataagcgggtactgcaatgacataagggctggatgaataggtgacaactgacataactcacctgaatgcttctgcacaatgacatcaaactttgatacctcacaagatgcactaggtataatcagtgctgccaactcagaggtggtgggaaggctgtaacggtcactctgagaatggcctgacccaatgagcttgatagcaatctcaggagcacttgaagaaagcagcttgtttcgagaggacggaactgctgcacaagaggattgaactgatcaagcatcgagataagctcttgcacaataacaggatcagggacatccccaggattatcagtgtgatcaaaaatattaagcctattctggagctcattggcggtgtcatatatgtacagctgggcgaattccggacgttgtccaggagcaggaaccagagaaccaattctgtgatggacaacaccattgatatgaaaacataaggccccggaccagtgtttatgctcctatcaatgttagccccaagcgatgtgaatgcaaataatgaattatattgcctgatgagtcgcatgaaagagttggaatgggcaccgccatcaaaacgaatcaagtcttgtaagataggaggaaaaggcttgggtgcgggtaaggagatctttccaccacgacaacacagattgtatgcaatcctcttggctctgtgcgagctctggctaacaaccctttcttggtaccaaaataatgcaccacaatgattgcattcatagtcagggccaccataataggagcgatctgggtacgtagctataagagcggaaaggaaacctataagtagagaagcatgcatatgtttgtccagaaatagatagagaggcaaaaaaaagggacaaaggcgaagcaaagcaaggtggtactaagatattacctttaagaatttgcatgtgctcctttggtatggaatatgtgaatctcatcgacagtgaacgcggcacatgttctgtgcaaatagaagaagaacggaagaagagaaatagcaaataagaaataaaggtaaacaaaagcaagaaagaacatcgccataagcgacaagaaaggatcatgtacataagcaggtcaagaaccttgtcgcaaaataagacgcattttcctagcggcctgtcttttttcccggttcactcgagcaacacgtgctggcactattgggcaaaaatgatctcctatgaaaaatttaaacaggaaaaacaatcaatcggaagaagggaaaatgccttagcaagctaagcaacacaacaaatagtagtccagagctaactgttgggtcgagaagactgaatgtggccagctccacaactccctgtggaagtgatgccaggagatagaatgagggatcggagagaaaacaaagctaagctagaaagaaccaatgagcaaatagatgaacttatcaatatgaacatacattttgagtatatcatatcacagcaagtggacaactgtacaaaaatatgagaaaatggatgtgcaagggataagagatgacactaaacattgagacagcagcgactacagcaagcgtacatacctatagtgcatgatgaactacccgtgagcattgagaacccagtggcaccgtgggatgatgacggctcatctatcagaaggcagaattgcgaatcaggaaacaaaaaaacaacaattatcctaatgacctcgctaactctcagactattgagcgtacatacctatggcacatgacacaccacccgtgagctctaagtgcttattggcagcagatgatatggaggacccatctattggtgagcaaaagtgtgaatcagggaaaaaaaggatcgctaatggccttgctaactccgaggcttgcatacgaaactataatgatatcaccaagtaccatgtggacgcttccgcgggcagatgcgaacgaatctggatggctccatgtcatttctatacaccaagaaacgaaaggagcaaaatatagacacattcggaaaaacatatggatgaatatataatggagagggaaagcataaagaacagaggcacgagctactatagaaatatggaagaaagatagatgcatataagcaagcactgaataactggacataatatgacatatctaacagcaacaaagtgggaaatcatcaagagctgaaccaggagctctcggatgcttagactggaacatacaaatatttgaaaatgcgtttacgaaaatggtaaaacaccaaagacataaccacattgaaaggctaacccaaacatataactgtataaggtccagcaaagaaagaaacagatggacgccgaacgaaatcaactggcaacaacacaagcgttcgaaaaacaaccaagaatatatatcacagcggaacaatgtaaaacaaagtaatcagtaattgaaggagggaaaaaaagaggagcgaatatatatcatagcggaacaatgtaaaacaaagcaattggtaactgaaggagggaaaaaagaggagcaccatatatacgaaatccaccgaacagctatactggagacaaaagcatctcggtttatacatatcgcagcatcgcatatgtgaaatgaactaaacatgtatcccacataagcgataaaaaaaccaacctacgaaagaatatataacatagcaggacaatagaaaaatgaaataatgtaaatatatgccaaagcacagctaattagcaatccaagggaaaaaaacagaggagcaccatatatgcgaaatcaagcaaacaggtattcgctgacataatcatctcagtttatccatataccacagctccacacatatgtaatgaactcaacagctatcccagtgataaaacaatgtgatcttgtactaaataccttagcgagcattagctgacgaaggcaaagatgcccccctccctccccccaaaagaagatgcgatgtgtgggagagacgccaattggagcccgcaacctggaaggcagagaaaaaaaatacactgagcacacgcatggatggaacaatgtcggcatcgcaatggggaaatcgacagcgagacacggcaggaaagatgaaaaacgaaataacataaatatatgccaaatcgtagctaatcaggaatccaatgaaaaaaaacagaggggaaccatatatgcgaaatgaagtgaacaaacatccagtgacataatcatctcagtttacccatataccacagcaccacacgtacgtactgaactgaacaggcatctccgtgataaaaccaggtgatcttatactaaataccttagcgagaagtagctgagggaggcaaagatgccccctccctccccccaaagcaagacgtgatgtgggagagacaccaatccaagagcgcagcctggaaggcataaaacagggaaaaaacagtgagcacaagtatggctggcacaacatcggcactgcaatggggaaatcgagagcttgcaatggggaaatcgagagcgagcacagcaggaacggtcggaccacacgagacgatgcggtgagggaaaccaccgagctagaaatccccaagaactaagcgggaggagcagcaaatagaaccagctccatatatggaagaaaaaagggagtggaagaaagaaggagcgatgcagattacctcccctggtcctcatagggctctccgcgtagtggagcagcagccgtagccagccccgtcgtcgtcgtacgcccatggcagagcactatcgttgctccgtcgctgatggtcagataggggatggagaaggggcacgcgtcgagaggatagcggcgaccaacggatgatccagcgcacaggaaaaccaggacggagcaaggtcacggcaccgatgccgcgatgggcctatgagcactaaaaggctgccgtgcattgggccaaaaaatcagctggcccatatgtcacgtcccaaaacgactctaaaatatatcccttaaatgatgcctagaataattaaaatccgtgtgaaagcctccaacaattaaaatgtgtaaagttaaaagccaaataaggcttagaggatttttgtaaatctcctaaaagcctaaaatgcgtaaataaattttagtggaattttcagagcacaaataataattattaagaaataaacaaagttaaaatgattttataaaaagaaaaaccctaaaagtcccccttccctcccttgggccggcccggcccatctctcctcccccctttctctctctctcctctccccgcggcccactcggcctctccccgcgcgcgcgccgctgacgggcgggcccgcccgccaccctcgctaacgggtggggcccacccgtcatccccttcctcccgccgctcccgccgcctcccccgcgccctagcgccgccgccgccgtgaatcccgccgcctcccgccgtccccgcgtgcaataaagtggggggaatcactccccgtgatcccctctccctttccccccattttttccctctctctctctcgcgttcaaacgggcggatttgcccccgcaaatctcgtcggcgccattgatggcggccggacctcccgcgccggtgtccttcccctccggccgctctctcccccttccaaccctatttaaaccctccccgcgcctccctcgcccgtttccgccccttgccgcaccgtctccccgctggaatcgagctcgcgccgtcgccctctctctcctccgtcgccgacgacctccggccggccttctccgctcgccgggaccgtctcccgccccggcgtcgcctcctccggcttcgccgcactgccgtcgaccccgtccaccccctcgccgagtccgccgaccgccgaacgccgtcgaccccatcgacccgagccgcgtcgccgccttcctccgctccggtcgcctttttcgtcgtcgccgtcgacctagggtgagccgtggaccgccgcctcttttcctccttcccttcccctctctcggccgccgctccgccgtgcctatggccgccgccggcgaccatagggacgcgggcgccgcctcccgccggccgcgccgagtggccgccgcgtggggcccggccgtcagccgcccgcgccctcgagtgcggctgacgcgtggggcccacggcgccggccggtgcgagcccgggtgcacccggtccaccgtggaccgtgaggctgccgcgtgggccccactcccgtggacccggtccgcgcgccccctcccctcggctgacgcaataaaccctttttaaattaaaatttaaatgaagaaattcgcaaatattcatttaaagagcatataaacttcaaatggccataacttggccatttgaactcggaattggaccgttcaagtctcttttttttccttaagaagtcaagaacccatttttgtgctttgttcctacttgttatatggagtttattagagtaaaagcccttttatttttccgttggtcatgtagacgttgcagcttcggaagatccgctcttcgtggaggttgaagccgacgtttgggaaagtgagcaaggcaaatcacatcatccttgaacatattgaatcccagtttataaaattattttgatttaaattattgcactatcgctttatttaaattctcgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaggcaacattaggtggttttacaactctagactttgggaatactcttatcacctggacactatggaatggttggattattgtggaattggattcacacctccccctctattcaaaaccctcaaaatgattttaggctgggcttggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgagctgcggcccggtagtcgagatgtcatggcacagggccggtgtcctgctgctaggggctcagtcctgcctacctatcccgggggttccggccgtaggtggggttgggtcggtactcttgtttatggctaggatgggttggaaactatgtcatgtcttccgtccgtataccatggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttaattcttaaaacctgcctaacagctaaaatgtggaatggttggcctgggttggcttgggacaagctgggacccagggtcgggttgccagttcggtctgaatcatcgtaggccttgggttaaggcaggttcgtgtgggttcacggccttagttaataatattgtatagctctaggaccgtgtttacaaagtagctttaagcaactaagtgacttttaatgctgtttactgcaaaccctaaccccctatattatggctcccttgtactcccttgcatttattctgcacttgtgggtgtgtcttgttgagtacggtggttgtactcagtcttgctcaatttttcccaaacccagaagaggagcccctggataatgaaggctttggtgtctagctcgtgcctgccgtcaagcgcttgtggtcgtcgccctagtcttccgctgtttttcgtttgtcttcttgtgtgctgggtcttcgtcgcccatgtaataaattaattaattacgcttccgcttgttaaactctgaattgtatcaacttttggtgtaccttgcctcctgggacaaggaataatgcacgcacgtaaggaacgcccgttaggttatttctggtcgtgacaccatagaagcgctatcctggcttggcagctgatcaactgtaacaaaacaacgtgtcatgattgtattggataacggctggctcaatcgcccggaaggcagctaatccagcacctttaagatatttaatattagggaagcgttatatctgttttgtaattttgtaatattagggaagcgttatatctagaattgcagtttagtgatgattttaaaattcgaggacaagaaaaagggacgtcaagtgaacttttttccttcttcatcaaatttaggattcctacataggccgatttattccttgaaaactcaacaattcacaagaagggcttttagggccaaatcaccacataatttgctcgtggcccataaataaatctacatctatatacctaattaaaaatatgtaaggcttcgagaaggattttcgtccgtccctcctcacgtcggtcaaggcgacacgactcctccttccctcccgcgtgcacctccccctccccctcccccactccctccctcctaacggacttcatctctccctcacgatcctgacaatccccctttccctcacagcccctctcctatgtggcgcccctcctccccatcgccccttcctcctagcgcccatcttcttccctttcgttccctccctcctgcgcgtttaacgaatatggaaccccctcatccgggaacgcgttttgacacactcactcggccggttcaccaccagagcttgtcgttaccatttctctctctgccaggaccacttgttgttgtttccgctattctagttttcttcattaccaaccgccaccatttatggacgagtcacgtcgtgggatacgtccggccaccttactcaccaccgtttggtttccatatgaccgatgctcatcttcccttctcttttgtttcttgtttcggctaggaaaggcgatggaaaatgttaatctttttttccatctttcattcttattgcgtattcaaggaagacggaaccctcttgttagggaatacgttttgacacactcatccagacatccagtcatgttcaccaccagagctcgccattgtcatttctctttctatcgtaccacattgttgctagccgcatgcatgtttattgattttcttcttagccaacccccaccatctatggaccactcatataatattgaaaccataggaatatgaataaaacatgaaaattcgaatttatgttaataaaacaggacctattcagaactaatagatcggattttcatctatatgttaaaataagcttttttaaaaaaaattctagttaatttcagttgtttttccatttccatttttaattttagcactatttgatccactaaaaattgttgtaacttataatattgaattgtttgtagctaaattaaaaagtaatttattgatatatttttttgatattaaattatcgttccggccaaagttatttgtagtttcatgttgatatttctatgattatattttcttcagtccaattgtgatatatggtttaagattttagtttaatcatatttctttcattccaattgtgttatatggtttgtaattttagttatgtcagtgttatttagaattcgttgcaacgcatgagtattatgctagttaattagtaatgagtaaatttcattagcggtacataaacttgtcaggtgggtgcaatttagtgtataaacttgtaaattactcgttttggtgtatgaacttgtctggtatgtgcaaactaatactaaaatggcacgacaagaccgatttttctatgatgaacataataaattatatattagtagatgtcgtgcttatacatagtagaaatgttatatttataaacttaggttccaatttatctttctttgtttctgtgccatgcatcattgctcggatgtttattttttttatgcaatcattataccttattatatatttatccttcttagacacatgtttacatagagtttaatcttgccgtgcgattttgaccttgttcacactcaccaaataagtttgtgtactaaaacgagcgttttacaagttcatgtattagattgcacccacctaataagtttgtgtaccgctgatgtaatttacttattagtcatttataagagaggaattaactaatatatttccacgtgggtgatttgactatacggaagcaaaggccaactaattaaacattttcttgtataagaatgatttctctcgtattccaggaatgcgaatcggtgaatttgaagactaataaagagagaagacgacttatgcatggcttctaaattttgctaaccgtgactttgtggactaataatttcgtcacatggttattctttaaatatatcgtctctgtgccccagctgttttactttattttgttggagtcgatccgtggaaataactgtggcttgaagttatagtaaacctttaccctcgtgcatggttcatgattgaagtctcaccgaacgttttgtcacaacgttatagaaatcgaccccagaacggctcagcaggaaagaggcacgtccaaatgcgcacgaccgagacagaaacaccatagttctgccaccgaacccaaacagtgcgtctgtgcgtgcagcgacaccagtgttgccaccgtatgcggaatcgcagttacctgtaccgtggaaatcccttcgtgtagcctggcataggtacgtaattccagtactaggctcccatcggttgcccatttggcctaaaatggcttatttggcttattagaaatttcaaattaatttataagtaaaacttttatagatttgttcgtagcgacttaaaagccaatattaacaaaaaaaatacgttaaaagcattttaaaatcaacttcaaaatcaagttcaaaaatttaaattttggcttattttttgcttgtctaggccaaacgatggggctactagtgtttccggcccgatctgctctgactttctggagcgagccatcgtgcttgtgatcacgtcgtctccggcgagtcacctcactcgtggttagtactgccactatctgaggtaaccaccagcacagtacatccactgatcgagagaacggaaagggcctattcattcatccccagcggtcggcgccgcggaagtccgtgccaaattctcccccacgctgatcgagatctgaacggtggtgacgactcacgcctcgtcagtcgtcagtgcccgcctcggcgcctcggctgcccgcagtttcggcgcgtgcgtacgccggcgcagacgccagatgcaattcacctctccgggtccgggcggcaacgcagcgtgcgcgggcgtgacgagcccgagggggggcggcggcggccgatctcgtctcggcatggtgccacggcgccacgcaccctcgtctttccgcatagcttttctccaggttcacctccccttgctgcccccaccaacgtggccacgccagcgcccaaccaccgcccccgcccgcccgccccgttcggccgcctgcccccacggccccacccacgcaagcgccccttccacgcgtcacgccgtgcggcgaccgaccaccctcccactgattgcgaccgccccctcaccacgtgtccctcccacgtcgtccccacgcccgccctcacacaccccgcgccactgtagacactgtcgtgtggagcccattggctctgtccccaccggtcagtgaggggttggtggacgactatccagtcgtgactcgtaagggcccagggtaaataggtaggcctgatatttgtgggtcgcccatgagagagaccccatgtggggtgggccccaccaggcatcaataaataacctgtctgaaggcgggctggcgccacgtgttggcagcacggggttaggcgataacaccggcgtcgtgatcgccgttaacatcaaccgcctggtggaccctaccgcgggtgggccccggcgcacggataccttccacgtgttgcgggccgggccggggcgtggccacgcgtcgagatcaggtggagatggacggctcagattccccggaacgggagcacgtcacaacaactggacctgtcgggcgctgcccgtgacggcgacgggcacctgccctccttcccctcctcctcctctcctcccccctaccttctcttctactccccccaccacccccgccttcgtgcttgcgtgtcgtcgcctcacctcgcgcctccgctactactgcttgtctgctgctgcagctgctgttattaccataccgcgggagaaggggggccgaacccgaaggcgtgcgagagggaggtgaggtgaggtggagccgtggaggcgcttgtttcgcgtgcgagacggtgcttcgtttcgcctcacgttttccgagggctacggcgacttggtgggagcgcggagaaaatctagcgagccgtcggagttgggtggcgcgcggccggctgtgcttctgaaggaggagtaattggagtagttgcttgccatggccgagatctgctgcgaggaggccatgtcgccgccggccactgccacggctgctgtcgcggcagcggtctccgcctcggccgccgcagccgtctcctcggcgatagacaggcggcgccgcaggatggagatgaggcgcatccgcatcgcaagtgatctcgagctgcaggccggagaggatgggcgccctggaaagcggcagaggctggcgcgcacggcgtctggcgccccgcgtcctgacgaggattcggcgtctgagcggccgagttgtggccgtacggaggagttcccgaggtatggggtcaccgctgtgtgcggccgccgtcgcgagatggaagacgccgtgtccatcagaccggacttcttgccggcatccggcaagttccatttttacggcgtcttcgacggccatggctgctcccatgtaagtgtttgctgatgtctaaatgtgcgaaccggatagtgatctgtgcacatgtaattcagcgtgctaattcgagttctatgaatattaggttgcgacgacgtgccaggacaggatgcacgagattgtcgccgaggagcacaacaagggggcctccggcgaagtggcgccttggagggatgtgatggagaagagcttcgcgcggatggatggggaggtcggtaaccgggcgtccacccgcagcgacgacgagcccgcctgcccgtgcgagcagcagacgccttcgcgtcgcgaccacgcgggttccaccgccgtcgtcgccgtcgttagcccaacacaggtcgtcgtcgccaacgccggcgactcccgcgccgtcatctcccgtgccggcgtccccgtcgcactatccgttgaccacaaagtacgtatatgctcgcatcacagggccggctgagcctttcccgtccatctgcaaaaaatcgttagtttcttgtccatgagcgtgtgcctgacatggttgctacttgctacctcggaacggttcagcccgatcggcccgacgagctggaacgaatcgaggcggcgggcggccgcgtcatttactgggacggcgcccgggtgctcggcgtcctcgccatgtctcgagccatcggtgagctgatctagttttaccttcttctctcgtcgtctcaagaattttgatttggcacccggatccgaaactcacctgcgtatgggcgcgcaggggatgggtaccttaagccgtacgtgacgtcggagccggaggtgaccgtgacggagcgcaccgacgacgatgagtgcctgatcctggccagcgacgggctatgggacgtcgtgaccaacgagatggcgtgtgaggtcgtgagggcgtgcttccacaacaacggtccgccggcaccggccgcgcggccgagcggcgtgccctcctcggccgaggcggcggaaaccgagaacggaggagccgcatcggtgaaggggataagcaaggcggagtcctccgacaaggcgtgctccgacgcggccatgctgctgacgaagttggcgctggcgcggcggagcgcggacaatgtcagcgtcgtcgtcgtagatctccgccggggattgtgattcttggcgcaatattctatgctccatgattgctttctttcttcttcttttttttattctaagttaatttttcccttcaaatttcttccttatttctctgtttagttttagttttactactagctcctaccaagataaatgaatataatagccttttttttcgcacaaacacgaaccagacagatataacaggagagtgatcgtaggcgtaagatttcggaatcaagaatcaatgcgcacatctttaatcctgccgtagttaatcgttattcgatcctaatgtctctgcaagtctgcatccatatgggtaaaattggatccatgggatgctaggttccgttgacactaccaaaattagagcatcttcatgaaggaagcatgaaaaagctcaccactcgtgtgagtgctagcaacacgtccatcgtgcatcctagaaaaggagaaaaaggagaggaaaaaaatagggaaacccaaaaaaaaaaacgtcccatcgtgtgaggctatttcggtggccatcctaggatgaggacagacagcagagcatagaaattgatgctgatccatgcgtgggggccgcccccatggtggtgagctgaactcggacgagattctcctgctccaccgctttctgtgtggaaatgtatggtgtttcttgtgataaagttttgagccccaatgatgcgacccacgagcaaatagctggggtccgcgtgtccagcctcgtcccccttttccctttctccccgtcctcgatgcccctttgcgttggcgacggagcaccgagccaccgagaggcgggagagcactcccttcgccgcgagttaggcgccgcaacattattgggggctgcacgctctcgacgcaccccggggcgtttccgcaacagaacatgacacgacgcgaccgggagcaaaagggaaccagctgtcgcgatacagcaggtgggaggagtagcgaccaccaaattttaaggcagcgtcgtggtggtgactccgtgctgactcgaccgtgcgtgccgaatcgttcgactggattcccggccaacccctcctaaaaataggcgtcggggggcaacgtggcgcaacgcgcgccgagaggtggggtgtgtgtcactcacgccgcgcgctggggacgacgggacgatgaggcgtgtgcgtgtttcccccgatgtgcccggcacgacacctcgccccgcgtagagttgacacacgggagggcgcgtcgccgtcgcggatccagcaaaggaagatatggcgcgatccatcggcggcaagggcgggggaggcaacagacgaaaggcgtgccgcgatcgcgatgggacgccatgcgtttttttgtgcgatgggagatgaggacgacgggacaggttacggagcacgggagcagcggcgaatcgtgatccggctgcaatccaacgtcggtggcatactgacatcagaggaagggcggggaagcaacggccagtccagctccagggctccaatcgtgcatgatctgattgacgataggcgtatccgcataggatgcttgctgtttctgtgttctgccgactgacgtcgcatgcgtgaaatagccaaacagggaactatacttgcaacagaaagagaggtgcatgtagctgcgccacatctacctatttggaactcatcccttattactactcactactacaaaatctatttttcatggcatcactttatttttttttctttggcggttatacgcagaaaccgccagaaaaaaattaggggggggggctatgggccaccagcgaaaatgaatcttcgctagcagctcacttagataaccaccagcaattttcgccagcgggtgcttaggagcaccatctgagaaaataaattcgagatataaatcctatccacctctctccgcgctttcgtggcctctcccacccaacccaactttctccgcctctctcccacctttctcgatacctctggcctcccccctctctctccacctttctcgatcttcctccagcctccctcctctctccaccgccgtcggctgccgtcgctttcaccgccgccgcatccgtcctggggaaggcgagagcgaggaggacgaatccgctgcctctcgtggcctctccacccaacccaactttctccgctctcttccacctttctcgatacctccggcatccctcctctctccgcctccgggcctccctcctctctgcaccgccgtcggctgccgtcacttccaccgccgccggttgccttcacttccatcgtcgccacggcatccatcctcgggaacgcgagggcgaggaggagggatccgccgcggcctggctgtggggagcgtgcatccgccgccgtcaggccgcggggaggatggatccgctgccgccagcacgcggggagcacagagctgtcggcggtagctgcggggcctcgtcgtgtcgcggatctcatcgtcacggtcgccgccatcgggccgtggggagcgcggttccgccgcctccggccgtggggcctcgttgtcggttgcgtcgcagatctcgtcgtcatgaccgtcgccgccgggcgcggggagcgcggagctgacactgctgggccgcgggtagggatggcaatcgggcacgacgggcacaggtagtgcctacccatacccgtgcccatgagattatttgtgcccgtgggtatacccattactacatgacgggtaaggatggttgcccatgcccattgcccacgggcgccttgtgcccgcgggtgtgtgcccgtttacccgctacaacaaaagcagtggaacaaaaagtctacaagcttctaagttcgaatcgaactttaaacatcaaatattcttcgccttggtgtggtgtctctcctctggcggcgatagagtaaggggaagagaaataataagggaaataaaagggaaaccgtagaaaacaaagaacgtggctaatgtattctagtggactttgctcctcgcctacatgtaagttagactttgcgggtaaatgggcaaagtgggcatgggtagtgattacccatacccatacccatttacccatcgggcatagcttttgacccaataagatacccatgggtataaaatggagaacaaacccaaccctaatagagtttttacccacggataaacgggcaaacgggcacaattgccatccctagccgcgggcggtggtgctcggccggtgatcgttcgacgacggcgacaacaagcggtagcggcttaaagtttctttggatttgtgcaacgatccgatccggttaatgtgtttggagatgggaatggaaattggtgtgattctgaatgaaaatttttttaccgtaaattattgatgcaaattgctgtggatttgtggatcgaggagtggatttgggaataatttgaactggtgttgacgaaggtggacagagcgatgttgctccgtcattttttttagccttggacagtattaacactggcggctggtatagtgtaccgcctatgaaaaatggatcgtgtggtattcaagtttcgcaggcggttagcttacgaaaaccgtcagagaaaatggatctacgctggcggtcagctaccgccggcaaaaatactgtattaccattggcctttagtcactggcggtgctgtcagccaccagcaaaatttcattttggcaaaaaaataatgatttttctagccgtgactgtatttaatttgttccaaaatggtacggcggtgattccaaatttatgatgtgtttagttcacgctaaaattgaaagtttgattgaaattggaacgatgtgacggaaaagttggaagtttatgtgtgtagaaaagttttgatttgatgaaaaagttaaaagtttaaagaaaaagttgggaactaaaccaggccttatagtctatagctatattttgagatgggtagctacgttaatagcttgtcaacaatatatgttagtgtagaatgtcagttagcacttggaagatttgtttataatcttcccagtttaacactatcaatcttccgcgcacagttgttgtgatgatggtcgaaacaagtcggtcgaacaaacgcattccacgtatgatgtaatatagtaactgtgctataaaatacagtcttttattctctctggagaaggtagcataaaattaagtttttctggagggtaacataaattccagttgtttgtggcgctcgctagtcgctatcacagaaataggcaatggctcgtcgagtcgttttccgtcttccatcctgtcttgtcctagaaaggccttcagtccttcacccttcaagccctgcttttgtttccaccaaagtctctaactgggccttcaccaaatactttcgcgaacattgtactacgatggggctatttttctgggtccaccaaagaggaaaatctattgtgtggcctgcgcactacaaaaagggcttgggacacccatgatctgactgggccgggagatctgccttggatctgactgtttgagagtctcttctttctttcgctaaaaaaaggtctcacctttcttagtctcccctgcaagagatgtcatgaccaatatgcaatgaacatactcgagagtaacgcatagtctaatatgattgcaatcaacgatgcactgtattattagagcaagttttatggaggggtgcttgctagcctttagttttgttcacatcatcaactaattaattaagcgatagtatataaaatagattacctctaatacactagctccagtataatataattttttatttgcatccaatttacactggtctctcgagtctcaattttctcccttagagtttgttaagaggttaccttttgtatgaggagtggccttttctcttttttctttgtcctctccttcaattcacctcataatttagtcttagtatatggcatcatgggatctggcttaggtgtccttaatacttaggtggtgtttagtccctcccacccaaacaccaccttactcttatactggcataatgctcgccaggttctgaatgtggtctccaatagatatcttttataataaagtagaataacaccaaagttgaatgtaccttttttggagcgtgtatgtgataagcatatgcttttgtattgtgtttctcaaataataaaataaaataaagcagagtgacgtacattagattggtaaaaccaaacaaacaagtctaacgcgatcgcaattggtttcgtttgctcatgtcaatctatgggtttatgattacgggcatgtttagactattgccaaaacaactttttcataatttagcatacccaaattttttataagagacaacatcgccatgttttgatagggtaaagttaatttggatatgtttagtttggtgcccccatataggataccaaatgttggcaatattcaaaggataccggattttggtatgttactatggtattgccaaattcctgtagtcattgctatttgctaatgtttcttaacaaaccgacctatgttttgtattccactttaaaaaaaatagcatggtttaaattgttagaatcaatccgaataggtcttatgtccacttcacgaaattcctgctgctcgggcgactggccggggccggggggaggggagagagagagaattgggcgctctccatgtgctacccctggggccccatcatgtgcccctgttacctgccacgtgtctccaccgcatactccattgcaaaaaatcacccacatattttggaaaccctctattaagagaattcgttttatttttttccacaaaaaatgtttcacctagtatactcacgatgtttcactatgtatagatctaatgttgcagtgaattgaaacattcttttgcaacaaattatccacatattatagaaaccctctattaagggaattcgtttcattttttgttccacaaaaaatgttttacttagtgtacttataatgtttcactatgtatggatcaaatgttgcagtgaactgaaacattatttcgctatttgctgaaacattgttttttatataaggtgaaacaacacccgatttaaacgattgaaacattttcgatctacttagtgaaacaattccaaaatacttggtggaacatcgtgcaacatttaaaaataattcaataataagctaaaaaagtttcgccggaatatatctatgtgtgatcttgttttaaagatttaattataacgaatttaatggtgcaatcggattatgatttggacaaataatttaagagaaaaaaatagtttaaagtggttttgcacgtatgcgtcatgctgacgtcaacgtccgatttcccccctccctgtcgggagcccgacgcggagtcgtcttctccacttcatttatcaaatggagctgattttggataggcatgggatatgccggtccaaattttaggtgttagggtgtgcttttagagcaattttaataataatattgccaatcactagttttaaaaattgaaacattatttataaccaatctaatagctcatttatataatagttaattatagatatatactgcatcattaatacctaatatattaatgattaatactgtgtgtaacaagaactctcttccttttaatatattgacgtacaatctttttacgtgccttttatctctcccttcacataagcacaaatataatgtggtacttcctccgttccacagtataaaaccttctaacattatccaaattcatataaatgttaatgaatctagacacatatataaaatatatatattgatcaatggatgaatctagataagtccaaaaagtcttacgatataaaatggagggagtgacttggacaatctgtttacgtcatcttattatactcactcttatatggataagtatataaatgtgtatatgcgtaaatatgtttattgtgtttctaataaaattactaccacattgtttcgattttgaaggggtgggtaggagagaggggaaaaagtttcctcctaaaaaaactagaaagaggaggttgagtcgagggaccgatcgaatatgtttagttccacgctacaattaaaagtttgactaaaattgaaaatttgaagaaaaaaattataagtttatgtgtgtagaaaattttgatgtgataaaaaagttagaagtttgaaaaaaaagttaaaaagggtaccgcatagtgccagatagtacagtagccaccaaaaagcccacatatccgactaggagtacgtttttacttgcttcccccatcggtctccctctggcgcgccgctttggcttttccgaaaggaagccagtcatccatctcccccgatttaacccgacgccgtgccgctagtctgatccgccaccgccacggtctcctcctcgcccccgtgcctccgcctcctcctcctcccgtccagcccgtatcgacgagaccagcaaggcgccgccgcgcgcggagctctcgacgcccgccgacgacccgcccgccgtcagatccgcctgctgcatgcttcctccaggtttagatcgtttccaaaaatcctctgcttctcttcagtaattccacccgcgtacggggtttctcgatcagagcgggggttccgtttatgatcgggtcagggtttacctattccttgtgatttgggcggcatgcgatttttggattataggtgacgtttggaggatatgtaatattatgggttttcaggaaatcgtttggatgctgtagttaccaaccaccgcagcatgcctagcaatttgtgcaattactcgttactcttaacagcactcacgctgtcacgcgcggtgtggcacactgtcaaaatttgagatacgttgacacttcatcattggtggaatctcgtgaaggaattatttcagcggatgtgcatatgctatagtatgagaacatctatggtattatgtagatacaacaatcactaaccagtcacgagaagaaggtttttagttgtgattctataatatatttgagaatcaaaactaactttacaagcttatgtgggtttgacccttcaaaatttcttggagttttttatagttcaacaagcgtcaatgattgcgattcatatatatacattgtttactagtaatggtttgtgtgagttcttgagacaaaaatatgtggttgaccacgcaccaaatgcattgttccaccactgcttttggttgtgatcattttcgcatagatagcgtcatgtcatgctgcattttgatggtgatgttgtgattcgtgaatgcaagcaaaataaacgcaatggaaacattttttttgcaagtcatattttttgtttgtttctagttctcatcgttatcttcttttaataaatgtgtccctttgttctcttagagcattttcccctctcagaaaattggaaacatttaataagcatcagagtgatcaatcttagtgaatacttaatagagaacataattccatcaatgttctgttcagagcaaatttgtagaaaagaaaaccaggcaagcattgaccttctgacttgtggttagaaaaattatctggttgaatctccattctctttgtttttaacagtatttttatttgtacccatgtaacatcttgtttttcctttttggtccattatatttcgttgttgaactgcaggatttcagtatgactgaacatataaattatgatgtggtggagcagtgtgttaaaaacatcctctctctaatcaaaccagtggaggatgacagacgcaaacgactatctgcaattcaggagttatcaaattccattcctaaagttgcagccttaagaggtgagttatctcatatttgataatttttaagtttgtaacaatgtaatttttgataagctaaatatgaaatgcaatggccactgtggacagttatggtcagttatccttttggcacctacagctgaggcccttggtcacttctcttgtgatttgttgctagaatggtgggaacgggcaacaagtagaatatctaagaaacaatgtcttccagtgatagcagataggccggcaggctgcagaaggtggtcacaagttgtcggcgaatacagatctaggcgacttaagtttagtctcacgcattgcattcttttcagtagctgtcagtttcgtattagggagaatcctccagttgtttgttgccttttttttcctttttgcttctaattatctgcatcatttgatctctcaagcctttttgcatgctgctaaaaagaaaataaaggcaatggtgaccagtgttcagtttattttttcactacagtcctaatgctgcataatgtggaactattaggtgtttgttttgctataatggggtcatgatctcttcaaatggtatagattgttcaataacttattttccttcatatacttgcttagtcaatgcacaggttctctaataagtttccatgatggcaaaatgaaatgtcaaaggatttaatgatgatatgatggtggtgatttagtgttgccttatctgaacttttaaatttctttaacaggtgctgttttcaaaccttttggatcctttgtatcaaatctttactcaaattcaggtgatttggatatatcggttcacctccctaataactcaatcataagcaagaagaaaaagcaatatgtcttgagggaattaatgagagtgctacaaaatagaggtaaaccttttttaccatattacataataaaggagcatgcagacttcttctcattgcatgatcattgtacccatgaaataataaccatggcttttgcggtaaaaccataaaaggattccatattatgcaaccacacatttacgcacataggatagcaaaatcatgtaggagtactaaatatgatgaaccgtgtatctttatttcaaaggagaattggacttgaaattcacaaccttgtgctactatattgggcaattctttttagtcatacaggtagctcttatttatattatgatttcgttggttgaattgtgtcaggtgttgccggatatgtgcaatttgttccttttgcaagagttccagttcttcagtatgtgagcaacaccttcggaatttcctgcgatatatctgtgaacaactaccctggtcgaattaaatccaaaatcttctgctggatcagttctttagatgtgcgttttggtgatatggttttactggtaagactaggtaactagtagagagtttcttgctgccccatcattttgttggaaagcccaaggttcaaactatgttttcttgcagatcaaagaatgggcgaaagctcaaaacattaatgatcccaaaactgggaccttaaactcctattcactttgcctactagtcctcttccattttcaggtaatattcatctgtggtatttcaagttatactgatacatgattttaggaatatccttgttactgtctttaccttattccagacatgtgagcctgcaatccttccacctcttaaggagatttatgaagggaacattgaagaaggtattgctggtaaaatgaactaatattttctttgatgatgattgtctagcatatctgtatctgaattcattgcatttacatacagaaatgacggtgtatgatgaggaacatcttgatgaggtttgctctgaaaatttagcaaaatttcaaagcaagaacaaggaacgaaggaatgaaagctctctttgccatctgcttgcaacctttttccacaaagtaattaaacagtatgctccgtttcattggtaaagttagtatgcttcttgtaaggacatatttgctgttcatgtcttggcgaagcatgtcttcatgtttctaggaatatttcctatgccatattttagtaagttatatcgaggttgctggtgctcatgtagtttaataagttgagttatttcaaaagtctttggcccttgcttttgttcagcatcgtggcatcttgttaaactcaaacataccttttctctttgtgttttgtattttttaaactaattaacacttgacagactcttccttttagagaagtaagacgatttttgttataactcaactcatcttccatgctagcctttgttttgctcattttgttataagtccaataagatgatttgtgttcaaatctaagctaagtgaaatagctacttatcttcctttcattaaacataattaaacaaatgagctaatccctcctttttgtggggctacttaattactttgctccattaaactatattttatccccattaaaataatgctactgtcactgaaagcatatttaagatttagatgccatgcacatttttcattcgttactttttgtaactcatgagatacgagctttaccagtaatcttacattgattgcagttttcctctatcggcaccctttcgggtgatgtgatatccacttacacgggccagttcaaacgaatagaggagaacccaagttggatggccagatcatacagcttatttgtaaggatttccttttatggttgcattcagcagtcttattgaaatttggactatttactaacacaatctcgttcgttcattatctccttttcaggtcaaagatccaattgagagacctgataatgccgctagagcggttgatttgaaaggccttgagcggattgctggggccttcaccgctgctaatcgtaagtttgcatctctccaacacgccaaacgaaatgacttactggagatgctgtgtacgcctgctgttggctcaaagcttggcataagagttagccaagaagttatggctaactcttgcacaaatactccacggaggaaccgtcatcatggtagaccaacggaacaagtctcagcgaggccatctgataatcaaaatcaccgcggggccagagaatttacagttgggagacaagttcataatcccccacgggcgcgccaatcaactggagcgtaccatgctcttaacagtcagcatgtaattcctgcattgagccaaccagcaggaatttatcaaacagttggcccataccagagtaatggtcatccacaggtgtatactagagatgtccaaacagtagggcaccaaaattataggcatccaatgggacacaacacacagctccaaacagtggaaccatatcagagtaataatagtcaaccacaggttcatgctaccagcatccaagcaccaagacaataccagaattatactcgataacgcccggccagaaactacaatcaccaagtgttacatgctacagcgaccgagacaacggccagaaactacaatcaccaattgttacatgctgcagcaaccgagacaacggccagaaactataatcaccaatcgttacatgctacagcaaccgagacagaaggatcataccggaatcagcagcagagacaacacacatctggccgtcaaacaaataggaacgctgtgaacacaaggtacgtgcctgttgttggaaggccacaaaatgtagcatgtgaatcacgagctcaagactcctcaggcaggggaacatggcaacaaagggagccgcgagcaggatcaacctaccaaaatagatagcaacggattatcttcagcttttgcatcgcagtgtgtatgagtttttggtagtttgtgatagctttcgtcagccagcagtttgatctcagtgccgctgcaatgcagcgaactgtattgggtaaaatgcagttacaagattttcttttgtgcagatgttgtcatgttgctacacgcgtggctacgattgattgcgctgtagctgagaactgtttaaaaaaatgaagaaaaaacagtttatttttatatgtatgataaactaataaacgaggtaatctgcagtatcagccgtttaaaagattaaggcttttgtagtagttgggaactcatccttatttacgaaaaagaagcaacaaattaatatataattaattaagtattagctatttttttaaaaaaagttaatatgatttttaaagtaactttcctatatttttttttcaaaaaatgtactgtagcgtgcgaacccagcctaaggccgagaaaagaaaccaaaaacttacatttaaagtaacttttaatacttacgttttggttgtggctgataacccaacaagcagacaattttactgaatatttttgcatctggctattttaattgtctagttgtgaaggaataggtaaatatagggtagaaactaagtcaaaactcatgtcacccaatcccccgaaaaaaaacataaaatcatatataagttccatataaattcatataaaaaatctcacgcgtagatgatatgatggtgggcaacgtttaggttcgactttctttgtgagatgtgatttttcataacttataaacaaagttcaatttggacaatatatctcggtgtccaccatcatctcatatatggccttgtttggcataggtttggatccaagattttatgaaattgggtatccctagcttcacaaatttatagaattggatctaagattttatgaaattgggtatcctagctgcatcaaacactctcatctatgttggggttttcacgtatataggagaggcttggatgccaaatagagtgcatatcagttcttgctaccataccctcttttttttttctcacaaaatctatatgttgcatttggaacactgccgtttcaaaaaaaaaaatcaaaactcataagggaaaaaaaaaccacgtttcaaacggcttcctctgtggtttccccagaaactggataagcgttcccctcgggccggctccgacgtgctacggactgggccttcgcgcgccgtcccgtccccgctcccgaagcgaaaccaacgcaacgcacgactccctcccactctaccctcgtctcgtgcgcgtggacgactccctttgcctagcttgactcgtgcgccgcctactttcgccaatcgccatggtgcaagccgcctcaacctcctcgcgctttctccgcacaacccgtctccacggctcctccacctccaccacgccagcggagcccgcagcctccgcgtagccggcggcggctcctcctcctctcatcgcgctatctctctctctcggtaaacccctggcctcggttagtatctgaagtggatttctcgcttggtctactggcggggttcgctcgatactcctcctcgagttagggtttggcgaatacgaccaaccccgcggatcgcggttggatggcgactagagcggccgcgctgctctgagaatgcaatgtacctttcaagggttcggtattttagttccttgcttgataattgctactactgcgacaatctcgcggttcgtttgcgaagaaatataaagagggtgccttgctgtggctgtgcacttctctctccttctttgttttcacccgaaagttgtgattttggtgtggggttttgatgtagagaaattgatgagtaccacgggtattgccagccaaatattaattgcggaatgtggggaatggggaaagggtgttgccttcgacgtggattcgcctgctgcgacacataagcatgcatatattcgtagagtggagcggaattctgctagcattctgtagttacccagttacgttaactactgtagtgctaatgttagagttaaatgatttatatgatgaagtgatgaagtatacttttggcctgccgacttcgtctggggtttaatttacacaaaacttcaataccttgtaaactacacacccaaatatcatgcatgcaaatcacatcctaggggtggtattgcgggtgttttggttgatgtggcatgcaggtgaacgtgggggcatgatgatttagggaaagaaaattatgtgggcctttttctctttcctagatggggtgtggtatgggtgggagtactgccatgtgttaaagaaattgatgatgtggtagccacatgacccaatggccaacacctctagtaacctctttgggtgtattctgcgctggaaactggtggagggatgaaaatatattaaattgcagggtgtacattaaactagagcaaagttaagaaacaattgtagggtgtacgtaggtcgttgcactgttggtttggacttatggagcaaatattttacaatttacattagaaaaccaggacaaccattattcttgtaactgtaatgggtttgaatgcggttatatctggttatggtgcttagcgacgccactgtgtacccatataatctcttttgatcatacgtctatatcatttgttgcccaggatttcaggatgtcgatttggcgtgtccctaattatgatgtgttggagaagtgtacagaagatatcctctctctaatcaaaccagtggagggtgaccgaaacaaacgaatatatgcaattcaggagctggcagatacaatctattcagctggggccttgagaggtaactcacacctaaagttaccacataacccctgtattatttgaaaatcttccgttgggttccttgtatttattgacggtatggtgttgtgatgtttctacatcaagcttggttagacttatctatgatcttgaagagaaaatgtgttttccactttattgctgtgaatgctagcttgggcatggatttctgatagatctctgaaagaaaagacccagtcttataggtgtaaggtgcctctgcggtgcctatcgtatttcttgttatattcataaggaaccttaagttttaaagttatcatcacactttgtctgggcaatagtttgaaaatacaatgagtgacatatttatgcaatccatagtacttaaaagtgatgtgtttgttttgtgatcgatgctagaaaatggtcttcatgctgcgattgctgtatggcaatgggaactctacggcagacccatgaggttgctagcaggcaactgttgacctatgacagttcacagtacacagtaaccgttaaccaacaatttgtcatatcatgcctgacaaatgacaatcacgataagcttgtgttgctagaattaagggtgggcataattacctgaaaccaaagaaccaatccaaactaactgagaccaaatacttatgtcagagtttctaactaaccgaatttaatttggttataggccttggttaaccgaattgaccgaaatatagttaataagcgcaaaatcaacctgttaagcctattaagtatcatgtttgaacagttgaattttgatgttaagttgcaagtgctatctttgtgttctatatcatttgttgtttattttgtgactttttactgtcaaacatgtcctgaaactggggaattgctgccaaattttttactaccgaaacatgtcctgaaattgatcaatcagttcggtcatgacctaggaccgaaccaaaatgaccaaaaccaaatagcttggcctttatgattttgcattgaatttcggtcttgattttcggatggccaaaattcgagaaaaccaaagaatcaatccgaattaattgttcaaaccgaatggttacccatagccagaatggagctgctcaaatgtcacataatgtttttactggattttttttttggttacattctcttgttatacaatggatagtgtcttcctcaatgcatatattatttatgaagtttgcatgttggaaaagggtaactgttagagaagtcagcagtgcaattattttagtgtttctttttctgagttcttaactttcctttataggtgcttctgtaaaaccttttggatccttcgtatcacaactttatgcaaaatcaggtgatttggatgtgtcagttgagctgttcaatgccttgaatctccctataagtaagagaaagaagcaagataccctgagagaagtaaggagagctttgcaaaagcgaggtaaactttcttttcgattaatgaaaacagctttaaccgaaatgatagaagttttggttgtgtgttctttgtgatcaaacaaatagtcactatatgcatatacatgcaccaaggaaagcaataagtgggctttgcgcgtctttgatgcagcggccaggttatccattatctaaaaaaaaaaaggaaagcaatatatcttgtgagaggtgaagtcactgtaatgaataagttttgatcaagctattcacgatcttctttttgttccgtacttcattcaatgcaaccctttttgttgaatttacaggatattcttatctgttttcattccttatttaggtattgctagacatatggagttcattcctaatgcaagagttccagtccttcagtatgtgagcaaccaatatggtatttcctgtgatatatccattagcaattaccctggtcgaattaaatcgaaaatcttctactggatcaatactttggatgatcgctttggtgatatggttttattggtaagctctgtgtaaccaagagaattctctttttgctacaatcttcctttttgttaagccatgttttttggcaggtcaaggaatgggccaaagctcaaaacattaatgatccaaaaaatggaaccctgaattcctattcactttgtctacttgttctctttcattttcaggtgttatttcttactttacaagttacctctatttcttatttattgttccattaaagttatctatatgcgttctttattctgagccttccagacatgtgaacctgcaatattaccaccgctgaaggagatttatgaagggaacatcatggaggacatttcagataagatttcattatgggaatatggcttacctgtgatggatagtgactatctattgtcagtgccttgctgtttaactgctgcattcacatacagggaggggtactataatgagaaacatcttgatgaggttntgctccnataaatatagaaagattccggcgccaaaatatggggcaaagaaatcagagctctctttctcatctacttgcatcattctttcacaaggtaattgaacttatggccactatattggctagtcaaccttgtctaagagagtatgacttccttctaagtactgtagttctgttgatcaaatacaggtgtatgttttattcttgtctttaggcatgtatctccacattctgtctactatgtaatgaatcaacactggcatttttaggccatatatggtctctcttgagcttgatcaaacatatttggtctgcttaatctaactcactgggggtgtaaatgcaatgacgacgactcatatgtaacctttttagtaactagtagctatcaaattgtcagtacatgagctaatctcatcagtgattacatgtagcttaactcaagatagtcagtaaaatacatttaaaagttatctgcaattcaccatttgtagtatgtctacgcaatgaaatttggcctgaaacttccccaataccaaaggtcaagggctagcgtcaaaattgtagcctttagttttcttgctttgtatctgggatcattgcatctttctttagatttttaacctgaagagctagatgggcttaaccagcaattgatattgcctgcagtttttccgcatcgatgccctttcggataaggttatatcgacttacactggtccgttggagagaatccaggacaatccaagatggatggacaagtcatacagcttgtttgtaaggctttcctttttgatgcttttggttgttatgatgat

SEQ ID NO: 2880 - DNA, 19207 bp, Oryza sativa
  unsure (1)..(19207): unsure at all n locations
ttcctgcgccccatacacagctccttcagaccaaacaagatgcaagagaccgaacaaaactagcaccacaaatttataagagtatacctaggtccccaagattaatcggagcatatacaaatacactaatacacataccttgtgcaggttcctccataccaactggatagtccctcttacagcaacaagatctaacaaagcagtagcagcgccgccgcaaccactcagcataaagaagcagccagttataccacatatataccagcctcagcaaagcagatgcaatcccaccatgacacgttgccctgggacaaccgagcttaactcaaaaaggccatgcatcataaatcccaaaaccagcccactaattatgggactatacatctttaaaagcccaaggtcaaacataaaaggaaaaggccataactcctctatggcattgcacgatcagcccataataacagcttgacatacctccactaccaaaaatacgttttctatatactgcaccagtacgtaccagataaaacccatctcttagcagccgcgcagcgtagcgcgcgtaaccgctctagtattataaaaccgggtcacattagacaccaaggcagtattgagagtggtttggataacgtgacactaaaaaaatatagaaaaaaccatgtgagagtgtgagacccttatatcagtgaaacaatgtattcttttcgtccgcctcctgcaactgatcagggaacctcagcaactcgtcatggtccaacaacccgttgtcgtcggtgttgattgtagtgaggatcgccgcctcctcctcctcgggcatgtcctcaccgagcgtcgccgccatgtcgccgcacaactcggacacggaaaccttgtcgtcgccatccttgccgaatgcctcgaacaccaacgacgctgatgatggcatggcactgacagtgattatatgatactccatccgtcccattttaagtgcaaccataagtttccgtgcccaactttgatcgtccatcttatttaaaatttttttataattagtattttcgttgttatgagatgataaaacatgaatagtactttactcataacttatgttttaaattttttttcaatttttttcaaataagacggacgattagagttggatgaaaaaaccatggttgcacttaaaatggaacggagggagtattaattggtttctcttggaccgataattagaatacatatcgtagtgactctaacttgtgacttgtatgctgcaacttagggctgtttggttgagtgccaacctttgccaaacttgtggcaatgaagcttgaccaattaggtctgtgtttggttcatgccacaagtgagttatgctacaattttttagcaagttggtccacttgtcattgagcgttttttttttgccataacttgccacaattgtggccaacaaatttttagccataaaatgtgtggcatgccacactttgctaaatattttgtggtatactatggaattcatccaaacaacctctttttactatcggagtcgatcgatctgatgatagctataatatgtgcgtaataagatgagagagatgatccagtcaataagtcagggctcatggcctgtcaactgcatgagccgcatgtcagcaatgactccacggaatgcgctgcctgagcttgaggaggaagtgctcgtagtcctccttggcggcacggacaaggtgctcaagggctcaagtaggtgcatccgctcctggaactcgagcccggtgacgtccacgacatcatgctggggatcatgacctgtggcttgcgattgaacgctagcaccgatgacgacacccccgtgcggccgtgcccgcctagcccgtgccgtcttgcacgagagagcaggcgtcacccgccccccccccccccttcccgccgatggcgtnncccccnnatngcnccgnggcgcccgngcnnctctgntgtacaacctacatcgtcctgcacgaggtgcgcctccaccgactactggccctcgtccactgtggggcacaccgcacaccggccaccacctctggcccccctattgcccgtgcacctccaccacatctaccgccgccaagggtaaaagatgaggatagagataaagaagaatatattgttttactgaaatgcgggtcgaatgtaagattagagctgtattttatctgatattccagttcagagacgattttaaaacttgatgacaaagataaggaacgttaacgttaagtgaacttgtttcaatgaagaatgcaaggggcggtagactgagcagcccatcattattcgatagcccattattttgtacttttagactgagcagcccatgattagaatttttttcgtttttagatttttttttaatatttacagaaataatctatcgaccaaaaaaattgcagaaatagcccctaccgccctaatggtgggcggcaagctgacgtggcagacggtgggtcgaccgcgccgtctgctgccgtcggccaaaattgcgattaggcccttgccgcccgtacagagggcggcaaggggctaattgcaattttggccgcccataaagagcttgcggccgtacttttttcatctgggtccctgggcggcaaaggacccagatgaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcttatcgcagtctgggtcgtagaaacattatatggacttaaactaggagaattatgtaacatgaagaaatagtagtacaatttgaacatgatacaactatttgcattgcggttacatagattgtcacatcctgattttcgtttcaggatttataaattgtttaataaattaataatagaatttatattaaatgttcattaatttacaagtgaagttaaatgtgggaaataaaatttcctaaatataaagcatggatggatttaatttttattaaattctccatggttaattatactctctggaattttctcggatttttcggagctcaattcctaatttttaatcatacaaagagcatttcagtaattacccacatattaaattaatcattaaatggtctaattgtaatttttttaagtactttgagtgtccaagtattttcaggatttttcttgaaattatttgagcattggaagtatttttaataattcaaagatcatttaagtgattattttaattgggaaagtaataaaatcctcctcctcagcttgggccattttcggcccattccttcctttccttcctctctcttccgccggcccaacctgagccgcctcctctcctctcagctcagccggaaaagtctactttccctccctgcgctactgttcatcttccaactcaggcagagcccgagccagccgtgccgtgcacagtgccgccgcctcttccttccaattctcgcctccccgttgctctttttctccaattttgttgaggggaaatattcctcttatcctcctctatctttacccccaaaaatcggagcaaatcgttgagtatcttatccgaatcaaactcgttttcgagtttatctccaaaaccgagtttttgatttcccggatcgatttcttgcgggaggagtccgatctcttcaatccaaggctataaataggaccccctagtcctcctctttcgtttgccccctctcccgtcctctgccgtgctccgtagctccgtcgccaccgccgccaagcaaaccgccgccgccggccatctccggtgccgccgcgccgccgtctccatcgtcgtcgccggtcgccgtcaccaccgttgggtgcgccgtggtgaggggaagctcggccacccttccttttccgtcgccggtcatcggagctccgccgccccgtgcaacccgagccgccgccgtcgcctcctcgtcgccggccgtcgtcggtcgtcgtttggcacgagggtgagtatcgttgggttcgtctcgtcgtcctctacgtgttcatgtcctccaaatccgcagccggtcgctctatctccggcgaggtcgccatcttggtccggccattgatgatgtcatcatgacgtcatcatcttctccttttccagttttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgtcggaagtgatcaagaagattacttgaaggccgattattgcaaggcaagtcacacagatcctaaacacaatcctttgagcatgttgatcctatatttaaattctctatttatttcaactgtgcatttattttcgaatgtcaccgagtggtgtgaacttattcctttgttatggccaatttgcattgattactttattccttgataccttgggttattataacttgactagttgggctttatatattggttcagctagatattagttatgattgcttagccatgcttagaaacattagcacactattgggataacttatgactcactattatttaaggatggcttaatgatagttcacgatggttaatcgtgattggttaattaattacttgccaactaaaacttgataatggtgggttgtgagcacatggttttgagagtcgtgctcatgacaattaaggaccggttcgcgagctactgttgtgagacatttaccgtgccaaccacaagccagcgtgggcaacggctttatcttttgtatagcgtgattcattatagtgcgccagactgagaagtggcgagaagtccacgggggtcgctggagagtccatgcctctggtttttgagggggtgattatgatccaggaaaggtgcgctgtaatggattatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgttaatacctgataataatttgcctagctcctggtttggagttagatctgtacagccgggtatggttgttcaggatggttgggcctgtacagcatgggtgtgctgttcagtgttgattaaaatttttaattaattactctactgttttactactcttaactctttgctaaatgctgctttcgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttaattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaaccctgtatttctctggtagttcaagctgcacaacacggctaggtggagttagaacccttctggtgtctatccattctgtgtattgacatctccttggtggttcctgggaggaaagaatagatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggatttatggaacgaagaacctgacaacgatcaccacacctgcatcttggacgggcttcccatggagggagtgccatagttaacacccgccagtcgctctgttgttcacgacattgttgttcataagccgcttttctctgtaagtattgctcagtactttcggatgcgaaataccagcgaccttcttgtaaacaagtggttaggtcgagaacgggattttctgtatcgacccactcgatgtatgcgcaagccgtagtgcgcgtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgctacgccagtttggatcctcaacacctcggcgtctagccattgacgaaagccggtcggatttgtaatgaagcaagtggagaagagagtactgaatgtgactgagttttgaaagattgtgaggcctcactcgttaaggcgacttatataggcgcaaaaaatcgagtgatacccctgacatgtgaacgtggtggggtatggtgggtacgcctgattggcgccgaaagatacatgcatgatcggcgccgaaagttacattggtcgtatgcgccaaatggcgggcaaatactcgtatcatacgcgaataaaggagactgtatcggtgcggcagaaagtagtcgtgcatgcgccgaaaggtatcgtgcacatataacaacaacgtagtcattacacaagcatacagtactggaaagtgaagcctgcaataacaaattaatatgtcattataaaaaatattacagtgcaactaacttatagtaaaacactgttcgtacctctcgacaaaggagtcgtgaaccgtgagtagctcaccgcacgtccgtgcccggaacgtcccaagctgagccccctgcaccgcagtaaggtgagaccggtgtcggtgatctatcgccgggtccaacaactgaggtgtatcctgacgtgccatctctgaaaaatatagtgtttcgtgttagaacaattcaaaaaatagtactgtaaaacaaaagataacttgcaaaattatgaaatagtaataaaatcatgagattaattatgtacaacaagagtacaggctatttaaatatagcaaacgttactaatggtacataacgatgacgtgcaatttaacatatatgtagagttcaataatataacataacattacgtgtcgaagtccgacatacatcagcatacctaaagacgttaggcaccttagtccgacgttatatcacgagacctaaagacatgacatgccgaagtctgacattacatgacgaaacataaacacatcgataagttcgaaacgaattacaagcaaatccacatgccgacatagaacataagaactacaccacgtagccagacgtggcacgacgacgcctaggacgtggtgaagggaagggaagggcctttcaccgtaaggggaggtcccttcggtggtggttcttaatagtcctgcctccgccgcacttggtttctccttgtctttaggacaatgcttgtaggtgtgcccatgttcatcgcatttgctgcaacgcttcaccctgccagctccgactcgtccatatcgttgcggatgcgacgagtcctcctccttccagccttgcctcggagcttcgatgggtcaggaatattgagtacttcatcgttagtctctgtgaactccccagctatgccgaacccataaatctcgccgctccatgtagatatattgcttgcttactaaagtactgtgacacatatactgcatctggtatgccacactccgctgcggcagcaatgacatgggtgcatggcctgtagagcagcttcggctttgcacaagagcaatgacatgtgccgtcggctttgagaacacactcctgcttcactctcttgcggtagatacccctgcctgccttatcttgacatagtatctcaaacctgtgctgttgggtaccttgcactagagctcgatgtttcatggcctttttacgcaactcctctagctttttctgcatgaaagctccaaacaaaatgttgttgttcggcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcccatttctcttttggttcatgcagaatccactgagaaaatttccgaatctccaatccagttcttctaaccaatgttggactatccgttgggagaggtccaagagcttgaggagggtcagcaacggcggtcgatggagccgctgcacgctgatcactgcatttggctgtcaactcatctaatctcttccaaagctcattgaatttttttctcctggttctgattgcacagcctcttgaacatgttcatgagctccttgttcttgaattgcttgaagaaattagctcccatatgacgcatgcaccacctactctgtacatcttcccaaacaccggggtatcctcattccatactcccaaactgcaactctcctatcgctcgcagaatgccagcgtgcctatcatgtatcaggcatacatttggcctcataccaacaacttttgttttaaccaatttcatgaaccagtaccagctgtcggtattctcactctcaacaaaagcaaatgccaagggcaatacctgattgttcccatctacccctattgctgttagtatctggcaccgatactttcctgtcaagaatgtcccatcaatgcagagaacaggacgacagttcacgaatgccatcttgcatgcatgtagagctaagaacgccctttgcagcacactcttgccaggatgttcaattgaggggaatttcttcacttcgtaagagctcccagggtttctttcctcgataacaccaagcaggcgtggcaaattgtcatacgaggcttcgtaagttccaaatctcatctctattattttctgtttggccctccaggccttggcatagctaatagtatacttgtatgtctcttcaatgtgtcggattattgaccttggttcatatgtgagattatcgatgacatgcgcatacatctcagatgcaacaaatgcacatgtaatgttcctgtggtatttctgaacaccaggtagaaaacatgtatgcttggtaacaactgacactgtccaataatccttccatttccccttatacgcgtgcactctccagggacaaccatctttttccttaacacaccgaacttcatattgcgaccggttcgacttggcaacccaaaactctctatgaagtgacattgcaaaatgttttaccgcctccttcatatcttctgctctactataaatcgctccctgaataacctcattttctttgtactcccatctcacactatcctcttcagagacgatcagcccagaaaaatcctcactagcccattctgctggattaatatctgtctcatcatctgacgaatcaccttcctctacacgctcgttgtcagaatcgtccctctccatttcatccacaatggcaccgacagtctccccctcgtcggctactccacctggttgaatgcccactggagctactacgcccccgtcctctcgtgcgttgacctcctccacagaagtctcgtttactttagcacttggtccctcgccatcatccatgttcgtctgcacacctggatcctttgggtgaacaaacggaaccaaagctagaggccacccgcgttgcaatgcattttccaaataccatctccacactcaagagttttgaactggcattagttcccaataaaaaccctcagttgcccgacttactataacattgattgttatgtcacttgtctgtggatcaactctcaagcccctcattaaccatccttttatagaaggtacactcctctcagccggtctatcaattcccctttctgatacaataaaatctaacagatctaccccagttggcccgtaacggacgtttcctggtccatggtaaacttggaatatttgtttgttcgacatatctgtcaacgaaataactagatcatattactctttcatgcaataaacatctacaacgtaatatcttcttgtgtaagccaatgcaacggtaatgtattaattccaaactagcagatctacgtagttaccgatatctacaatacgcacttctagattagtacaactaaaaccctaaaaatataatgcatttattcaaacaaatttttaaagaatacacactatttaactcaatagtcacatataggatctatgaatattacctgaaatcggcgtctgaatccggcagggcttcgccccttcttctcttctcctcccctctcttctttttttttcactggaattgaggagagaagaatgagggctgggggctgggcagcaggccttttataggcagcgaggcctgccgcccggccagagggcggcaaggggccgcctgcaaaatagccggccccgactgacttttttgcattcgggccccttgccgccccaccagagggcggcaagggttttcctgcaaaaaaccctccctccatcaccgcccgttcctcccatgtttgccacgtcagcttgccaccccagaggtgggcggcaggggctatttttgcaatttttttggtcgatagattatttctgtaaatattaaaaaaaatctaaaaccgaaaaaaattccccatcattatgcatctcaccaattgcaacggacttcacgcaagccatttgctcctttatataatagcaccaaattatggaacgatgtccatctgttctcctcaactatttcatcgtctaattcacatccctcaaccacaaaatcacatatataggccttccaactgtcaaaatcgagtcaattacttcccttggtgctttagatggttgttttcatcctacatgccaactagatggtacattgacatgatattcatcacgcgtggtatttatgtggtgattatgtgacatttatagtcagcaaataaaaataattaaataactagtaagcctatatgtaagtgacatcgaaagtttaaaacgacgcttttgtgctagatacaggacaccatagacgaagattggttccgatccccaccgttcctgtaacataccgaaaactaaccattttctaattctgcatcatgctgagtcttatgttcttaataacttcctaaacaatataattagtggggtctcctaaaactaactcacacaaaacctctctggtatttaatctcttttgtgtttttcatttaaaaatatagttggttaaattaaggtgtttcttgatttggttttaatttaaaaccttcctttgactaaaatttctttattcaaaattagtttgaaaaccctttctattttttttatggattatggtctaagaaaccttcccaattttcccttgaacctaaattaaccaaagtaattccaattttattggaattaattattaacccatcctttgatcttaaacccatcctttgattcttgatccaaattcttccttttgatctagccactgatttaattcctgtggcttgatttcctcttcggcacaagaatagtattattgcaaatattgtgaataattgctcttgtgctaagaaaataccaatttatattcttcactcaactttccctattagccacaaataattcttcaaatacttctactatcaaatttaggattcaaatcctatttattttacctccaaccattctcctccaaacatatatatatattgaggaattatattgttaattcccctctcatttgagtgcattaaattccaccatattccacttccaaaaatattgcactcaaattagaaatatctcttttggaaattagatccaaatataatttcctttcaaccttccctattcaaattatctccaaatatattttcctttcaaaatcttctattcaaattccttccaaataaaaattctcctctaaatcaaattattcagccccaggaaaaattagactttcttccttctacgtttgggccgaattctccctttccttcttttcctttcctcagtccaagccggcccaacacccagccgagccgccaacttgcgccgccgctgcggtgccttgccctcctcctccgccaagcaaccgtcgccgctgcccttccttcgccgccaagtcgcgccgacgccgtgccgtgtcctcccttcccagctgcccaactcctcccgcggtcgccgcgtgtacgcgccgccactaacagccaattggagaacgaagccggcgccgtcgtctcttccccacgtcgccattgccgtgcatccttcgttgttctccatccgaaccgacctactctaccgcctctcgacacctataaatagccggtgaagccccctctcttcttccacaaccgagccgtgagctcagtctctctctctctctcttctcatgtcaaaccaccaccggccatcgtcgatctccctcactggagtgtttctggccaagcccttgcgccatcgggtttgcctcgacgaggcgaactcattttcctagtttacccttccttttcccttccgaaaccaaccatcatagccacctcctttgttgccggagcaagctcttgccgtcgccgttccggtctcctccctaaccttctctatcggcaaccaccctccctaagtgcgcgttgctcgggaacgcgttttgccgccggagtcacagtcttccatccaccggagagccggcgccccttctctccctcctctcaactcactcggcaacagaaaagaagaagagaacgggaggaagaagaaggaagaagaaagagagaagaaaaaaagaaaagggaactgacaggtgggcccctacagtattatttcacattttctagatttgatttcaaatctaatctttagaagcccatatctcctaaaccgtagatccgattccaatgaaacatggacctaaattcatctaaattcaaaagctacattttgatatcaaatttgctattttactattttatttgaaattccttcatgccatttgaatttatatttgactttcaaatatttcctttttactccaaaataccctatagccacttaaaagccgcccggttaaaaatttacgcctttcatggggacgttcgcgcgatctactggccccgacgttgaaccgttggttgtaaagcccggcagaacccaaacccaaggtcaaagtgctgctcctggcaccctacgcctcgacgcgtataacagtcggagcttcactattccctcgacctccacagcacgccgcacagttagctctcgagctctgtgtaatcctagccgctccgccgccacccacggttgtcggagtaacacttccgccccaccaaacctacaccaacctcctattcctctagccaatatgttgtcggttgacaccggctagagaaggtaccaaatctagtcgttatgctctagcattgactagcatataaccaaaccctaactaataccttcccagtcaaattccagttgtcatccaaattccacacccaccagtatcgcctatccaccatactctccaccacctactctccacctaccagaacctacacataaaattatagagccgagctgatatgctatcctatttcagtatcgactcgaggacaactagaccttagtttccatacgacctaaacctagctaccgccaatgaataccaaccacatacccttttaaccaataccattatccaaactagttacttcccatcctcctactaatcaaacccacatatgaaatataagcgatagtagttgcttaatcccctctagcctccaactctctagaacctccgcataagatattagcacagtaatccatataccctataaaagagatagactataccctaaaccctagccctcctaactgtttatctctttcttgctattctatggattttattgaaattggttcttcgtctttcttagtagagtctattttattttggatggcaacctttggtatttcgagaatcggataatcaggttgcctatctcggatttatttgcgttggagcaaggcaagttattattcatctcctttgagcataaatgccctgtattctatatctctgatatctcatgcattagccattcatgattttcaatgcataacctgaacatatagcaaaccagatatgctagcttttgcttagccctgcctagttagattatgcataaaatttaatgaacttagattgggacagtacggtagaaatggttgatttccgggtggctagtactgtctcagtcgatataagtttataccaaatacttatgtcaaacgaacgagtacgaccgcagcttctagaatagggacaaacctagctattatgttaattagcaatgtggtacctctgtacagtggttctattttaaagtcctcgtgtaggaggcaaatttacgccgagtagggcaattgtgatatttaccgaggcacaggtaaatatgtatttgagatatattgtgatcacgtttgtgaaccctgattgcgatgacatggtgtcatacaatcagtcctctctaaagaccccggtaacgccagaactcctctcgctgcagttaacgtcacgttcagagcgcatgaggatataagttcatggaacaggtaccacaattgttaataacctaatactgggccatgactaagctaatgaatattggcaagtcgtggactgcgggtaaagcgtacatctactgcagtaggatattcatcaaactattcgaatagccgtgctcacggaattgagtaccgagattcatatggtatttggttagaaacctaattcgagattttactaaatattgttgcattaaagtcattacaagctttcttcttctacattctctgctttctgcaagtaaatctagccctactcaaatactgctatttcatacattcatattgaatataatagcttgctgagtacgttgtactcacccttgcttcaacctcacctttttcagagtccatttggagttcttatcgaagccgggagttcaatcacataagttagttcactttaaacctagtcttgaagtctagtattgttagatggtttaactctatagcaaaacattagagttgatttattctatagcttctgttgtattagatagctacaagtttgtaaatacccatgtattttataataatatctcctttggaaccttgttcaaatgtatgcaatgaagattcagattgttgaacctgtatcaatctactgatccagggcttgatacagtctaaacatgtcggttaccgaatcattagttttgagacccgacagttcccctccaggcgatgagctagatctgcaccgtgggttgtcaccgtagccaatcggcagctgaatccgaggttgtcgccttctctgcaactcagtgcctcatctctctccttgtctttgttcgacgccaaggcttctttgctaatcgccttggaagcaaatatgaggatttgaggggataccactgccgctatcatattgcccccacctctggctccaccgccccctccttcgttaaccttgctgatgcgagaaaggaattatggccacctacatgcttcccctgcgtgaggaaggcccgttccatgtgtgccgttgtcggcacatcccgatgcccaccttcactaagctcgagtttcatgtgggcgatatcttggagctcgccagcgatggccgtctcgaggtagaactcactggctgatccactattctctttttttttcatgtggctataattgccatttaagagcaatattagtatgggtggaccaagtcaacgtgtcaggttagacagaactactgtaatgtcacgtaggacggaatcacagcctaaacaaccgagtgaggttaattgatctggttttgtggttttgtggttttgacttttgaggtatgcgaatcacattggagttgaggaggcaagtcggactttatcccaacttacgcccatgaggggtagttatgggctttaaactgggccggtacgggtcaaacgaaacgaactggtctcacattgctatcaagtggtatcgcatacgattcgattctgcttagcgaaactgcttccaaatcatcgaaagaattcatttttactaaaacctagtatcatttttcgatacgttggcccaactgttacttacctgagaattagtcctctgccgtcggcgtacaggtcgagagtctacactggcctctgccatcagtctacggttcagaaacagaaacaataagttttacggcgttcacagtcccagctcgggtctacgttgatcaaacctcaaaagcggactgaacgggagccacacaagcagctatagctaccagtaaacccagcgcgaaaacgaagccaccatacggggtcgtaagcttggcgcggcgaatctgccggaaattctcgcctgtattctgtctctacctgcagcctcttgactcgcctttccgtaattttaaccgatttggaggggagcccgctttcccgttcggtgacttgtggatttggtacccactcctccccagatcccgtgatgtgcgcctaccctctccctccaaataaaagacagaccctgattttcgtgttcaatatttgaccgttcgttttatttgaaaaagttatgaaaaaaattaaaaagataagtcacgcataaagtattaatcatgttttattattaaacaacaataaaaatactaattataaaaaatttcatataagacagacggttaaacgttaccacgggaatctatggtttttttttttttaagacggagggagtacttacgtgcggcgacgtccctctcaccgtctgaacatgggcggactcgcgtctctgacctgaaattgccacggaaggatcgatctgacacaaatcatcactcgtttttgcgtgtccccagaagctgtaaaagaaaacaaaaaaatcccgtagacgcgccgagaggaggagaaactgtggacgtcgcctctctgtctgatgatcaacgtacgagaaaacgagtgcgtgcatctgtcccgtggttgatcgcgactccgtttactagagggtccgtcgctgttgttgttgggggtccttgcacggtacgcgcaaatgtttgtcatgtcatgcatgcatatgtacgttcgtcttgtcgtgtcatgatgtactttaagtcaatcacgacgacctgatcattagtatcatggtggccattgtatcatgtgggccgtggacttgcggaaacgcaggtttttgccgaattaaatttaaaaatatactgttgatttgttttttctcaaaaatatttaggaagtaattttttttaacagaaatataccgtaggtcttgcataattattacgaaaatgatgtgggcggtctcgcgcggcgacggtgcgagaccccgcagtgttgtggaacgacaatgtgagaccgcgcagtctcgtgcaaccaaacagcgagaccgaactgtcttgcacaaggaatgagcgagagcgaacagcttttgagctgccgcttaattagtgattaattatcacagtaagtgatcatgataattaaacaatttgaatcggccacatccattcggtctcacctatttcgtcgtgcgaggccacgcggtcaccgttttatcgtgcaacaccacacgatctcgtgccgttgtcgtgtgagaccgtccgcgttgtcatgtccacatcattttcgtgtaatgcttgtgtaaaagtgagaatatatttttaaatttaattcggtttttgcctcggttagtgctggtagagagtattgcattaccatgtgtcgatcgattcgctgaaatgtccaggtaactcgagcactggaacgccggtcaaattttgtacgggaggagttgattataggactcatgaagtgtcatctacgtcgatagatgtaaacaactagcagtaaccgatttgggtatctggcctgactggccgcagtagatggaaagtgcaaagtgaaagccatatccggatacgacccggccgaaagggccccacacgtattcgggtttgacagtgagtgagagtgacccaggccgtacgaccggtcgagccaaagccagcggccggccatgcgatgcgcgtcaagctcagtaccggcagcttccaaagttgtcatcagtaaccagtctttctctttcccttctctcgagagcctccacgcaatggttccgagtataaaagtcgggtcaaatcaatgaagcatggaccctgcagtggggatccgaggaaattttcgacgatttttggatgcgacacttgtcatttgtcgtatggatagactattcattgatttggatatagggacatgtttgacattaatttggagtattaaatatatactacttataaaactaattatataaatgagagctaattcacatgatatttttttaagcctaattaatctataattagcacatgtttactatagcatcacataggctaatcgttgactaattaggctcaatagatccgtctcgcgaattagtccaaggttgtagaatgagttttgtcaatagtatacgtttaatacttgtaattagtgtccaaatatccgatgtaacagggactaaaaatcttagtccatccaaacagccctgatgttcaagctgagtattctatagtgtcacctaaat

SEQ ID NO: 2881 - DNA, 446 bp, Oryza sativa
gccgatctccacagcttcggcgccccccccccccccaaactccctctgtcgtcatcatcgtgcctcctccaccgagctccactctcgctgcggctgccgttcccgctttcccacctgcttcctgccgccgccagacgacaacgacgggttcgacgaggaagaggatgtgcaccacttcttcctctttcatgtctcctccatcttcatgccactgtcctctcgccacatctgtcgctaccgtatcatgcgggcccctcctcttctcctcactcccgccgcacgccaagctcctcaccctcccctccccccttccaaccgccacacccctcccggcgcggcctctgccacttcgtccacctccactccttctcgggagcgtcgctcgtcgagtagtccccgctcttcttggcgccctccacctgcttgctgacctgtgcaccccgtct

SEQ ID NO: 2882 - DNA, 12822 bp, Oryza sativa
ttttcaggaagccggctgatacatgctttcagattgacatacctgaaagagaaatagaacataaagaatagcacaaaaaagattcatgccaaataaaacataacagcagtacaacagtccaatcaaacagtagctaaggccttgaatgatgtagtataatctacataaccagaaaaatgaatagccattatcacagattttgttgataatatgctttgcatttatgaggttttaatggtgaatggtttaacagatctaaccaatgatgatgcaaaaagaaaacattattgccatctagcccatcataaatcaatgatattaaaatattatatagacaaactgtagtgaatggtgatgtatttttatggtccaatagcacatgtgactgttaaaattttatccaatacgattgcagccagaaagacatagatttagaatggtacattgaggtttcatcaataaaaacaggacaaaatgaggtcgaaacataccagacatcatctggattatcatcaggatcacaaagtgcaggtttgaccccagggtcacggttcatgtagcatgagttatttaatggtttcctccacatagcaatatatccctctttcttcacaagctcccaacagagtcttgcagtgaagtcttccatctctacacataattttgttcacaagcaattctttcaaaacaaaccaaaaaaagcacttcattcaaagtaagcctgtcaaaccaatatattatgtaatcctgataaaaaccatgcaatacattcatatttctagacatgatacatcataacaaaaatctgcagctttagttggtttctagaaatgaaaagaatttgtagtttagctttgcatttactttacttcacgtggaagaatgcctcaggcttgccatggatttaatctggagatccatgcatattaaacattttgcattaatttttttcttcaaattactgtgtatacataaccatatgaatcactccagatatcgtaaaatttgacatatgtcattccagaccataataggaggttgattcaaacttcaaagcatatgaaacataatgctgatacacaacacaataaacaaggaaagaacggcaatgcatgaatgaggaataaaagagcagctgtcataaatctaaaaatgcaaacgacaagaacaaatatgaattcgtcatgtgggaaaataccaacagaataaatgaaagactagtgtgtttcccccacaatggaacaaaaattactaggggtacataggaaataatgcatacctttccatgcttcttgctgagcctcttcatgcttataaacaggctgtgctgcccaagcaaaataaccgccggctctgagcattctattaacctccagaagcaggattccatctttaaagtggcaaatcatggcaacaaaagttaagcaaattggaagtcagggtgctacaaaaaacagttatctttgtgttgatattttgttgaaaacaatcattggatgaaaaagcgtcttcacgtgctaaaaataacacactatctttgcaatgtttgagtgccttgagcatgtctatttttctaataaaggaacttccagtcattatttgaataaaatatttttcttatgccgtaggaatgaattcagactagctccttaaatactccttaaatatgttgcctttgctcaaacgcataactaagaaaaaaaaaggtagaactttacatcaaagtgagtgctcaccatcgtgggtccaatttattcggcagcgtgaacaatggattaagtcaaatgcttgactgggatatagtaatcggtgtgtcgcaaatgctgctgccattgcaggcacaccacgctcaagagcaaactgtatctgattctcatgaacgtctttgggagctatggataatgtcaacacatcacgtgaaagtaagtatgcaccaaaacttgctactccacagccaacatccagggcaactctagtgtgagagccaaatgcaatatctggtaccatctggatgaacagagagacaggtggtgctactgagagtcagcaacatgataaaattttcatcagataaaagtacaatcagcatacttgagaaatctgatccaggtattgatttgctccatggataaattgagttcctcctccaggaaatctaaatttatccttagctttactaatccaattctgccctcctttgtcatcaaccaaccgcgtgtgaggtacattgctaaaccatacctgcaattcatcaaagtgtgttatagaaactcctttacctgaacccagaggtctttgaaaaattaaaccaaatcagttggttatactccctccatttcataatataaggcacaactacttttttcagatatttcataatatgaggtgtgcatgcatgcatgcaattaaatagcacctcctctctattcaattattatatttaaatcctccacactcaagatctctaattctattgggtgcatgcattgcatttgttacggtgatccaaactaggaggtgatcgtaattgtttcttggtctttgggttaagggtggttatgccttatattttggaattttggaatggagggagtatttaattttgcattaaataaaatgctgtacttcaaatgctgcttcatcatgctctagttaatttgaattcatacttcatactgatggcagaatcagaagacatctcctctacttagcaaacagaaaacccagtatgagcttgctacaatgctagtaataacccacaaaatcaaacactaccccatgttccacgttcggaaaatccaaaggcaatccatcaatttttgaataccttgcatgttatactcgatgcctagtactatagggcatagagttatacactgaagaattgtatgcatcacactatcaaaacttttgtttacagcacactgtcaaaatgtgaaagagagaacaccaatgcgcacctcatctctgctccgaggccaaggaatgggtgccttataccccttgggtgccggcacgaggcagctcagacccttgtccttggcagggcagtgccgctcgaaccgctcgccacgctccgtcgagggcagcctcctgatctcttcctcgttgtcgaggcagggtatgtactccctcatgctctcaggacaaaccgggaacctcccaatccgaaccctgctcccgacggcggggcccgcgtcggtcggctcctgcggcagggcctcgtcggtggcggccagatcggtgtcgttggcgccgccgacgacgacgtcgaagtcgtcgcgcatcgcgccgtcctcgccgacgatgccgaggcgggcgggagggggaggggggcggaggggaggaggaggcggcggcagcgaaggtgggggcgaggcattggcagtaggagaagcaggcggcgtggaggcggcaggggtggggatcagggaggggtcgaaggagaggttggcgttgggggagacggcgacggaaggggagccggtggagaggagcggcgaggaggaggaggaggcggtggaggagaagaagagcaggcgcggggaggagtcggaccagtggtagccgacgaggaaggcggcggcgcaggcgaaggcgagggccgcagcgcggaggacgcgcgggccgcagagcaggtcggcgccgtgcgcgcccaggggcttcatgctcgcctcgcctcgcctcgcgtcgcgtcgcgtcgcggtgcggagagcggtcggcgcggcggtgccttgccgatgcgggagggatgggatcgtgcactgccggggactgaactgaactgaggggcactgctctgttatttttcacttgaaaaatctatccccttcttggagtactactgtataataataattcttccaagtgggtcctctttgtcagtggacgcccgggacaccggcgaattgaagtcggctttgccgtcgcttctaccgacctcgccgccgtcgatcgtcgcctcgtcggtgaaggatgggaaaatgggtatttttggatctgggctatgaaattctcgttttctgcgagagagagtattgctcctgaaatgggtgagcaggcctagaaatgttgggctgggcaatgagcaagaatttggaaaaagtaaactgaaggtccctaacgcatccctcaacttacaaaaccagtgcaaactagatccctcggtagttttgactctgtgtgttgtccgacgtgcgctgactcggtgtgggacccacatcggtctcttcttcccctcctctccaactcgcttcctctcctctcctcatactctctcttctctgtatctatccactctgtcccatgggagcagccgagcagaggggagcggagtaggtggagcagcgacgcacgaagccggcgggcggagtggggcgacggtggtgcgtgaagccaacgaggcggcgacgggcgaagaaggcaggtgaaatagggtgacggcaggcggggtggggcggagcgggatggcggcaagcggagcagccaggcgaagtgggacaacggcacacaaagctgacagggtgacggtgggcgaagcaggcaggcgaagtggagcaatctgtcgccggtgccgatctccacagcttcggcgcccccccccccccccaactccctctgtcgtcatcatcgtgcctcctccaccgagctccactctcgctgcggctgccgttcccgctttcccacctgcttcctgccgccgccagacgacaacgacgggttcgacgaggaagaggatgtgcaccacttcttcctctttcatgtctcctccatcttcatgccactgtcctctcgccacatctgtcgctaccgtatcatgcgggcccctcctcttctcctcactcccgccgcacgccaagctcctcaccctcccctccccccttccaaccgccacacccctcccggcgcggcctctgccacttcgtcgacctcgactccttctcgggagcgttgctcgtcgcgtcgtccccgcccttcttggcgccctccaacctgcttgctgtcctctgcaccccgtctccgccgtcctccgcaccgccctctgacctcgacggcgtcctcaccaagggcagcggctcgccgcgctatcccctcgccatgggcagaggaaatgggacccactacccgcgcccagctgctcccccactacttgtgcccgccggcccccactcacacgcagctgctcccttccctccctccccccaaccgcccgtggagagaagaggagagaggaagagaggtggagaggagaggggaagaagaggctaacatgcggggcccacgctgggtgagctgccacatcggacaaaacctgagtcaaaaccacagagggatctagtttgcactggtttcgtaagttaggggacacgttgtatctggttttacggtttaaggatgattttgtaacttgatggcaagttgtgagaccttgggtgtactttttcccaagaattttgtgttcctttgatcatactggacctgagtaaagctaagcctgcatggacgtttttatgtttgggctgtccttgaggttgggtttggcccgttaaaagagcggtataatgggcttccagctatgcagtgaccacaatgcgagttctgaattctggattgctccgtgaactgaagtactgctgaactgtgacttgtccttgtgagttgtgagagatgcctcccaccgattccgattatgtacattgctaacttaacaatcccttggtttgaagcgaagaatatggacaacaccgctgatttgccaattgtcatatactatattttgctggtggcaaacaacagttttacgtgttccctttgttacaacgcatcttactgaaaagagtgaacgcagtcttattttatggcggtcctaatatcttccattttcttgccaaacatgcttctaaaggaaggcctttttcctatgttattgcagtattgctacctgaaggatggacacgtttccacggtacatgaagcaccaccccatgtagcattctaaagggaaaagttgcgatttctacgagcagtctatcggaaattaaacaatctcatgtagcaagagtgcatgacgcatgtggatggttacaagaaatcaataatgcgtcgtcgcatcccgggtctcgctatcgcgcgatgaatgagaaaatcacaggtggttggttggttggtcgagaagcacgatactaacaaacacagcaactcgaccacggtgcgccgtacgctcaccacaggagaggcatcacacgaacgatttcattcagacaccgtgcgtgcacaacggctcatgatggttaggctcccatatggcgggtgcgggaggcgagtcaagtcaagtgctcgagcgaaagcaaacgcgaacggaggaggcagtacactggcagtggcagcagaagaacatcgtacgccggtcgctttcccctcctcccccacccgtcgccgtcgcaggagaggacaagtgtgaccaactggtgacacccacaggcacgtttacctgttaccgcaagagagacgttttttcctcgcacggcacgcgtgcgcgtgacgtttttctcccacaactgctcgactcgatcaagatgacggggctgcttgctgctacagtgttgttgacgcggccccctttttttcgctgctgattgatgcttgcgcggggcgggaaactgaggcttcgtgaagcttcgagacgttggccacaaagcgtcgcatcgcacgcaacctggcccccgccacgaagtgggccgatggcgtcttggcgcatcggctggctggcggccgccgctcgtgagtctcgtggcccctcgagcggtcaagccacggagggagataagaaactcatgatgcgtagacgaggttcgtcaccggagcgttcagggccgaataataaacgagcgcgcaccaaagccggtgcacggctgcacgctggtcacacgttctcaccgcgagcctgtgtgtttaccattcgatcgggtcatgtgtggagccaaaaaatggtttcgatatttagaatattattttaaggattagttttacataagcagctatcttttacattctaaccctttcgaaaaacatatttcagaaatggacgcaaaactctacactagatattgttgacgccgaagttaaaccgcccacgagacaacccaccctagtctgattggcatgggtgaaaaatgttgtgcgcataacgaactacagtatcgtgtggatttctattaaaaatatcatgaaatttatgtattccagacatataaatcgcacattagtgcatatgcctttcagataaaacatggtgttatcaatcggtgaatctactgcacgccacaattacgctactaaaagtactcttttatgtattcattttttttttttgcaactggatatagttgaactatttaagttttttttatgacaaaacctactttctccgtttcatattataagactttatagtatttttcacattcatatatatatgttaataaacctagacatatatgtgtgtttagattcattaatatctatataaatatggacaatgctaaaaagtcttataacctgaaacagaggtagtactaactagatctaaattttaggcttagcacgaatgctcatgtatacatcagtagagagacaggtatggtaacttcttcagccttaagatatcccaaccgtcttcctcgtacgggtaaggtaaggtgtacgtacgtgcgtctatagggatgagaggtaactctgttaatttcaatcattttttaaatatgttggtccaatttttagagatgctcatatgcgtagaacgtgtgtgcatgtttatagagatgagtgtgtacatgtgtgtccgtatataggcctggtttagttctcaattttttcttcaaactttcaacttttctaccacatcaaaactttcatacacacacaaatttccaaattttccatcatatcatttcaatttcaatcaaacttccaattttagcgtgtactaaacacgccctctcccttatgccttttgtttttttttcgtacggtgtttaaaatcacgatggtccaatggtccaggatgttcgagctaccaacatattacatataagcatttactccattcaataaccagctttagatgatattgcattcttaaaaactgcgaaataaaactccctactaaaactatccttataattattttcaacatttattctatcatatactcaaccaatcacaataattttgtatttgatttatgtatataacttttaacctcaaattaatcactattatttattatttataattttttacctcaaacaatcacaactactcgtatgtttttcttattttattttttttgaaaattgataaaagtagctagtataatatactcccaccgtttcacagtgtaagtcattctagcatttcccacattcatattgatggaagtagacatacagttgtactccatcatataggaaaacaaattgccattccatcgggaaaaggcggtttagagcatgtacaatagtcggctataagccagctataaacatatttaaaagagacaaaggaagagagagaagagcagcgggctgcagtacggactccaaatcgtacaatgtgtatgacaggtaggaccatgtattaatagtgtagtaagcaactattgtatgaattggctataaatgatatggagctagttgttggctatactattaaacttgctcttagagcaggtacaatagcaggctataagctagctataaacatattttaaagagataaaggaagagacagaaaagtagcgggctacagatctgtagctggctgtagcacggactccaagacgtaatgtgtgtatgacacaggtgggaccagatattaatattatagtaagcaactattatatgaattggctattacattggctatatatgatttgaagatagtagtggcctgtactattaaacttgagcaattctacggttcttaagaaggtaccatgaggtatcatttttttctattgtaaatttagtacctcttggtacctagatactatgagataccaaaaatttagtataaaatctgatatctcatattacctcctcaaaaactgtagaattgctcattaaacttactcttaggaaggctaccagcaaatttaattggtggatgcggcgccggggagtcaaattgcagccggccacgttttccctggccgcgtctcctggctccgacccgcacgacgtggcctctcccacgggccgacacgtagcccctccaagccctgggcctcaaacctttccagaagcttccggccgtttcctggccaggaattcgccgtcccgatccagcggcccgccgagcgccacgtgtctggggcccagccacgtcggcatccgacgtggcgcccccggccccggagaaactgatacgcccaaatctcgcagctcacagcctcacgctcggaaagcaagtggccgccgcttccccaccccaaccaaaccaacgccttctcctcctcctcccccccgtggccgccgcgaggcgagagcgatcgagacggaggcggcgacgacggcgacggagaaggtagcggaggaatcggcggcggatacggggaggacgggtgctcccgaggagatgaacggccgcggcggcggcggaggcggaggcgtgggggtggtgggagcgggaggcgaggagcagatggagatggaggaggacggcgccgggcttcgcgcgcgggtttctgcggggaggaaggagcgggtggtgcttatgtgggggtacctccccggcgtctcgccgcagcgctccccgctgctcgggcccgtacccgtgaggctaccggccgcggcgggcggcgatgggtggagggacgtatgcggaggcggctgcggcttcgccatggccatctcaggtgacgtcccgtgactctccttctcattgctgttccgctcgtgctccgttgctctcgattcgttgggtttttcggggtgggctgtggtagatctactggagttgtcgactcttacaattaccgtggtggattgatgatagtaataggtagtgaatttggcgaaaatttgcgaacagatagtataggacgggtttacggggcattaatactcgtgacgatttttttttacagcttgcatttattgggcacatttgaattagttgattgtgatgtacttacatttcaagtggaggtccagttttgcacgacttggtgcggcaagtttgagctcggacttgtcctcttgttccgattgtgctttagttacaaccatttcatagctgtgggtgaatgtgtgaaatggggatttgtttgtcgagagctatatagtgaaagaagatgaatacacagctgaaatttgttaaattaagtgtatttctgaattttctgagaccttattcgtgtgatacccagaaacaacgataaaaaatcgtgtgatcgaggagaggtgaaagaagaacgtcatatcatgttcttagttgcctctaacatgatcacacgagtgaccttttaattcattttgttcggttgaccgtgatggggaatttgcattcttgttggccggccccacgaattaatttgatgtaccaaatcagagtgttcgaattaaaactattagttcaggagattgtatgtgttcagactcaacaatatgccaatagaaacgagctttctctgaaaatttctgtaatcggttgctcaccatgttcaagataaatttgatactaaactggggtttttatttggatcagagtctggtaaactcctcacttggggttctgctgatgatatgggccaaagctatgtgactgccgggaagcatgaggtaaaaatgctacccgtatctgtattgatgctttatgctctcatcactcggagatatttctaaggacaattttgtacttctcaggaaactccagaagcttttccacttcctagtgacgtggcaatagtgagagctgatgctggatgggctcattgtgttgcaataactggtatactactagttgaacacacatagcgtactttaggacagcaagagctcataatttttgtgttactagtaatttcgtaaatgtcatactggaccagatgaaggggatgtctatacatggggttggaaagaatgtgttccaacaggaagggtcatttctgaccaatcttctggtggaactttggaaaaagatgaaagacagagtgcgattgccgctgaccaaggtggtgatgattactgcctaccttgtttcatttgtgcctaaaaagtataagcttctctacatcaattgttttcagatataacaaaggcaactccattacagtgagccccaggtcgcaggtgtctaggacaagtagcggagcagcatctggtccttctgaaagtagaggtactgatgatagcacgaagagacgaaggttgtcttcaaccaaacatgcacccgaaagttcaacgtccagtgatgaaaacctttcagcacccccttgtgtagtgacatttaatacaggagttaaaataatggcagtagctgctggtggtcgtcatacattagcactatcaggtagcctacattttgcactaacactatggcactacatttgctgggctagggaactttgctgattaaaactaaatgttttctcgaaagcttcagatttaggccaagtatggggttggggctatggaggagaagggcaactaggcctgggttctagaatccggactgtttcctctccacatcctatcccgtgcattgaatcagcattgtacagcaaagatcggccagcagctatgaaaggaaacaaaagtgctgaagtgcagattagcaaagtcatgggaaattgcgtgaaggccattgcatgtgggggtcgccacagtgctgtagtaacaggtaagccctttctttcaagctcactctgggaaccttttatcctacttatttaaagttgatgtcgatcatatatgatcttaaggtggtatgtgtgaatacctcagttgggtcggtttttttcttgtggatgacaatacatactttcaaattggtagttcagtttgctttggtacagtataaagtaatgttttgtgatgtagtattacgaatttacaagaatggacaacatgctttttttcatgtttgttttcacatagaaaatagttggtgattagaggcaacaaggtgcattgcttgattggaccatatattgtagttaacttttaagtaactacgatattatgtatatgagattttctgtgtaaaatcaccaaagaacatgttccaaagaagttactttaaatccaaggatgtgcacaaaagtctaataatcaaaactgcagatctagacgagttacatctaggaggaatttcaattcaaaccaaaatattagcaactgttcagctctgttcatatcttctagtgaattccaacctgcttttacaacacatggaaccctaaattctagtaaaaattttggccctgcacttttaacagctagttcttttgcagattcaggagcactacttacatttggatggggactgtacggacaggttagtgcttctaccatagcatatcagttggaccaagcttgtgtgagatttcaaagcatcatttgcatgactaaacacatccaagtagctaggaaaagaaatatgtattcaagggatggagaagtgtatgattgttttgggtaatccatctatgtattcaacaagattaggcattgaagagttgtttgtacttgctttccgactgaacaagtacacagcaaacttatgctacaatttaatttggtttacatgtgatatgtagtt

SEQ ID NO: 2883 - DNA, 250 bp, Oryza sativa
atgtaagccctaccgcctggtctgagtattcgatccatctccagcaagatacttgagatgttacatctggtaacaacagagatactacagttagacgcactgtttatccagaactcagtggtatctttacagcatagtcaagaacgtagaaaggaatgagcatgaatactatttttgttcttgcaatgtatccataaagcatgagatcacctgtcagctatttttatagtcacattgttggggcacataa

SEQ ID NO: 2884 - DNA, 19824 bp, Oryza sativa
cttctaataccagcagcatcacattctggttgttgagggtccactgatacctttacctgttgcagtttattgttttaaataatccaatcaaacttttgtttgagcttattgctgaatagcacagcagcagtacatgcaatgcaagatgcccagatgatgagaataaaggcaatggcaaaaatataagtgctagttctatttcaaaataacaaacagacaacattgcattctaaacttttataaccaaacaaacaaaggaaacagggaaaattgctgaattaatgttccctttactaagtaaattctactagaaagcactagactatggtactttgatagcgattacccccatacattcaaagtcataaaacctaaaacccaaaaacaacaaaatggctacaatagccaggtcaattccctcagaagttgggtccagatgtccagttggcatattgcataacatgagtgcacatgaacgaagattaagaaaaacagtttcacaaaatataataagtaatagaatggcatttcttagtcttacaggatgtctttgcggattcttgtcctcccttaagaaaccaggaacagataagtgccaatttttttctgcatgaaaatatattcagattaataagcaaataaagttgattctatcacatcagagaggagggttatcaacctaggtgcagcaatacatccttggcttccaggactgatgatttcctatgcttcgcaagggtacacgcaaatgcagtcacctagtaacaaataaaaaaggtcagttgatacaagttttgtccatcagataaaagaagcaaaatcagaagctcaaggtactcagattctgaatcacacggaatcacatttttcaaccaaatagaaattcactaagagcagtgtgctgtaaaagcatgatttacaaacaacaaacacattaccgaatcaatgaagtcatcagcaatctccaaaagcaaatcttccacttctggatcaaccttgcccaggggatctacctgtaaataggagttcacaattcaaagacaaagcaaagtattattcaaccaaaagagtaaagtattattcgaccaaaagagcaaaatattattattcaaccaacaaagagaatatgcttctgaaaaatgggaatgcgattctaatatttcaagaaaaatctcaaagatcatgatacgatcacatcataccagtgatacagaagctcataagaatgaacccagaaggttatttgttacctgtgaaaccaaatcttgtatttttctcttcccaagaagttgattagttacttctgctccttgacttgcacttccaccagtcatagttccacctgataaaggagtgcccggttgtgatcctgtcaggttcatggacttctgggaaccagatgctgatatccttggagattgttgttgttgctgaagttgctgtagaatgtgttgctgctgtaaaagctgggtattgagatgaggatgctgttgttgggtttgtgcgatttggtgttgattcaatcctgactgctgttgaagttgatgtattaatagcatcctttgttgatgctgaaattgttgtggagaaacaggtgatcccagcgatgattgcatttgttttaaccatgctgcctgctgctgtttctgaggaagggacatttgtgccatcggcccatttgtcgacgatccaggtagctgtggatttaatgcagcaatcgatgctgttcttgtcaagccttgacccacaaccttctgataaataaaccaagatagaagttatccgcataaacatgagaggtgctagaaaaattgatgcacgcaactgtcacaagttaaaaatagaatatccatggtgcaaagttaataagcatagttctgattaatcctaaaagaaaaagggaaaaggacacacaaatgcttaactctcatgcagttttagtgggtaaaagcataattttagtaactgtgtgtaaagatacatcagaaagctgccaagagattaatattagcttctttgatcagtacctgttaatatatgttctttaaaaaggaccttggctatttgctgcggcatgcattcacatataataacaataaggccatgaaagatacatatggtaaggtaaggactaaggaggtgggtgcttgataaccaaagataattcttttgcttacggaagtcaagtacctgtggagacagtgtgccttgctgtgatgtctgctgcggcctcaattgtgcttgtgcatgggcaaaacgttgctgattatatggaatagttccatttcctctcataccacccatgactcccatggactgcataccttgtaatgcttgagctgcattggcagtattaaattgtgcaccttgcaccatacccttctgccttggctgcagcaacaagaaaaaccaattatgctagtaatacaatcagatggtgatagttactagttaccttcaactgaattattttccccaataataataatttcttaacataggcaaaactagtacgaatcactcctcttaatgtggtttccaataaaaaaaagcagagggtgtttcattaagcaattctaaatataatacagatattcgaacaattgtggttgcgcctgcaaagattccaacaacagaaggcttcttatcagagcttatatttgattctaaaagaaatcacaaatattttaccaatggaacatagtacgagaaatgtagatttctagtttttctttcttgtggtatgcaccatcacacccaaggagttatctccactacttaaataccatgatgctacaagaaaaaaaagtcaaaactgtttaagaaatttcaagattctggatccacgattcatttccttttgattcacaatcaactggtaaatgcaaagtttcagccggacctggcattctgatcaaattgatctaattttgtgtgcgtaccctcctaaaaatattcagcatagatatttgagtcaccaattcactaagccatgttacaaaactgttaccatatacgatacgctaccctgttaagctgatagaaaaactctaaccacaagtaaacaagtctacaattaaaagagtctgtgtttcccacttccgttaaaagtggaattcatgatgattagatgcaaaattcagctaactcaaagcgtgcctgagaccccaaatttacctgcgccatcatctgtgactggagaccatagtgcgccgcagatgctgcgttcccctgcccttgcagcatcccaatctggccttgactaagcatggccgcgcgagcagccagctgctgctgctgctgctgctgttgtcccacctgtcctccacctcccgagaagttcacctgactgccgtacatcctggccgcagcagcagcgtactgtggaagctggccgacagcggcgaggcgggagcccgagcccgagcggtggatctggccgaagcctccagccccggccgccgcctggccgggcgaaggagcctgcatctgcggcggccgcggggggtagtccatggccccgccgcccgccgcggacgggtcgagctgcggggacgagatggcggacaggtcggagacggtgggcgacggtgggatttggggggagaggagggggttagggttggggttttgcggggtggagacggcggcggcggcgagctgatcgggctgcggcgaggcggtggcggccgcggacggcggatccgccatggcgggctgggggcggcggggctccggcggcggtgggcggcggccggagacgacgcggggtggacgattgcgtcggggggtgcgggggcaggtacgggtcctgtggggtagtttgacgtgtgcgcgtagtcttttcgtggttgagtcaggaggggggtggttgctgtctttagggtcactgccaggttggccccacgggatcatttagcggataagaagaatccgctcagagtttgcttctcgttgccatcactatgcttgcttgtactctcctgggttgatctaggaacatgttcgaggcatttgaggtgtaacaatcatattcaggttccctgcaaaaaaaaaaaaaacaatcatattcaggtgcagtgaccgtcgaaaaaataagcccagacgcaggagaaaccaatgctgtctgggcgattggagactaaattaacaagagacggtaatcactcgccgttacacgtgcctgctggccgctgccaacgagcaaagcacggcacgctcgcatggccgtgtctcagcagcttacctcctggagaccggcagtctcgccttcgatttctctttgatcctttccgtgacccgaccggctccgagtcgacgcgctccgcccagctagcgcttgccgtctttcttgctctttgccgaggcagcgacgcccgctcgccgaaactctcgcggctcgcgctgacatcaacagcagcggggggcaacgcgcatgcgcgattgcgcgtggccgtgggagacaagccaaacaccgcccggctccgactcgacggggcaaccgtctcgctcgcgcgcgcgcgcgtcttggcgttcgcagtcgccgcgcgcttatcctatgggtcgcgaggagccgaaatatttcgcgttccagtggctgcgagtctgcaacctgcgactacgcctttctccattccactcccgctggccaaactcgtccgcacatacgccaacagagaacacccttctgcctacgaattacccgcgcccgcacgcgggatatctctctatgctttccgcggtcagttcttgctgctatacacctatattcctacgctgctgtcaagttcaaaagcacatgatcagtttcagactttcagttccagtggacgaatggcacctaggcacgcagacgcagagaagaaacgtccattcctgtgctgatcaacagggttaggctgcgggagtgtgtggggtatctacatagcgctgatcgatcaggttgattgctttatattttccagtggattagtgcaataatactacagtgaacgaagctgaaagtttcaacgggacaacggcgtaccggcattgtcaagatcaaggtttaaaaacgctgtcttatttctcctcccgtagcaggtacgctagattatagcatcatcaacttcaagagctgaaaaggtcatccacaggtttgcatcctgatatgattgccgtccaatcgggaacgcgccttgtaagactggctaacccctcattccctccaagtcttcatggattacactggattaattatccaaaaattaatccgttggctgaagagaaaaaccacggggctagctgccggtatatgatacatccacgtcagagtaaagccgatcaagattgccatttcaacctaatacagttaactagtagtatttgggattccgatcgatcttgtttcaacgtcattttgctgcgtctgttacagtagctcgtgtcactttctcggcaactttacctgctctttttatagcccccatcagttcaagcctcactcatcctaatccagcatcagtcccagctcgatctccctacaactcgcaaggaaaatcctctgaatctctcccatggaaggcatcatcccgttcatcttcaaggcggtagcgcagtacaaggagggagggcacgtatccctcagcgacatgatctccgacaggccgtcgccggcgtcgtacgtgctcctgccgggggactctgacggccgacacgccgatgacaagacccagccacttcgtcttcaggcttccaccggctccgaggaggaggtcaccacctgcaccgcccgggcgtcgcacctccggtgctccacgctgcgccggcgagcttaggatgccgtgaactgctacgccgatcaaactgcaggtgccagtcgttcagacaatttgaggtttgtggtgctgtgcttgtgcagtgcagacagtgagagatgtaaggagcctagtactttagctagtttgggcttttcagcctatagcatctataagcgacctttactttttttttttagctgtttatgctctgtaacgaggtgcaggtctccaaagggaagatttgtgcgtcgaagggcgaaacgctttgtatcttgagaaaaacgaatttgtaaaacaatactgtgcgtgtaactgtataaatttggtgataggttctgtatgcagagaggtacgcatatgcaagtgctatctcggtcactgtgattgatttgcctctgaagaaaaaattctcctgttacctgatgcaggactgccgtttgtttgggttgggctttgctgggcgtaattagacagtggaaaaagtacactaaaagtcctttgtcttgtcgttgaattacaaaatcgtcgctcaaccgaaaaaccaaactatgtaatatctctcaacttaaaaaaggaattactttagatccttagatggttttgaccccgattttatccaacgtagcagttgaatcaacatgggactcacatgggccccacatgtcagcgactatttcccctcctctctttctcttcatatttccctctctactctttctcctcgacacgaagcatttgactaagatggaggagatgacccctccgccgaggagtatcttcaggagcacgtcaactatgaagatttttagggttccgagcctagttccaaaaccgtgcctatgaaataagttagtcgcttaggcgcttagcctagcgcttagtcgttaagtcgccttccgccgttagctcccgctatgttgttttcgcgttatgttgctgtcttttgtgttccaaagttgtctatatgggatctgtccacgatggcaacctatgtaaggactaccctagtgatgtaataatattagactgttttggatcaccgatgttccgtgtgtatcagcttgtgtatcctgggactggtacatgttacacaagtacagtatcgtggcctccggacttgcgaggttcggggcactatagttgccagtgttgcagagacggtgcgcggcagctgttggcaagtgccactgccacctttccactgcccacccgccattgcagcctttccgctaatgagctggcatgggcggctgtggcgtcaccgatgcggcgggaaggagggccagcgcgacatgggaggaatgcggcggagaggagggccagcgcgacagacggcggccggcaaacgagagcagggcggtggcgtcaacgatgtagcaggaaggaggggctgatagagagaagttgggcattggcagcggtggtgtcactgacacggcagggaggagggccggcgagcaggcgcagctggtggctggcgggggaagagcgcggtggtggctcccagccgaccgactctcgagctcctgattcacgggctcagcgacgccgccgccgcagagctcatctacgccggcagccactcttccccaatgccgcgctgtcgccgcacagccttcgagcttcctccactctctctctctctctccactgtcaccgccgccagcattcttgggagccacccgccgccgaccgcactcgaatctccagtgccaccgcatcttgggccacctccgtcgccgtcgaggtcgcccatagccattggagtcgtgcgccctcctctggccttcctccctgtgcgcaggaaagagaggaagaagagagaaagagggatctaacatgcgggtcctaccttttattattttattatttccccagaaactgccacgtaagccccacgtcaatctcacgtgggatgaagaactagtaaaagaagctacgtaggtgtcacgtcaatcaaaactggggacaataccaccggaggacctcatttgcactgtttttgtaagttgatggatgagttgtaactgggtttttttttagggacgatttataattcggttacaagacgagggatctccggtgtactttttccttagacagccagtagcttttccaagattctgttttttcaggcccagttcatctggccacagagaggcccatcatcacgtaacgaaatgtaacccgactaggccttatggcccaaaaagtcgtaagaacggctaagccttatccaaaattccgaagcttatcacgaaacggacaataaggtatacaccctaatcccaaaaaccattgaactcaaaaggggaataaaatatcgactgggaggttttttctgacggttgtatcacaggatcacacagtattactagtgtattactgcagcgttttcagatcataaacagattctggcggcaccatacacgagaatacgagattaagtaatcacaagatcagcttggaagcaaggaagaaaaagaaaagagcaccgacacggcatttctctcgcatgcgcgtttgcgtatcagtgagtgcgcatttgggtcccgtcactcgcaaccaaagaaagattagtcgaagcaaggtgcagatatcttggataccggagagccggttgaccctagaaagaggagccaagatcatcagatctgccgggtttccggacgcatcaggattagcacatggaatatcctatgttatgcgtgattacaatgggcagcgcaatgcctcgccttggttggttgcctgcatctacagtctggacagatgacagtccgaagcggcttcattgtgacaaaaaagaagaagcaatctttggtttcttggatcagggaaagtggaaagcataaactggaacagaaggccaggcggaaataaactggacaagaagaaaaggcgtatgtaacgtactaacgtgcatgtttttttcctcattcaaagatttcccctcgacttctcattcaaacaaagcaaacatagcgttttctaaaatttatttattttaataatattctcccatgattagaaggggattaaaagaaaatctcttccgttgacagaaaccacatctctactgtagttatctgaattctgaaagcctgaacctctcgtcgtgtctcgtactctcgttcccctcccctcgcgtcgcctctccacttcgtctctataaagtcccacccaattctcgattcccaatccagcgcagcacaaagccctcctccttccaccgcagctgcgctacctacctccaagagggctggtccgctggtcgtggagaaggaagagagatcttccaggctgatccctcctattggtacggaagccctaaactcatcggagctttgccgcggccgcgagcgatcaaatcgaaatctttctttctttgttctttgatgctccaacctagtgtcggatttgattttgactgttgcaatggcagctttctccttcccgagcccgcttgaggatccccgccggagtagggattagggaggggagaacaggaggcggcgattcaccatgaaggcgctcattcttgttggaggcttcggcactcgccttcggcctttgacgctcagtttcccaaagcctcttgttgatttcgcgaacaagcccatgattctgcatcaggtaataagtggtttcgctagtactctgatggagtaataagagtacttatttgcagtgccaatggatgaattgggcacaagttaattatagtacagtattctttaccaacagtccaacaatggcactggcctctccatgaaaggagggagagggtgctaaactggtcagagaacattaatactatttgatttgtttattactcccacataaacatggtgtaacaactaaaaatccatggtaggttgcacttggatgtgattgaatgcacctttttactattcaattgtttctttccttagttatcaatttggttacatgattttggaaaactcttttggtatcacaccaaattttctctgtcctcgaaaattccaatcggttatcaagagtacttgatttatatccaaaatgttggctccagcaaacatgagcatgaggattgaggagagtaatgagctctgaattaaaagttttccgatttatgcagattgaggccttgaaagaagttggagtaacagaagttgttttagccatcaactaccgaccggaggtaaaaaggagataatcttttactgttgtctcatggtataagtataactaacttcacattctaattggtttgctctgatccgtcttttaggtaatgctcaatttcctgaaggactttgaggataagcttggcatcacaatcacgtgttcccaagagactgagcccttgggaactgctggccctcttgctctagcaagggacaagcttgtggatggatctggtgagccattctttgtcctcaacagtgacgtcataagtgaatacccttttgctgagctcataaaatttcacaagagccatggtggtgaggcaacgattatggtcaccaaggtagatcctttctttgaccactctcttgaattgtaaacttgtgtactgtgtatactgactattatttcaatataggtggacgaaccatcaaaatatggtgttgtggttatggaggaggtcactggaatggtggaaaaatttgttgagaaaccaaaaatatttgtaggcaacaagatcaatgcgggaatttacttgttgaatccatctgtcctggaccgcatcgagctgaagccaacttcaattgagaaagaggtctttcctcgaattgcatctgatgcaaagctctttgctctggtccttccaggtttttggatggatgttggccaaccaagggattacattacaggcttgcgcctttatctggattcacttaggaagagatcaaccaacaggttagccactggagcacacattgttgggaatgtgctagttcacgagagtgccaagattggcgaaggctgtctgattggtcctgatgttgctatcggtcctggatgcgtcgtggaggatggtgtgaggctttcccgttgcacggtgatgcgtggcgtgcacattaagaagcatgcttgcatatcaaacagcattattggatggcactcaactgttggacaatgggcacggatagaaaatatgactatcctgggagaggacgtacatgtaggtgatgaggtctataccaacggcggtgttgttctcccgcacaaagagatcaagtcaagcatcctgaagcctgagattgtcatgtgaactaaccctccttttatgttatggtatactcaagttcttttaatgcagtatctttagtttatacctgtgatccttccaagatgttgacctagcatgtgtgttactcacattctgaaaactgcttctcaatgagaattcagtgtgccatatttgattgtaccttcatttggaccatccagtaaagttctcaaccctgcaccaagaggaccagaagaaactctttttcctataaaagaagaggatcagccttgtactttgttctttttgaaacaaatatatactgctatatggaacagacccatgatgtattgcacaatttgtagcaaatgatgcaaagtggataataataaggatcaggcagatccatataaactataggccaattatttgtacaagctcatcgcaaaaactagaaaaagaaaaaataaaagtagaactactggtatgtaagtatgaaacggcaatttgctcatgctgctgtgctgagcttcgcagttgcggttgtgatttgtggtggtgatttcgatctgtactggcaattcaagccttgtcattttctgtataccgatgagtgatggtttatggatctgaagttcttcagtatctcaatcaataaaccaaatgagctagtggagcaactgaagccaacgagatgagaaaccatcctaggccatgcttcttgttcttccatcagcctcagtcttgcaagccattgtgaggacgagagtgttccatattattttctactccacaaaatagctccctgaaatgggtagccatatacatatggccaagagaaacgttggaagcgaatatgcatcggaccttttcttggttgggacaagacacaagtacctaccatgttgtcctctcaaaaagaaagaaaaaaaactatcatgtgttgcaataagggctgggatgactcaaaatcatgtggactggaggcttagtgaattaaaaaccacgtcactctcggatacagtccttgtcgttgggtcatttagatagaacatgtttcatctcaatgcgcctatctgatgacattacaagtttacccgtccttaattcagttaaccattgtttcggtagagaaaatttcgtttgtttggtgaaaattatgcagtaaaaagcttcatctgtatcgtttagtaattaatgtagaagtacaagtttaagaggttatagtgcctcattgcattaaattcagagaggggttggaaacaatcgacgataactttgcaccaatggaaacaaaaaaaaacaaacccaaaagaaaaatgacgatgagaaggaaacgtgcttgagcatatggaacataaattttctgcagatgttccattcaattagtttctcggaaacagagttcatggagcttgtatgacatttcagaacttctgttgtgttgtcgtcttcaaaaattagttcgtatacagagaagggatcaaacagaggggagctacagacagaggttgtacaaatttattcacaatgaagcgaggagccaaaacattacgagagcagatgtggcactaaacgcccaagaaagaaaagcacatgctatggctagttcaaatcttccacaagggagttggggattcctgcaagcgtatatgtccctatcgaagagaacaactacacctgctgctgagcatgatgccgcgaacgacaggattgctgttacctgcatcatgtacaactgttgctttagtacatcagaaaacacactttaaatgtttagatatggcacaaaatgttttatgttctttatgccccaaattcaaattgtgcggtaagatggattggaaactgtatagtaatgcgaacgattcgcaagtcatggaaatatttatgtgcttaagctaagattttcgcatgaaattgcccatttcctgtaggaatagcgaaacctcttgtgtttgaaactttattttccagtttgttaactaaccatcccaatttattgatgttccagtcctcacataattggcagtccaaattgcatacatttatttgatttagttggtaagtggagaactaggacaagtcaagagttggtctcgccccacctggatcctaattctacctacaatcagaatgtactaaatgaaaattatgacaaattcgatctcaacaacatccagctaatattaatatttgataccatgtagctcaagctttactagcctgcatcatgcgaacggaagtcgattaattctgttgcctgtctcttaacatgtgatgcaattacaaatcctaaaacagaatgatccaggaatgctaaatgtggttcaaaatactgcagaatatggttttgatgtgctaaagcaaatcatttctaagtggatatttttataatgagttctatctgagtataatacttatgctttgacaggcctggcagagaaattttcagaaatttaaatttttacttgatttgtttctaaatatttatccatttcaatggttgtgggaactactgaggtgaataatacatgagatgaaaaaaaatcattaataattacccagtcgccaacaacaaataagctcaggagaacagcactgtggagatctttcttgaatttcaaggcatagcaatcaaggcaagcaagtcccaagctccagagtgcctgtagtcccatcgatgcaatcaagtaactgaaattgagagttcaccaaaaactggttacttaacaggatactattcaatctgcaagttctgtcatagtgcagatcaaatggttttgctttgatggatgcatagacgaatgttcacatatgcaaacgactgccagattccttccacaaaatgaacacaccaatcttaacagcacagacaacactgagacttcctatgtcactcatcaaattaaatagagtaataaataggacaaacaaacaaagaacagattatcatgaatgattggcatgcctaccctacttaaacaatgaatgttggatatgagtaaagttgctcaatgttccagcaacataaaaattttaaatttcattatattgactacctttggtctctcctagtgcttcaaacatttagataacggaataacaacatccccggctgctgcacccgaagatgaacaaagccattctactgcttgaaacagatgcctcagtcactgaatagttttaactgattgtcaattttgaaggagtgtctattcaaatcttacagctatcagtggctacaaacttagaccaaaagcctaaggccaacttatattcaaagcaacagtgacaatatatttactttgatgatccaaattgcacaaacttgaattacgaaatgaatcgttctgtcaatgaaattgtgaataatataatgcacaaaggaaacctcattgccacaaaacttccatccccaattacagtagcagacggctccaggaagcaagcagtcggatatagaataaagccacaacaatgattatccagcaacaaagctgcatatcaatcagcaaattgcagggcggcgtgacatgccggccaaattttaataagctactctatcaatcagcaaattggccgactcaatcatgattgttcaagcgtgtatgatactatgatgcctatgatccgcactaaatcactctgcccaagcacgcgaaacgccgtcaccagagcatccccaatcgatttgcaaacgcataaggcacgcagcgagggttgctcgtagcaatcgagcgacagactactcgtctactcgtacgggatgacgtcgagacaagggtggggagaagagggggcgggacggcacgcaccagaaggcggtgtatgcggcgaagccgagggcggaggccgtggcgcagacggacgcggcggcgaagacgagctgccccacccgcagcgagaggccgctccacgtcccggggctgccggcgagctccctcatctcgatcgccctcctccgcttccgacccgcgccgcgcgccgcgcgggcgccctctcagacgccgccccggcgaccggcggccatgcggcgaaagttggtgggcggtttccgtgctgggagttgaactggcgtttcggtttttcaaagaagcgttgggggcgatgggtggacggcgaaaggtggcgcgcgctctctgacgagagaatttttggtggaattggtgcgcggtgacgacgccgggttggggttggggtcgcgttgcgcggcgtcgggtgcggtggggcaagccaggacgcggtcgcttgcgtgcgtttgcttgcaaagacggcgaaaattggtgggctttggtgttggtgggcactgcacacagaaatttgtgattattgattaaggccaagttttttttctcaactccaaattttaactttctctttttttttcattagcatgatttttaagcggtacgtttttttaagataataatagaagttgtttgaaaaattcaaataaactatttttaaaattttaattgttaatgcttaattaatcatatgttaatgaggtttctcgttttaggtgtattaaaaatatgccttcaaaattgacgatcgatcgcagcgagtcgtgcttctatgcttctaaagaaaagaacgcacgaaaattgaagtgcataaatggctcggattaaaagttactccagtttacatgacaaacatcattagagaggggcattttcgtccatggaaaattttttcgcgaacacaaatgagaccaatctagaaaggactagattgattttgaattaagaagggggtgaggctcaaacccggaccggctagctcgcagcttgtgttgctagtcgggaagaccccggacctttctccatgggaaaattcagtccatctccagccatgcccgtcctggcgccgggagctcgcgctgctcgaggcgacgcgagcggcggtgggagctcgaggcgaggcgaggcggcagtggcggcgaaggaggaggcgagcgcggcgggcgacgccatgcgcgacaaccagccccagcccgcggccgcgcccgcgatgaagcggaggaacagatgggaccaatcgcgtcgcttgtcgtcgtcgctcgcgccgcgcgccgtcgccatctcccctcgagccctgcccgtgccgcgcgccgtcgttcgtcgcccgtcgccgtcgtcgcctcgagcctcgttcgcgcgccgtcaccccgcgccgccgcctcgcctcacctcgagcagcgcgaactcccgctgccgctcgcctcctccactgccttgccccgccgccctaccacctagtcctcgcgcgccgccgaccaccgcgcgcccacgacgaggaggagcccgcggtggcggtggtgtcccaccacgtgtccccatgcgcccacgatgaggaggcacccgccgcgtgtccccgcgcgcccggtcagcctccgcctctgtcgccactcccctccgtcgcctctgccgcctccgcctccgcgtcgacattcgagccgtcctcgctaaccatcctcgctgtgcacgctgcatgagccgcgagagagaaaagagcaagagagagaatagaaagagagaggaagaagagtatggcaggcgggtctcacaattttttattaaaaaaacgctgactggattgtcacgtgtgcgccacgttggacaaaaccgctctgaattggtttgagggggataattcgcccggtttgcatagttaggggtgaagaatatccatttttttggtttaggggtaattcggatgactgcaaaagtttaggaaggtaattcgtgctttttttccctacaaactatgccccgtccactcgacacaacctgccaccataacggtgaacctgaagcctcccgtagtctcgtggccgcgccggactgccgggacaacctagccgagcgctcccgctggccgctgcctacagtaaagcagcgcgctgcgcccgcctcgccgccgcctccgcagggtccccgtgccttctcgcaccggcggcaccgctcgatctctgcgtgacggcgtgtgaggctgtggggtggtagtaggggcgggcggagatggcgaagcatttcgtgctcaacaccggcgccaagatcccctcggtggggctcggcacctggcagtccgacccgggcgtcgtcggcgacgccgtctacgccgctgtcaaggtcccccactcgcggcgtctcctcctctcctcttcatcacctttttcgtttcgtttttttttctctctctactttgtgatggatgatgatggcaaaccgatataaggttgttttcggattgtgcaggcggggtaccggcacatcgattgcgccagaatgtacaaaaatgaaaatgaggtaacttggttggtccaaaactttgaatcattcccgcattactggggtatcactgcagaattctgtaggcatggtcctcctagttctcgtctatgtttttgtttgaaacgattcgtgtatcaattttgcattaacagcattagtgaaaacagatcagcggcacaaaacagatgatttccgttcttgattcaattgggcaacctactgttatggaaacttgtatgatattcctccattttatatggactgatagtgaactactcgtttagataataagttgatgatcttccaccttctcaaaaaaagaaaaaagaaaaaaagtttacatagtaaaagacaaatctgcactactcagggccatgcgctggcaatcagaactcaaaactagcacttacctgtctttcttactactatatgctttacactagaccccaattttatcttgtttcaagacgagtaataattaataaacgcattttgggttttcaggtggggatagctctgaagaagctatttgaagaaggtgttgtcaagcgtgaagatttatttatcacatctaagctatggtaaccttttgcgtgattgtcctgtaaatatgtcttgtctttgcagttgaattggattacctagtgcctgcttgagcttttacttaaactgattggtgctgatgggtatgtttgtcaggtgtgattgtcatgccccagaggatgtgcctgagtcactagacaaaactctgagtgacttacagcttgagtacctggatctttaccttgtatttatcttattttcttaagaatttggatcaatacgtgacttgctagattctgtactttccatcgtcaaagtcttgctttggaaccattggcatcaatctatacaactatctctacatgctgcagaataagcctcctgatcagtcgatgcacattgataaactgttacattatccagcaaaatttctgcgagcttttatggattagccctgagacatccaatcataatcatcatgtgctagactgtagtccattgcacgagaacttccttttatcattcattgggtctgtaggaagatattcctttagtcctgccacgcaaccacaataaataaattaatatagaattatgttgttcatatcagttcaccttctttccttgaattatggtggatttttttttcatcctaaggtttcttctgggatcattacatatacctatatggttaatgactttgataaccttgacaatattattcagacaaatttgcaatagtaacataatatattgaacttgaataagtcttttctccacataaatgggaggatacctatggttaacctttgacttaataggttccttgttaaaatagtttcagcatgttgttacactaataataaaaaattctgatcaccattacgtttatgcagattcattggccattcagagtcaagaagggctcaggcattagtaacactgaagactacataccacctgacatcccatctacctggggagcaatggagaagctatatgattctggtaaatctcgtgccattggtgtaagtaacttctcatcaaaaaaactgggtgacctgcttgctgtagcctgtgtacctccagctgttgatcaggtagaatgccatcctggttggcagcaaacgaagctacataacttctgccagtcaactggcgttcatctttctgtaagtctgtggtacttatataattactctgagtcaatgctcttgttaatgagtcccgtggtttttaattttctgaatactgctaatccttttcttcctcttctttttaggcatactcgcctctaggttcacctggttcaacatggatgaacagtaacgtccttaaggaatccgtcatcatctcaattgcagagaagctcggcaaaactcctgcacaagtggcactgcactggaacattcagatgggtcacagtgtactcccaaaaagtgtgaccgaagaaaggataaagcagaacatagatgtttatgactggtctattccagaggacttgcttgttaagttctctgagattaagcaggttagttcaacatcctttgatcacctatatttaattgtcaatgttttcaaacatctctacagactttttcttaacaaccagtgtctgcatatgatttggacaaacttacattgatacctgctaacaattggtagaaggctatatagaggaaattaaagttgcaaaggtcatccataaaatgtttctaacttccatatggcgacctttacttttggaaaataaatcatttgcgaatactctcaaagaaatttgttttccttgaagcatgctacatttggcggtaattaagtaaatgaagcggtatactgtatgtagcttctactccctccgtcccaaaatataagggattttggacggttgggacactttctagtacaatgaatctggacatgagtgtccagattcattgtactagaaagtggattttgg

SEQ ID NO: 2885 - DNA, 9433 bp, Oryza sativa
  unsure (1)..(9433): unsure at all n locations
taatgggaatttataaaacccggtttctacaccaacgggggtggtatccaaccacaaagtgtgatgttatattcttgacctatataatggatgtttgttgctgcgcacgtgcttccctgaacaggtctaataagggataaaataatgtttctatgagtatcctggtattgacgtccaaaccaagtactccctatgtcccaaaatataagagattttgggacatagggagtacttggtttggaacgtcaataccaggatactcatagaaacattattttatcccttattagacctgttcagggaagcacgtgcgcagcaacaaacatccattatataggtcaagaatataacatcacactttgtggttgtatacacccccgttggtgtagaaaccgggttttataaattcccattatctaaaataataataatataacaacacacagtataatgaaatggatatgtaggttcaaggctattgtaatttgtaatatctcagcaatgctattattcacctttgatctctggttattatgttgcctgtctcatttctcattacatgtgctataattatattcatctattgtcacgtgatcttgtttggtttttatgtcgcaaccactggccttatcaggacaattttgtacatcttatgccatgagctattttatttgccatcaaggcatcaatcaagtatctcattatcttgaaccccttctactaactcataacagtgcaccagttatttctgatgttcttgttttatgatgttcaggttaggcttctcaggggcgacgtcattgttaatccccacagcgtttataagacccatgaggagctctgggacggcgaaatttagatgcagtcagcttacgttagtgccagtcactctcactgaacattattttttcacgaatttacgcttatctaatgtatggtgtttgagtctcttgagctcctattcaatgtaatgaacctgcttgatcagcagcatcatgttcccttagaattcgtattagcgctcctctgaataatactggatcatgtcatttgtatgcttcgcctctggcatcatttatcccatgctacttgtttgtctatttgtcctttggcatcatcattttttcttgtaccgaggcgttagtttgatactcatgttcctcactgaaattagtcaaattacttagcaggctaacagacatttgatagtcaccctgaattattgttggtagtaggtattcagccatgccttttgctttgatttgcaccttattcacgaaagatttcttgcaacattttttctctgtgagaaacaggtcaattctagctttgttcaggaatactatttttttccatagcaccaaaggcgtgccacaggcatagtatgattgtgctatttccttatcttttgagccatgatatggatgtccgtatgctctacaaacatggcgagaatcgttacccatcgcttgtgtttgtgttgcggggcattcctgcagaaattgataccagcaactaattaatggtactcctgtggagtcctggttcagtaagtgtttaactggcactcctgttaagtcctggttcagtaagtgtttaactgctaagggtatgactttaagtacacagggagattaagtgattaacaccgactagtttcagctgaggtgatggtggaggtaggatctatccaatgggatcaattatgacttgttatttacttgacgctatttttctattttgtttatagtttcccataaaattgaagatctatagattgtttgtcccttcagataagcgatgatgctactggaattctacatttgcctcgacgccggtgactctcgaactctggcagagaacccatgaattaatgttttaggggttggaggggatgggaggctgtgggtggcggtaagagcaactttagaagaatgactggagtgacgaaagaccgacgttgagcgacagagatggacggatggtgagacgctgacggcaaaatcaaagctacggggatgaaagaaagcggtggtcgggatcaacgacgggagcgagggaggcctactcccaccgtcccataataaataaataaactagatgcggcatatatactacaacgaatctgaacaaacgtatatctagatttatagtagtaggatatgttacatccagtattaggttagttttttatgggacggagggggtatgtggttaggaagttgggacaatgataagatagaagagtggaggcgtggcgaggggaaatgacgttagactgaaagacgtactccctccgtcaaaaaaagctaacctaggcaaggatgtgacgtccagatttcgttataccatgtgctcgatttgttacaccatgtagtatccaattcttacttaggatggttttttttggatggagggggtagtggaagtagacgagctactatgtatctagctagggaaaaagaaggaataagttaggggacgaaagatgtagaaggcaacgacaacgatgtggttggtcggaagaagtgaggaggggtaaggattagaattataaagggtagcacagatcttggagtaatctcaaccgttaaaacaagtggctacattttttaagaaaatcaggtgatcaataaacaacaagaagccccttagaatccagtatgagaatttactatttatcattcttccaaatatacatgtctaaataacactctcttaaaattttattctcatttaccatcgactcgagtggcgaatgagaatgaaaatagtaaattcggcattgcaaggaatgccaatggacgggtggagtcattattttcagctgctgcccagcctacggttccagcttccaacagctcgagaagagtgaagagatggcaacacagacacaggaaacggtcgcgcgcgccacagcgacagcgatagagccgctccgcgtcacggcttacgcttccgttgcgacaagctcgcagcctcgcacggacacaacgctatcgacgtggtgtcgcgtcggcctcagcctcgacccgaactcgtggagcgcggagcggaagcgcgggcagtgacaccacggggcggccggcggcggatgctgagagtgtgtccccatgcgttcggcatctcgcgctgcgcggggcggcgggggtcaaaactacaccgtgtgcgatgtggacaaaaaaggtttctccgttttctcctttaggccggagattcccccggccgaatccggcgaatcggcaaaagcggccacatgcggccaacagttggtgcacgttattgtcaaaaaccagtccttacgcaagacgccacgaggtcaacccggagaggaactacatgaatgaataacaaagacgtgattgaaacaaatacggagtagtacgtggttaggacctctattatcgagtaatgatactcgttaggacaagagacaattgaagcaagtagacgcaaaaacgtactcctcctagaggtcacgctagtactccctccattccataatataaggcaccctttgattcaaagaaaattcataggaattttaaagaattttatttctatagaaatttttactatatagccctgtgaatcaaatgaatgaatgaatcctatagaatcctatgaaattcctatggaatgcctcttcccatgcaagttttggagaaaatttagcatgaggtaaaacctcatgttaagaattctttgagtctttatatctcctcaaattcctgtgttttttctacagctcaatcaaatggtcattcctatgttttttaaatggttattcctatgtttttcctgtgttttgtaattctctgttttacacttgtattcctatgagaatcctatgtttttcctattcctccgtttttttcattcctatgattcaaagggggcacaaccactttttttaaagatgtttctaatataagacatgcatgtaagcatgcaattaactatgacatctaatcctattggatgcatacattatatttattaggataatccaaattacaagatgataataattatttcttggtctttgggttaagggtggttgtgccttatattttgtaatggaggaagtatctactacctccgtcccaaaataaacacaaccatgagtttctgcgctcaactttgatcgtccgtcttatttaaattttttttatgattagtatttttattgttatgagatgataaaacataaatagtactttactcgtggcatattttttttagttttttttaaaaaattaaataaaacaaacgattaaaattggacacgaaaagtcatggctgttagacggagggagtactaataatgcgcccataatgggctgtccttgtcacgggctaagctatccacacgatggcacatctaagccaaagcccccgctattaatttgccaaaccacgtccacctggcgcagacaccacaccaccaccgcaacggaaacacggtgaacgcctcgtcccgaaaccccggaaagccggcgagagctcgagaagtcgagaccaacctcgccgagcggatcactcgcactactcccacctcgccgcccgccgccgccgccgccgggttcccgtgctgcgcgcgcttcgatctccttctccttctccttctcgcggccgttcttgtgcgtgagtgagagacagtgaggtggtgggagacccgtgggaagggagaggggggcggaaatggcgaagcacttcgtgctcaacaccggcgccaagatcccctccgtgggcctcggcacctggcagtccgaccccggcgtcgtcggcaacgccgtctacgccgccgtcaaggtttcccccattcacccgcgcttcctcctcctcctcccctttttcgtttcttcccccatttggcttattatgtctggcaaatcaatgtaatactgttctcggatcgtgcaggcggggtatcggcacatcgattgcgccagtgcgtacaacaacgaaaaggaggtaacttggtttctccaaagctctgaatcgttcacgaattactggggcatcactctgcgtgttcttgtttgaaacgattggcgtatgaattttgcattagtaacatgggtgataataacagaagaaaggcacaaaaaaaagtatttggaaacttctactccttcatttttatatttggcaaagaagattcatccattttatatatatggacagtgaactattagtactttagaagggagtacctatacatctttcgaaagatttttataatcgtatcacacagatttttaatctttggattaaaatccgatagatataataaaaagcaaaaagcaattaagaaacactataatggacactaaattaccatatcctcaagaaaaagaccaaatccaatacaaaatttaaaatttacatgcgaagattcaaaaattacagtgtaacttacaaaagttacagtgtaagtttcataaattacactataacttacaagaaaatgcactgtaaatttgagtgagaaaatcgagtgagagataagaaaaaatctttcgagtgagatatagcaaaatcgctttagaaaggttgatgacaccttcacaaaaaagaaggaagaaagtaggggcagatccgctctacttttagggcatgtataatccgcactactcaaaactaagtagcacttacccttcttgcttactaccacgtgctttacacctggtccaatattatctcgtttcaagacaagtaatataacaaacaattaacaaacacattttgggttttcaggtagggttggctctgaagaagctatttgaagagggtgtggtcaaacgcgaagatctgtttatcacgtctaagctatggtaacctcaaatttatgtgtgattggcctgtaattatgtctttgcagttgaattggaattccagtgcttgcttggagctttacttcaactgatcagaggtgatgggtatgtttgtcaggtgtgatcatcatgccccagaggatgtgcctgaggcactagatgctaccttgaatgacttacagcttgagtacctggatctttacctcgtacgtatcttcttttattaagaatttggttcaatatgtgacttgcttgattctgttctctccaccatcaaggtcttgctttggaatcattggcatcatcaacctatagcaactagctctatttctatatgctgcagaataggtctccccatttgtcagtgcgcattgatagctaatgttacattgtccagcaaaatttctgcaatctgctatggaatacacctgagccatccatatcagaatcatcagcattctgttatatgtgctagactgctagtccattgcatatttgcatgacaatttccttttatcattcatccatgcaaccacaataaacaaagtactccttgttttggtatcagttcgattgttcaccttgaatgacttacattgaagtatactctccacataaattggggcatatacctgtggttaacttttaatttagcagattcctttgttaaaatgtttcagcatcttgttacactaatcagaatttctaatcaccattatatttatgcagattcattggccattcagaaccaagaagggatccagcattggcaaacctgaaagctacttaccacctgacatcccatctacctgggcagcaatggagaagttatatgattctggcaaaagtcgtgccattggtgtgagtaacttctcatcgaaaaaattgggtgacctgcttgctgcagcccgtgtacctccagctgttgaccaggtggagtgccatcctggttggcagcagatgaagctgcataacttttgccagtcaacgggcattcatctttctgtaagtctacatactaaaaaactgagtcaatcctctgactgatattagtaatgaacaaatgacacctgtggtttttccttttctgaaacctactgatccttttcttcctccttttttaggcatactcgccgctaggttcacctggttcaacatttatgaacggcaatgtccttaaggaacccatcattatctcgattgcagagaagcttggcaaaactcctgcacaagtggcgctgcgctggaacattcagatgggtcacagtgtactcccaaaaagtgtgagtgaagaaaggataaagcagaacttagatgtttatgactggtctattccagaggacttgcttgctaagttctcggagattaagcaggttagttcaactttctttgagcacctatatttgtcatctatgttttcacttttcatacatgtgaacagactgtttcttaacagcgagtgtttgcttcatatgattgggataaaattacattgatacttggtaacaattgataccgggctatatatagagagcaagctgatgttgcaaaagttctccataaaatgtttcttaattctatatgacaacctttatccttggaaacaaatttgcttgtaaatactctccaaagaaatttgtttacctcgaagcatactagattgtagaaacttagtgtattgtttgttagcatctgcttgttttggaacatcagtgccaggatactcttaggaacattcttttatcccttattacacctgttcagggaaacatatgcgcagcaacaagcatcaattatatagttcagagatcacacatgataatgcagtgacgtgtatgctcaaggctactctttgtaatttgtaatatctgagcaattttttactcagcttcgatctctgatgattatgttacttgtttcatttctcattacatttgctgcttttctattgtaatgtcatgtgacatgacaaactgtctgttcaggtttggctttatgttgccagtactcactagtggccgcaggacaattttgtaggtcttgcgcagtgtggtagtattttgtttgccatcaatctagtacagctcactcattaattcaatatcttgcaccccttccagtaactcatatagcagtacaccagttatttctgacgttaattgttttatggtgttcaggttaggctgctcaggggcaacttcattgtcaatccacagagcgtttacaagacccatgaggagctctgggacagggaaatttaggagttccgtcagtgccaatcacgcttattgaacattgattgtattagcaaatttacgcatatttaatgtttggtggttcagtgctctcgagctcctctgtcctatgtaatgaagtgcttgatcagcagcatcatgttcccttggaaatcctttttactgctcctctgaataaaactggaatgccattttggtgcttgtgcttcgcatctggcatcatttatcccgttattcccgtgctacttgtttgactatgtccttggatcatcaaattccctcgctgaaattacttagcagcctagcaggctaatcaacaaaaagaaattatatatgtaccctgaattgctgctggtagctggtattcagccatgcctcaccaacgattatagcttctttctgtttttattcttagcaccgaaggtgtgccgtcgtttgtgcacttcccttttctattgagccatgatattgactgtatttcttctgtctcataaaaaacaaatctaagatagaatatgactatcttaatactacaaatctaaacagctcctaaaactatgaatttgaatctgattgtctagattcgtaataatagaatatgttccatcatatctaggtttatttttaagagtacatttattaaattcccatgttttaggtgtaattgtgattttacccctacttaagtagactttacaattttacccttaattttctcgaactgaataatctgtttacccctggtttagatgtccagtcccacataaagtgagttcaagaaattagaaaattgactaagaaaatatgtaaatactctactaaccctcacctattcaaacaaatccactgcccccactctaaatcccctcacaaccaaaatcgacatcccgatcccctcccgtacttggcggtggcccgtgggccatggcggagcaagcggtgatggcggaagcggcgcacgggagcggggcggagcaggccgaagaggggcacttcacatcttctaacctgttcccccatccaaaaccataaccaaggggtggtgctgccgtgatgcgttgccctggggcgacgggagttgtatgtcataaaggaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2886 - DNA, 720 bp, Oryza sativa
ccctaaaccaaaaaatggatattttcacccctaactatgcaaaccggaggaattatccccctcaaaccaattcagagcggttttgtccaacgtggcgcacacgtgacaatccagtcagcgtttttttaataaaaaattgtgagacccgcctgccatactcttcttcctctctctttgtattctctctcttgctcttttctctctcgcggatcatgcagcgtgcacagcgaggatggttagcgaggacggctcgaatgtcgacgcgaaggcggaggcggcaaaggcgacggaggggagtggcgacacagacggagactgaccgggcgcgtgcgaacacgtggtgggtgcctcctcatcgtgggcgcatggggacacgtggtgtacaccacggcctcggcgggatcgtcctcgtcgtcggtgcccggtggtagcccgtgccctagccttaagctccaacccccgctcgcgtcgccttgaacagcgcgagctcccggcgccaggacgggcatggctggagatggactgaattttcccatggagaaaggtccggggtcttcccgactagcaacacaagctgcgagctagccggtccgggtttgagcctcacccccttcttaattcaaaatcaatctagtcctttctagattggtctcatttgtgttcgcgaaaaaattttccatggacgaaaatgcccctctctaatgatgtttgtcatgtaaa

SEQ ID NO: 2887 - DNA, 1250 bp, Oryza sativa
aaatttatcccaattattttccaagttagctggtgcaagtcatacgacaatagtactctctctgtttttaaaaaggaaaaagtacgaattactcccacgaactatcgcagatgtctgaattacccccctgaaccacaaaaccggatattcttcacccccaactatggaaaccggacgaattacccccctcgacctaatccgtggtggttttggtctacgtggcgtacacgtggcatcccagtcagcctttttttaataaaaaaatagtgggacccacctgtcatactctcccacctctctctctctcccctgctttcctctcaatgtctctccctcttcccctcttcctctcaatctctgtctctgtctgcactctgcaggcgtgcacgggagtggacggcggacagcggcgtcgcggctatgcccgagcggaggcgactgcggcggcggctgtgggcgtggcgcacgggggcgggcggcggaaggcggcgtcagcgcacgggggcgggcggcggatggcggcgtcgcggcgacggccgagtggaggcgactgcggtggcagctacgggtgcggtgcacgggggcggacggcggacagcggcgtcgtggcgactcttgggagcaagggcacacggcagcatggggacggacggtgggcggcggcgcgcgaagggtgcgctggcgggcggaggcgtagtcgaggcgggggcttggccgagaggaggaagcacgatttttccctgtaaatttcctggtggcttgtcgcatctcgttcatcgtcgtctgcctaagacttgacggacgaggaggaagaagggagcgattggtttcacggtaacaaagggagggacacgcgggcggccggagccggtggccaacggccattttttcatgcgtggctccctggaggttcacgtgattggcagagacgccaggtcgccgtgcgccctgagactgatgattctgtgcttctacctgttaatctatctgatggttttgttctatcatttgagttttggtcgagtccacggaccggacgctcgacgaacaacggcgacgaggtggtcgagcagggcagcagcagccacgccggcgtgcccagcccgctgaaccgctcctggcagagcagcaagcagtagacggcacagccggagcacagcgtccggtccacgcccgcagccgccgccgcagtcgctgtcgtggtgaactcgagcgccgccatcttccattgcgcgacccacgtctcgccg

SEQ ID NO: 2888 - DNA, 8535 bp, Oryza sativa
  unsure (1)..(8535): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttcaaatgacatcgtgaaatatttagttggatggggtctcgataaaatctaaataaaatggtaaccatccaacttcatcgatgccctatcaaatcaaaaagctaacacgttatgaaacccgaagcctcaagtacagagcataggagatattactaggactactaggactcaacgtgctagtcaaccgtcaaaccacacgaaggtggcgaccaggttacacatctcaagagacatgaaaaaataagctagagttctacaacatcgcaaatgctctaaacacatactcatgtgaagctagttcccaggttaatgtcacacccagagttttccctttccttaggttccaattcactaataaatagtctatagaaattactttggttaaccaggagaaaaccctaattaacaatatatttaataatcggaattgccagaggaaattttttttcaaattctatttgctctaaaaatgactaaccggacttaaagcggaattcatagagcaccggaggtaatgttgctaagtttaaaaatgtcaagatcacattaataataattcttccttttgcctttggtcatgaattgtgcccaattcactgccttctcagtccgcggtttcattttgcatgatcaaccgtgtccgtttttgttcgcgggaccgtttcctttcctttcctagaacggtgccgcagttgttttcctttttagggaagtccttataacaccccgattttcgttcggcattacaaatcaattaatagtacattttctagaagttaaataaaagttaaagtaatttaatcaagtgaattattaagggaattaaaaaaatttccttaaaaatcatggccggaaatatttttgtaatattctctgtgccctaatatattctctgaaatttcccgtgaattttcggagctcaagaagtaaatttttaaagtcacaaaattcaattaatcaattaaattaaatgaaaaaccaattaaatttcccctccttcctttgggcccctaccggcccaaatccctccctctctctccttggcttgtttccccctccctcctttcctccttcctttcgggctgtcctctctccctcggcccacgccctcggcccacgaagtctactttgcctccctcctcctccctcctcggtgaggttggggcggaacttcgggggccaccggacgtttcggagactcgccacaaaggccttgcacccagccccaccggacgggggcgtggggggccggccgcctcgcgcggggtggcgcgacactcctgataaggaggcgccttcccccgcgcagggagcgcggcgctcatccctgtgacgcttgatgttgattcgggcgtcctgttccccgtaaagactatcgtaacgccctcggcttttcgagggcctcgacgacgtcggggttgtcgatcgccgtgagatcatggctgaccgacaagccctcctcctcgccgatgaggagagggcagtagaggtacgtgaggtaccagcagttaagggccagccgttagtggccagctgccgctgtgcggctacgaccaagttggccacatcatccagccaccgctggaccggggtcttcggctctagaacgacgggagggtgccgtaggagagcctccacggcctggagcgcgccttggggcgtgccgccgtcgtcgtaggtgaggcggcggtgtaccccggcgcggcgcgcccttcccccatcagccggcagggaaagggccgaacctcctaaccggttggggtccttccgccgtctggggcttcgcgaggaggggtcggagagtcccggcggtggtggcggggattacgactcccgctaccgtcctcacttccggacggagtgggagtgtacaccaccacttcttcctccactacctcgaccatggtcgttgaggatggaaggaaacttggggcggaagaaaaacggctccttcacaaacgcgcgggatttcccctaccttgcgcgccagctgtcgaggagtgaccatctctagcgggaggacgtgagaccccccctttgtgagttcggccagaggattaggcgtgatgatcaggagcgctatctctacttagcgaatcggattcgctcggggctaagctcgcaaagtggatggtaatccagacggggacgagagattatccaggtttgggttgctatgaagcgtaataccctactcctatatatgggttgatcttcgagaagttacaaggaatccaaatctcagggaaaacaactagggtttttctagtctcttcctagagctagagttcttaagagtcgtcctttgctcgctgggcaaggtcctccatttatagttcaaggagataccacatacaccgccgctacggtccctaccttggagaggggcccacatcggtctgggttgaacagcttcccaatcctttggccggaagtgaagtgtgcgctcgtcctcaggtggtccctagcgaagtccttcgcctgacacgggggacatcccctatcattccctcatacatttttggagacttcgtgggttcacgcgcgtggggtgcaccgacctgcacgtcgatcccctgctgtcgatgggacggggtatacctgcccccacgtcgcctgatacagggtagggcgtgggtgcgctgccgcctgtcacatccgtctgtcaccgatcgcacgccggtcgcagaccggtcaaggctgcttgacgcacgtcttccggtgggcggttggggcgctgcccataaatgcgcctggcagtccccgcgttcccgcctgctcgatccccctcgcggtcaccacgtggcgccgagcgagggcctcgaggtaaggcagcccctcggggccgagggatatggcgagataccccgagccccctgggggagcgcggacgctcctgggctattcaccgtccgtgcgtccaaccccccgatgtggggcctgggccacgcggccacgtggctgacgggaaaggatcccttcccctcagcataggtacccccgggcccatatcaccgacacggcggaaacaggcaagcacctctcccctgctaatgccgtcacctaccgtggtcgatagcgaggaagaaaggaagagggagtggcgacgacggcgccgtcgtcaatgtcgttaatggtcggggaagagagtaaagagagaggtgagagtctaactgctccaccccacttatttttaaaaagaaaaatgctaactggattgccacgcgtacgtacgtaatgtaggacaaaactgcatcggattgattcgcgggggttattttgtctggtataaatagttcggggtttaaaagtctgattttgggatttagaggacaattcataatgtcgtgatagttcagtgggtaattcagatatttttctaatcgtaaaatagtttagatgcatgctttgattgaactacatcggtccaaaatatagcaatatagcatcggatgagatgcatcctagtattattaatctgtacaaagggtctgtccaaaatttatattagtgagatatgttccatctgatactgtattgccatattatttatattagtgagatatgttccatctgatactgtattgccatattttaaaacggatatatagtaccaccacgaagtatcaagctgcattagacaaagtactataattaaaacattgtacggctactattatagtccatccaattcatcattgtttccgcgtgcaggagagaacaaggagacaaggggacaagagagtgtccgctcagtgtcgatcgatcgagtcgtacgtcttcggcggctaactcatcagtgtcacacattaccgggtgacgcggcacgagcccgacagcggcacgcacgtacgcctgaggacgacgcacaccgaactcaatagttagggcatccacaatatgaaaatcggaaagggcattatgcttatgatatctacttatacgttgtatgtggagatgatccttatagctattctttacttaagtaagcattatacaaaaggaccactcataaagaataaaaaattcaatcttctctgctccaactttgtctctctccaaatcttttggttgcccccgtaagggaggagaagcagcaagtagtccgccgtgggagagtgagagagcatgggtgcacctgcatggatatcactagaaatccccctgcgactgccatctccgcaaccggagatccacccgcgaccgtcgaagatctgcccacgaccgccgctggatccgctcgttcgcaccgtcgcgggatctgcccgcgaccaccatcgctgacgctgcatccaacctcgaccgtcgccgacaccgccagagatccagccaggaccgccgtcgaattcgcccgtgcgcgcgttcgcaactgctatcactgttgccgccgcgagatcaaccaacgatcaccgtcgatgctgccacatatgaccgcacatgctgccgcaacccccgtcgttggctccattcccgtccgtgatggccaatgtccccccccccctctctctctctccttgtacattgctggtgccctaagctagctaggttagcatgctgccagaaccggaatgagccagagtggctggtgtagttagaaatttttcgataggtagtcctacttcacaagttcatattacacatcaaaattttcaaacacctaaaatgatatatacaagtagtaatacgttgagaatatggtacaaataaagaaacatgagtaacatttatttcagacgatccatatattttccaatgtgacaaattagatgaaccaggtttggcctaatcaaggtgagtagctggttttcggtcatgctgatggtgctcccgctcagctctgttgctctcaaacagctgattaggttgatagaatctgatctccacacagaacaagtgaagcaaaatgagccactagtacaaatccgctcatatgcctaggcaacatgggccgttaaaatgaagccatctcaatcgggcctaaattaacatcgttgtagatgtacttatatagacataatagaggtgtatatacctatagcccatcaccgatgacattcatcagtgtcgggctctcccttaggcccgattgagattacatcctatatctcaatcaggccggactactaggcctgttagcgatgaagaatatcggtaattaatcaagacatgatcttctatatgttgagaaaatttgaaccttctccagttgtaccaacccaagaacgcagattactcagagctaaactacattgttttgtttcactcttccaagatcaaaattttcctccattgcacgctccaagatcgaacaacaaacaaccagacagcataggatgataggacttggtagagagagatatcaagtagggcctcagggggccggtgggggcgccatggcaccatgagggggaagccagctgggcgctgggcggggagcaagttccttgcctatgccacgtcgcccgtctgccctcctctaccctctgcaaatcgatacaggaaaacggcggcgcggcgaggtgaggagtggagagaggcgagagccagagaatagtggtggtgcggctctctcacgggcgtgcaaggagtggagggtcgcgtcccagccgatcagcctagggcttctgctatgttttctctttctctttcttgggctggcttcttttcatttcttgtgcttactcttgagacagaatttaggaggtaggggtccttgggccaaaatcggggtacttcctccgtttcacactataaaactttctagcattgtctgtatccatttagatgttaatgaatcttagatatgtgtatgtgtttagatttattaacatctatatatatgtaggtaatgctagaaaattttacattgtgaaacggagcgagtagtttcgagtatatcaggaaactaccacctagctacgcccgcacacggtagatgaagatcccgagcagagcagcacacatccgtggcgcacgatggagaggggggatgatgaggctgcggagctagcgtctctcgttaccctacgcgtgttgcacgatttgctcatggtcaatcaggatcatagtaactggccaccagccgtagccaccgcccaccgacagctactggatcgatcagtgacaaaaaaagcctgtgaagaatttcgctttgttttctcaacatttctaaaataatatattattgacagaccatataaaattctattttcaaaacggaacctcatatccacgcaatatagcaaaaggacatatagcctattaattgtagtgacttgagtagtactgacttcacatctttataggagcgaatttcagattagattgtttgagaagctaagtcccaatttaaaagattgcatatatccgatcgggtaaaaaatattcttctctaaaaaatccacgcaatataattaacatggtatttaactaatgtcacgccaacacgaatggagtgtcaacatagacgagcacctataccaaaaaaaaatccacgcaatataatcaacgtggtattcaacatgaacggggtgtcaacatagacgagcaccaataacattcagcattatatcgaactcaactatatataaagacatatcagtatatttttaccaaaaacagtacatatattgaaagttatctaaataattatattatgacaaattgttgttaattatgtgaaagcaaggttcttctttgcaaattagaataaccaaggtaatcatatatatatatatacttatatatacttatatagttcatccccactaaatgtagttcatgatatttctctcttctcttattaaaccacaccacctcaattatttctagcctttggataaaagatctatggtctaaattgtctattctttcttctctcataaaacatgcaatctcatttattttcaggctcaaaattatatcaaattgttttcgttttgataatcaaattatattttatttgtatatattatgcaacttaattctccgcagcaacacaatggggtattcatctagtaaacatatacattgtctacaaatacatgcatgcatgcacgacgaagtcgtcacgccataaagtttagcattgttgcacgaggttaccacaccaattaaactggtgtggacaacaaccaatcctctcttactatatactatatataaagttaaagtacactaatttctaaagtgtaaaaataccacatcatcatctactaacaagtattacatttaagtatcatgcaaacatgctatattatctataatttaataatttattaaattttaaagatttaaaatgtaataatgttaaatcatcccacataatttacataatatttcaatatatctctccatcatttttttataatacactatatacctatgtatagttcatcctcacttaggtcattatatttttcttttctctcgttaagtcgtatcagatgaattgtgcttatgcgattaatccgtggttcaaattatctctatccttttcttctctcattaagccatatcatctcaacttttttagcccttatatgtatagtctaaattatcttccttcttttattctctcataaggccacaccatcttacttttatatttgagtcatcattgtatatactatttaaatttaaattacatcaatttatataaacttatgtttatataaacttatgttgtttaagttattttacacattataattacttattgttatcatatagtaaactcccacagtaccacgtagggtttcacctagtttaatactgcatctgtccgaaaatgtagcaacctctgtcctaagacttatgtccagattcatagtcacccatcctagattgctacatcttgggatggagggagtaatgctatactacataggtagattcttgccaacttgaccagaatttgctactccctccggttccataattcttgacgttttggataatgacacggtcttcaaaatatgtatttcattttgttttcctaaaataatatatacaataaataaatgcatgtttacttttcttacattattttgaaagacgaatctatatatgttgttctagttcctttaaacttaatagttctaaagttattgataattaaagttgcaaaagtttgacatcaaccttgtccaaaatgtcaggaattatggaaccggagggagtacgtcattaattcaaactgaagtgacattaatcaaatgtcacgtgaattatattagcatgataaaacgcacaatttcacaaaataaatattgtatggtaattaaaaatactgttttattaatatttgaaataaaaaatcgccagtgaagtgacgaaaa

SEQ ID NO: 2889 - DNA, 28333 bp, Oryza sativa
tctggacccacttttcgtaacttcactggcaatttattgaggcaatcaatctgcagggtacctattaggcctaatgtagtttatgtgaattaagtggagatggaagcggccggctctattatataattcaaacatacactctctcagttctaaaatatgaatacatctaacaattgaaatttgtactaacaatctcttgtttaatgaaagacatcaaaatcttttatccttaaccttatctcagctaaacagttaaacaaattacaaatgcttatattttagaactatccaaactatttgctataaacaatggagggaggacactactatagaaaagatttttcggacgaagaccctgtaggttgcaggcgcgaactgtaaccttaacatgcaaatgaattttcacatgtgggcctcttaaaaagcctgcatctgaaaataaacctattttcatatacgggcctctttagtgacccacgtgagaaaatactccgctccgccggatccgccgctcgctgtcgccgccgcagctgcagccgctccctagggcagcgctgccggatccaccgcccaccgacgccatcaccacccctactccaggccgcctgtgcccgctctgagagggagaggagagaagagagagagagaggggagaggagagaaagggagagaaaaagagagagagaggaaagtaaataatagtaggagaggtgaggggagagagagaggagatgggttgaaaaaaattgaagtggtgggagggaaaaaagagtggagggagatgaaaaaaatatgtgaaggggtggtatttttgcatggaaccacttaagaagtccgcatgcaaaaatctatttttgcatacggacctcttaaggggccacatgcgaaaatatgagaatttcaaatcgaattttgtgatactaaataaactcatgtgaaaacgttgtcaaaaacaaagttgtggaacttgttgagatctaccaattttattttcgtcatttctctatctgagtttgatttaactacataaaatttaaattttaaaatataagaaattcaaataattttatggtagtaaatgatttcaactggaaaaattgtcaacaacaaatttgtgaaacgcataaagatctacaacttttgttctaatcatttttctacatgattttgtttgaacagtttgaatttaaacatcaaaatatgacaacttcaaacaaaattttcaaaaactaaatgatttcaactgaaaaagttgtataactcactaagatctataacttttacttttatcatttcttcatcaacaaaaagataagtaatgttgttcacgaatttcacatatctctcatatggttttataaactgtaagagagatatgtaaattgtgtgaacaatgttactatcactttatcggatgaaaaaatgactaaaagaaaagttgtatatcttgatgagttctacaacttttttttaaaaaattgagttctacaacttttatgttcatgactttttcagctgaaaatatttactgcatcaaaatattatttgaagttgccattttttgaaattcaaatttttaattgataaaacaaagtcacatgaaaagttggccaaactaatagcagtaggaacacaataacataatagagcatgattttagaaacatttaggaaagaatcaacacatttgaagttagtatgagggaaaaacactagttacaagttttagtcaaagattaaaaagagaaacctttgttgtggaaaaatcgattttcgcatacggctccttaagatgcccgtatgtaaatttttccatacaggcgtcttaaggagccatatgcgaaaatgccgctcgatttttccagatgctgtaagttatggtccgtttgcaacctaccaagggtctcgtacacaaaaatcgtttatgtagtattggggtggcgagcggcggcagcgacctcccctctcttccccacctccccttcccctctccgtcgacggcgtcggcagcgggtgggaggcggctgccgccgacgggtgagaggcggccgggtcaccgtcggagtcggcgtactcgtcctcggctcaagggaggaacgccgggcccagtccgcgcgacggcggagacgaacagcgccgcggcgtgtgcgcggcggccaggagctcttgtatgtttctttgttcttctcttctgaatgcgtgtagtgttcatgtacataattaatcttctctttgaagatgtgtagctgtgaactagtccttttttgcgagtgagaacatgagttgtgcacatccataagttgtggatggttttgctgttgaatcttgaagagtaaatgtatgtctaacataaaagcttttggctggctttcattaaaggatccactgaataaaagatacatgctagatcataaaaaatatgcacctcctgattgtgaccgcgggtgtgttttatgtggacatggaattgtggagaccatgttgcatctaaattttgagtgccccttttcaagatttgctgggccgttgttaggattttctggaaaacatcagacaatttggagaatataatgtttggtgtctatcttcgctaccgagaaagatgctttatcgagaaaattttaatggtgacttgaaaagtttggaaagtgagaaatggttttatttttgaaagcaagccagtttccatgtcgtcttggaggtgtctcttaaaaggagatcttctactccttttcaagctagcagagagagagagagagataaagatgtagccatgtattggatcagtgttttttaatatttctattgtaattacatttttctttatatattaaataaagcatgcaataacaacggggacctcctttgccgtgtcttctttaatagaaaatcacgatattctcctatatttaattccaactatttccttaatgtctgtacctaactctacaaattgttattacttattttaggagacagacccattaattaagtgaggagaaaggtcagaggatcaagctgcatcagtggaagctgtacgataaggcaactattagtgtccatccaattcatcgtttaccctgtacatggaatgagagagagagagagcaaggagacaagagagcgtcccctcaaatgcccatcgacttcggcagcaagctcgatcgtcgatcggtacaatattaccaggtgacaaaagacacgagcccgacagcgacgcccgcttgcttgtcgatcgaccgtgccacatctgtctatctatagcttgccgatcgatcgacaccggccggcatccgaggactaatgagagtcgcggaagaaatttgaggcaccgagaggaagaggaagaggaaaaggacgacgttgacgcggatgatatttgaggccgccgcacgctagcttatccatcctgtgtggtggcgtgtcgttcgatccgacgatgttaccccgtgcgcaagtcaggccgggtcactctcaaggtttcaattttggtcccccccgaaatttcggtggttaccgaaatttggaaatgtcgtgatttctggatttttcagaccgaagtgatttgaatttgtaacgtattttgactgaatttgaacagatttagaaatatttgataaaaaaatggaacttttggggagatttgtgtttgccgatggggtcgaaattactgaaatttcaaaccttggtcggtcgtacggtatgtttgggtagtttaaagttttaagaaacagccggttggtagtcagcttctgagaaactaagtttctcaacttaattatattttctaattaattttctgaattctataattatagcttctcaaaatctgaatgaaaagttaattaaactgtttggaaaaaactcctgaaacagactcctagccaggatctcggcctctagcatgtgccgaccgtgactcttgagtgagagagatggccagtgaaagttggtgaaagcatcgtccagacggtacaaaaattcacgtggcaatttcgttgagccaatcaatctgcttggtccagtggtacctgttagctaggcctattgtagttcatgtgagtagagtggagatggaacgttttatattataaaactttatagcattgttcacgtaattctactaacagaggaagtactatagtaccactattttgaatataatatgcttgcttggtcggttatacaatataaatggttctaacaattgaaatttgtaccgaaatctaagtaatttaagtgctattcgtattactttatacccgtgtaatcaatcacctctctttttattttttaatatatagaattaccaatctaacctaataaagtcttatttaatgaaggatatcaaagttcttttttcttatctctgctaaacgcccaaacaatccacgaatacttatattttggaactatccaaactatcggttataaacaacggagggagtagtagtatgcatctctaattaataaatatgcaataataacatacccaagcttagggtggataaatatctagatatttttacacgtgaatatgtcagaatccttatgttggaggattgtccttgttctgttgcgaaaacccagctaaaatagatcacatcgttcacttttcgcatagcatttgactattcgttttattataaatgtagtataaatatgtaaaagtacaggctaggattttagtttttttggtgataaaataagtcataataaaataaataatatttatataactttttaaataaaatgaatggttaaacattacgtgaaagtcaacaacgtcatactgggacagaaggcgagtactatatctatctcttggaatagccttataaaaggaggagttgttaggagcaacaagcttgcaacaatggcgaccatagcatccatgcatatgtatggcttctctcttcaaccacgcctgtgcagcaccggaggaaggccagccaagatcaccaggactaagcctttggcgactcatgattcctctgcgcacatcgtacgcacagtactaaaccacacctccctccgtagttagcctctctagtctcctttctgtctctctgcatataacaactgaactgatcaattattccagagctagctagctctactgctataagcatgcaacaacgagattgagattgtatattttactgtttgggccaaaaaaaaatgtatattttactgttgcattgcatatgtacaatgagatgatcatatgattccattttaatacgttcatttgatacatacagccacctcgtttcaaggagcttcagcaagtattgaaaaccaaacttagggaggcatctgctgcaggaagcagtgcttccaagaaattgctggatgcgtttgtggactctatcttcacattcagtcatcaatctttacgtcccaccgaggtagggcaggcaagcatgattgcatatacgttacacaaaatgcagcagcaatttattgctttgaacttcctataatataaattttcttccgtcctgtaaaaatgaatgctttttaggattaaaaatttgtctgaaaagagtattcttctaagtactactacctccgtttcaggttataagattttttagcattgctcatattcatatagatgttaataaatctaggaacacatatatgtctagattcattaacatatatataaatatgggcaatgctagaaagtcttataatatgaaacggaggaagtacatgttatattcaaaactttgtcccatcctactcctaatcatgcatcctcctatcatacatcatagttgtttccttctcaagcattgatttatgctaaacaagttagaagagcaagtagcacttattttggggtctaagcaatgaattggagagaaatacattaatttcccttggagaaacaattttcctctaaaactaaattggagaatcagttcaatttccattgctaataacttacgtatgtggtggatctatatatccatgcagagtaattttgcaccagttgaagaaattggtcaaataacaaatatattgcggatagaaggggcaatcccggaggactttccagagggtgtatatattagaaatggtaattctctttcattactaactattactaactagattgaaagttatatatggtagcatttggctcgggtgcctggtgggaaggaaaatatcgggcgccctgcgccccacatccctcctttctctctcggtctcatctattcccctcctttatctctctcttcaccatttctctcctctctatcccctttgatctgtgaggaggcaaaggtggaggcaaggtagtgacaggcagaaacataaggcaagatatcggcaggacaaggcggtggctaataggggtgacggtggcaggcagctgcagtggcggcaatgtagacttagctgagtctatgcaacaacggcggcaatggctatgtcctgagtggctgtaggagtgggtggtggtggtggtttgtagggcatcatcagccaaatcatcatcttcggcagctgcacgccatcattagccacgtctcctccgtggcttgggcagcatctaccgtcgatgatccggctaacctgaagtggatttagctggtcttttttcgggtgattgtttcaatgttttcattctatgtatatggttgtttcattagtcagatcaaagtgtttcacttggatttttttatggtgtttcaatttttgtcttcgatttcactcggaacttgttgatctttcaatggctttaaatcattagttttatttattgaaccaaattgtttcatctggcgatccgattgcgtttcacttttttcaagaactaaaacattctttcacttagtgctgaaacactctttcataaggggtaaaataatgcctgatttttaggaaaaatcgggcacccgatttgtagtcatttcatcacaacagacacatacggtcagatgcagaacaaagcattactatctactagcttctcgaatatatatgacattttaaaatgtgtacagttaaaccatcaaatcttaaatcattaatatatgtaaatataactccctctttcctagaatattataacctagtaccactaatctaaaacgacatcctgtcgttaggggtggaaacggatcggattcggacggatagtggtcacaccattgttaacagtgaaatttggtaagccccgaagtcctgatcggcctagagttagtattggcttcagagttctggaatcagccgatgagagtcatcaagtcgctagtaatcagattaagaaaattaatcaattaaagaaagcttatctagaagagaccgtgttcaaggaagatgtggcatggcagtttatctattaattaggaagagtttgtgtttccttttatctttaggaaagtgtgtttagtgtcccataaggattttatgttttctttttatctttcgaaaagtttctttcttgtccaacaaggactagtatctacccatgggtataaatatgtacatatgtggtaattttaatttatctcatagatcaatacagctactcttggcgtatagccaccctctttcccgaggtttttatttatcatccggcgaaaccttagcacttgacgcggggttgcatcggctttcgatcttcggcgaagggggtaagtcctacgttccgccagtcctggcaattgtatcggctataatggtgttgttcaaggctgcatcgcttcgacctcttggatcgctctggttcggttgatatttttgcctacctatttatcatatatcttagttaatctagttttagtatatcgatttagtcatatcagctgattctcgcttaagggtttatgccggtatcggctaaatcgatttactagattggattagctaaggtatccaccaccctaaaaattagtcaaaagcttgattgtctagatattgtgtttcttttcatacttagtgatgcattagtacattcgatctactaagtcgtatttagaaccatgatctctagcctgcttcttgattgctaataagggtttcatcggggtttcagccaatgagttacatgggcgttgcatcggcttacaaggattacatacaagttggttttagccgatcgcaataaaggtttcattgtttatctaatcgtttggatttaatgacatcggactttcagccgatgtaagctttaaccttcggattagtgtttatgctctcatatcattattagccgattggtttctactggattacattaccatcagccgattgtctttatatcgttatctacattggacatatagccgtttgatcaaaaccctattgacatcggctagtatcggcatcgactggaactactccatcagcttatcagccgatcggctatttgatctgctattgtatatcttgtgagttgcaggatcaaactgattggcacacccgcatctcatcaacctttggacctgcactggagttaagcaaatctcccaggccaccgtgttttcacatcaacaaccatattctaaaccattttttaagcagattcgaagcgggtgcggatatgtgcgcatgcagagcggattgtttcggatgttggaaatggtgcggagtcggtgcagactcggttcgggaaacaaattaaatttatcagatgttagatgtttatacaatcaatacaacattgagttatcaatgcaagggacagcaatacaataatcattaaacgacctttcataaacttaagtgtaagatgagacggcaaaagcctcaaacaaggaagtttaggttaattgataaattaggtcattggatgggccgactcatgttatatgcccagatagagtggttacatgggttgatattttcggattatccggcaaacgacctatgggataatccgatagaaataccagataatccgcatttatcggtttttagagataccacatccgaatcagaatccgcaccttactatccgcattcgcatccatatccgccgatttctaaaattccataccatcctcgtttaggacggatttggaacggatcagatcggatataatccgatccattttcacccctacctttcattgtatcaccgttagtctcccataaactatgtgaaaagtccatttcacacttagaataatatatgcaaaaatacactttatgtgtggtgcaatggagtatagttaagggtaggctaatagtgatggtaaaaggggaagaaaaaaccacttgttcgatagcatcttgtggaacttttatttgtcaatattactcagcaagtcatacaggaataggggtatgatgcaaggattcaacaagggatagctaagcaggttcatttgcataaagcgagcatttataaacagaagctgaaagattcaaacagttgtaattattaattaaacatcctctgtccagcgctaacccacgttgcgacaggcccaaccatccacctaaattatccaaattcaaaagattacactaaggtgagactaatcacggtgaatctggttgaccgcccgtaaccgcgggcacggctattcgaatagttttactctgatcagagctgtacaactgtacccacaagacacagccccacgacacgtttccgtgcgcccacatgccaccacgacatatcagaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataagttcttccagggcatcccgcgaactggtaaccataggtaaccatcccatagtaatattataaaacaatgcaatatttgaaagaaaacaatagagcatttgcaatataggatcaacatgttcaagtgacaagcatgacttgccttgctctgctgctggagaaacctcggcgactatttcgaagtacacgggagcgtcggaagaaacggaatctagcgacatacaaggcaaacattgcaaacaggctataagactactgaaacagagaacaaaaccatttttaatggattctacacatttttcttgatttactgagacttgaatgggcttaaacggagctcggatgaattagttatgaattttagaagattcactgtgtttattactatacaagaaaaaccttaaatcatttattgcgcaataaatcccagggctgacgtcagcacagaggggggtgcggcgccggcaagcgggccccaccggtcagcggctcaggaggagcggttcaccgtggaccaggaccacgcgggtggtccaccgccggtccacgggaccgacggcccagatcgccctcgggccgatcggacgggcggcggtggaggcagccgccgggctcggctcggcatcaaagccgaccggccgacccggggctgacggcggtggcacgcgcgcgtcgcgttgccggcgacggcatccggcggcggagacggcgacgcaaaggcggcgccgaagggcggtgatgctaaagcgacgactaaccggcggcggcgctaaagcggcggctaggagggagagggaggggaaaagaggggaggggggtgcctcaccgagggtggccggcgcggaggaagacgatggcgaacagcgacggcaagccacgggaggacgacgtcggcgggcggacgagcttcggggtgccctaaggaaggagaagagagggattagagagaggaagatggaccacggcaaccggaaaccatggccgaaggcggcggtggaggtggtgctcacccgagtgcgagggaacgagggctccggcgacgaacctcgacggaggaggggtggacggggtggatctcggccacgcgaacccgacggcggcgacggcgcggcctggcggcgaccctaacggcggctagcggcggccggagtagcggaaaaggcggcggcaaagggttgcacggcgcgggagcgatgggaggctcgagagagtacggcggaatggggaaaaagtgagaggggacgacggcgatgcttaaatagggggagaggggaccggacgtggccgggagaggcgggaatcgccggccgacgtggggggtggcggaggagagagaggcgggattcgaaaatcgaatcccggccatctcgggcgcgggcgcgagcgggagagagagaggagtgggcgcgggagacgcggcgcacgcgcgggcgtggtcgacgtggcccggaggaggcggagacgtgggtgcggcggcggttgcgggcgcggcggcgcgagcgagatcggcgggaggtgggggaaggacccgacaggtgggccccacctgtcggtgaccccggagaggagggcggcgggacggcctggctgggcctcggcctgcggccggcctagcaaggaggagggggaaggaaaggagagaatgggccgacggcccattcgaaaaaaaggaggaaaaagagaggaaaaaagaaaaagaaaaaggaaaaaaaaggattttccctggaattaaaatattgcttgctcaattttaattggttaaaattatttctagagctctgaaaattccactaaaaatcctgttaatgaatttcgacatgtagaactcaagaaaaattccacatgtcaaatctgattattatttgcattaccttcttagggttttctcttgatttgcacctgcattttcttagggtcatttataaattaaattttaggcttgggaggagaactttggggtgtgacaaccgccaaggccaggtcaagctcccatgacttggaggaaattcagaaccgaccatccacgcaaggccgtgatggttgttgaagaagttcaagccctccgcaaggagttcgacgcccagcaagcaagtagccatcaacagcccgttcgcaagaaggtcagaaaagacctttactgcgccttccatggacgctgttcgcacaccaccgatcaatgccgaaacattcgacagcatggcaacgcgcaagatccaaaaccgcaacaaggagtagctgttgaagcacctcacgaagctgttcaagagcaagcacccccggccgaacagcgccaagatgtgcagcgcagagtaatccaagtgattacaaaggttgacccgccgaatcaactgtcaaaacagcaaaagaagatgcagctgcgaatggcgcacaacatcacttcggcaagcgaagaggccccgtgatacttgaatcagtagatttccttcgggccaaaatatgccgaaggagtgctgttcccgcatcaagaccccctggtgatctcggccgaggtagttggcttcgaagtccggcgaatcatagtcgacggaggaagttcgaccgacgtcatcttcgccgaagcatatgccaggatggggatgccaaccctagccctcacccaagcaccggcctcgcttcgcggttttgacggagaagcagttcaagtcctaggccaagtacaattggtggtagccttcggcacaagtgaaaagaggcgcaaagagcaaatactgtttgacgttgtcgacatcccatacaactataatgccatcttcagtcgcgcaaccttgaacaagttcgaagccatctcccgccacaattatctcaagctcaagatgcctggccctgcaagagtgatcgtggtcaatgggcttcaaccttcggctacatcaaagggcgatttggccgtaatcaacagagcagtccacaatgatgaggccgaaccgcatgaccgggcgaagcacacgccgaagcgcgcccctcatggcagggtgatcaaggtgcaggtcgatgatgccaatcccacaagacttgtatcgctgggggcgacatgggcgaaagagaagttgagaacatcctggaggtgctcaagaaaaacattgatatctgcgcctggggccccgacgaggtggtaggtgtttcgccatatctcatcatgcatcatctggcggtcaggccgaatgccaagccaaggaaatagaagctgcgcaagatgtctgctaatcgccaagaagcagcgaaagccgaagtgcaaaagctgctcaaatctggggtgatccaggagatcgatcaccccgagtggttggcgaattcgatactggtgcggaaatcaaacggcaaagggcgcatgtgtgtcaatttcacagaacttaacaaggcgtgcccaaaagaccatttccccctaccgcggatcgactagctcgtggattcgacaactagctgcgaactcatgagctttttggatgcgtactccggctaccaccagatccacatgaatccagccgacatctctaagacagccttcatcacaccattcgacaccttttgctacctcaggatgcctttcggcctgaggaacgccgaggcaaccttcgctaggctagtgtacaaggtcatttacaagcagttggggtgaaatgtggaggcttatgttgatgacatcgttgcgaaaagccacaaggctttcgaccatgcgtccgacttacaggggaccttcgacaacttacgcgcggcgggtatgaaactaaatcctgagaagtgtgtttttggtgttcgcatgggcaatttgttgggttttctcgtttctgaaagggatatcgaggcgaaccccgagaaaattgatgccattcagcaaatgaagcccccgtcgagcgtacgcgaaatacaaaagctcgcgggccgaattgcggcactcagtcgattcctctcaaaagcggccgaaagaggcttgcgtttcttcaagactctccggggcgcggaaaagtttacctggacacccgaatgccaagcagcgttcgacgagttgaagcaatatctgcagagtccacctgctttggtcagcccagcactaggaagcgaactgctactctacctagcagcctcgccggtggcggtcagtgcggccctcgtccaagaaacagagtcaggccagaaaccagtgtattttgtctccgaagccttgcaaggggcgaagatacgatacattgaaatggagaagcttgcttacgccctagtgatggcttcgcgcgagcttaaacactactttcaagcccacaaagttacagtgccatcacagtatcctttgggctaagagctccggggcaaggaaattactagccggctcagcaagtgggtggcggagttatctcccttcaacctacatttcctcgcccgcactgccatcaagtctgaagtcctagctgacttcgtggccgaatggacaccggcattcaccctttaatccgagcctgtcgaaacaaccttgggtgacgtactccgacgacttgtttcgggaaacaactaaccgaacaccgttacactcgatcaatatgaaaacacaagcgctcctatcagcgcagaatactacagatcgaaaacggaagccgaaagctgaaaagtcagcagacctatttcgctaatatacgcaaatgggccaacacgttccgacctaacgaaagcacgaaaagtgacaatgcaaagaatagcgaaaaggaagtaaaacacatctttatcaacttcgaaaaaacaatcgaagaatacaagtcttacaacatggtatagacaaagaaagcaacggctttacagcctagcttacagataaattacacattcgcccccacaacaatcctcactccctaaggaatgatttggcgaatcaggttcgtcatcactactaatattatacacgaccctaagagggaagggggcgaaacacagactagactataacgacattgggagatcgcctcctgacgatctgttttctgatggtttcgccaaaagcgaaccatgtcctccagacgttctgtatggatacggtcgtagtcttccagggttctcccggggtgcgcccgcattcagccggcaaccttcaaaaccttgtagctgttgccgtttattatcatctcgcagtaaacaggccgaaacgggcatcgcacctttggcaaacccttcgccgccacgaacttctcgttcttgtttcgccaattcccaaagggggaccgaacacacaattttcggcaaacaccctgctaaaacagtgcagaaagggcaaatgacgaagtgcaaagttaagactccacaagaaacgtaaaagtgggcaaaaagagtaagcactctctagtatgcaaaaataatgcgaaaatgacgcaagcatatatgccaaaggcatcaagcataataattggctaaacttggatcatccattccatatatcaaaaagaccgttcttggctatagtaagaaagggaaggggccattggccaaatttacatcgttcgcctttgtcacagcctgaattttcgtttcaggatttataaagtatttaataaaatattaatagaatttatattaaatgttccttaaattacaagtgaagttaaatgtgggaaataaaatttcctaaatataaagcatggctggattttatttttattaaattctccatgattaattgtactctctgaaattttcttggatttttcggagctcaattcctaattttaataatacaaggactatttcagtaattattcacatattaaattaatcattaaatgagctggtttcaattttgttaaatacttagggtgcccaagttgtcgacgtttgatgtcgcgattccggtatttgcatagtatggagatcgttggtactaggatatacgcgagactgaggtaaaagagatggagacaaggatttttatacaggttcgggcccctgaattgtcaggtaatagccctacatcctgttggccgaagccggtattgctcttattcaccataatcacaccaagtacaatatttggggtagcctatctaactgttgtcgactttgcggtctgtaggtctgactcgtagtcgacaacagggtagtcttcttcctcgagttcgtgcccggcgaggtcagagacagcgctagatccctacggctagcctcagtacgtaccggatagggtcgatccaggcgtatctctgatgtcgatatccggcggcttgtcttggcgcatgttggcttgtattggcttgtagctttgtggcgtctatgttgtctgtgtcttctatggtgggtgtgtcccctctcctcctagggggccttgtatttatacccataggtatccccttgtgcaagtagaactaggggaacaaatatggatacaatccgagtagtccttgtcgtttccatgtagaactctagttgtctttccttatccggaactcttcccatatccacaggttctttccgtataggacatggtatatggtgggtcctgccgagatttagtcaactactattaggtatgtggtatccataaccctgacagtagccccagacttcgatgcaaatgaacaaattcatattctcaaccgcgcgcagaccttagagtaattgttatcgagctcatgtgaccgttcttggtgaattcagagataacgttagacttcctttatcagcctcgtgcgggcacctaaagggtgtgtctgagtcaatctctgacgtcaaccaagaaagttcaaagcatacgactaagtctcccgtcttgctgtaatcgagaatttggattgaagtcaagaaattttatctcggtgggtacaccatttcttcattccgtattccttgtcgagatccaccaactgttctcgagtgatcgagaaggcgtagaatcagcgacgaagccttgtcgaattttgtcgtactcgccttagtcgatcttggtgtagaaccatagagacatggagccttcgataatgtcgaatagaattttcctaaaatcaatactcagaaaagaatattagatagaaatagcccccgagcgaacgctcaaagggtaacatgttataatatgtatggaaaaccgaaaatgcattaaacttacagaccaatgttttgtatatgagcgtctactcttttaccgacttcgatcagtcagtttgttgagttatacactctccctagcccctagccttattgtcggcgaattgttcttggaggataaggctcttggacctttcacctgcctcggttgaacaagcactgatcctagcccccagccgtgaagttggaaaatccattttcgattacacggcttggttaatacgcacggcgagaactcttacacgaccagatcttacatggtctttcgtctctaaaggatccgacaaagccttatccgctctgggcgtccccagccgaagtttccttaggttcctcagaggctttgtcaagacggcgtaaagggacattaggataggtttcaacgctaggtgtcttttgtggtaagggatctctgggtaaaacacttggcgatattgtgcacctgatatcaactttgttgaagtagaggtaatgggagaatcactacacctctggtcagaaccaggtagtagtcgtaactcaaccactagaattaaatgtacgagagatcgctacaattgactggttgaggaccagtgagtaggtgtctctcgatcatttgaagtcgtagtacgaggaccgctgcgttattgctgtagtcgtacctcgactctcgaacacctatggaggcgctggaattggtttattacatgcgcatctcatgtggctagcatgactcacacacccaacttgtagcatatccggatgtccgttcacaatcatgtcaggtaataaagccgacaacgttcacgaggaattatccgttaacaaccttttctcaaatagtccagccacagccggtgctatgagataggttgtcagttttcgttggtaggttgggcgcgacgactctgcatttgtcgagatcgttctcgataatgcggtgtacttgaccacaacctactcgagtgctcaattgttcctgaaaaatattttctagaagacaagatatatagcagataatatcgagtatgtactcaaaaaactgcatgaatcttctagcattatcaggatataacgagcagattaaatatcagggcattatgtaaactgtaaacaagcatgatttatacagaagaagacagagcgagtccccagcgttagatcgtagtcgatttaacatcagggacacccgcgcaacagatattgtataaaaaacatgctctaggtaaacataataaattataaatccgacaatgttgtatgatctgaatattggtatggaaaattttatataaaataatgcgtacctgtgtagatatatgccggatatatctacgaaattagtagatcaattaaattaattaacctactaattacatttctgacatgtgtattcggagtagattagatcgatgcaatcttacttctccaggtgtacagccgcatgaatgcagtaaacacatgcacttgctgttaattgatctgatgcatgcacatatggacgttatccaaattggttggacttgacgccggccgtgatgagttgacgcccgtgtcaactgactaaaaatcgggtcctagtcagaacatggtagcactactctggcagttgatttttggctcctcgacacacttgcttggttggtaggaatcggtgtcgggttcggcttggactcggccggccgatgccttgcaccagttgatgtcgcacgcgtcgagggttaggctgcttccgacatcatggttctccgcggcggcggtagtcccaatctcgtcggaagatatgctccgatcaggttagattttcccacagccgaagtcgccgagtagcttgttgttggagaatccatctcgtaaacccatctcatcgaaaccttgaagcaccaaaaatcgccctacctggcgcgccactgtcgacgttttatgtcgcgattccggtatttgcatagtatgatgatcgttggtactaggatatacgcgagactaaggtaaaagagatggagacagggatttttatatagtttcgggcccctgcattgtcaagtaatagccctaccttccttggtgggccgaagccggtattgctcttattcaccataatcacaccagttcacctttagtcctcgcccattcttccttctattcggccggccttatcccttcccaaagtctggtttgcattcctccttctatcgggctgtgcaatagaagcccagccaaaagtctggtttgccttcctgcgccactgttcatcttccagctcaggaagagccgactgtccgccgtgcgcatgcactgccgccgcctcctccttccaaatccgacctccccgttgctcctatttccaaattagttctgggaatggaatcctcttaatctcctcttccttttccccaagaaatccccaaaagtttctacggaaatcctttccaatttcgcggatcaatctttcctttttccggcgaagatccctagaatttcccgtagtttttccgtcgatttgggcctggacccgagctcccgtgcctatataaaggaccccctcgttgtcctctacctctccctcaagtcctgtcttccgccgtcgccggaattgctctccccgggagccccttctctctctaccttcggccgccgctccagccgccgtgcgccgtcgcttcggccgtcgccagtcagcgccgccacctctctcggctccgcaaggtcaatagcaagctcagcagccatctccccaaagccgaagaccccgggaagcacttcgtcgccatgaagaccgagctcgccgccgcgttttgatctccagcgaggccctgctgctccttcctgttagtgatatgccctagaggcaatcatagagatgattgtatcacatactttgtttacatatttatccgacattgttccttgaaatagataactccttattggttaatgaatatgtgattctttcatgagactctttatgttgtttgttactatttctaaaggatccctaatcaaatatcatatgtggaacaaatatgtttatatgatcagcacatgttttaattgatgatcatgtctcatggatcatggtatagagataccaaattaataatgtggacacatgttggtgaacatgttattggatagacccaacatgagacactgcaagagccatatgtgttgtgtcatcagtgatctcatttagtgttggtgttgaatccttagacctgagattatcatggttctcaacatgtgtagtagcttacttaagaactgctaaatgctactccgtaaatgggtagctataaaagtagttttcgggtatgctatgaaatatgtagtgggatatgtataatcaagatgggatttgcccctcctatggagagatatctctaggcccctcgatgttgtagattatggaagtgcatagccatgccaaaggtgattgaggggtcaatcacaagttatataatctatcaacaggttcgagtgaatgattagctattagaggatgccacatatctagccttgagcttaatcgatatcgtgaggcaaaggggtttatacaagtatacactagaggttcaaccgatatgatctttatgtatgcccggtgggtcaatacgttctgctaggggccgctgttgacgcgtggaccgaaaaggagttttcagattacagccgagtatatatgaacatacagggtcgcatgcttaatgggccggaataaggggatttgatagggatccaatataagcttaattcggatagggatccgaataggagtcctatgggccttggaggcccgagtgatggatcctatatattcgtgaggggtgtgaccggcggaggtattgcaatacgtgagaaaccctagccatcacttccctccccgagcaaaaccctagccacgcgcgggtgcaagcacatctgcgcgtggcgttccgtccctgtacgtgtggataccggtagagacgccgctggtttgcggtgctgatcggcgtgggaatacggcgaggagaaagcacgaggaggagaaggtcgagccggtgcgatcgactacttcctctacatcgacgcgcgctacttcgcgagagttccttcgacttctcagcgtcttcttccgctgtgcagcgcgtcgagtggtaacgatctatgatctaatacttgcatggttcctggtttacgcgatagaaaattttgatttatgctatcgtagcctacgcgtatcccaacacttccatcatcaccaagcttcaccgccgcctcctttgggttcggtgttcgcctccgctttgctgacctctaggcgaagagcctaaatcttcggctcgatgagattgtagtaatcggttagagcggtagaatgtgcttgctcctttttgagctcagccttgaggcgctctatctcagccttcgcctcgctccccttctccaattcagcttggagccgcttattctcagccttcgcctccttgagggtattggcgaggccctccatctccaagctcttgcggcccagttcgtcgtccttggctcgaagacggttcttgaacccgtcaaggcaagcccgcatagtccgttcggttgaacaatgggccgcgagaatctagatcaaaagaaaaagagagggcgaagaggacaagcgttaacataagccgtcgaagacggacaactgaaagtaaacaaaaaggagaacaacatacccgaaccgccaaacgcttgatggcagaatagccttcgtcgaactcgttcagctcggtgaataggctcgggctgccagccagagacacgagattacttaccccctcgacgaaggggataaggtccgcgccagtctcgaagtcagcaggggcgcagtggggggccaccaaagaatactctgaagcagacgtctcgacgaccgtcttcttccccttctcaatgacaagcggcgaaaaccacagtcctccgcacaggactgccaaagaccctagcaacgaccctgacaatccggtcagcaaaggccaaagcccagcggccacactccccccgagctccacctgcatcaaccatggcgctgagagcggtcgaaagacccaagctccgaccagtgggcgaagtaggggtctcgtccgaagactcgtcgtcgctaaaaatgcgagcgacatcaacgagccctttctttttgggggccttcttgatcgaaccccccttcgtcaccttggttgcggcgatcgcaaccagcgccttcaccccctccatatccatttggcggaggagggagaagttcgactccaccccggtcccaacgtgctcggggctcggagtcggagtgtagctgggcgtcttggcgcggttgccggcggcctcgtccgtggccttttcggccacaacctccgtttcccccacatcctccccttcctctttgtcgtcgtgatctatgacagtgtctttgtcatcagcatcagagtcggtggaggcaggggccctgcacttccggggggccaacttcacctgccccgcagccacttcctagatggcccctcatcgccatcggccttgaaggacttcgtccggggaggcagttcaccgacatatacccggttcgcccgaccggccgccagccgcgtaagcagctggctgaactcagtaatcgacacgtcgccgatcatcttccgggcttcagtgtcaacctgagcaagggtcaacactgcagaaagtcgaaaaatcgccacatcaagcgttgaacaaaaagagcgagtcacaagtacgtaagggaaatgcagaggctcactgttcgccccctcgggcatgacgagctttgacaagccgtgaacttcctcgtcttcattcaccacaacatgccacgattgggagagggggaaaatccgaagcatgcaaaattcctccaccagatcgcggcagctaagccgagagcagaccttgcgaagcagggtgaaccgagcctccatggtgccatcgatggcgaccttgggcttcctgttcggcgaaattgccctgcgccgccaacggagggccttcgccgcgtcggaaccggcctcgaaggggatggagtggtagaaccacttcgccatctaatggcgatcccacttcgacatggcggcgttcaccggccatagatcggagcgctcggggcgaacattaaagttcacgctcccgaacgccgttttctttgtcccggctggggtgaccactgtcttcgagttcacggtgccatagaacacggcgccgaaaagctcggcgctcggttcgaacctggcggtccggcacgcccagtcgaagatggtgactcggacaagtgccgatgggctcagctggggaagctccacctggaaaagacgaaggatctccggcaacaaaacgttgcatggaaactgaagccccacctcaaaaaacacggcaaataccatcgtccggttgtcgccgtgtttcggcaccacggcctttcccggagcgaaggccttcccctccaccagcaggctggcgctgacaagctttgccagctcgtcgtcgtccacaagcgaagcccctagaaaggcggtggtgtcgtcgtcgattcggcctggattagggcttgtcgcggaagctgggttcggcttgcgaggagccatggtgaaaggtgtgcgcggtggcgaaaagggagaacaagcgaaagatctaggaaatcaaagggcgtcgtgaaaggaaagaatggagaaagagagagcgctcgcggtgaaaatgacgagagtgcggcggtgaaaaaggggaagggggaatatatagcccacccaggcgacggttcgtctccccacccaatcgtaagagggaaagcccatcactgttcattttggcctagagaaaattaaaaacggtttcgccgttcgcaagacgcgaaacctagaaaacgttactaaccataaaagtacacgtacacataatgcacactttctctgcaggactccagaataggtttcggcaggagcgtcggtccaaagggggcgccccataccataccacatggtttgcacggtctcagccgaagctcctatctcactcttgcccgtgaggggcttgttggcggtatgtcatgagacccttcgaccggacctgccgaaaccatgcaaccaggggtgggttcaagcccaagacgtcgagtctgttgaggtgaagcccccatggcgaagactatgaagcaaagatggcgaagggtgaagaatcgcaccggtatcccacaaggttgaaggcatgttgggcgaagactatatggcgaagagtgtatggcgaaggcggatgactttgccgtagcaagtccaacttcaaggaggcccaagaggccatctcagccgatcaagcccggaggccactgggccagcgttcgccagtcggcccattaggggcccatataccttaattacactatatacccatgtaaatgtccctttcataagggcaaccatgtaaattcccctgttaaacctaaaccccaataggggaactagtaatagggttataaataggctcctagggccatgtaacggggatccagaaaaaataaaagaaagataatacacttcaccgtttccagtgactattgagtatccacgtccttcgacgtacgcagttgtcacttcgacaaccatacttaatattctctaaaacatcatttacaattatatcggaaattgcttcttgctgctactacacgaacaacagagattaggaattgtgaatttatgattagtgaagatggagtgctggtctctcgagttgagaagtattgacgctttttttttcaacaaaagattacctaacggcttacggtataattaatagagtcgttaaaattaagatcaaaaccggttaatgaaagcaatcaattcactttcatggaatcaaaaactaatttacatttgtaaagaatatttttagataaaagaagataactatcgtacttacatgacgacgaaagattactttctgagcaaaaaagcaaagaaatagaaggtataaatagaacaaagtaaacagcagataattcaattgttggatgttgggtgccttcccaatcgaccatatcttaactaatataaagattcataaatttccgttcgtcacacttattttcgtccatcaatcgtgcgattccctcttccccctctcgcgcgtgtgtgcgttgcccgtctccaatagttagcgcggaaaaataacatgggttgcatcgtaatacagtaggaaaaatagggtttggatagggctttattctcagctagatatgaagcagatttgatttgatttttgggaaaacggaaagaggagaatataaggattgaaacccctcaactaatttcatattatcttaaaggatgcggccgagttttatgaaggcggtgacatcgggaggcgtcgggaagatgaggaacttgacggaggtaggggatgacactgtagtgatgggcccacacgacagtgagatagggagggtaattagtttttcgttgcttgctgggtcggacgcgtgtccgcgggccgaggaggaggggagaataaggaatgaaagcgggccggctcggctgtggactgagggtggccatgggctgaaaatggcccaggtgtaatgaggattttatttagattactatttaaataaatgctgaaatgatatttgtattattaaaaatagcaattaagctctgaaaattccaagaaaattccagaaagtgtaattaactatagagaatttaattaaaattaaatctagccatatcaattttatttcctacactaactttacttttcaattaatttaaacacctacctacttaaaaaatacttaaaaaatacaagtattccagaaatttgtattttagttaattaagtaaatctttcttaactcctcctcaattttctcatcttttcttcccgttgcaacgcgcgggcactttttcttgaaaaaaatcaaagatgatacaaaatcctaatcgtgaacggagtacaaatcacaacataaaaaccgaacgataatcccaaaaaaaagaaaaaaaaagcggcgtcacctatcatttgagacttttcctatcaagcaaaagtaccaaacagtgtgaaaataactttggctaaaaataaatatttttagttttaatacactgtagcgaagcacgggtattttgctagtatacctatagatacatatacgctatgccctggtcttttgacgtacatattctacatgatacgtttgcaatatctcagtctattaaaagacgatctgataaaaaaaacctcctcaagtttctcattttgaaaacgaagctttaacgcaacaatttaatgagaaagagattaaggaggctattttccaaatggaacataataaagcaccgggtcctgatggatttcctgctgagttctatcaagttttttggaatgttattaaacatgatttaatggatctctttaatgattttcataacggtactttacctctattctcttttaactttggtacaattattctactacccaagtgtgttgaggccatgaaaattcagctatataggcctatatgtctacttaatgttagtttcaagatttttaccaaagttgctacgaatagaattatgagtgttgcctagaaggtcattagtcctactcaaactgcttttataccggggaggaacattatgtaaggtgtggttattttgcatgagactatacatgaattacatcgcaagaataaaagcggtgtaatctttaagattgattttgaaaaagcttatgacaaattcaaatggtcatttgttcaaaagacgctaagaatgaaaggtttctcccctaaatggtgtcagtggatagcttcctttattcaagggggtcatgttggtattaaagttaatgatcaaattagtaataattttcaaacccataaaggtcttaggcaaggggatcctttatctccaattctttttaatatagtggctgatacgcttgctttacttattaagagggctaaagatgttggttctataaatggtgtaatttcttatttggtagatgatggtttatctatattgcagtatgcagatgatactatcatttttctagagcatgatttacagcaagcaaagaatctaaaattgattttatccgtatttgaaaagctctctggtcttaaaattaattttcacaaaagtgaattattttgcttcggtcaaacgaaggatcattacgatcaatattctaatatctttggttgtaagttaggctctcttcctgtcgaatatcttggtattccaatgcattttagaaagctgggtaacaaagactggaaggttattgaacaaagaattgaaaaaaaacttagtagttggaaaggtaagtatatgtctgtgggtggtagattggtgttgattaattctgtactttcaagtttagctatgtttatgatttccttttttgagataccgaaaggggtacttcaaaaaattgattattatagatctcgttttttttcaaggagatgatcataagaaaaagtacaaacttactagatgggatatcatttgccagcccaaagatcagggtggtttaggggttcataatttggaaatacaaaataaatgccttttgagcaaatggttgtttaagttaattaatgaacaaggggtttggcaagacttattgaggaggaaatatcttcataataagtctattactgaagttgataagaagcaaggtgactctcatttttggtcagttttagtcaggtctcatgaaagtttaggatactttcttaaacatgggttcctggattgtgaatagtggggaacaactagattttgggaagataaatggttagataacttagcctttaaagataagtatccctctttatatgccattgtccgaaggaaaggttcttcaattgctagtgttatgagatctgttccacttaatgtttcttttaggagagctttagttggtcagaatcttatttttttgtatgagttgtgtgcctctattgtacatatccagttgaatcattcttctgattgttttagatggaactttaatcagaatggaaggttctcggttaggtcaatgtatcttgctttaattaataatggctatattgagagaaataaaatgatttggaaacttaaaatgccgcttaagattaagatcttcatgtggtacttacttaaaggggttgtgttaaccaaagacaatttagcaagacgaaattggaaaggtagtttaagatgttgttttttaatgaaaaatgagaatattcaatatcttttcatgaattgccattatacaaactttatatggagagcaatccaatattcttttggtctatgccctcctagtagtatatcacatattttt

SEQ ID NO: 2890 - DNA, 4476 bp, Oryza sativa
tgcgccagcccgcaattaacactactacaaaaatcgtttttctgtacgagggggtcggtaggttccatgcgggccgcttgtggcggtgcttgcaaaaaccgcccccccgggggcgggttgattagccgcatgcgaaaatagacccattatcgcatgcggctgtcctaagcagccgcatgcgataatggatcttcgcatgcggctggcttaagggaccgcatgcgatgatcggccatatatgctcctccaggcccgagcttgaccatttgaaaacgaagctttctctctcgtaaagcaagcaccaattagggggggaggttttcaactcgaaatttttacttgaactctatacgaaaggtgaagaactctctatcctgcttcatttggctccatttttgttatatttcgttggtggaaagtggagtttttttaatattttgacaaggtttgttctaactattttttgcaaaatctagcttcaaaatatatgttttgatgggcaaattttgcatgtaaacaattgtacatactagttacatgtattgttgtatttttttgggagacaaatgcatttaaacttttgtatgaaatacctgcggtctatttttttatctgtaaattttttgcctttatataattagatggatcggtcgtcatggatgtatgagatgcggagaacgcagccgatatttattaaggaagcatctaaatttattgatcaggctaaggagcatgctttgagggagaatatgacaaagatcttttgtccgtgccgtcattgcaagaatcagaaattgttggtagatcctggtgaaatattgggtcacataatggagtacggattcaccgccaactacaaggtttggacctatcacggggaattcgccaatccggaagatgacgatgaagagttaagtttcgagatgaatgaggcagagaattttataatcgaagacatttcgcgtgaaagaatggttgtcgatgtttccaccgatagtgatgatttcgatggtggttttgatttagaggatatgctacgccatgttgaaccagaggtgctagcgggtaggtcacgaggattggagaattggcaggcattagagaaggcatcgaaggatcttctttacgatgaaacgaagggatgtgataaggatttcacagtcttgcgttcagtgcttgaacttctgagattgaaggctaaacatggatggtcggacacaagttttaatgatctgatgagtttgttccgtgtgttgcttcctaagcctaactttgtatcatcgaacacgtatcaagcgaagaaactcatatgtcctttatctcttggtgtagaaaagattcatgcttgtaagaatcactgcatattataccgtaaagaatatgcggaattggaatgttgcccaacgtgtggcacaagtcggtataaaacggggaatgggcccgtagattcagagtgtaccgatccagattctgataaggtaagcgcgggaagattccttcaatggtgatgtggtacctaccaattaaggaccgcctgaagcatctgtactcaaacccgactgatgctgagttgatgagatggcatcaagagagccgaaaaatagatggtatgattcgacatcccgccgacgctcgccagtggaagacatttgatgcaaaacacctagaatttgctaaggatcctaggaatgtaaggtttgcattgagcactgatggaatgaacccgtttggtgacttaagcagctcgcacagcacatggccagtccttctcacaatgtataatcttccaacatggatatgtcagaaacgaaagtacattctactcactatcctcatacaaggtccaaaccaacctggaatcgacatagatgttttccttgagcctttgatggaggacatggaggagctttggaaagaggggttacgactatgggatgagtttaagcgggagacttcaatctacgtgcgatcatatttgttaccatcaatgacctacctgcaaacttttcattatctgggcagattaaagggaagactggatgtctaatatgtctggagaaaacttcatacaaatacctgacgtcgtctttgaagacagtgtacatgcgacatcgacggttcctaccacaaagacataggtaccgtaagatggctagattgttcgataatacagtggagaatgacactgccccagtagcaagaggtggtacatacgtgtatgagataacaaagaagattaaggttgtatatggaaagggaaagaagaagacagtaaagaggaagaaagctgatggtgacaacggtactgcgtcgcctttcaagaagcattcaattttctttaaatacttagattactggaaggacctagagattcgacatgcaattgatgttatgcacctcgagaagaacgtgtttgatagcaccgttggcacattgctggacatcccgagtaaaacgaagaatggattgaagtcacgtaacgaccttgtagatttgtccatacggcatgaccttcacccagtagtgctgccaaatgggaagaccgagattcctcctgcttgttacttgttgacacttgaagagaaaaaagccttctgtaaatgtttacaaggggttagagtgcctactggtttcgcatcgaacatcaggaagctagtatcaatgaaggatttgtccatttcgggatacaatacgcatgactgtcataggttgctaacggtgttcctaccaattgctataagggcagtcaaaccagtccatacaaaggtggttataacaaagttgtgctactttttcaatcgaatttcgcagaaggtatttgatcctttggaattaggtccgcttcagacatttgccgtcgagactgtatgccagcttgagatgtatttcccaccatcatttttagatatgatggagcatttgatcgttcacatcgtccctcagattattgaacttggtccattatacttacatcagatgtgggcctataagcgttacatgtcgatcctcaaaggctatgtacgcaatcgcgctcacccggaaggatcaatgatagagggatacacaactgaagaggcagtcgagtgttgtatggactacataaaggatgctaatgccattggcattcctgttcatcgacatgaaggtagattgtctggaaggggtactgttggtaggaagcagttcttcgataatgattacaaaaaggtgtccgcggcacacaacagcgttcttcaacagctcgctatcgttgagccattcattgagcgacacctagaagaaatcaaagcctgcttcccagggcggtccaatgattggatatcaagagagcacaagcgtcgctttcctctgtggtgaaagatctaaacctgccagttggtgattctgtggaggaacttactttacaaagactggcatgtgggccttcaagtattgtcaattcatggcaaggttacgacatcaatggatttaccttgagtacgactacgaaggacatgaaaagcaccgcacaaaatagtgggatccgtgtcgaagcgattgacacgagtggagaaaagaggtcgtattatgggaccattcaagaaatatgggaactggactatggcctaaacatccagatccctgtgctccgttgtgaatgggttaaagacacaataggggtttccgttgatgactacgggctaacgatagtcgatcacagtaaaacaggccacaaggatgatccatgggttttagcagagcgtatggctcaagtgttttatgtgaaggacccttcagatgaaagaaaaactattgtcatatccggaaagcaacagatcgtcggcatcgacaacatcgaagaccccaatgattacaaccagttcgacgatgtaccattgtttactgatcttcctatgcgaattaagaaggttgagagaacaatcgatgaagcaaatatgtcgtacgttcgagcagatggtgttgccaaggttattaagtcatagttattttgtaacctttagttctcattgtattccaaatgtacgtgcatgaatttaggtcccccttatgttgtaatcattagcatgtaacatttgattacgagttttgagcaattttcatgagttttcttagtgccaaaaacatttggaatgtataattgtggcgaaatattgggaaaaaaatatatatggacagtttacttagagaaaaaaaaatatgagtttttttggtaaaaagatctttctatgcggctggctcgcatgccggcttaatagcccgcatggaaagatctttttcgcatgcggccggcttaacagcccgcatggaaagatctttttcgcatgcggccggcttaacagcccgcatggaaagatctttttcgcatgcggccggcttatgtcgaccgcatggaaagatatttttccatgcggtcccttaagccgcccgcatacgatgatctgcgcctatatataggggagcgcgggaagccaaaat

SEQ ID NO: 2891 - DNA, 2178 bp, Oryza sativa
gccactgccaggacctctcccccctcgttgtcgccgtagccaccgccaggtcgccgtcgccgccgcacggacctctcccccctcgccgttgccatcgtcgccgccaggtcgtccccgccgtcgctcgataacatttacttttaaaaaaagaaatgtgaaatgtgcaattgtggattgtggattgtttaattgtgcatcgtggattgtgatatgtgcaattgtggattgtttaattttgagaaaggtttaattgtggattgttaaatggagatttatgtttaaattgggacttatgtttaaattgggacttatgttaaattgggatttatgtataattgggacttttgttaaattgagatttatgtataattgggacttttgttaaattggcacctatgttaaattgtgacttatgtttaagttgagatttatgttatattgggatttatgtataattgtgatttttgttaaactgagatctatgtataattgggacttttgttaaattggcacctatgtcaaatggagatttctgtttaattgtcactgatgctaaattgggacctatgttaaattgggacttatgtgaaattaagttattgggacttatgtgaaaataagttaaattgtgacctatgttaatttgagatttatgtataattgggacttatgttaaatagagatttatgttaattgggacttatgttaaattgagatttatgtataattgggacttatgttaaattgggacttatgtcaaattgagacttatgtgaaattgcgttaaattgggacttacgtaaaattgggacttatgtcaaatttttttacgtcaagttggaagatgtcgaacgaaaaggttccatcgaacgcaccaatagcgcctcaagaaggtaacgctcctcaaaattccggtagcaataagcagccagacgcttctagtgaagaaacgtggcgcacaccaagtgacccgtttccaatggaaataacacaagtcgccccccgcgatgatgatccggactacatacctatcgaacaggccgtaagtgctgaaaatcgttagccatgtattattccctaactatgatgtgacatgaacctaatggtgtatagagttacctattctgtgcagatggtagtccgacgccgctcgaaacgtaaagccgggaggaacaggacagagcaagaagttgagatggacaccgctacgtctgcacctgaacgtacggagacatctacaagtgcaggcgggagtgggaaaaaaagacgtggtgagagaagcaaaaataaattacccaaggaaacttacaacgtgattgctctcgatcaggatggaaagcccgtcgagccaccgatagtgcggtccaagttcagcaacgcctgtggcactctagtcaggacgcgttgtcccattaatgtcaagttgtgggaaacagtggacgacaacatcaagacacttctctggaatgagttgcagaagtattttgtgttccctcctggatcagaggtcagggggagagattacgcacttaaaaagatgggagatcgatggcgacagtggaagtccgatctaaatcgggattatgttcagaagaatctcccaccgtttacggattatggacatatatcgcaggctgactgggacacgtttgttgcggatcgtacaacaactgaagcaatggctttgaggaaaaaaatgtccgagctcgcgaagaagaacagatatccccatagattggggtcgagcggatacgctggtcacgtcgatcaatggcgggagatcgagcaaagatttgccgcggccggtaagcccctgctggtagaccccatggttgaacgtagcaagaactgggtttgggcgcgcagcacaggtcaagtctcggatgagggagacatactatttgtcacgtcctgataaattcatcccgaaataaaaatcattcgctaaaaggaataatagaattaattaaaattcgaaaagaaattggcaaacactaaaatacgtgcaagaaaaattcaaatgtggcccggagaatttttgttaaattctccttggtctaaaaggagccctcaaattttagtggaattttcagagcacaaataataattgaaaagaaatgaacaaagttaaaaaggtttataaaaagaaaaaccctaaaagaagtctccttttccccc

SEQ ID NO: 2892 - DNA, 9825 bp, Oryza sativa
taggccttgggtaaaggcaggttcgtgagggtgcacgggcttgtttaataatactgtgtacctctaggatcgtctttacaaaatggctttgggcaactaagtgtcttttaaatgctgtttactgcaaaattaatccctatattattattcccttgtacctcccttgcattaattatgcatccgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaactatttgtgaaagttcctctttttctccttcccctaatgctatttgcaaaaggtttaccctcttcttccttcttcagatttcaactagtactagttggttagctttgtgaagaagaagatgtcgtcagttgtttgccgaagctccgaaagactgcaggatccgctagcgaagtggaggaagcagtgaagccagctgtgaagcaggagtgaagatcttggagaacctgtcgctgaacctaagccaccctatagggtagtgttgttagtcgtgtgttccttgcttgtgtgtgtagcgcgtggtttgcatcagtgggttgtgatgtaaccatgctaggttgtttgcttaatcaacttgcagaataagcaaaacaaacaacacatcaacaaaaagagttagttcctttaaggtcttgtccctagttctggtctattctttccttgtatgcttcccctctcaacctctaccttgtgacagatggataacactggtaacaaaggctacgggaatgatggatccgatgactcaagaacccaagccaatgggaatgagaaaagcatcaacgaaacctcaccagagctaatccaagttgtggttaaccaaaccaacatgttggcaacaacctttcaactattacagaattggaacaacccagcaggggcaaccaacgttcaagtgcctacagtccagcaacagtgcaaattatcagaatttctcaaaactgagcctccaacctttgccattgccgtcgatcctatggaagccagtgattggttgcgcacaatcgagaagaagctagggttgattcagtgcaccgaccaggagcgggttggcttcgcaactcatcagctggttggaccggcttcagagtggtgggatagctacgaagcatcacggccagaaggacataccatcacctggaacgagttttcatctgtattcaagagatcacatgttcccgcaggaatgatcacactaagaaaacgagagtttcgctacctgaagcaaggagatttgaccgtcacagagtacctacacgagttctatcgtttggctcactatgcaccagaagatgtggaaacggatgaagacaaacaagagaagtttcttcaggggttaaaagatgagcttgcagtgcaactacttctagaggattatgaagatttcgagaaacttgtggacaaagccatgcaactcgaaagtgagcataatcggatgacgaactgcaagagaaggattgtcaacatgccagtatttccaggtggtaaccaaagacagcgcactgagccacttcagatcaccggatcttctgttgcgcatcaagagtttccgccccaagaagatggacgcaatgcagacaacaacactagcaatactaatgatgatgataccaccaacaaccatggatcttgccccattagtggccactcgaataaagcgtgcaatgtcagtagcattcaccaagatgtcaacgatagtatcaatgttggaacccagaatgacaaccttagcaattttgactctgagaaagactccaatggtgatagcaactatggtaccactgatgccaatgttagcaaggatttccaaccaccaattccaacaccgggtcagaatgatcgttctcagacggacaactcagtaaaaagggcattgatttgttacaactgcaaagaaccaggtcatttctccagagattgtccacagccgaagcgtaacctgcgtcatcactccggccattatgcaagaagaagacaagtcactcgccttgtggtcactggagcaaacgccgtacctgtgaggcctcatgttaattctaacccatagtggaaacaatgtaccgatgttaagcaccttccctttttgcttaagacagtgccttgtattcatgtactatgggagagatttgtaataaaaacaagttctaagaggattcttttggaagatgcggatatgtgatcctgtgtataattgtttactgacaaaggagacctagggtctcgtgccagaggaactatattctaacctcgagttaataaccaacctgatgatggaaaagaaaatcaagcgattaaccaaagagacatttatttggactaagagtttcagatgtgtctttttcggatcaaaggcaaagacagtcagtatagcttttggtgaaacacttcaaggtttcactgaaaggcagcaagccaaaggacctcatcgtccccagaagcgtccgcaatccacattaaagaataccacctgttagagataagccgaaagatgattgataaaagagattggcaaagatgttctcaagcatgaaagaagtaggccgaaaggtgattgataaacagaaacatgctctgcatcgctcaaggaagacccctgatagtaattgcctcccccacaacagtcaccttgtcattaagtaagcaagatgacctaggtaaaagtgtttctatgaaggcaaggagtgaaatcttcaactcggtatcagatgctacacggagtgaaaagtgcaagccccggttaccaggcgacgccatgtcttgggagatgatccaatgggaaagaacacatcaaggctgaaggtgcacaggaatacgttgaatgctaactgaggacaacatgaagtgaatagtggtaagttagaagtaaatgacaagcatgatattctcatgataacaagcatggtaccctagtaatgacaagctgatatcgacgcatgacatgaagttgataacttgtccgaggttgactccgaagatatgaatcatgagaagttctggaacggaagcatcattgaactaccgcaacctagtctgagtcagccaaaaggtgcaccctggtccaagtcaggtgaagagaagattccatccgcaacaggaggtcaagccaagcagttccgagtggtaaagttttgctggaagttcgtcaagacgcaacggaagaagtcagacaagaagagaagaccgcccaacctatcttcttgctagcctcctcgaatctcggggacgagattcttgtaaggggggtggatttgtcacgtcctgataaattcatcccgaaataaaaatcattcgctaaaaggaataatagaattaattaaaattcgaaaagaaattggcaaacactaaaatacgtgcaagaaaaattcaaatgtggcccggagaatttttgttaaattctccttggtctaaaaggagccctcaaattttagtggaattttcagagcacaaataataattgaaaagaaatgaacaaagttaaaaaggtttataaaaagaaaaaccctaaaagaagtctccttttccccccccccctcccctcttgggccggctcggcccgttccctccctctctctctctcttcccccgcggcccatcggcctcccccgcgcgcgcgcgccgctgacaggcgggcccgcccgccgccctcgctgacgggtgggtcccacctgtcatctccctcctcgcgccgcacccgccgccgcccgtgccctagcgccgccgccgccgccgaatccgccgcatcccgccttccccgcgcgccataaagaggggcgaattactccccgcgtttccctctcccgattccccctcttttccctctctctctccctcggattcgtccggattcatcccgcaatcgtcgccggcgtcttcaatggcggccgagatctccgcgcgcgattcctctctccccggccgcgctctccccctcccgttgctatttattcgatccccgtgcttcgctcttccgtttccgccgctcgccgctcgctctcgccgtcggattcgtgctcgcgccgtgctcctctctctccgccgtcgccgccgagctccgttccgccgccgccgccgctccggacttcctccttactcggcgacacctccgtccgcttcgccgtgttgccgccgactccgtccgcgcctcctcctcgcccgaacatcgccggagcaccgtcgccctcgtcatcccgagccgcgccgccgtcttcttccgcttcggccgccgttcccgtcgtcgccgtcgaccggggtgagccgaagaccgttccgttcgcttcccccttccctcctctctctcgggtgccactccgccgcgccgttggtcgccggcggcgaccatcggggcgcgggtgcgcgtcctcctcccgtcggccgtgccggcgaggccgccttcggcgcgccctcgcggctgccaggtgggcccggccgtcagccgcccgcgcccgcgggtgcggctgacgcgcgggacccacggcgccgaccgccgccagccgcgtgctcccggtccaccgtggaccgagaggctgacgcgtgggccccactcccgtggacccggtccgcgcgccctctcccctcggctgacgcaataattcgattttaaattaaaatttaaatgaagaaattcgcaaatatccatttaaagagcatataaacttcaaatggccatatcttggccatttgaactcggaattggaccgttcaagtctctaatttttccttaagatgtaaagaacccatttttgtgctttgttcctgcttgttatttggagtttattagagtaaaagcctttttcttttccgttggtcgtgtagacgctgcagcttcggaagatccgctcttcgtggaagttgaagccggtgtttgggaaagcgagcaaggcaagtcacatcatccttgagcatattgaatcccagtttataaaattattttgatttaaattaatgcattaccgctttatttaaattcccgcgttatcactgttttatttagccatgcctatttacctttgttaagacattattattgctattgttattattaccttgttcaccctagaataaataaaaccctaactagtggacactctatttatggttccactagtatgaatttaggtagatgcttcgctgattaattaggcaacattaggtggttttataactttagactttgggaattctcatatcatttggacactatggaatggttggcttatgttggaattggacacacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctaatgggtaaggcttagtttgtggctcagtctagtcataaacaaaagtacacggattggagatggatgaagtcgggtgtcgatggacattctccaggacaaatgaaggctacacgagctgcggcccggtagtcgagatgtcatatggcagagggttggtgccctgctgctaggggctcagttctgcctgcctgtcccgggtatcccggccgtaggtgggattgggtcggtactcttgtttatggctaggatgggttgggaactatgtcacgtcttccgtccgtataccgtggtggtatgtggcacgtgtttgcacgtgaggaagatgtgtcctgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctgggacccaggtcgggttgccagttcggtccgaatcatcgtaggccttgggttaaggcaggttcgtgagggttcacggccttgtttaataatactgtgtagctctaggatcgtctttacaaaatggctttgggcaactaagtgtcttttaaatgctgtttactgcaaaacttaatccctatattattattcccttgtacctcccttgcattaattatgcatccgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacactattcgagactccagacatagaagaagtgactactaatttgcagcagatagtcgagaaagaaagatcaggacagttcgtcccacggagggagcgagatcagcttactgcggcgttggggacggctgaacactctggacgtgtaaggggtttgtcctcaaagacaagttggaaggtcgggtttccacaagacgcaccaagttataagaagagagacaaatacaaagaacaactatcggacaagatctatgcgcaagtgaaggaacacttctactcgttggcagctgaaaacccgacagcatttccaaggttattccctgatagccagcaacccacacaatccgcacagcaaacaactaatgtacccagcagtgtaggctcagtgcagacaagtaccttccctgtggatagtataactggaccaactccgtgcagtctcgtcgtaccaatcggccgcgctggaaagactaaggaggttgcaacgggtttagcgatacccggacgtcaattccacaacacggcaatccctgaggattacgcaagggtacaggtcgccaaggtccatagcgaccacgtttccttggaactagacatacctgcacctgaggggattgaacttctcggtgatgcagtgaatcagtttatcttgtggcaccgcagagacataatcctgagcgcggccgttcttgcagcaggatcttcaaccccatcctcagctgccgctcctgcaccaccgtcgcctcctgaaccaccgtcacctcgacatccgccgtcaccaccaccgcttaggtcaccgcctcgccaacctacaccaccaccctccccttctcaacaaccgcctctcccggccccgcaaccagttcaagcctctcccacctccccagctaaaaagcatgctcccccggctccgccctcagttcaaacctctccacctacaccccaatctgctctggtagaacaagtgcacataccagatggtactacatccgaaccgaagtctaatactttggaacctcgtcgtataattccaaagttgatatcgacatacgacccaaaggagattgacaaggataaggagaagttcatgttttcagctttcaggaattctgagaagagaaaagaacttgctcacgtcttgtcagactcccagaagtcagtactggcggcccaagatgaagtgcaatcctggttatctgccgatgtgcctgaaacttatgagtatggcaagccattcttgccaacttatcttatgaacaagctaccatgggaaatgagggtaatgcacgaatggtatatgaaggcatctaggaaaggcgctttcatgagtggtcctaatgggatattttttatctctttccaagacctttacgccctctacaagctagataaaatggacgttaatctcgttgcggctttctgtctgtaagtctgaactctttattacatgttgcacgtttcattcgaaacaaataaaacaaatctcatttcttctttattcattgtacagtatgcaattccacgaaactgatagaactggagcaaaggttggatacgtcgatccaacaagaatatgcaaaacacaacacaccgtagagctgagacaggactgcgagcaattggttggcaagaccccggaagaaaaggaagaatatgtgaagacattgcacaagaggaagaagctataagtagcaacatacttggcaaaagcaatgttggcgcacgccgacaaagatgtcttaatggtcccctaccaattcacgtaagctctctcttctttttgtttaattaatttatcttcttcggaattttctgtctccaataagcctatcttatatgtagagaccactgcatattattccttgtatatccgaaagaccaattgatcatatcattagaccccgcacactatgacaaggagacatttatggaattcctcactattttgaatttgtaagtgataaacatttcattactataaattgtttaggtcgatcaccagtcttctaactactaataaaacaattgtttccttcaaacatagcacacaagtactaccacaaaagaggtggaccagtacatattccatcccagaagaagttatccgtcaggactggctggccggtactatcaaatttataccaatacaactaattatcgaacagtacatatatactaaatatatctactgagatcggtccccataattatatcgcagtgctacaaacaaccaccaggaaccaacttgtgtggttattacgtgtgcgagatgctcagagtaaatgggaggtacaaaacaaccagtaaccgagtaggtcatcgaactcttctctacaaagaaacccatctcgcacacacttctcactgagtaccgttttattttcctttatgtgtgcagatccccgaaatcccatatattgcacaacgattcaaccacactactatcttgaacgtggccgctgacctctgccgattcatccgtcgcgatgtctgcaacgcaagaggtctcttctacgacaaccagagtgaactcgcaatggacgacaaatttaaacctctcagagagtgggagaaagaacatatgtaataacatgtacactaattatacatatgatgaaaaaactgtgccacttgtattatatatttgtatgtaaattacgattgaattaatggttatgtattacatgtttgttactgcggcacttgtcttatcttatatgcttactactccgaaatacgataataaatccctcaataatttaatattaattacgaatcaccaaaatgctagaataaatattattttagctattcggaaattgaatttcgcatgcggtctacttaagacgcccgcatgcgaaaatagatcttcgcatgcggtcttcttaggtcgaccgcataggaaaatatatcttcgcatgcggcttcttatatggccgcatgcgaagatctattttcacatgcggtcgtcttaagtgaccgcatgcgacggccgcatgcgcaaatggtgatctttgcagaccatttcgcgcatgcggcc

SEQ ID NO: 2893 - DNA, 16349 bp, Oryza sativa
  unsure (1)..(16349): unsure at all n locations
ttacgtagctcatcacccaccttggtctaatcttgccggccgctagctaggcagcagggctcccatctgcgttgtgtgcaagtgcaaacatcaaataaacttcgtttttttttttttgataaattgatccttgtagaaaacttattttgaaactagtctctaccaaaaactatagccagaaatagaccgttggctcagcgccaaagaggttggcgctgaggttattcctatcagcgccaatggaactggcgctgacatcgcgctaaccccctgtacagggtaattaaaagaataagaaatgcaattgtggtgcaatggtatgatcatttgcttgtgtaccctagcaccagggttcgaatccccatcacggcagcatttttcgttcttttttttttcttcaaatgttcaatctacgtgcgtacattagtacatataaatgattaatgatgctctctgtttttgatatatatatatatatactagcaaaatgtccgtgcgttgcaccggataatgatatggtgactgaaatttgatttgaactatttatatgaagaaaatgaattgtaatttaatgaaatataatttttctgcaatattaattacactctttgaaattatagcaaaagtggtcgtgcgttgcaacggaaagaaaaaagagaaaattgaattaaaacatattaaattctaactaaatgaaatacaactcttctgaaatatttgggtattttttaagtaggtagggatataattggatttaatttttattaaattctccatattgattacaccctttgaaattttcttggaattcacaggtcttaattgctaattttgataaataaagtctaatttacctcctcaaaatcctcctttaattacgtttgtctggacccgctggccttccatcggcccataagtgtgggaggccagcccaacacttgatcgatctgagccgtttgttttgaggaacggttcagatcgattccaaatgaatcaaaaccctaaccctaactctcccctacccccatcggctcagctgtccgcccgtccccatcctccctcccactgccggccgcctccctcgcccaacgctgcctctccctctccctttccctattggcgctggctctcccctctcccctctcccctctagcggcgccgctttccacccctctcccctccggcggcgccgctccttctccccctctccctcccgtctcgccggcacggcgcggcgacaacggggtgtggcggagccgacggcgacggccgtccctccccgtctccctcttcccgtcggcctcgacggctgtcccttcctcccaacggcggatccgacggcggtggtagcgtccctccgacggtggcggcatccgcgggcggatctggcagtggcggctccctccggcggcggtggtggccccaacgtcggatccggaagcggtggcagcgtcggcggtgtctgcgggtggatccgccggcggtggcggcgaccgcgggttgatccggtagtggcggctccctccggcggtggcggtggcgtcggcggcggtggcaatggttgagggcggatccggcggcaggcatgatgtatgtatgttgttcttgcatgattatgttgtgattttgtgatgattgagattgatttttttggggcaaagagtggatgaattttgtttttgtttttggatctgactcttctcagtccggcggcggtggtggtgtcggcggccgctgatttttttttttttttacaattttttctatggctattgctattgctaaccaaatcggattgtgtgtatggacgaaaattagatgtgacgaccggaaaaatatgaatatttatattagttatagatatatacatggtggaaaaaaagatcgcaacatcacatcagaatatggtctacagcggcgctggcctttatactgagtaaatagaagtaaaagcaaaagcaaatgtaacaatgaggtttggcttagctcagtggtaggtacttgaatggggtcgttacagtgaccatggttagaaccctctccttttatgtttttactaaacttttttttacttagtttttttaaatccattcttcttatttcttttttataaaaaagtgatatttcttttaaaagttgactctaaaattttttaatccattcttctactttttaaatttgtactaaatgtgatatttctttttaataaaaattaatttaaacaaaaaaaagtacattgaagatttgaagacaaaaaaacgaaaatggagattgatgatttaatatgcacgcacgtagattgatgatttttaaaaaaaggaaaatggctgacctgggattcaaaccctagtcctaacgtacaccaggaaagaaactaccggttgcaccactagcgacaccattaattcattgctgcacatcagtctattagcgtgtacaaggtgtcagtgctaagtgcattggcgctgaggccctgccacgtcacgtctcgcccgccacgttggcgcgatgtcagcgccgatcccgttggcgctgataggaacaacatcagcgccaaagtggcgttgagccgacagcctattcctggatatagttttttatagggacaagtttcgaaataagttttctaccaggatcaatttatcaaaaaaaggaataaacttgccatcttcatgcatgcaaaccctgcatagaaagaaatactaatcttgccgctaattaattatacttgattaaggataatcaagtatgactgccagcttgatcttggcagccgatttcttccttattcctatacgtttaatgctaattaagctaattaactagtagtattagccaaatatagctgatcaaccccgtacttctataatttcgacctaaatcacaatgacatgctaaatttgattatcaccagcgaggttgttccttacggctggactcgacaatcggcatctacgagactacgaatcggcagcagggctgcagggcgggctatcgtaggcgtcgcgcgtgtgaaacgggccggctgggcgaagcggcccaggccgaggcgcggggagccgcagggtggcccagcagggagaaagcggcccaagcgatgagcgggagcaggccgtgtgggcgagcggcgtgggctggctgggcgaggtggcggcccacgcgcggggaggcgagtaggccacgaggccgagcgaggcgcgggcctagcgtggcttgggccatccgggaaggaggagccccgggagagagagaaaaagggaggagagaatttattctatatcatatagcagagtttaataatctgtcatcgatattatctttttctataatagctgacaactttattagttttttatgatacgttattgggttgggctttcttttaaaaaacaccccaaataccattacgaacatacaagattaataattgttttatctcattagaaatttcataaaaatatgaaaaattttatgtgatctcttacacaacctggaaaatttgtataaaagtttcaagtttttttacttttctatttttaaaaaagatataacttatatgttatatgctatataatatactattttattgttatttttaatgcaaatgatctttcctacactacataagatatttatttttatgctattatctcttgtttaagcaaatcctctcttatataccacataaaaatattttttctaaaaattaaatataccataaaaaacatgaatcttctatacaagctttcatgttgtgtaacgatctgatggacggctccgattgtccacgcgccggatgaagcgccgatgaggagagaggggcaaaaccctagctcccaaatgttctcccaatccctttctctccggcgacgagcaagcagaacgacagcgaaggtggcgacagcggttcggcgagctggtgcgcgcgtgcagtgacgaccgccgagcggatactgcttcgccggctgggggaggggggcacctaagggcgccgccaagccatgccacgtcatggtagtccggcgaggcaggcgcgcaaacggcgagcgccgagtggcccggacctcgtcagcggcgggagagaggaacgcgcacgcgcgcgcacgcacggtgaacccgacgcgactgcaagaaggtgaaggtgtggcggtgccgctccggtgagcataggggcttcaagtctggtaagtaatccaaacccttagcttaattgatttagattttgagtcttagggttcttacccgaaattagggttcttcgaatttggggaattttgtcggaaaattttaattgtggctttagaaatagaaataagaggctttgacttttacattttcatgtaatcggactcgggattgggcgcaactgcgcatgggagcgatcattgaatcggagtttccttcttttccttttttatgttttttatcacgaatcggactttcctttttttttctttttatatgtttttttgcacttttttctaattaaacggacaagggaaacatcttcaattttttatgtagtagagatttatgatctatttgtagaaaggccgttttattcggctacaatacgaaagagggagggccattggccaaatttacattgttcgccctccacggcaaatgccaaaagaaaactacaaaatctaaagagcgggcggagggcctcacacctctgggtgatcttgggcatctcctccaccctctccggccgctgcctcttcgccctggtttgccgcctctgccttcgccaattgttcaagcagacgcgccttggtagtggatcggccatccttttgccagaactgcttgcgccaggcacaaagcgcgagggaaacatcttgacagctgacctcccaatcccccttcgcaaagttagggaattcggcgacgtgttcgcacccgaactgctgcagcaagcccatggtgaaggccgccgacacacgcgcacagcaatcgccgtacgcggtggcgcaatccgagaccgccctgccggcctgctgagtccactccgagaagtcaaagatggaggcatcttctctagggactccttgtaccctctcccccatatcattgagggcaaggcgaagcgtacggcatgcggttttggtggactcggtggctttcaccatcccttgcgtgaaccgttccgcctctttttcagcgctcgcctctgccttgagggccttctggcgaagagcctccatcttcggctcagtaagattatagtactcagtcaaggtggcggattgatccttctccttttggagctcagccttgagtcattcgatctcggccttcgcctcgctccccttctccagctcggcttggagccgcttattttcagaattcgtttctttgagggtgttaacgaggccctcgatctccaagctcttgcggcccagttcgtcatccttggctcgaagacagttcttgaatccgtcaaggcgagcccgcatggttcgctctgtcgaacaatgagccgcaagaatctagttcaaaaaatagaggggacgaagagggcgaacatcagatataagattatcaaaaaaaacgacgagggaaaggaaagaaaaacaaacgacaagactcaatcatgaaaaaaatatgcaataatttagtggctgatgtcataatttcgttttgagtttgaaaaaaatatggaagcaggttgaaaactttctgttcctagcatttttcatcctaatctctacagaaacttcagcaacctagagcaaaacagtaataagtataaaatatgtgataagagaagatttgctatatgttttcttatgaaaataatataacacagacaagtctttagcaaacaatagcagattttctctaaatgcacttgtgtttcgcccccccccccccttttttatctgttcgacgcctgatgttttgacacgttttgttttcgcagtgctgactcttgctcaggccgacaccgaagcccgtaggatgatcggcgatgtgtcggtcactgagtacagccaactgctcacgcggcaggtggccggttgggcgaatcgggtgtatgatggtgatcttccaccccgggcaaaacccttcaaggccgatggcgacgaggggacgtccaggaagcatatgcgcgggcaagtgaagctggcccccgcctcctccgactttgatgccgatgaggaagataatgtcgaagaccatgacggcgaagaggaaggggaggacgaaggggaggcggaagttgcggccgaaaaggctgtggacgaggaacaagctttatctaaatcacgagcgatcctaaccgttcaatcgaattcgatgactcttagcacacctgtaccgacttgggccgtggcctgccacatgggcccaacgcacttaacaggccagccacaacgtccttctaattatgggcctaattgtgtattatttattttggatttaatttatttagatctgtgttttagtcggtttttaatttggttttataaaaattcgaggtgtttttgtcaggcctttgacacatcgccttgtccgattccaatttcctgttccacgcgtttcccgtcctgtttgttcgcacgtgccacgtttagcgtgactttcctttaatttcagcccgaccgatgatcccgtttggaatgttgcacctggcctcgcgtgtctcgccacccgtgcgctcgcttttgttcagtacatcgtcatgtactcgcaagccacgcgcccacgtgtgcaaaccacatgtggaacgatcacatcagttcatccaattaaaacagcagcgatctgtttcgattggttaattagctaattacaccagcactttctgttgattcgtgtggagattatggataccccatacctacacggcgtggttatccgactggttataggggataacttatatctatgaaaaatgtaacggatcatgacttgggtattatgtttccctgtatattatgtaacggcctaaagtcctggtttgataagatcgtaaagtagatttaggaaacagataccgtattggttaaggtttctatcttgtaatcctgccccccattctatataaggtgggcaggaggccctctagggnnnnnnnnnnnnnnnnnnnncgtcagatcaatacacacccgacggaatcaaatccccaaacaggagtagggtattacctctcattgagagggcctgaacctgtctaaatcctttgactccgcatctatccacttttttaggtctcgtgtgctatcccttttattattgccgaattcatgtttagacagttggcgcgtcaggtaggggtgcgtcaagatttccgtcaataagggcgatggaaacaatttcaggaatcgccgacatctttttcggtcgaggataatctcaattagaactacgattctaatccctggtttgtcatttcaatattttatattagattgatttctaatcatatattgatttactctccgatattttgttcgaatacgtgtactggaggtcgatgagatctgccgaccacctgtgcacgactcatcgtgctgggagactatcaagcaagccatcggatacgtataggagacgtaatgtggaagccacacgtgaaatactccaattgccacagactcctgatggtgtcacaacatataaagaagcagaaagcagatggcatacatacatacatacatacatgcattgattaatacccataatcatctgcactttttatttgtttctactaccaatctcagtttgatctgtggtttattattttgcatgcacctcgttgcccgagtctaattcgatccggactcggacccgcgacctgtatgcacgcatggcagaagattggtataataatctgattgtatggatgcatataatgttcatgctacaggagatcaatcggccaaccaaataacatatgtgtgctgcatatatgcaaatatacatccacaggattaattttcttgatactaactagagactatttttgtctctttacatgtattgttagagccaccgccaaatttgccatggtctctatagaacacgtcggacgatgccgctgctgattggtgtctccgcctgcacggctggcctattatgccgctgttgttgggcgtctacgacttcaccgaccggtttgccttggccaccgaccagtgtctccgcctccacggctggccaattatgccgccgttgttgggcgtctacgacttcatcgccggtctgcctccgtcgtcgccgactggtgtctccgcctccacggctggcctattatgccgccgttgttgggcgtgtatgtcttcaccgaccggctggcctttgccgccgctgattggtgtttccgcctgcacagctggcctactatgccgccattgttgggcgtctacgtcctcaccaccattcatggacgtccacgtcttcaccgaccggcttggctttgccgccggcgactggtgtctctgcctacacagctggcctattatgccgctgttgttgggcgtctacgacttcaccgccggcctgcctctgtcgccgccgactggtgtcctcgcctatatggttggttggccacaccaccgttcatgggcgtccacgtcttcaccgaccggcttgcctttgctgccactgactggtgtccctgtctacacggctggcctattatgccgccgttggtgggcatcttcgctttcaccgtcaaccgctttcttcgccgccgactggtgtcttcattgttattgatggacgacctcgtttccacatcggccacctctgccgtcatcaaggggaatattgcaaagctaagtcatcatttattctttatatgatattttgctcttcctctgcctcactacatcaactggttcgccgttgactagtgagtcgggggctacatatgttatatcatattttttaaacaattttcataatattttttttgattgcttgcgatataatctgagtacaaaagtgcctatcgagttatggagttctatcttcctatgctttccgtttggtttgtcatggatagttgcatttgggccgattcctagcacccgggggctcgttggatagaccgagtaacgcaaggtgctaagtattactcggaagaaatcaaaagcatagagataaagataatttattttcttctcttaacaattgcaaaagtacccgagtattaaattctaattcgtgaagctttattccattaatgacgaactcatgtcactcatatgcatgtttgggaagtgcctaggccgacttccggtgcttgggggctatgactagtcggacagagtgtttaaacgtaatgagtcatcagctcggggaaatcaaaattgacaagaggagaaatatatatttataaacattttaaaatacttgaattatatcttcgagtattatatttacatcagatactactcattccatatgtttgttctgcaggatccagatccagatatgcataaaagggattcatggctttaagcttatctcttacgctctaggaatggatcagttagaacatcaccaccggcttgccttcgccgccgccgactggtgtctccgcctgcacggctggcatattatgccgccgttgttgggcgccgttggtcggcgtctacgtcttcaccgccggcttgccttcaccgccgccgactggtgtctccgcctgcacggctggccaattatgccgccgttgttgggcgtctacatcttcaccgaccggccgcctcgtatgacgccaactggtgttatcgtcttcacggctggccacgtcgctgccaccgctagtaggcgtcatcatcttcaacgcaagctgtctgcgtctgctgccgactggtttcttcactcccatggctgcatgattctgatactgttgattggccttatcgtcttcaccgtcggttgtctggtttgctgctgactactgctctcgcttctacggctggtttataccgctaccattactgatggacgtcatcgtcttcattgttgggcgtcttatctaacgccgactggtttgttcgcctccatggctacgcgtcttcatcatcattgactgtcgtcattgtcatcgccggtttgccttcgctgccgcccatggtgtcttcactttcacggctggcctattttgctgctgttcaaagacgtcttcgttttcgtcatcattctacttcttccatcgccgactggttatgccgccgccgactggtgtttttatcttcacaactacgcgtcttcgctaccggtttgcttctgttgccgccgactcgtgttcacttcatcacggctatgcaactttgtcaccatgatggagcggcttcatctttattatcttcggcaccggtaaactctattgcctctacttcgcaagctttgctacttcaccgaccatgacgtctacaagaacctcgacatctcggcatgcgttaacaaatataatgccgtgttattctactacaacaagtggttctctaattatcaagatttctactcagacatcttcgacacatatcttcactcaagtgatggctactcgatgacaagaagctacagttctcgactctatgttcagttgctttccaactaaccaaagagtcgggggctacacaaatacaagactctcaaaattcgataagctgaagaaatcaattaatcagccaacgagtcaactctaggagtcattatcttcatatttgcttcggagcagacattctacttcagcaactccaattatttcaccggcaattttggtttctggacgctgccataattaaagtatcaaattcaagatttaatctacatgttcgggagtttggagttatcaaccaatcagctcagtttagatgagttggacaacagcatctactttcctccaagtgaagcatctacaacagctataacactaagttctgtagtcatcttcgtaaatcaagaagcgttgcatcagtcttcgttatgcacatgctcacatcaaggaaattactcgagctttgatatcttctcaacagtttgatggattattgtcactgacatcatcaacagcacctctatttcattggccctgacaactctgccgttgctaatgggtgactacgtcttcgcttctggctacttccgtcattgccgacttgttattttgccttcatggttgacctactatgcaaacgctgatgagcatcttcgtcattatcatcggctgttacaccgctattgactggatcaccgacatcgtcatcttcatcaatatcctgtcaagcctcttcaacatagcccactctactgctattgatggacaacttcgtcatcatatttgatcatctctgttgctgcttatcatcattactgttggttgcatttgtcgtcggcgactattttcttcatcttcatgattggtggatttcgtcatcgcctttgatgcgtgtctacatcttcaccgtcggcttactttcgtcaccaccgactggtatcctcgtcttcacggatggcttattatgtcgccactagtgggcatcctcatcttcttcaccagctgcctcgtctgtcaacgactgattatttcgctgccatggttacacaactttatcgctgggcgccttcatcttcattgctggctgacctgactgctgccgactggtttcttcgcctctacggctgtgcaacttcatcacttttgattggtatcactatcttcactaccaccaatatttttgccacctctggtgggcaatattatctttatattggtcgtcttgtctctatgccaactacatcagctaccatcaatggacaattgtgactactacagaaggacaagctatatgctcaagggcttactagctcaaacacaagtagcataccttcaatttggacttgttctggatacatgcaacatgaatttatgatcatgggtctattttctatgctcaaagactggactatttattatcccccataagggttatcaaccgaatacttccgccagttgggattcaattattatatctatttgggagtatcccataagggataatcactcagatcagaagctattcatatgagctacacttggtctatatcacccagaagatttattactcgggagcatgttacatgcgtcatcctttaaagggtgttgaaggcatttttttttggcctaggcctaatatgtctgcagcctatattttcagggccaaagtgcgcgtgatcaagtgccaaataccttaaaatccttttataccgcagttactcaactttttaggagttggtacaatgcatcttaaaatgtgtcaaacagtaaagctttatatagctgccccgctgacttttttatatagtcatggcactgtttgggtttatcaagcaattgattagatacaatatcattattttttgccatgtaagtgtgcatttttattgaccaatattatggctaaggctgattatatattttggtcattttccagacgggagtttatttactcgaatgttacaccacatatgccatatatttccagttacggtgaaaccatgtgtcttttagggacttaagcacatatgttaaagcagtgtgcgcatggtgtatgcccaatactttggaaatttctttattcacaacatcaagctcttctttatagctattttgctatgtgaattttcaacgatgttgtcaactttagattgcacgcatcatattctgcaaagcagtcggtatatcacttggatcatattatttagggattcacaccgcatatgctatgtattaatattaagtcacttggttgactacaattatcaaaaccactcagttggttggattatttactccttgactatatgtttagtttgttcaactatccacatagtcgggggctacacctattaggtgcatctagtcgatgcacctaagtttacatttaattatttttcagccctccacagtcttcagatttggtaaaagtactcggcagaccatggcaaagatgattgaagcactcggctttggagtaatctggtttgagagaagattatcttttcgactatgaaggtctcaggggatactgtggagattatgggtaccccatacccacacggcgtggttatccgactggttataggggataacttatatctatgaaatatgtaacggatcatgacttgggtattatgtttccctgtatattatggaacggcctaaagtcctggtttgataagattgtaaagtagatttaggaaacagataccatattggttaaggtttctatcttgtaatcctgccccccatcctatataaggtgggcaggaggccctctagggggcatatgatacaacctgatcgtcagatcaatacacacccggcggattcaaatccccaaacaggagtagggtattacctctcattgagagggtctgaacctgtctaaatcgtttatctccgcatcatccacttttaggtctcgtgcgctaccccttttattattgccgaattcatgtttcgacaattcgcttaaatattttcgttcctattttcatggcaaacagacgagacaagcagataacgtatttacgtttcctactatgcttatgtttccatctaatcttgggcagctactgggatatctatttgagttgtttgagtccgtatgatctaatgttgcagtgaacgaaacattcttttacaacaaatcacccacctattttggaaaccctctattaaggaaattcgtttcattttttgtttctctatgtatggttcaaatattgcagtaaactgaaacatcttttcactatttgctgaaacattgtttttatataaggtaaaacaacatctgatttaaacgattaaaacattttttatctacttagtgaaataattccgatatacctgtgtcgacgtgtgtcgacgtttgatgtcgcgattccggtattttcatagtatggggatcgttggtactcggatatatgcaagattgaggtaaaagagacggagacgaggatttttatacaggttcggacccctgaattgtcaggtaataaccctacccttgttggccgaagctggtcgttgctcttattcaccataatcacaccagtacaatatttggggtagcctatctaactgttgtcgacttggcggtctgaagtgctgactcgtagtcgacaacagggtagccttcctcctcgaatccgcattcagcaagatcaaagacagcgctacatctctcatatcagtatcatagacaccgtaggggactagccatgcttatctctgaagtcgatatccgacgtcttgtcttggcgcatgttggcttgtatgttgatcttgtgtcttgatctattgttccgtctcccctctcctcctaggaggccttgtatttataccaataggtgtccccttgtctaagtagaagtagggaaaaccaatatggatacaatccgagtagtccttgttgtttccatgtaggactctattcatccttccttatatgaaactcctcctatatctgaaggttgtttccgtataggacatggtatgtggtgggtcctgccgaaatttagtcgactactattaggtatgtggtatccataaccctgacaacctggtggaacatcgtgcaacatttaaaaataattcaataataagctaaaaaaatttcgttgtaatatatccatgtgtggtcttgttttaaagatttaattgcaacgaatttaatggtgcaatcggatcatgatttggataaataatttaaaagaaaaaataatttaaagtgtttttcacgcatacgtggcgctgcagcgccccgattttacccctccctatcggccgcccgacggggagtcgcctccgatattttgccattatgttgattgagtctatacttaatcgatccttctgttttgtcctgtcttcctccgaagtcatcaacgacttgccaatattgtagactaatttaccataacgtctatattgctgaacttcaaaattttccgatcacataacaacggttcgttgaacaacgctgaatatatagaccttgttagcttcgtaaacatgctgttaagagaaaaaataaactacgatatcctgttaagatggcagttgggatatcagcatccggcattattaatacacgaaagggtggactatgtcaagtcaaaattatatatgcataatgtgcttatttgatcatatatatttttccaaaatataatcgcatatagtgaataaacttgtcttgtgacatggaaagaatggatttatacaaccaaacttcttggttacacactaatatacaccacgaaaagtgtacgagttattactattcgttctaacagaagatgttttgcctttttctatattcattgatgaaacattgtatatatgttatatatatatatatatatactaaaacaaatattcgtgtattcataactagaagaatcatttttgcagatgtatgcttattttttcccaggtggatatgtccctcgaacccaaatggccgcctacgaaaatagcaaccgggggtaagatcgtcgtccgcctgcaaaaatcaatttttccggacggatcacttaagagaaccgcccgtaaaaatacttttattttcgctagcagacctcttaagtggttcgccagcaaaaattacttttcacatgcggactacttatccttattcactcgtccaaccggcctgtccctctccatctcctcaaagcacgtatgcgcaagcaggagctggcggctcagcacgcgcaaggaggcggcagcggcggaggagatggaggagctgacggccgtccgtgtgcacaaggacgaggaggaaccagctgccgtcggcggctcggcgcgtaaggaggccgcggcggcgtcaaagtaggtggagccgatgactgtcagtgcatgcaagaaggaggagccagtggccgtcagcggctcggcgcgtgcaaggaggcagcggtggcaacgtccaaggaggggagctgacagccgtccgcactgccctccccccttcatctcaaatatggcgctggcccctccccaccctcccagatctagacggaagaggagacaatggcggtgacgctccaatcctctccttcccttcctcctagatccgtccgccgccgcctgcggcggtggcacagacagcaccggcccctcccttcccagatctagacggaagaggggagccagccggcggcggcggaggcagaggcggaggtggatagaggtagagagccgtcggctagagggagaggccaactgacaacagattttttttcgtgcactgaaaatattttcgtaggcgggtggatctaatgcctacgaagatggagatgccgagatgccggct

SEQ ID NO: 2894 - DNA, 24973 bp, Oryza sativa
ctataattcagtatagatggacatcatgatgtatagattttgcatggatgcaaaaatgatagcagggctcctattttcatccagcaaataatggccagctctttagatcaaccttgaacttcctttctagagtaggatatcctgagtgtgtagggatggaaattttgctcacaggtccaagcatgagtgtaatattttactctgagtgtggacttaagtaatatgtaaaattaaaattcctttaacctgttgcaatgcatgaatatttttttaagtatgttataaatatacaatgttttatcaatgaatatatagaaaaaggcaaaacatcttctgttagaacgaatagtaataactcgtacacttttcgtggtgtatattagtgtgtaaccaagaagtttgattctgtaaatccaatctttccatgtcacaagacaaatttattctctatgcgattatcttttggaaaaatatatatgatcaaataagcacattatgcatatataattttgacttgacttagtccacactttttcgagcacataatcatgccggatgctgatatcccaactgccatcttaccaggatatcgtagttttttttctcttaaaaggatgtttacgaagctaacgtggtctatatatattcaccgtttcaacgaaccgttgttatgtgattggaaaattttgaagttcagcaatagagacgttatggtaaattagtctgcaatattgataagttgttgatgacttcggaggaatacaagacaaaacagaaggatcgattaagtatagactcaatcaacataatggcaaaatatcctttaattaattacggcacggttacgtatgccttcgctaagaatttaaattttgtcctccaaaagacgatgctatatatactgtcacacccggagttttcctttttcggtagtttctaattcaccaataaattgtctatagaaattactttagttaaacaagataaaacccaaattaccaaggtatttaataatcgaaaatgtcagggagaattttttttcccgaattctctttgctcaaaaaccattaacgggactcaaaaaccatcggaataaatgttgttaatttaaattgtcaggatttattcgttcaacaaaaaattgtcaggatttaaattaataatattttttctctcccgcctttggtcgtgaatcgtgctcaattcactcctctcttcgtccacggtttcgttttgcatgacgagacgaatccgagtcaatttcctgttctgtttccattcttttcctaaaatgtgctcgattcactcctctcttcatccacggtttcgttttgcatgacgagacgagtctaagtcagcttcctgttctgtttccgttcttttccaaaaataacagcgcatttcttttccggtttgggaaagtcctagtcctaatcctaatccctccccctctccctccccctagccggccgcgcgccctctctctccccctagccgcgtgcgccctccccctttccccatccgagttggcctcctttcccctcctaatccgactccccaccggtcccacctcctctcctatttttcctctcctatataagtcctagtccccccaccttttttctaatctattttggcctagtcctagccgcaagccgctgctgccaccggccactgtcgtcgcctcccgccgtcgccgttgcgtcgtcgatactccgttctccctctctattggtgtgtttgccactgcaaccatcaatttagctattctattccgtttgtttctcatctagcgtcgccgttgttcccatgtgttgccgccggatcatcatcgtcgaatcctcctcgccgatcgtctcagtttggtgaggaactttcccgtgatcccctagtttaggtattatttttcctagcgttattgccgtaaccctaattgtttagtcccgctaaaccatagtgccgccgcgccaccgctctagcgccgccgccgcgctgcggccctagctgccactgccgtgcgcctagccgtcgcctagctgagccgcagccttagccatcgccgccaccgctctcccgcaacgtcttcatggttggttcgctgcccgtagctcggtagctgagtcgcaaagccctaggtgcatccctaaattcctatcggcctatcgtttaccaaatctctactgtaaaccgtgtctagtttaccggtttagccgtagtcgttctaagccgccggttccgttcgccggttcagttgactgtttggatggtcccgtgtcacgaagtattgactcattgagtcattaactcgtgagacttgcttaccggagatatatttctattgatctatttatctttgggcaataatatgtaataaatgattatggttttccgattattagtaatcatgcagctcatattgtaaaattcataactaaataatttgagctccattttaacccattcaagttgcagtgaatccgttaaaatgtataacatccattaaaattggtttcttttgttgtttcagtagccttattgcttgtatttcttgtgtactttgtttgtcgtctagattccgccagttccagtgatccagtttatttcgaagtggtaccgaggtttcgtcagctcaagagcaaggcaagtcatacatacaacattgatcacgttgaacctatttttacaaaatccaccgctttctattaaatttattgttttagaatgtcatgtgggatggatgcctatcgtacttagcctgttgaatatcttatgtcattgataacttgggttataattgactagatgattggtttagcaatacttagccatgcatagatcaattagctcacaatgggaatcattataattatgtccttaattatattatgatgtaccaccataattaaactaaaatatgctttaatggtgggtgttggtacttgttaacgacactactaggaatagtcattctcagcaatggtgccagaaatagtcctggcatatttatggttactgttggtatttcttacgaccacagataaatccgcaagcgcacgaaataccgatgtagcacttcaccttcgagtgatcccaaaaggatattgaactcagggaacgtgtgtaatctacctaaggctaagactatccaaggacatcaacaataggtaggcaagctaggctagagaggtatttctatgtgttttaattatctacgctaagcaaaggtaatttcctatctgtagctttgggcaccaacccctgcttttctaccagcgtggttccggctatagctctatgatgtacccgaatgtggaggattactgggacgggattcagggctgtcaccacctaccgcctacctctgacaaatccgtgggatacacaacaaacaaaggtaatctctaacctagacaccacgtctaagttattaattattactctaatatttgcgcaggaacttccttcaatatccgtagtcctagtactagagcatttagtacgaatactaaacaatgaacccacaaagatggaaatatatcttacttagactaagtaattaaataacataagaaaaaaacacaaatgcttactttatagaagaagttctccgaacctggagcagagtgtaccgccagctccggtactcctccagaattcctcctaagaaactgcagtcgtcgagaaagaagtcggatgagcgccaaacttccgggcacccctccagagcttcccctcactctctaccttgttctaatgtacaaaaaatacaatagagcctcttgtaattcagctcaaagttgtgtgttggaaatgagagtgagctactccatttataggcaggtatgacggttacagcttatgtgaaatgtccaaaatgcccctaaactgccatcaggaagtaatcagggccgtccacatggaaaatggcgatcaacagcctcaggaacggttcgatcgaactcaggacggctctgatcggcccgtttttcctcgtggacactaattttgaggccctcagcccattggcccgatggattgggccatttggaggtgtttaactgacttatggggcctccaatctatgtaaatgtgtcctgaatgcgcggaggtacagtttgtcgcttgacggatgtgttttcttctcaaaatacccgcatacacatatttcaccaacactagtggaaatgattagtaataaaccctaccactaagttggatactatattttatttcattatatgcaagtattgatggtaaaatcttatgatttaaggatggtcaacagttactataatcagcaagcgcacggatataccattgtagcatttcacccagaagtattccaaggtatcgtatttttaatctcaagggaagataataagagtgagctttgctaatgcactttatacatatactgcttataattgtcaaagcctaaatagcggttaagtgtaatacaggggtagagtgacacgaagcaaagctgattaaatcctcatcatgaaataattctaactaagtgggaaaagaaatagaaagcattcaattcatatacttctagtatacacttaaatcctagtttacatctgctaatgtacaatcatgtggccaataccccctaaaagtgtcctcctggtacttcaagagaccaccccggttgctgagtttcttacgacaacctgtcatggctgtctagccagggctaaatatggaggagtaccctccctaggaatttgtcttaggaatatatactaatgtggaggaatacccgtactgagctgtcatcatcagcggcccacctctactatcctgcaacatatatgcccaattaatgatatttaataatctaagcaccatgctcacattactaaatactactctatacacgtgcactcaacatagagcaactgataaatcagacattaaacccacaccattacacctctctggtaggctacccacacaattaacataatgcagatataaagcaagaccaatacttagactaagcaaagtaccaaagatgtataaagaagagtattgcatttattcggaatgtattatagacgagattacaagagctgctagagccataccgaaaactcttccgaagactccggggacttccgaacactattctatactactcctgatgtgcactagggttcccgatcttccgaaaggttctaataaacaacagtttggggcttgcccctggttcggccgaaccagggtcggctccaaccgacctccccttcggtacagtggctgacaagtgggtcctttaggtggttgtggaagttaaggtcagtttccgactgttacacctgacttgtgggcccattttatccatttgcttgcttaggagtgaggtttcttcactttctctttattttatttgataaattcctgcaacatgttattctccaagtacaagtggaactatattatttgaaaacaaatatgcattgtaagtatagctaattctccattattttagttatattgacggtcaaaatttgtctgtaacaaccgtcaacaaaccacccaagcttgaacctttgctcgttccgagtaaaggacaaaagggaaacaaaacttttcgatccctatactaaggttgaatatgtggagcttggtaaagatcaaatgaggaatacttgcattcacatatattactatgtcaaaaatttagactagagcagatagcaagtcatacttagatcaagatcgtgcaaagtgtgtggaatgtatggcggaaaatatgatggaaaacaaaatgtagataaagaaaatgcttctcctttgtgcttatgcttttcctccaaaatatcctttaacttttcatagagagggtatggcttctttttccttttttttcatcatgctctaattttgggagagcaagaatttattattttctcatagccatacctttccctcttttttttatttttgcaaaggatttttctttggaaaggaagcatggatggagagcttatttgtggataatgatgacatggatgctatcttccagggtagaagcttagcatatgtgtgcatatatgggtttatgatcttgatcataaagtatgaaaagcatctacacaagtcacaagatttgacaaagttcaatggatatacaagtaaccaaatattgtataaagtttgtaagtgcaaactatatttggctgtggtaggaatttatatcaaatgaggaacatgcaaatttatcatttcaaaaaacaaatcatccagaatttaaatcaagcttggatctagattatagcaactctatatcactatatcatatctcacaataacttagggttagatcactgttggtatttcttaacgacactattagaaatataattcccagcaatggcgcataaatacttctggtatattatggttatagagttcatttgcaagcgcacggatataccattgtagcatttcacccgagagtattacaagggtatcgtatttattttataccgtgggaagatcatgtagagagaacttgactaataatttatatattatttgtgataatcatatcctaagcaggggttaagataatccaagcgtagagtgacacacaagcagtaagctactcattctcataataaaatatctaagctaagtggaaagaaaagagaaagagaatctattcctatacttctagtatacatagtatacatatattctagttatctgatatactagctaataccctctatgtgatgccctcctggtacttcgagaagccacccctgactgccgagttcctcacgacagcccgtcatgaccatacaaccggggctaaatacggaggagtatcctccccaggaaattaacttagaactatatacacgtgtggaggaatacccgtactgagctgtcaccatcagcagcccacctctcatccgcagcatataaccccaaataatgatatctcgtaatctagacacgacgtctaaactaccagatactactctaatatcatcgtcatgacatagagtaattgcatatgcaaacattatacctgcaccaaagcatctcctagataagctagcagtatattcaatataacatgaacataatgtaaagtaggcattcaaatactcgaaaagtatttcaataccataaatgttgatgcgaaaacacgaggcctggaagatctgcttaacttcagtgcaggtccaaaaatcttgcctttagattcgtgagcgtgccagttgatttgatcctgcaatcaacaagaaataaagacaaagaaatcgcagttaaatccttaaacgatagccgatcggctagccaccgatgacgtatcatttatctttgagccgacgtcatatttgaatcaatcggcagtcatgaataagtaagagtaaatctattcgatcggctgtagatatcaatgacacataatattttcgtcgatatatacataaatcaagtgattgggatagatcggtcaccatgaagggtatttcttcatgaaggttacgaggctgtccatttttggcggctgcacttcaacttccttcatgttccgtgcattcaggtcgtatttgatcttgaccatagagcattgctctgctcttggtctaaagttgaatttctgctcctttccattgatgtggaaccggatgttcccagcccccacatcaatgttggcttccgcggtactcaaaaatggacgccccagaatcaaaggcgtctccttatctaactccacctcaagttcgacgaaatccactaggatgaagaaatccctgacttttattggcacatcctcggcgatgcccactggatagcagacagaggagtcagccagttggagcctcatcggtgttggaatcaaccccgtatagttcagcttgtcgaaggcgtccttcggcatcacgctgacactggcctcaagatcacattgggcctgatcgaagtgttgtgtcccaattgagcatgaaattatgggacaccccggatctttcttcttttccggcagccggtggagtatagcgttgctacactcctccatgagcttggccatctccatggtaggcaacggctttttgttgttcgggatgtcctttaggtagcgggcttatgttggtacccgcaatgcatccaccaacgggatgttgatgtggatcttttggatgacatccatgaaccgagcaaattgctcgtccatggagggcttcttccaacattgaggaaacggcagccgcgttgtgtcacagtattcctgcggcgcgatcttgttgagctgcatctcctcatcttcctcgggttcatttatgctagcgggctgtgcctcctttctagcttgcttggtccctatagtgttaggatatggcggatcctgagtggattttcctcccctcgtggttatcgccttaacatttttttagggaaggttcgggctgccccggaatccttcccgtctccttcataggtactaaagagtctagttgcaccagcagagtctatcattttgttgaagctcagctggttttggaaagcggaagcaaagccttctagcttgacatttatattctcaagaactttaacattcaaggcaagctttttgtttatagcatcatttgttttagcctgcgcaaaaactaagtccttcacggagggctgattgaagttactgttattgttattgttgccgttgttgcctccttgatagtatggtcggggctggttccacccctggcttccttgcggccggtagccattattccccatgaacatggcttcctcacgggtctccgggcaatgattccctgagtgaccagtgttctcgcagaccttgcatgtgatgtgcgagtctaatgccttgacagtggcttgcggtttggccttctcctgatcgtccagtctcttcatcaggagatgcagtttagcagcaaacatctccgtctccttgacagaatgcatgccgcgttgtctggtctagagtcgttcttcgctccatcccatgttggataccatcttctcaataagatcaatggccgcacggaccgtctttgagaagaaggcacccccagcagtagcatccagatgatttccagatgagggaatgagtccattgtagaatctttgcagaatgagtcagtcgtccattccatgatgaggacaggtggccacatactcctgcagacgttcccatgcttcgagaatatcgtctcatccctagtctgctggaagcttgatgttctcctacgaaaggcattggtcttgcccatctggaagaattttgagaggaacgcggtggagcatctgtcccaagtgttgactgtcatccggttcgcatagaaccattgcttcgccttccccaggagtgagaatgaaaacagacgaagcctgacagcgtccgaactgacaccctttacagtgtaggtgctgtagatctctagaaattgttgcagatgagcgcttgcgtcctcgttcagcttgccacagaacgggcttgcctgcgccatagttatcaggctgctcttaagatcgaagtcgatgtgtcccatgttgacagccgggtcaacaggcacgttgtcagcagacggagcagcgaattcgcgaagggtcttcttggccctattcatgaaacttggtgacgttgggatggctagtttcttttaagagagcctcttctgtggagggatgacacgaggcttgactctccggaagaaggactatggattctcgttaaagttttccggtaagttgaaaccagttatacactatcctcttttcacgacacaaataaaagcaatcaaggttagcctgcaaaggatagtgactcatacagaggtattatatatataaagttattagcttagtcaactcattattaatcttccccgacaacgacgctagaaatgcttgttagtacttcttaacgacattgctgggaatgagtattcccctaggatatttatggttacagatataatccgcaagcgcacggatatacaattgtagcattttacccggaagtattccaaagtatcatatttttaatcccaagggaagataataagagtgaactttgctaatgcactttatacatatactacttataattgtcaaagcctaaacaggggttaagtgtaatacaggggtagagtgacacgaagcaaagctgattaaatcctcatcatgaaataattctaacttagtgggaaaagaaatagaaagcattcgattcatatacttctagtatacactcaaatcctcgctttacatctactaatgtacaatcatgtggccaataccccctaaaagtgtcctcctggtacttcgagagaccaccccgagttgccgagtttcttacgacagcctgtcatggccgtccaaccggagctaaaacgaaggagtaccctcccaggaatttgtcttaggaatatacactaacgtggaggaataatacccgtactgagctgtcaccatcaacggcccacctctactgtcccgcaacatatatgcccaattaataatatttaataatctaagcaccatgctcacattactaaatactactctatatccgtgcactcgaaatagagcaactgataaatcagacattaaaccaacaccattacacctctctggtaggctacctacacaattaacataatgcagatataaagtaagaccagtaattagactaagcaaagttccaaagatgtataaagaagagtattgcattaatttggagagtattacagaatattacaagagctgctagagccataccgaaaactcttctgaagactccgaggacttccgaacactattctatactactccacttagcactatactactaatagtaatgtatgaagagcaattgagcttgcttgagtgggttgagaagtgaagtgagctcctccatttatatggtcgatactttgcttagtctaagatggaaaaaaaactaatttcataacttgcctggaaactgcgagacgaatttattaagcctaattaatccatcattagcacatatgagttactgtagcacttatggctaataatggactaattaggctcaaaagattcgtctcgtgatttctgtgcaaactgtgcaattagtttttcttaatctatatttaatgctttatgcatatatccaaaggttcgatgtgacgtttttgggaaaaaaaaattaggagctaaacaaggcctaatgtgcaaagctacagatggatcatggtcatattcagctagctttatgtcaggtggtcagatgcagtggtaagaacttgcagctcattaactttttatcaaaacaattattacaaacattttgcaatgccatctaccttaaaaccttggttcagcaaacatttaaagactatcaattagttgaaatttgatttcaattagttcagttgtacacatcaaagacaaattaggagatagatattagatatagggataatacctcctaaaactatctcaactcttattgaagctatggagatattttcaccctgcggctatcaatatgaaatatctacggtccagcaagcaatgcaaacttgtatttacatgcagttggtccatttaaaacctgccaacatcgaattgttgccctcagaaatgctattgaagtagaacatggaagcaactcatttacctagcgaccctacaaataaggggatccggtgacctggttggagagcttgcagccgtggacggagaggaagaacatggcgacaaatcctgcatggtgccctatcatcagtcatttagaataaaaagattgtacaaggcctgttgcttttgatagattgtcttttggaggtgctcataggggtagggtgtgtgtgcgcgcgttcataggggtgagtgtgcgcatgttgtgagcgcctgcgtttgtactgtgtttctcaacaaaaaatcagtacactgataaaaaattggaggcataaaagcagaacaaaatgaagcccaaatttagtgtacgatagcatcttgcatctggaaaaaggagtaggctaacattatagggtatattacaatcttgttggttccagctgttaatcatctggcctattttatacaacaaacccttcaatccttaccaatctagtttgctgagatgcagtagtacttgtggcaccgcaatgaagataccctatatgaatcaaggttgttcacctgaacagggcaaaaatatattaacaatctcatttgtaaaagggagtaatctagattgcttgcagctaatccaattttcgttgatatgaaactaaaaaattgagtaaataccccagatgcattagaccagatttcataatacagtgagtactgaaaaatcactatatccatctaaaaaatattgattatatagtaagtgtatcacttcatcaccagttataattcaatgagaaatacttgacatgtgttaatatcagacatctaatgtaaaatcaaaggtgtttttattattattttgtgatgaacaattggcatcggagattattggttttattatttggaattaatttgcgaagtggttttggagatgattggattttacaagtgaatttacaggatgctgtcattttatgtgaccggtcagaccgggctctggtagccggtcagaccggcggtatgcgtgcggtcagaccggccagcccgcggtctgaccgaccgactctgtgtcggtttcggtttcgggttgtttgtttggatatccgtgattgtttcatgattatggcttctagatggatactatacgtatgtaatgctgttgtttgctactaatgagtcaagttgggatagtttggtctcggaatatggtttgttttgtttatttcatgtgtaggtgactcgatgtctcgggagagtatttgcggtgatggaccgggagtcggcttggggataagacgacgtccgtggtggtcagacatcatgcgggatacttaggctagagttgatgcacgtggttgatggagattccatatggcatacgatggagatattatgtgcgtatgggatgcggagtcgaatttggagggagtctaaatttggtacgattggttatgtaaagtttgtttcttgtactagagggtttcctaaggtgtttaggactcctagtatgagtttggttcgtgactttaaactgcctacctcgggtataaatagagggggagcgtgaggcttcccggtatcgcttttgagagcaattgagttgagttttgagttagggtttcgagtttagtcgaaatttttgtaaggagtgttgttggtgtactttgtaaacacagagagaatcaataaagtcgtcatccactttaaaagttcttcgatttgtgtttaccgggtctcggcggtctaaccggcgatataccggcggtcagaccggcggcaagcagcggtcagaccggcggcataagggcggtcagattggcggcggcgacagctagcggcagctgatcttggcggttcgaccgatcgatctacatcggtcaaaccgacgttcatcttcggtcagaccgcgatccgttaatttcaagggtaacttttatttccgccaaaagtttttgtttttaggtataccaactattcaccccgttctggttgggcttagttattgtgattcgatcctacatctaacactgatacagtgagtgtcgtgtcagccacatgatttgcaaggcattcaaaacacaacacttacgtcacgaaagtgtcaaccatttgtgaacaaggccacgtcgtcctatctggtaatacaaaagatcatggagctgtttgtagcgaaaaatgaacagacatacacatgaattcacatggagctgcttgtatccaaaaataataattaggcctcactcgtcaaataagtacatggccttccctatttaaatggtttaaaaatcctaataaataccaataatcatatataattaacatatggcctatttaaattgtttaaaaatcctaataaatacaaataatcatatataattaacatatggcccatttaaatggtttaaaaatcctaataaataccaataataacatataattaacatattgcctatttaaatggtttaaaaatcgtaataaatacaaataatcacatataattaacatatggcatatttaaatggtttaaaaatcctaataaatatctatagtcacatataattagcatatggcatatttaaatggattatgattcataataaataaaatcatgaagttaaggagaatatattaaaaattaatccaagctgtttgaccttcagtacattacaaataatttacatcgtccatacaacaacctatgtcactgtcttcctcacgtactttctcctcactattgttccttcgctatgatccttacgtgagtaaggggtctcctcctttgataggaggatgttcgggtcaaccatcactgcgaacggaggttgtccctcaaacagattgtaatgttcgtcagtcttatccttgactccgacgattttcctcttgcctgggagaaccacgtggcgtcttggctcatcgggccctttccccttctttggtttgctagccatgtccttcacgtagaaaacttcctttaactcacttgcgcttcttagatggtacggcatcatcttcgtcaatgatgacgaccttgatagggtttgcccaggccggcagctcgccggagaaaacacggttcgcccagccacccatctgatgagtaagcagctggctatgctcgtttatggtaagctccccgatcattcttcaggcctcactttcggccttaggcagcataagtactatcgaaataaaggcaaaggaatgagcacaataagaaggggaagcataacaaaaacaataacaccaaaaaaagttgaattgaatagcaaactcacaattcgcccctccggggagcacaagtttcggtaggccatccgcctcctcctccttgtttacttcgacttgccatgtctgctaaaggggaagaatctgaagcatatagaactcttccaccaaatcatgacagctaagccgaagagtgatcttccgaagtagggtgaagcaagcttccatcgcgtcgtcgatcaccactttgggttttcggacgggcgcgatggccctacactgccacttcatggtcttggctgcgtccgatgcggcctcaaaggggatggtgtggtaaaaccacatcgacatccaatgacgatcccatttaggcatggacacgttcacagaccataaattggagcgctcggggtggaagttaaaattcgtgctcccgaaaaccgtccttcgggtaccggctagggtgaccaccgtcttcgaatttacgatggcgtagaagatcgctccaaacagctcggcggtcggctcaaaacccgcggttcggcacgtctagtcgaagatggcgacccgaaccaaagcggaagggctgagctggggcaatacaatctcaaaaagccgaagtatctctggtagcaagacattgcaaggaaactggagtcccgcatcgaagaatgcgacgaagactacggtctagttctcgtcaggcttcggcaccaccgccttgccagaggcaaaggcctgttcttcggtcacgaccctgatcgaaaccagcttcgctagctccgcctcatcaatgagcgaagcaccaagatacccggtgtgctcttcgtcgatctttcccgggtctagaccagtggtcgaagcaggagcaggtttacgaggagccatgaccgaaaagtacagaaaggctagtgaaggagttgagatcacgctagtcaaagtggacaacaagagccggtgaacacaaaaggcagacagggcaatactcccggtagaggagatggtgaaagtgactcggggtaaaagtaaaagcgacaccggggggaagtatatataacccacccacgcgacggttcgcctaccacccaattagagcttgccacgtgtcgctaggggggtatacggaacggtaatttcccgttagagtgggccgaacagtgaaaagccaaaaacaatggatagccggcccaaaaagcccaacactattcataggcagtaaagccaagacaaaagcttcgccataaagaaggcgaaggtccaagacaatttgcctgggaaaaagcactagcaaaaataacaaaagtgtcaaaatttgtgcaggaacgagaacaggtttcagtaggaacatcggccgaaagggggcgcctcatgccataccataaattttgcacggtctcagccagagctccatactcacccttgcccgtgaggggcttgttggaggtataccacgaggtccttcgaccagacctgccgaaaccgaagcgctagcaaggattcaagccgaagacgtacggcgaagaccgaggggacgcagttgcgctccacacccgagaaggctgcatgggtgaaagccacatggcgaaagccatgttgcgaagcacacggacttcgctggagatggaccttgtcagaagaagactacgcgggcgaaggctgtatgatgaaagccatatcgcgaggcacgcgagcttcgccaaagccaggccttgccagaagaaggcccgatgggccgtcgtgcccttgaggagccccttcgccatgactgggccgagtctgttggcccattagaagcccgtatatgtaaaggacacagtgtgccctcaataatgtccctatcataagggcaaccatgtaaattcccctataagcccaaaacctaaaagaagggagccatagggttataaatagcctaatgggggatcccgaaaaaatttgaccaagtaatacaattatctttacttccgactattgttgagagaaccacgtccttcgacgtgacgcagttgtcgtttgacaacaaagccaattgtggacccgcagtaatgggtgtttctatgctagtgatagtgtatggtgtgcaaatcaaacattgtggaatctatggtggttcccaaatcccaacgcacaaagaacacagccttagcaagtgtatggtgttgtgatagttattttcaagccaaatctatctataccatattacgttcaatattaagcacttgagaaattgttcatgatccgaattttataagttcaacatcatttttttcttcgcaaatacgcaaaaatattatacgtcaatatattagaagaaagtaaaatttcaattacacaacacaacagcaggaggtcaggtcactgccaaggaacgccaaggaaaaaacggttaggggaagaaaagaaaaactccaaggaagtaaatgactccgaaactagcaaagcatcaaagaaagggcctgatactactatcctgctaacaagaattctaattgagcagcgccggcgcaccccaacatcaaatatctactccctagtttaatggcaaatatttatgaccgaaacaagtaaataagagagtgctttattataaaggcacctgtagtcacaatttatgaacgaggtaaggcatgtcattgaagtcacaattacaaccaactcaagacacttttggagtaggggtgtgttagttcacgtcaaaattagaaatttggttgaaattgaaacgatgtgatgaaaaagttgaaaatttgtatgtgtaggaaagttttgatgtgatagaaaagttggaagtttgaagaaaaagtttggaactaaactcggcctaaatatggcttggattccgggcaaatcgaaggaagtgctgaatcttaggcctggtttagttcccaacttttcctttaaacttgtaacttttttatcacatcaaaacttttctacacacaaactttcaacttttctgtcacatcgttccaatttcaatcaaactttcaatttttatgtgaactaaacacaccgtcagtgtgaaaagatgaacttcatgttggcctgtcatatcaatcgtgatactggctaacagtcttaacacaaccaaatctcggtaatccaagctttgtagcgaccataaaaggtgctggaatataaagacagatagaccttgtttagtccgcggaaagaaaatattttggtgtcacaacggatgtttaaccggatgtcggaaggggttttcgaacacgaataaaaaaactaatttcataactcgcttgaaaaccgtgagacgaatcttttgagcctaattaaaccgtcattagcacatgtgggttactgtagtacttatatagctaatcatgaactaattaggctcaaaagattcgtctcgcgatttccatacaaactgtatatttaatttttgtttttatctatatttaatgctacatacatgtgtccaaagatttgatgttatgttttggggaaaaaatttaggaactaatccaggccatagttataaagatttttgtgaaaggtttttgaaatttacaaaaatatcttcctctaacttcattggtcaactagttcgtccagggataatcaacttgcgtgcaacatgggccgaacagtgtaaactccaatcatgtgttgcggccacactcatggggactccatttttgtccatgttaggctaacagtaaagtaccattctccatttgctgtccatgttaggccaacagtaaagtatcattaatttttcacggaattgtcaaggtgaacaaaattagccactgtctatccgtacaagatcgacacgaatttgcagcgtgagttctgtctgtacaagtaatcagatagcgattgctttcttctttgttcggtgacaaaactacgttttaccatcaactctatcgaaaaaatacatgtaacgctctaagccgtaatatatcacgaccacgtatttagaagtgagctagtctcatcaatctaatcatctcctgattggcttatcagtcataagcagaggctccaggagccacatctaggccctggcttatggactcatagttttctataaattttagaaattaatatgaaacttactggagtccataacccaagcataaagcttgagcagttgagccctagatatcctatgatatgcccctggccgcaacagtagattctatttgccttagcttttgaaacataaaaaggaaaaaaagttttacacataaatgttccttgtttgatttgttatttttctacgtcttatcatccataactcaaccgattatagccatttaaaataaaatgaattccatcaaccagataaaattatctcaaaaccagataaaattatccatcaaccaaaaagaatagatataattcacagctttcatccctgtttaatcatggttttaacttcatatggttcgctttatttttccgtgatgtttgctgtcttatttggactacactcgatatgaagtgctaaattgtaataatgggttgtagctctcttgagcaaaggccgggatgtttatttctttataaaaaaaatggtgtaaagatagatgggagtatggacttgtcaacacaagagtatggaggtattgtgggtgtcatctgtacctcttttagatgccatctgttttaatcactattcctgttccgcacaggcgcaccgacaagcaaggtggcgcgtgtttttggcccacacccacatgtgcggttttgacccaccagctacaagcaattccgaattttgataagttcacgattccgccccactagaccaccagttacgtgtgcgttgttagagtgggatcgggaaaggttatgatttgctcaaataattagttttttattatcacggatttaattaaggtaaccttttcttttattttattcataggaagttgtttcttttttatataaaaaatttaaaaatatatactaaaatttgctaactttcaaataaaatttaaaagtacttcctataaaaatatgaaactaaaatttaaaattttcaactaaaaatttagaactaacaactagattttgaaaattttcaactcaaaatttgaactttcaagtaaaattttaaaagatttcaactcaaaatttaaactatcaagtctaattttgaaaacttttaactcaatttttgaactttcaagttaaattttgaaaacattttactcgtttcaaaacttttcaacttaactatttgtttactattttcattataaaaactataattaacacgaatcaattcgcttagcactgtaattagcactaatagcgtgtgagctatcctacttcctccgtttcacaatgtgtctagattcatcaacatctacatgaatgtggacaatgttagaaagtcttatattgtgaaacggagaaagtggctattttcattataaaaactacaattaacacgaatcaattcgcttagcactgcaattagcactaatagcgtgcaagctatcatagcgatgcgacactatgcacaataaggaaaagcgtgtataaaaacaaaaaagacaaccgagtccaagatgcacggtactccctccgtcccaaaaaaagacaacctagtactaggatatgtcacatcgtagtaaattttttttaaggacggaggaagtatttattttcttggcgcaccactgcccaaaaggaaccccctttcggagtctgagtgatctccgtcctaagaccctgtttagatgggactaaaacttttaagtccatatcacatcgaatgtttagatattaattataaatattaaacgtagactattaataaaacccatccataatcttggactaattcgcgagacgaatctattgagcctaattaattcatgattagcctatgtgatgctacagtaaacattctctaattatggattaattaggcttaaaaaatttgtctcgcgaattagctttcatttatgtaattagttttgtaagtagtttatatttaatactctaaattagtatctaaatacaaagactaaagttaagtccctggatccaaacgccacctaaaaagccaagggagtgcattttctagacaggtactaggtaagaaaataccttttttttttacggaggtagtagcgttttctatatagtttatcaaaaatatctaccgctttaattactctcccttctccatggagagcacgtgctctccaatttatcctactaatataacacaagaaacgcaatcacgactgaaaagtacggtgaatttgtcacttcatgttctctctgatggagattttgtttcgtttccgtaccgcttgtaaagtaccgtgatacggacagttacgtgtgggcataaaagcattcacacatgaagtgcagatataaatagaaaccccggcgatcaattaaaatgtgcatacagggagaccaaaaacggtgccatccatgtatacccttcaaccacgcgtatgcatctccagctccaggtcatccatctcccctaaagctgctcgtctatctcatcagaaagcatccactggaaaggttggcaatcttgcacacagcaatagatgtgtgatccttcagtgagtgagaaatgtaaaccaaatactctgctttgtttcatgtttcagccgtatttcagggagattcaggtgcatctaagctccaaactgggagaggcatcaaatgccatgaacagtacttaccaacagctgctggattcatttgttgatcacaccttcacattcaaatgtcaacctttgcgtcccactgaggtaaatacaaatggttcgattctgttccagttaacttgctgacaaggagctgaaaaacgagcagaaggcaaaatattatatgcataccttgtgttggcacttctatagagcaattttgcaccagtcgacgagatcggggagatcacacgggttatagagattgaaggagagattccagcagattttcctgagggtgtctacataagaaatggtaattcacatatgcaagcttattagtaatacgtttgaccgaataagatttcctttttttttcacaaaatgtcatggaacaaacccagatgctctgatgattgtggaatgcaggcggaaaccctctctatggaggcctccaatctgttagttccattttcgggcagtcccataacatctgggtggaaggagaaggcatgctccatgctgtatacttctgcaaaagtaataacagcacatggtcaatctcgtacaataaccgctacgtgcaatctgaaacatttaggattgagaaagaacgtcagaaaccatgctttctccctatgaccgatgggaaccctcccgccatgctcatcgcctctgttcttaacacagtatggtgcctgctgctattactacatcgcatttcttctgtaatttttttgggattgtcgcaaacattttggaaatgctatatgttgactgttgagtatgtgcagctgaattccgaaaggtaatgaaaagcatgagcaacactagcgtgtttgagcatgcagggagagtttatgcagcatcagaggatgatgttccccacgaggttgacttgcataacctcagtacactaggcagctggcatctcggtggtgaatggaagttgccatttacagcacaccccaaggtcggtggtccttttgcctagttcttcaaaatgttaagctaaatagcttacacatcagatttttatggcccgtaaatagggagtaccatgaccataaataaagtaatgagaatgcaatgcatgtgcttagattaactgacaagcatcacatagccgatttgacattggagatgaacaccagaaccaagcatagcatctatgaatactgtctataagttaattcttacatggaaacagttagattgttttctgttggtaaattagtacagcattactctgcttcaaaactaagaagatagctaaagattattgcagaaatatccatggaaatctgtaacttttaaacatgtttccaccacaacagatggccaccacatcatttaaataatgacaagcaaaaatatacaaatcaaactgaaggtagatacagccaaaattcagtccctataagtttcattcatctgaactttccaagttttccaataataacagttcaactactgtagttaaagccactagtgctccattgtttcatttgtacatctgttagctttcttttgtcatgttttagctatgcaatgcatcatgtccacggtaacaggtaatccctgggtcaaaagagatggtcattttcgggatcaatgcggtacagcctttcctaacagttggcataatctcaggttatctactttcataattccattgtcttctgctacatctcctgaataaaaatggggtcatatgcttaacttcataaacatcacagaggatggagaaaaacttaaacaaaaggttggtctcaagctagacagatgcacatattgtcatgaaattggggtcacggggacgtaagtttcttgcctacagctagctatatttgtttttatggctgctcttctgatttcattagatatttagatgcatgtaaaattttgctcttatttcaaatagtatatttatttaatttcaagaattgctcttatttcaaatagtatatttatttaatttcaagaaatggaagatactaaacagcacatttcacatagactgatgcacaagaaaacaatcaatcttggtcgcttcttgaggattcttaatttttattttttttcaacagggaatttttaagtaaaaaatagcaattttattgtgaagaacagaggaatggtgtcttatgaactagattagaaccaactggaagctagtagaaaaccatcatattcgtttctttttcatgatatgaagtacactaattttgtctggtttactgtcatttacaaatttcttaaacattacacagaaataaaacaacaatgtcttaactcacatgggatggacatggactccataaaaaatctattagaatttgaaacacagagcactattaatccctaaatgatatatatggaataaccaaatccatggatcccagttatggcagcaaccagctgagttgctctgctactaactgtaggattgagaactcacattctaactgtgcctaattcaatgcttgcaattagtcagcagctcagtcaatatttgtctagcagttttctattgaactgtacagaataaccaaaaaaataatatattcattttttactatgccacataaaataagctataacttcattaaagtcaaaatagttctattaaagtcaagttctcttgaagctccacttttcttatataaaagtaaagtggacctaaaaactttcaaatatgcatgaacacaatagctttaataggatgtaatgaattttctagaaatagcaaaccaattagaaaaattagtgaaatctaacatcctcaatgattgcaggtacaacatcatcatagattcaccacttaccctcaacccaactaggatgctaagaggggctccgtaagtacttggtatagctaataccaaaaatccaaaattattctcacaaatcgaatttatccttcttcatccctcatatagagtgcttgagtttgaagaggaaagctattcaagaattggggttatgccccattacggtgatgcagactcagtaatatggttttatgtagaaccattctgcacattccatcttgtcaattgcttcgaggaaggtcatgaggtaggcatctatgttatctctaaatacttctacagatctaccttagttagacacaggtccactgcaattttgaactacagtaaatgtgtgttcaaaggaagcagcataagcaatagttgagtaactcagatagtcagatgatcaaatagctaaagcagcagctcgacgactacctgtttctcttgtgactagcaaaatgcccgtgtgttgttacagaattaaaaatatcacatcggcacatttcaaagaagaaatctattttgaattttagagcttaattttagaattagtgagagatttttcatctttttatattttagccgtaaaatatttccagcggactcaatcgacttataccttagactctacacaactag

SEQ ID NO: 2895 - DNA, 680 bp, Oryza sativa
ggtattcattttttctcacatagatattttttattctcttgcacaatgagcaataacaaagctatttgaggaataacaattgaataaatcatatatataaagcatttataaatcaaaccatatgctagtatcaatattgtatatttttttaattaaagtatagaaataaaatgtcatgcatcatctcccttaaaagcaatatctaagcctcataaaaagactagaatacatacaagctataccagagacaaattaaccttcatagtattgatagcatgcacaagaatataccatatatataaaataaagctccttttttttaatttatcttattatcaaattttgcttgataaaaccatgaggtacaaaaactccccctcaaaccatgccaaaaggatgaataattcccaattctccacgaagaaaagcaaagcgattagaatctaatggtttagtgaaaatatcagcaagttacaactttgtatccaaaaacgtcaattcaacatcacccttctcaacatgatccctcaaaaagtgaaagcgaatatcaatatgctttgtacaggattcttagcaatgtttatagcagtagtattatcacaaaagagaggcactttctcaaaagtaagaccataatctttcaaagttaatataagccaaagaatctgtgaacaacaatt

SEQ ID NO: 2896 - DNA, 10604 bp, Oryza sativa
  unsure (1)..(10604): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacatcagcaagtctgaacaattcctgccacaatgcactagtgaagattctatcacgatcactcactatcaccttaggcattccaaagatgtcataaacattagtgataaacgctttggccaccgtcagagcagtgaatgggtgagaaagaggtataaatttggcaaatttagagaaattttcaattaccactaggattgtgtcaaacttgcctgacttaggaagcccctcaataaaatccatgcacactgtgtgccaagcttggaggggaaccggtagaggttgtaacaaccccggagttcttccatgttctacttttgctctctgacaggtctcgcattgctgcacaaactggtggacatccttccgtaggcttgaccaagtgaacagacttataatttgttggtatgttgcagcctggcctgaatgccccccaataccactatcatgcaaagccaacatcaccgcctatttagctgcagcatgctgtcctaaccaaattttgccattcagtcgaattatcccattcaccaatttatatccaccttgtccttctggatgtaagctaagtgcggctagaagcttcttggtatcagcatcctgttggtactcttcctggattatctccaaccaccttggaacactgatagagactgccaacaactcatctgagttacttctcctggacaaggcatctgcagccccattgtctgaaccctttttgtacttaattttatactgaaaccccatcaacttgacaaaggccttatgctgcatggtccttgtcagcctttgcttacgtaaatgacttaaactcttatggtcagtcagaattaaaaactctgcatgctggaggtatgccctccatttttccacagctaatagtattgccatacactccttttcatatgttgacatcatctgagaccttttactgagtgccttgctgataaatgcaattggatgcccagcctgcgttagtacaaccccaatccctatgtcactggcatctgtttgaaccacaaattgttgagaaaaatctggcagagctaacactggagcctccaacaatttcgatttcactaactcgaaggcttgttgctcttttgttccccacttttaactcacatccttcttaagtaaggtggtcaaatctctggtaatcaccccatatccttggataaatttcctatagtatccagttaatcccagaaatcctcttaactgtttgacagttttaggaataggccagtcttggactgcttttatttttgatggatcagttgccactctagaagctccaatcacatgcccaagatattccagatgttgtttggcaaaagaacacttactctttttgacaaacagttgatgccttgctagaatctctaacacaatcctcagctgactaacatgttcttgtagggttcgactataaatcaagatgtcatccataaacaccaacaccccttttctgatcaaatgggcaaaaattgtgttcatcaatccttggaaggtggctggtgcatttgtcaatccgaaaggcatcagtctgaactcatagtgccctgatggtgtatggatgacatctagtgggcccaatattaccctcctctcttctgtcaaaaaaaaaatattaccctctcccctcacgtgcgtgtgtatgcgtcctcctccctttttttcctccatggtagttaaagatctaaatcatttatttgataccgtgagggagcattctttattcttaaaatgataccgttgttatatattcgactgttctgctctacaataaacaatgcaaacatagataactggttcaattgttatttcttcacaagataaatttaggcttggaagacattgggaaaacaggctacacatgctgattcccaccagcttatacacacgatcaagcacagcttatgtcgaggatatggcatagttacccttattaccacatgatagaccgccatagcgcagatgtgtgcatgcgctgtaatttcatgccatagctattgatatccatgcctttgtgggggagatgtctgttggtgatatgccctagaggcaattatagaaatgattgtatcacatactatgtttacatattttatatccaacattgttccttgaaatagataactcattattggttaatgaatacgttgctatttctaaaggatccctaatcaactatcataagtgatacaaatatgttcaaatgatcaacacatgtattaattgatggtcatgtctcatgaatcatggtatagagatatcaaattaataatgtggacacatgttgggaaacatgttgttggatagacccaacataagacactgcaagagccatatgtgctgtgtcatcagtgatctcatttagtgttggtattgaatccttagacctaagattattatggttcccaacgtatgtagtagcttacttagggactgctaaacgctactccgtaattgggtagttgtaaaagtagttttctggtatgctatgaaacatgtagtgggatatgaataatcaagatgggattctcccctatggagagatatatctgggcccctcgatattatagattatggaagtgcatggccatgccaaaggtgattgaggaatcaatcagaagttacataatctatcacaagttcgagtgaatgatttagctattaaatgatggcacatatctagccttgagtttaatcgatatcgtgaggcaaatggggttcatacaagtatgcactagaggttcaaccgatatgatctttgtgtatgctcggtgggtcaatacattttgctaggggccactgttgacacgttgaccgaaaaggagtgtacatgaacctacagggtcgcacgcttaatgggccggaataagggaattggatggagatacaatatgagcataattcgaatagggatctgaataggagtcctatgggccttggaggttcgagtcatggatcctatatatttatgaggggggtgaccggcggtgtgattgcgtcacgtgagaaaccctagccgccactaccctcctcgagcaaaaccctagccgcgcgcggacgctagcacgtctgcgcgtggcattccatccctattcgtgtggataccggtagaggtgtcgttggtttgcggtgctgatcggtgtgagaccatggcgaagagaacgcacgaggaggagaatgtcgagctgctacgatcgactacttcctctacaccaacacgcgctatgtcctcgatgttcccccggctacttagcatttacttccactgcatagcacatcgagtggtaacgatctatgatctaatacttgcatggtttctggtttacgcggtagaaaaattttgatttatgctatcatagcctacaatgtcaacggtcctggcagacaagttaagaaaattcttgccgatatgctgagaagagcttcgactgctgcagcttccaggtagatccactataaaagctgggtctgcctggtttctagcttctcttatactagattataccccgcacgttgctgctggattttttagatgtatcttgttcacttgaatttgttttgattaaaagaaaatcatgcatacttctgattaaggcagatgcatatggttttataagtccaggggcagcctgctgattataggcctgttagaaccgtagaaccaagcaaagcagcatgcatcccaacaaacataagcatcaagatgaccttgacgtccaaattaattagtgttggtgaccgatgatgaggtacatgagtgttgatcccaattgtacaaccaagcaatgttcggcgaagagtaattgttccacaatatgtgtggtacagaaaccttgtaaaataaagcaatatgtatatcacagtaaaaactgaatgtaaaatgttcttagaatgcattttgtggaatcaaaattctccagtttgatgggaaattaatagttgaaaagactaatttggtgtacaacaatttaagaaggatcattagagcgagtgagaatatttgggaggaggatggggcagaaagacggcgtctattcatgtaattgattggttcaaaacataactggaaatttgataccgaattcaatcaagattgagtatatgagatgatgaagtcctgtcgccgccggtcgaaccgcccacctgccgctggtcagatcgccgaagcctcgccggtcagaccgctcgaacacctgcggtcaggccgccgctatcccaccggtcaaaccacgcgcacacctgcggttaaaccatcgggacctagaaacattggtagatgcaaactcaaagatgcagattgaaacttttcgactttattgcatcaactagtgtttacaaagtgcaccaagagcactcctcaccataatctcgaactaaactcgaaaccctaactttctctcaactctagtctctctaaaatcgataccgggaggcctcaccctcgcctctatttatacatgaggtaggttgtgcaaagcccatgaatctaacacaacttaggactcctaacccacatagaaaaccctctcttgcacatatccaactaatatctttccttatctcaatcaaactttccgaattcggactcccttccaaattcgactcctctttccatacgtacaccatccctcttgtataccatatggatttcttcatcaccacatgcattgtcctctagcctttagtatcccgcttgatctcttgatccctggacatcaacttctcccaagttgactctgatctatcaccagcaacactctcccgagtcctcaagcaactcctgcacatgcaacaaccaagaaaccatattccgagctcaagtttgtcccaacttgactcacattagtataacaacattatccatactcatagaaaccgtctagaagccaaatccctgaaggaaatatccaaatccaacaaaacaacccgaaaccaacatcgatcaggatcctgccgatcaaaccgttgggccgtccggtctgaccgctgcaacacctgcggtctgaccggcggcactcagccggactgaccgccagggtcaaccgaaactgcacactccacaaaatcaaccatcttataaaatctccaaattaacattagcaaaccaccaatattttcatcacaaaatctaaatcaactccttgattctacccaactcgcatccagcacagccgccactgtctgccgccgacgtcgagcctcccccgccgcctagtgtccccatcagagcctccgccaccgccatcgccgacaagtttattcaccccatttacagcagctgccgccatcccattatgtctccttcccaatcgcagttggtgcggaccattcaaaaatggcatcacaatgcctgctaaccccaaagtgccccaactcaaaaatgacctggtttgacgggaatatttttttgctcaagcggtcaagccgttgctgggacaactaaattcagcaacaaagtgcaaacaagagtgatgtgaaacaaactacaaacctggatgatttatgtttctgtcttattgtttcattcatggcacaagtagattcacgtaacatttgaaaagcagcaggtattaacctctagcatatgagtctggccaatgcattctacaccaagcataacagcgcagaactgcaacgaaaatggcacaataccaatagctcgctgctgcacatacatcataaccaacagcagaattccggagacatcaagcatcagaaattttcgtcaccaattgcacaagtcagccccagcaatgccaggatttctagcaaagcgcctacacagtggcggacacagaattaaaaccaagatgaggcgaatatgttcgctcttcataaagaccactaaacgcaataaataccatatttatactgtaatcacatcaaaatatacttaagaaaaatatacttaaggcaaacaaatcattttataacaaagcaataatatttgccccatacataattcattatacaccaaaagattcacaaagcatggttgatacataattttgtttagtactttttaattttagtaatttattatacattaaaatcactttacttttaacaatgttcatgatagggtttttttttatataggcctccatcatttatgttgagcgatattttttttaacttcatactcccatccctaaaatcatgcgtcggccactgctgactgatgccattccgaggcctgataagcttcatcaagtggacgtacgtagagcggaaatgctgttgggcgatccatcgccctggggatggggtagcgatcagattcactccccacctcccccctccctccctccacctagtttctttttttttaccgcattactttcctattttagtaaatttatacacctaaagtttatacacctaaagtttacacatctaaagtttagagaccaaaagtttataagttaaaagtttatatatccgattcaaatttgaatttgaattcaaatatttttttatatatagtatttttatacatctaaagtttatatacctaaaatttatagacctaaagtttataagtcaaaagtttatatacccgtttcaaatttgaatttgaattatatctgattcaaatttaaatttgaattcaaatattttctatatatagtatttctatacatctaaagttcatgcacctaaagtttatagattcaaagtttataagtcaaaagtttacatacccgattcaaatttgaatttgaattatatccgattcaaatttgaatttgaattcaaatattttttatatatagtatttctatgcatctaaagtttatacacctaaagtttatagacccaaagtttgtaagtcaaaagtttacatacccgatttaaatttgaatttgaattcaaattttttatatatagtatttctatacataaatttttctaacttttgtttttaaagaaaattgtgtggtgtactgtagtagaaagagaagaagggaggaggaagggggagaagagggaggagtatagggggggactgatcgctggatcgatcgcccattagaagggccccagtagagtcgcggatctggcagctggtctttgtgccttttatatggaagcaaccaagtaaagattctaaaagatgaggctacttgtacttaaaaacgtgaatattagggaaataactaacctctattattataaaaattgaagatatttttgcccggtgctttggtacatcatccgtgtttgaatcaattttaatctctatatatctctatctaaacttaaaaataagaaatttccaaagtaggaaaaaaagaaaaaaaaagattctgtcgttggtaaaaaaagagaaaaaatagtcctactccaaagaaaaaaaaagtctcgccactaaaaaaaaccaaaaatgtccgtttggtttttttttcaccggcgactttttttcacgtgaaagagttttttttttctgcgcacgcgctattgttttttcttctccggttttttaaatcaccgcacgcctcacgagcgcttttggtttttttgtcaattttttttgtcaccggttttttatcatgcgtgcttttggtttttctcatctggttttttaatcccatctattcgtggcatgtctaccgagttgaactctggcgccacgccggcaccatatcaatcgtgcgttttctctccaatttgagtgcaaaaaaaaaatcgattcccactccctcatcattttctccatgattttgctggctttatttcgtcggatttaatttaccggttgccgatgatgatgacgatcttccccgattgtttttatcccgaattttacactttgattttgggtaaaaaggaaagaggcgagtggataaaaacccttaaccaattttgggtgatcgacaaagattcggccggatttgatgggtcgaagaaaacaggccaaacagagagaggtagtggactggcctagggctgaaaacggcttcactcgtggctgggtcgaagcgagcatgccaaatggagggaggtagcggattggcctagggctgaaaagtaaggaaagctttcgacccaaaacccaataaatattttcattaaatttttttaattataatatatagcgatcccaatattaagattttcattaacaaaagttaattataatgtatagcgatcccaatattttaatttattgttcagctcttaatatatcattgaaaaaacgtttttacccgttgcaagttgcaacgcacgggtattttttctagtatttataaaaaaaaagaagaagggtggggtttcaaacccaggccagctagccctccaacttgtggagcaagtcggaaaaccctgggcgtttctcaagcttcctgtactccatcaagtcgctcttctgtggttacatccaattttccagtagtttgtatgctctccagttaactgacgaggcaaaatgttagtgcagagcagtctggtgtatgagacacattagatctcctgcttgcatgcttgcgtatgagagcaaaatgaccagtgctccttttgagttttgatctgcttcgctgagttttacttgtgaaaagccatgcaacagagtatatgttggttgattgactcatgggattgaagatatatatctcgtagtttaaggatcttcatttttctgtctttcagtatattggaggaaagaccacggtaaataaaatatattacaggaaaaagtgcagtggaaactgaaattcgaagttcatagagatgaaaaaaagatgatctacgatgcacaatatcaaatgaatgacaaaatttaattcggtccaagcatgcaccacttggttgatcttctatacaaaacctaatgggggagtttcaacctgctggaaaatcctaaaattcccctcctcgcatatctgagcaatctgtttgtacacactccaagtgaccgatatctccaccaatcaaatacaaaagtccatagtaattgggtgtatctacgaccggccagatgtaggcgttgttcacagtcactcagcagtgtgtgattcatcgccaatgtagttgtatatgttcaagatgtttaaatgcacttaacacgcaatcgtcactttctaccaccctcagggaaaggtcaatagtactagtagaactcactgtttgctccaaaattaatttctccatgtcaccaaaagctaactcatagccaactcatacggcatgcgctacaagttgtcattggttaaaacattgaaatattatggcagatggccaaggccaacttgtataccaacctaatgtaagatggcatctagctcttcaattaaccttgcactgacaacgattgtcccatgtccacatataaccttgcatattttgtatccatgtcactaggaaacgggtgaagatttgggttgggatgtatggaggaaggacatgagacgatttatgaattagaaaatctagacaacgatatcccattggaacggaatacccttttatgaaatagtacatgatacctgataccctgttgtggtaccagctgcatggtacccgatacctgttactcggtacctgtgatacttaggacctataataccagtgatactcgtgcaagagaatactccatccgtcccacgaaggaggacgttctgctcccaaccaaaagtcccataattcttaacgttgtactctctcaacagcacacactagcaaactcctagaaaagcacccatctaaaaactcctagaaaagaagtggggccatctaaaacagtagcgaactctttctcctccaagctgtaggctgagtttagttacaaacttttttttcaaactttcaactttttcatcacatcataacttttctacacacaagaacttccaacttttccgtcacatcgttctaatttcaacaaaacttctaattttggcgtgaactaaacacagccgtagtgttgatgctagcacccagcattaattggatgcttcaaatattcttttttagcagatgtggcagtgtagtagtactagtcgtactcctacttaagcattcaaatgattagccccaatcccataaattgagggcaaaatggccattttcagacaacactaatttgacccaactatcctaggacgtccagcattctgggacggaggaagtagttaatatgtctataccgttgcaacggaattccattttgtagcagtcctctttcttttctgtatacctagtacctaatctggccggggtagaacctgaacaaaccacacatttatatgctcatggttaggtttgaagtacggatcttattatactcctcattaaaaaatttatcccaattattttccaagtatagctgtgtgcaaag

SEQ ID NO: 2897 - DNA, 2028 bp, Oryza sativa
gccgccgagctcgtctccccgcgctcgctgcctccgctgccgcctagcctcgcctccctgcgctcgctgcctccgccgtcgccgggaggagagagagagagtgtgtgagagagagatagaagagagattatgacatgtgggtcccactttttttttaatacatagaatgctgactggactgccacgtgtacgccacgtagtccaaaccaccgcggattgggtcgaggagggtaattcgtccggtttgcatagttaagggtgaagaatattcggttttgtggttcagggtggaaattcggacgaccgcgatagttcgggggtaattcatactttttccttttaaatatatgacatgatgttttattgttaatcttatttataaaattaatataaatataaaattataattcatgtttacagtatatgtaattatagaaatgtcacaataaaatactgcattcataggaatataagacgtaagaatctaacttggagaaggcaatgtctccttaccccgtatcctgacagggttctccgagttctacttgaataaggaaacgtctagccgcataaatataacactagaaggggagcgcatcgaatcacaagccttagctatagacccacattgagagacagccaggtggaagagaagccctattcaccaacatcagctcgttgagacgtacttggtgaattctagctggtggattagaatagctaacttgctccccctttgtaatcagtgtggtacttttcagagatattcagataaactggtgtaagattattacttatattgagaacttgaaccagtataaaaatccttgcctcctatctccttactataatctcgtgtatatataccttaataccgacaaccccaatacactataaatattgttgtcaggtatagtccatcgacgaaaagctatatatattaccgggaatgtgaatatgcaagagaatatgttgacaatgaatagtggaatagcttatttatagaagagaacttatgctggtatatataagttggagatcagtaatggtatgcactgtccaccagttccaacgccatttctaccgttgtaaaggtagaggcaacactatactactaaatgatggtcttggaaggcatcaagaaagaaactcaaacaagttctgttacttaagtgttctatgttggtgctttagctagcagatttcatcaactatgtgcttattgttccggtacgactgatatgacgtactttcttgtgaaaatgaatcttcactgaagaatcttcagtgaatcttatttggccacttgtaaatttcagcttactataaggccctgtttagttcccagaacaaaaattttcatcatgtcacattgaatgtttacacacatgtatgcagtattaaatgtaggaaaaaaaccaattacacagattgcgtgtaaactacaagacgatattttaagcctaattatgccatgatttgacaatgtgatactacagtaaacatttgctaatgatggataaattaggcttaataaattcgtctcgcagttttcaggtggaatctgtaatttgttttgttattagacaatgtttaatactttacatgtgagtccgtatatccgatgtgacacgtcgaaacaaaaaattttgccaactagcctaagttgtcttgacaaatccatgtttaggttgtaaacatcaactccttaacagattaccggacccttgcaagaaagtagttaattaagggtcactggtgactttctttttttcttaaatgcaaactgtaattttctgccacttgcgcactataatcaccatctaccagcgcagtatattgattagtacaatggaccctgttgcgtcatttatgtgcttcaattattcaactagcacccataaaaaaaatcaatacaaaccgcatacgctgcatagtacatattgtgacgaacaagaagtggtgtatcactgctgtgtatcactgctggttcataagtacaaccggcaatcattgttgcatgcatcg

SEQ ID NO: 2898 - DNA, 8670 bp, Oryza sativa
tcacgaccaacccatatattttttttgcacactttgtcatcactcgtgcgcacacccatatattttttgcatacttttttgcatactttgtcctcactcgtgcgcacccgggaataattttctggtcagtcacccatcccaaattgctccaggccaaacacgcttaaccctggagttctttgtaaatcggcttccgaaaaagaagttacaacttattgatataagtattccattaatcctattaagccctaggctgggatgtcacggtatatatctcctagaacctactcaagttataaagaatctctctaaaaggccaggtgtacaggaaagtgaaaatcatcctgagttcatgaaagcagagagctcatgatgtttgtgagggctatagaaaaaaaaatatggttacatatctcctagaacctagttaagctttcatatatacttctcattctctatgtatacccctcacaaacatcaagagctccctgcttcaaagaaaaccagtggtactaaattttctattgggacaaaaagcagataccatggcaattacttgttgcggctaaaattgatatccatatgaaattgagaattttcatctgtttggaacaggaaagtgggaattaactttaggcatgggaagcaacaggaatacgggtcaggatttccaatactcttaaggcctgaagaaaacacggaaaatagcacctaaaaagcactgcgctagcaatgtgaacttcctagcctgagatggtgtcaccagcattgcatgcagttgcttggctggccatgcaattcaggacaatctggctcctggcaattgcatcccaacaacactcttggaagaggacagtcaacttgatcagagcagctgctacatgcttgatgcttgccaaacattctccattgctcacatcttctagggccttgttgacacttcaggatggaaaggtgtactaactatagtgagcagactgcgagccgcgaattaactcttcctgtctcacaaacatatttcattggttactggccttatcaatcctgcttgttgacaatcatcggtgatcttcggtggcttcgtgtgacatgaggatgcatatggctgggtgcatgtttgccaatctgtagtcatttcagggcgtgtgctgtgcctggtgtgctaacagttttggattacaaatttttgtttaatatatgtgtggtttataaaaaaacaaatggtattaagtttttttccatacttaagggcaataaatacttatatgtggtttgtttctattttttgccttgaaaaaggagtacagctatacaagtgcgcaattgctcgaaattccccgcgcgcccatataacatttttagaggaagccgattgagagctaagctttcattcatttgagagagaattacgatcactggctataaaatcaaagtgtgttttgattattactctgtgatgaacaattggcatctgagattattggttttgatatttggagattattggcgaagtggttttggagatgattgatttggagattattggttttgaagccgatttttcaggtgatgtacagggttactgtttttgtcgggtccagtcagacagggcaggtgctgtcggtcagaccggtactatgtgagcggtctgaccggctagtccgcggtctgaccggccaacgctgtgtcggtttcggtttcgggttgtttgttttgatatccgtgattgtttcatgtttatggcttctagatggatactatacgtacgtaatactattgtttgctacaaataagtcaagttagagatagcttggtctcggaatatggtttctttgtttgattcatgtgtaggtgacttgatgccatgacttgggtataaggtgatgtccgtgacggtcagatatcatgcgggatacttaggctagagttcaatgcacgtggttggtgaagatttcatatggcatacgatcgaggtattgtgtgcgaatgggatgcggagtcgaatttagaaggagtccaaatttggtatgattggagtttgtaaagtttgtttcttacatgggaaggtttcctaggtggattaggacttctagtatgagtttggttcatggtttcaggctgcgtacctcatgtataaatagagagggagcgtgaggcctcccgctatcgctatcaagagcattgagttgatagtttagttagggtttcgagtttagtcgagattttcgtgaggagtgctgttgttacactttgtaaacacagagagaagtaataaagttttcatctactttgagagttcttcgatttgtgttttctcgggtgccgcggtctaactggctacacaccggcggtcagaccgacaaccacgcggcggttagaccggcggcgactgcaggcgaccaaagctgatctcgacggttcgaccggtgttactacctcggtcagaccgatgatatccaggcggtcagaccgattcatctactccggtcagaccgtgattcgtcgaatttgacggtaacttttaattccgcaaaaagtttgggtttttcggtataccaaccattaaccccccactagctggtttagttcttgtgattcgatcctacaagtggtatcaaagccttgttttttttttggattttaactgatctagagtttttgccatggctaataagtttacaactaagccccatgttttcgatagatcggattttccttattggtgtagtaagatgctgtcagggttatagataccacatacctaatagtagttgactaaatctcggcaggaccactacataccatgtcctatacggaagcaaccttcggatataggaggaattccggataaggaaagataaccagagttctacatggaaacgacaaggactactcggattgtatccatattggtttccctagttctacttggacaaggggacacctatgggtataaatacaagccccctaggaggagagggaggaggatcaacacccaacacaatctacatagaagccacaacatagaaacctacatacgccaagacacgccgccggatatcgacttcagggataagcacggctagtaccctacggtgtctccggatactgtcaggagagacgaaagcgccatctctgatctccccgggcacggattcgaggagaaaggctaccctgttgtcgactacgagtcagatcgtcagaccgtcatgtcgacaatagttagatagcctaccccaaatattgtactggtgtgattatcatgaataagagcaataccggcttcggcgaacaggatatagggttattacctgacaattcaggggcctgaacttgtataaaaatccctgtttccatctcttttacctcagtttcgcgtataccctagtatcgacgatccccataccatgcaaataccggaatcgtgacatcaaacatcgacagtggcgcgcaaggtagggggattttggtgcttcaggatttcgacgagatgggtttaagagatggactctccgacaacaagctactcgacgacttcggaccaggaagatccaacctggccagagtacgtctctcgacgagattggagttatcgtcatcaactatttgattcggcgagatcgatcaagctccaagatatcatcgccgcgaaggataattgttcaatatcgccagatacgagacttcggttcatgtcgactacaacggaacttgccgatctacgatcataattggtcccgaccgagtccaaatctaactacgtgcgcctgtaaattctcaaaccggctggcggctgcaccttgtgcctggatagtcctactcggacatgatgacaagaggatgcacactatacgtgaagtctatacagggaactgaagcacgtgtccaccatgtgacgggatgccacccgttatcaggtatctgatagattatttttttaaattaatctactaattttgtagatatatccggtatatatctacacaggtacgcaatattttcgtacctatttttacaatctatacagcattgtcagatctatattatgtttacctaaagcaagttttttatacaatatctattgcgcgagtgtccccgatgttaaatcgactacagtttaatgctggggactcgctctattttcttccgtataaatcatgcttgctcacagtttacataatgcctgatatttacatctgctcgttatatcctgaaaatactagaatatccatgcagttttttgagtacatactcgatattacctgctatatatcttgtcttctagaaaatatttttcaggaacaattgagcagtcgagtaggttgtggttaagtacaccgcattatcgagaacgatcttgacaaatgcagagtcgtcacgcccaacctgccaaaaaagaccgacgacctatctcatagcaccggccatggctgcactatacgagaaaaggttgttaacggataattcctcgtgaatgccatcggcttgatcacccgacatgattgcgaacggacatccggatatgctacgagttgagtgtgtgagtcatgctggccacatgagacgcacatgtaataaaccaactctagcacctctattgatgttcgagagataattctacacgttcgctggtcctggcaccggtccataacaatttctggcaccacaccagccgtagctgtcccagatatgattatactcgctcgctgagatgtcgaaacagcgcggaagaatttcttgtactgcaccttccgttggtgctctagagatcattggaatcgatcgctcgttctcgaaccagtaagtagaaatctcactcaccgctacctccattggtgttcggacgatgattttacacgtttgctggtcctcgaaccagggtgtagcaatctctcgcaccacaacctcagatggtcgaggtacgactacagcaataacgcagcggtcctcgcaccacgacttcaaatgatcgagagacacctactcattggttctcaaccagtcaatcgtagcgatctctcgtacatttacttctagtggtcaagtttagactacatctggttctcgaccagcggtgtagcgattctcccactacccttacttctagtggtcgagtttagactacatctggttctcgaccatcggtgtagcgattctcccactacccttacttctagtggtcgagtttagactacatctggttctcgaccagcggtgtagcgattctcccactacccttacttctagtggtcgagtttagactacatctggttctcgaccagcggtgtagcgattctcccactgcccttacttctagtggtcgagttacgactattacctggttctcgaccagcggtgtagcgattctcccactacctttacttctagtggtcgagttacgactactacctggtcctcgacaagaggtgtagtgattctcccattacctttactacaacaaagttgatatcaggtacacaatatcgccaagtgttttacccgagagatcccttaccacgatgacacctagcgttgaaacctatcctactgtccctttacgccgtcttgacaaggcctccgaggaacctaagggaacttcagctggggacgcccagagccgataaggccttgtcggatcctttagagacgaaagaccatgtaagatctggtcgtgtaagagttctcgccgtgcgtattaaccaagctgtgtaatcggaaatggattttccaacttcacggctgggggctaggatcagtgcttattcaactaaggcaggtcaaaggtccaagagccttatcctccgagaacgattctccgacgacaaggctaggggctagggagagtgtataactcaacaaactaactgatcaaagtcggtaaaagagtagacgctcatatacaaaacattggtctgtaagtttaattcattttcggttttccatacatattataacatgttaccctttgagcgttcgctcgggggctatttctatctaatattcttttctgagtattgatttcaggaaaattctattcgacattatcgaagacaccatgtctctatggttctacaccaagatcgactaaggcaagtacgacaaatgttgacaaggctccgtcgcagactctatgcctactcgattactcgagaacggttggtggatctcgacaaggaatacggaatgaagagatggtgtacccgccgatataaaatttcttgacttcaatccaaattctcgattacagcaagacgggagattactcgtaagctctgtactttcttggttgacgtcggagattgactcagacaaactctttaggagtccgcacgaggctgataaaggaagtctaacgttatctctgaactcaccgagaacggttacgtgcgctcgataacagttcctccaaggtctgcggttgagaatatgaactcgttcatttggattgaagtcaggggctattgtcagggttatgggtaccacatacctaatagtagttgactaaatctcggcaggacccactacataccatgtcctatacgaaagcaacctttggatataggaggagttccggataaggaaagacaaccagagttctacatggaaacgataaggactactcggattgtatttatattggtttccctagttctacttggacaaggggacacctatggatataaatacaagtccccctaggaggagagggaggaggatcaacacccaacacaatcgacatagaagccacaacatataagcctacatacgccaagacacgccaccggatatcaacttcagggataagcatggctagtaccctacggtgtctccggatactgtcaggagagacgatagcgctatctctgatctcgccgggcacggattcgaggagaaaggctaccctgttgtcgactacgagtcagatcgtcagaccgccatgtcaacaatagttagataggctaccccaaatattgtactggtgtgattatcatgaataagagaaatactggcttcggccaacaggatgtagggttattacctaacaattcaggggcccgaacatatataaaaatccatgtctccatctcttttacctcagtctcgcgtataccctagtaccgacgatccccataccatgcaaataccggaatcacgacatcaaacgtcgacagatgcaatcttacattatggctgaggatcttgatattttgagaaaagtttctaatccttatgtgattccttatcaaattaatattgctgatttaaaaactgcatttaaaaataattgcaaagcttgcaatattcttttgagtgggatttctcgttcggattttgatcatgtttctcttcttcaaaccgcaaatgagatttggattgctttgagaaattttcatcaatgaactaccaatattaaagaactttgtcgagatgttttcaaaaaggagtacataaaatttgagatgaaacctggagaagctttggatgactatctttctaggtttaacaaaattttgagtgatcttagatatgttgattcttcttatgatataaattacacacaatctgaggtttcacgtcactttttgaatggtcttgacatgtctatttgggagatgaaagttacatcaattcaggagtctgttgatatgtttgctttgactttggattcgctttacacaaaactcaaaacacatgagatgaatattctttctcgtgaagttgattctaagtctagtgctttggtttcttcttcgacttctttggatattggtgcttcttcattgaattctactattcttgctttaattaatgccatgtccgatgagcaactcgaacaattcaaggaggagtacttggttttggttactttcaagtttgctcgagctatgaacaatgtcaagtagaggagaagaggtggtccaaaccgttgttttgaatgtggtgctcttgatcacattcgattgcattgtcctaagcttgggagaggaaaaaggaagacaatggtggagagaagaccaaggagaacaagcccaagagcacatttaaggggaagaagattaaggagaatctcaagaagatgtttgaaaaagtctatgccggttttaagccactaagcgatgtagatggagagagtgaagatgaagataagggaaagaacatctccagtatttgcttcatgccgcgtggtgaatcggattcaaagtgtgaaaaacaatgaagctttggtggcgaggaaggagaacgtgtggatcgtggattccggttgttcgtggcacatgaccggtgataaaaattggttctcttccctcaaacaggcatctaagactgaatcgattatctttgctgatgcttctactagtgtcgttctcgctacaggtttggtcaaggtaaatgataagtttgaattgaaaaacgtagctttggttgaggacttaaagtacaaattgctttcagtttcacaaattgttgatgaaaattttgatgttcactttaagaaaactggaagtaaagtatttgattcttgtggtgattctgtgttgaatatttctcgctatgaaagagtgtttaaagctgattttgaaaatcctgtttcacctgtgataacatgtttggttgctaagtttgataaggatgtaatgttttggcatcctagactaggacatgttggtt

SEQ ID NO: 2899 - DNA, 2009 bp, Oryza sativa
aaataggagagaactagtgatgcttgcaatgcataagtatattagaataataatattctactagtattaggtatactaaccttttgcagggaatgacaataaagtggagaatcgacatcaacatagacgataaatcaatcggacgatgtcgagagatagacttatgtatgaatgggccaagagctcagaattgacacgatgaattgggccaaaattcacaagtctacaaagtgaagcaatagaggaagtcgccagccgaagatgggctggtttgggccagcccatggttcagcaaccccatgtccactgttgaggctagggtttggcatggacgtccaagattgcaccccaatgacagttggagggtacttcggacaattccccttccacaaccatcataaccacctctatataaaggcttcactctctatacttcaacacacacctcaagcaagggctctctcattcctctcaagtttagtttagtagtatctagctggtggaatagaattagaataggaatcgggagtccggaagtcttcggaagagttcgggtatggctctagtagctttcctttcctcttttgtaagctttgatgtagtactagcattcttttctagccacatctgtagtgttgccctctatcatagtacattagtatcgactttacattatgttcttgttatactgaatatactgctagcttatctaggagatgttttggtgcgggtatagtgtttgcttatgcaattactctatgtcatgacgatgatattagagtagtatctggtggtttagacgtggtgtctaaattacgggatatcattatttagggttatatattgcggatgagaggtgggccgctgatggtgatagctcagtacgggtattcctccgcgcctatatataatcctaagttaatttcctggggagggtattcctccgtatttagccccggttggatggtcatgacgggctgtcgtaaggaactcggcagtcaggggtggcttctcgaagtaccaggagggcatcggatagagggtattagctagtatatcagttaactagaatgtatatatactatgtatattagaagtacaggaatagattctctttctcttttctttccacctagcttagattatttattatgaggatgagtagaaatgcttgtgtgtcactctacccttggattatcttaacccctgcttagaatatgattatcacaagtaatatataaattattagttgagttctctctacatgatcttcccacgggaaaaaataaatacgatacccttggaatactctcgggtgaaatgctacaatggtatatccgtgcgcttgcggatgaactctgtaaccataatataccagaagtgtttctgcgccattgctgggatttatatttctagtaatgtcgttaagaaacaccaacagctacttcacatgctcctattttttctatgatgacggatgcaccaggatagctattacacatggatactgttgatctagctagaatgcaatccgttggaggaaagtggtacgtgttggttattgttgacgatttttctcaatatccttgggttttctttatggcaactaaggatgaggcttttcaacactttcgtggtttgtatcttcgatcggatcttgaatttcctagttctttgaaaagaattcgaagtgataatggtggtgagtttaataatgcttcatttaaacaattttgcaatgaaaaaggtctcgaacatgaattttcttctcctcgtgttccacaacaaaacggttttgttcaaagaaagaatcatgttttggttgagatggctagaacaatgttggatgaatatcacactcccagaaatttttgggctgaggcagttcacactgtatgctatatttcaaatcgggttttcttgaggtcaaaatttggaaaaacttcttatgagcttcgatttggatgtcaaaccaaagtttcacatttgcgtgtttttggttgcaaatg

SEQ ID NO: 2900 - DNA, 1977 bp, Oryza sativa
agtgtttagagcgagtacaataagatgatataagcgagttatacatatagccacatcatatttatgcttatgtggaggagaggagaaaaggcatgctacaggtttatagccagctgcagcacaaattctaataagccatgagagttcaagttttatgatagagatgactatcacatctaatttcattataatatatacatcattaaattaaggggtaatatgcataataggttgcctctaccacacaatcgcaatatctctaacactctcatatatttcttgaaatttgtgtagggttgctccttgcatgagaggtacctatttctctctcatatttcttctctcctctctcctctacctcatttagccctatgtggtatcttagggcttatacttagatgcccatagtacttgccctgagagagaaatatggggaatgcattaatggtagttaggctgtgtttaattcacgctaaaattggaacggtgtgatggaaaagttggaagtttatgtgtataggaaagttttgatgtgatgaaaaagttgaaaggttaaagaaaaagttgggaactaaacaagggtttaactattgtattattagtagactattaagtgagtaatgggttaatttttggatatatgttaacttgctcactatatggttcatcacgtcagtgtcttacggctgcagactgcgcctaaagcattttcccagactctctcacaccgaaacgtagagaaactcgcgagttggccccacgtgtcatcctcacgaccgtgtccaacccagggacccaaaccgaccgacctcccaccacatcccccgttccgccgcctccgcttccgcatcgcgccgccccggccacgaccttctcccgccgtcctggaaccgggcgatggccgcgtcgtcgtcgtcgtcccgtcccctgctccgccgcgtcgcggccctcctcggcggccgcgtgcgcgccagccaccgccttctctcctcctcgccgtcctcctcctccgccgccgccgcagcaaccgagagggcgtcgccgccgtcgcccgcagacccggataccgtgcacatgacggatggctgcatccgagtaggtccccgtaccctcctccctcccttcgttcattccctcagcaagatcgtgtctcccgtattctgtgtggaatataggcataataggaggtttctgctgaaaacttttggtaacatgatgttttctgtttgatttggtaagatttgatttaggtaatctgtcgtgatgttctgggaaaatatgcggcctccctcttgaggtttttttgggctttgcactgacaaaataccgatatagcgaattgaattcggagtcagctagtcaccgtgtgctatgttaatctgctttggaaatgctacaactggaagcacattttctgaacattttcactagttcagtaagggggcaaaatgcaaaagcctgcatgagaattcgtttgggtatgacagccacaaaaaatgggtgttggattgcttttttttttctttttctaaatggaagtttatgttggaagctgtgaagtgtaggacaactacaagcaatgaagcataataagttgttccaaagctcagagtgaaaaactaaaaacactattagacagccgaaacataatcttgtcagcactttgatatttaagttattgctacattatatttggagcatgcacacaccttcatttcgcgttcccgtaaataatagagtggcaatagaaggctttgacgcccttcatttgattgcgccagagctaaatgctgtgttgattatacaagtttgtttggtcacctagccttgcctatatttctcactgttgaaatggagtattctttttgggctatatcagggtttctgtgacaggatttcaattcttgttacatgtgttcagggtctctagatgaatgcattttctgttgttaatactagacagtaaaagtggtttca

SEQ ID NO: 2901 - DNA, 906 bp, Oryza sativa
tttctactgcttctaccttgtgatccttgtgattacaagttatgtatactgaatcatttggccttcagtatttatttgtatgttgcttctttcaaagtgctaaataagatgcaatcttttgtaacattgatatgagtgtatatatgtcagaattttctcactatcttgaggttgatcctagtctagtatatataatatagggtgtggtcgtttttctattttgtctgtggtgcattggtaaagtatcgagagttccttgtacttaaagattgattgcatatgatttctgtgcgacaagtttatctcaatgaactaagtccctttgggcatgatctttttgctgatatgttttttttcgtcctgagtcctgactacacgatctagcaccatgctttacttcaaactcagtgatttccaggcagttgcttgatatctttggtgatcaccaggtatggtgtttgtgagatatcactttctgagtagcagacagttccaaaaggtaaaatgtactactctgttcactgaagattgatctgaacgttgttttacatggcaagaagttgaaaagagatcttatggtggatatttaaatgcttactgcctcgttggagtgatatattctctggattttcataggcatatagagccaacaacttgataaactcctcatattgatctcttggttaatcctcaaaaccacaatgttttgttctacagcattgaagatctaagagcagaatgcaactacgaaggcaaatcttcaaatctagtgcttcatttagcttggaacatattgtgattcctaatcattctcctggattctgaactggatggaactatttccaaaactttcaagtttcagcctcattatcaaggtcctgggaaagtaagatatcataccaaaca

SEQ ID NO: 2902 - DNA, 1150 bp, Oryza sativa
attcctgcagccccagagaaaccatgtgtgcacttgtcatgatgaagaagagccagagaaacatatatggtggaagaggaaaaggattttatttgaccaaactaggagaagttctgacatctttctcaactaactactttggtatccagcagaagatttgaccaaacatgtttccatggtgagagtattcaaatcaagaatcaaataggtcaaatttaaactaaccacgaatgcggagcgtataagttcttcctcataatccacagtggcacctttcacaaagtcatatgagacatcgtccacaaccaatttaacaccttctttctcaaagatcctacatgtgtaacaacaattgttgagataagtaaaactattgatgaagtatgtgacacactcactacataaatcatctataaggtatacactctgttcataagtttccacaataatgcttagaagaaatacagaatttacacttgtctaaaatggacaaaccagtcaggaaaattggcataccgatcatctgagtttttcttgtcatcaagagagaaagaatattggaatccagaacatccaccagcttcaacacttaatcgcagcatcttaccttcagaaggtggttctttagcatgtaattcttttaatctctgtgaagcattaagtttccaaagaacacaaaaatgcgaagctgttaggaaaactaaaattataagaaagtatgtaaaaggaggggggatacattctgaacaccaaaagcatatttgaagtcaacttggcacaaattgaattctcaaatgttcctactgcgttgaacaaaatgtgatagaagtagcatattcaaatgtaacagttgaaaatgaatcaaagacaaaaacaaaaaaaaagcaggaaatatttgttgtttccaaaaaaaaatatatcacctctgatgaaatttcaggaaatccctttagcaatgtccatatttcaaaattttcataatattttaaaggttttgcaaacatatggggtataagtgtaagcatatgaaaccacttttactgtctagtattaacaacagaaaatgcattcatctagagaccctgaacacatgtaacaagaattgaaatcctgtcacagaaaccctgatatagcccaaaaagaatactcc

SEQ ID NO: 2903 - DNA, 5530 bp, Oryza sativa
acctagctatgaacaataatactccatatgtagggttgtttagctgacaatttaactttagcacaatagttttcacaagatgtaacaagccattatcacccttaagacaagttgtagcaagaaaatgtaccaatcatgaatggtcttgatttcttaaaagtggtactataccatagctacacctatccctgtgtgtaagatgatcgaccacttatggccatgaaatttaggccctaaaatcgtatatttcaatctacaccgatgcattttaatatgcttagttctcttcatttcaccttttttttcaaagtcctttcttggcactggtaagtgttcgatgacaaccatggctacttcgaatggttgtatctcgtgacaacaatgtgagtgtgtgttccaaacaataagaattccattgttccacttaataagaaaaattaagtgcctcttcagaaaaactaaattggtaatattgtcaaatttttgtaggataaactaaatatgttgtaaccaaaattatttatacgttatcaatgttaaacgcatccacatgtttatcgacctttaaaaaaggtatagtttaaaatggcaccaatctaaataggctctaaattggtgtagccattcttcttcattagatcaccactacttaaataggtggatatgcttatttagtatagctttttgttgttagcattaaatataaggcctagggtcccaaatttctacaaatagcgtgatcaagttatggcaggaaccaaacactaggcttatcctatattatacatatatagttcatcgatcaccactaagtatagttaatgctatttctatcttctctcattaagtcgtatcacccagattatttctagcctttagataatagatctatagttcaaactgtgtcttctttcttctctcataataccatgcaatctcaattatttttaggcttaaaattcataagtatcaatttgttttagttttaataatcatattgcatcttatttgtgcatattatgcaacttaatttcctgcagcaacgaggctgaatattcatctagttaggttaaaagtagatgccacaccttcatgcctggtgcaagatcaaacgtgatgagtgcgacaatgcttataaggggatgtagatccttgcatcagcctgaatcgcctaagttgcgtttgagaagaaggaaggatcacgagcgattggcattggaactgcatgcgacctcgtgggggcacacggcatgatttgcggaggtgcgtgcatttgttggggggaggggtgcaggagattatgcggccgctgaccgccgtgcgtccgagcacgattaagagtcggagaagtgttcgggcaacgatcagtgttacgcattcgataagattttttttaggggggtggaatgtgagtgggattaggcctcatttgcgcgaagaatcatgcatcgtgatcttgagcgcagaatgcaatgtaccgtaggtaaaagaaaacgatccacgaagaggaaagagatcaatcgaactttctagaaaactgtgatcgatgatgcaagcggcagatagagatagtgttgtttcgatgttggtcatccacatgtccacatgtgacatgaattgtctgttttggatctaaaaatcttttaacggtcgttatcttttctttgtttatctccgttagtactttgttcaaagactaatttatcctctcaaaagaaaagaaaaggtaaattttcctttgaccaccttttattacggatattctgcttcggattacccattaaccaatatttttaattgaaccgggtattttacctttgcaccactttaaaccattctcaacttttttttattcatttacatacaacttgttgaatgaaaaaaatgtctcatacataactgtgagaattttattgttaaataggagccgaggtatctgacattgttcattgcttaagaaaaaagttgggtggtccaatccaaagcgaaaacacgagttgaatggtgatccaaataaaacatgggcaataaaatgtaggacacaactacaccgagagtgctagctggatagtgctaaagagagacacccttctttcaaaaaaaaaaagctactagtacactcaatatctatgtatttttttcttagagaattttctcttaaattactcatccgatttataatccgattacaccgttgtattcataacaattaaatctttacaacaagatctcacatgattatattttgatgaaaaatcataaattacttttatgatatatctaaattacttctaaatttcactaagttacttcttagacatataaaaagtaaattcagtaaagcttaaaagtaatttacatatattatagaaatatattatagaagtaacttataacaaaagaaaagtaactttaatttacaactatatctagattcattaacatctatatgaatatgggtaatgctaaaatgacttacattatgaaaaggggggagtaactctctgtagtagaaataattatattgtgagtgagctgaaataagaaactatgtagagtaaattcgcaagtaaagtgtagagaagatttataaagtccacagaatatagaattaactaaaaacaataataaaaataatcaacttagagcattatgaattatgaatgtataggagtaatttagtcaaatctaaaagtaacttatatatatatatgataaaagtaacttacgtatataataaaagtaatttataaatataaatattttttcatcgtaatataatcatgtaagatcttgttgtaaagatttaattgcaacaaacgtaacggtgtaatcagattgtagatcggataagtaatttgagagaaaattctataaaaagaaaaaaaaatagaatgcattgtgtgtacttgtaacaacgggaccttttctcacgtaactgtactagtagcacaggaccttctctcatgtactagtagcactagaccttctctcacgaatgagtgcgttgctctttaacactaaatctagagcgctatcggtttagattttgcgtaaaatgtagcaaaaaaaaagaatatttgtgtttaaaaaaagaaaaaaaggaaatagtcgtgcggcggtgtttccccttcttcctctcggcggcgacgccgactcctcgtgagttcgtccgccgccgccgccgccaccacctgcaccgatccccatccatcccgcgagcgagtaggggcgcgcgtcggttgtccggctgcttccgcggtatcctggtgagaatccatccatggctacgcacgtccactttctcagctctctctctccgcgtacccttttttcttctcgaatttgcgttaaccctagctgctgttctacaaatttgccttaagtttgttctcaaaatgttcgggggagttcaactgaacctccattttcccatgttagatccgccactgtttcgtagtgatcaaaatgacggtgaaaccgatgtgcatcctggcttcttcttttgttttatttacatgtgagttttgattgattttgctcagcctggaggtccaaatatttagtactgatcaatcccaaattcccaattgattttatctgtaatgtgctagatgatctcggagaagaggattgattttgtctgatcaggtgtttaatttggcaccagagtgggatctaggaagtggtgggaaatggagaagccgttacagctttgtccagggtcagtgaagatagattttgcctctgcctcgtatgctggcaaggcagatatcgctgctaccgcggcagcgctcttgcatgcgcttgggccgccccgaacacctccctgctatcagctcccactggcaaaagtaaattcatcactgccactatggcctccagtgatatgcccttcaacatttgcccagaagcgtcctatgtcattgcctagcccacctccggccaagaagctgcaagtgcagcagtcttcatccatgctgccacaagattttccaaagttagaggtattgccagttgaaaagcccacaaagttgcaggtgcggcggtcaccgcaacatgtatccccagcgctgaagcaagattcaccgaagatggagaggccattgttgccaaggcctgcaacctttattgacgtgtgagttctccatttcttggaatagtgagatggaatgctttgttgaagaaattgaaattgataacttcatatttgtgatagtatgatgcatacctttaaagttttataattcactgtttgccattgtttgcactaatgcatatatgagtttcttggattaattgagaaaattaggagaacagataatgaatatgtttcacatggtacgtaactgagttttccatttgctagtttaccttttcttagagcaagaattggatggagcactttactaaaggaggtaaattgtcttcttttctgtctcttcaggatgctgagttctcaaaagccatctagcgaaatgtggtctgaaacaaaagatgtgacactgacaaggaaaacaaactgcagctgcaagtattcgaaatgcctgaagctgtaggttccataataaatttcctccaattgctgcgtaagaattgtttttccatataatttttttcctatttgataaatataaaacaagttgttactatttttttagaactttggcgctgcttttattgctttgtagaatttttgttagaaatattatgtcagtagacactcttcaaccacaaagtttagaatacatgttcttgtgtgaaattaataaccgttagttggatttcatgttggttgaaagttgttttttgcaagctatctcttcttttcccttcctacctgtttctctgaacgcttgttgcaacctatttctctgaaggtttgttgcaattatgagatgctgcatttaacttttgcatgcttccatcattgatcaatttccttcctacctgcaaagcctttttttttttgttgcgaggaatttacacttgcaaggttaatggccctaggcttttttagtaataacagagccaatgacctggtttcgtttgtaaccataatcacacattcacacatactagtcttttggtttgcctgaatttgtaggtattgtgagtgctttgaaaaaggcagatactgcattggttgcaattgcacaaactgttgcaacaatgttaatcatgagaatgcaagacaggatgctatcaatgttgcattggaacggaatcctgcagcttttatgccaaaagttttgaatagcacagcccacaactgtgaggtagggcatgatgtatcttattgcaagatggcatgttttctctgttcagattctaattctctagtagctagcctataagccttagttatccatatcatttttgggttaattgtttgcctgttcagtttgttcatgagcaaaaggtataataaaggacgatttcacactaggttgtgaacagtataaacaccggcttttaaccaaacctggtgggtaccaccataccaaaataaatgtataatgtgtatata

SEQ ID NO: 2904 - DNA, 2665 bp, Oryza sativa
ttacaatttggaagttcaaaatacctgagagcatgctacgttttttcaccaagaaactgaaatgaaactggcaccctcaagttttgagacttagttggtgtcctaaactctcacagttaacgatgcagatattattttccagggactgaaattcatacattgttatgtcattagacaaagtttcatgtctacaagtcagttagatgttgtttccttggattctatttttgaatattctttgaggttcagagcaacagcgacacaaaatgcattgtaatggtcatctagaacttacaggtcttttccattgctagaaattaatttattgtcatgatattattaccactttattttgtttttcttggtacttttcctatgattcaatcagattggctaagtttgagtgcagtcatattttagcagttaaccagtcattgggtgcaaaaagcccatgtcaagatttaaggcaaagtttctcatatgaagaaccaatgagatgttcagctgcgtacttgtataacatatgcttccatgatgtgtatgaaactcattctatctttcaattccagagcaaagcagcagagggtgatattgtgggtaaacatacaaaggggtgtaaatgcaagagaacagagtgtctgaagaaatactgtgaatgcttcaaagctagtgttttctgttcagagaactgcagatgtacgggttgcaagaattacaagagtaatgcagatagaatttcccagaagaacactgttcatgcgcatcatgtgcagaatcctgcttcaagtgggatggttggacaatctgtgataattttccatgcagcagaaaatgactccagtctttcattggctgcatctgtgagcgatcattccattaacaacaacacttcacatgtaattcttttgcagcatacttttcaaatttgtcacgggccctgcttcctgataggctgatacttaatgtacaacacaatttaaggctatctactgcagcaatctggataagtgatgatagttgattagagaataatgcttttgtgtataaaacaaaataatccttctgagcaatcaaatggctttttactaaacctcaatccattcaattagcaagggtgcataaacagaatctgaaactctgtttgttgacatgcctccttgttagctccatttcaggctctttcgtgttcactcacttcttctgttactagagaagatgctaaaagtctcgtaaaatatgtaccacatgaagttacttacaggtgaaaattttctcatggtcataatggttttctctgttgtacttctttcattctactgtataacatatatttcattttttaaggccaagtttagcagacatcatccagatagaagatgtaaatgagctctgtaatcttttaattctagtgtcaagacaagctggcgcaacacttttaggtatttttctctctaaaaaacaatactagcgatgagttattcatattacagttgctacaatatactcttctatgacaatggaattcaacctctggctatattttacatgcatttttatttaccactgaatgttgggaacaaaacaatatgttggatcttctcagatgggaattgctttgttgctcctttagagaatttaataagagtgtcaactggagtgtaggggtgaagaaattgccaagccatcaattgacaactggccatctctcttgtgtaggcattaaaagagcacaaatcaagtatgatagagcaaatattattgaataaaatactgggactggtccatctggttatattacaatatagccatcagagattgagattatctagccatgtttgtatatctggtataacagaatttttccctatgcataaccatggaaaattcatgtttgaaccttcaaaagatgaaaattatatcattacaggtcatcgaaatcccccagaaagaaatgataatgactttcatgtagaaggcaatatagcctttatttgtaaccacatataatatgtttaatcatttagtgttttttattttttggggtaaaatcatctagtgttcttgtcattatgatctactagataacctgttgagcatattggtgaaatgcctccagctatccccttactatccacaaggcttgggtggataatgtactcttctctaaccgagcaaaggagccagaatagtcttgctctaagttgggagtttacaccagatggatttcttttcttgtgggaaataaatatcaaactataagttattttttcttgtgtggaatacctaagcatttctcaattggatattgaaactgtgcttatattctctcttttttctcaagaaaaaaaatatgtttatatctgaaaatatcaaaattacaatttcttcactggaactccttatctttttatggtcttggatgttgacttggtgataaattgcacgtccacaaccctcatgtccacatatttgacatatatcaatgcatatatcatgttaagtatgacacatgtgcttgttctttttccttgtttctctaccaaatggcatcatgtagccatacgatttgacgtggttgtggtatccagctaatgtagtaattaacaattacatcagcatcagttgtcatgcttagttgaatatatatgtggggaataatgcttcc

SEQ ID NO: 2905 - DNA, 2914 bp, Oryza sativa
atatacagaagggtaacaagaggcctctgtctcctggaacccaggcactgatgtgtgatgagcaagatgcagttttccaggattcaaaagctccagatgcaaccccctcaaccacagaagagaatctggtagacattttcaaagagcaagagaagcgtgtattgacaaatttccgtgactacctttgtaagcttgcgacctgcggaaaattgcaaggtgagtctttgtatgcactcatttggtaacgtaaatgcaaaactagttttaaatgagatactgaaaccatctaacataactttgcaactttccgactcttcattcctatcagtgtttatgcacacataaacaccaagataactgtgcttccttgtcacagaactgaagctctctttggcatcaacaaattgcagcgaacaagcctttgccgaccacggtaacaattcctccataacaagggttgcgaaggtaaccaggatcagacaaacaatccctcagttctccagcaaggcggcaagcactaccgctctggacgtctgatccttgctcggaccaaaatcggcaatgctggcatttggaaacttatggggcagaagagccctttgcacaatggcgtcgacaagtgctgagtgcatgggcaaacctgacgatacctccagtggcgctatcacaacttgattggcaactctggtataaattgatttgggccctttcttgggtactacattttcccactgccttgccatgtaaactctcggtgacgacatgagcggttctgttcatcttccaacgtaatcagtcgaattgccctttttccctactatcagagttcatgaatccatggaacggctgaattgacaggattgaacagaacgtgctagtggtgatggcatttgacaaggaagtagtattgcatatctttttctgagcaagatttttattagctagttacccatctgcttctcatgatctttagcacccaaagggcactcatgattacaatttcagttgacaaagaacatggcgtgccaacgtatttgattagcatattattacaatttcataccaggtataaagtaactacactttcctgcatatgccatgttctttgtcaaatacctggtgcttgcctgttatacgttttagcactatgtatactagtaatatgcccgtgctaaacgctacggtgcaattccattgtctttaataacttttaaaatttcatgttgggaaaaaaatttatatgatatgttcaccgtatcggctcacctttctacatttttcccctccctgttaatatttacctctgtatctgtccggcttcaattttttccccggtacaatcaggctgtggagctgtgttctctagaaagaaatccctccttccacatgtaaaatggaacgatgaattaacacaattagctaaaaaaactttaaaaatggataagatcatattactatatgccccgtctaatagtttaggaagcgtgcacgcaggacctttcaacgacaaagagacaacgtgagtgcaatttggagagacggcggcagtgacgctttaagcagccgcacgttgctggagatcggcatgagggatggtggcggcaactacagattgtcttctgaccatcaaattaaatatgaataactcgtcatctctttgaaacaaagggcgcttccggttctgtgcgtgcttcaaaccactttgtattctccatattaccatatctatagagtctaattttcaatgaggaactactgagttcaaatgcgaagacggtataataatacgctatgacaacagtgctgcggttatcattgataaaaagggaatccaaatggaacttgcgtttttggcgcaatggccgaggaattgagagaattgaattttactaaaatagtttcataagctcatgaagtattaacaataacaaaagggaaatttgagccttctttgttgtacttgctaattcaatgcaaacacatataagctgtaacagatggtttcatatttgagccttttttgctgtacaagctcattgcctgtaacaaatgctcattgttggaaaataagagagcagatcaatctagaagtcagctcctcctctagttgccaagctgcaaacgcatgtgaatggaaaaaaacaacacagtgggtaagttaggagaaggtgactttttctctttttctgaaggttggagctctgccattatattaagaagttggtttcagactacaattcaaggatattacatggaacaaaaagcaactgagctttcaccataaactccattgcatagcgaatatagttggccagtttattttttgttaaatttcctgcagatagaaccttgtggtgtacaaaaaccgatccaaagaacatctgcctgggttcatctggtgcccaacatagttctttcgaaattgttacaggtcattgaatgatgacatgagcactgattgcagctatcgatgcctcaaaaaatcctaagctattattagaggggcatcaagcatacagagttatcttgaaaggagaggctaagtggctatggagaagagaaattccactgaccgcttcttcatcgtcaatttccagccgccgctggccttcgtgagccattttgccgcttcgcccacagttgtccagcaagaactcaactgctgggcgctaccagtcgtcgcacaaccatctcagtcggaagcgctgggttgcttctaactaaaattactaaagaaaatccggtcatgaatttcacaacttgaagtccatgtgaaagaggccaaatcagtatggtctttatatttattctttgccttcataatacactggagagttgagcatgacgatattaactaaatgagccttgatcatctgggcatggtatgcttattatataagataaaaaaaatgtt

SEQ ID NO: 2906 - DNA, 4485 bp, Oryza sativa
tgcagcgcatctaaaggtaaaatgggtttcataacgtcaaaagatatcgggtatggaaatatttcacccaaacattctgatgaaatgaggatctacctttgtcatccatattggcacaaagaaaaatgttactgtatcaagcattttacagaagtaagcaatggccaagaagtagatgcctcacctctagctgccctctacctgcaacagcatacagcacggtggatccacggaagtcgagatactccgacacgtcggagcgacgctcgatgagctccctcagcatctccacgctgccgccccccgcggcggcgtggactgccctactcatcatttccagccagaacaccgaggagcagccaccaccgctcctgcgccttccccgttgggacaattcgtcgagcacctcggcgacatggcgtggtccagcagcagcttgaacacctcggcgttcccgcccctcgcggcggcgtagaacatgtccatcacgccatgctcgccctcgccaaacaccagcaagggatccctgtccataagctcctgcacgaacgccatgtcccccgccgacgccgccgagtagagcagccacccaccgtagcccgcccggagcagcgtgttctcggcggcggcgctgttcttgcactcacactccagcagagccgcgcaagggttaaactcgtcgggagcagtgcagatcgagggggatcgggggcggcgccgccgatgatggggaccggcgatgcgggctgaccgggggcggcaccgccgatgatggggaccggcgatacgggctgaccgggggcggcgcgaatgcagaccggcgacgcggaagcgagggatccgggtggagggggcggtgatttgccagggggaggggaagcgatccggtctggatcggatcggatcgggaggtgctcgagagaggcgcgcggtcgcgcgaatgcggaggaggcgcggtgattgcggcagagaggggggtgtgggacgcgcgctgatctgggacgttggatccaaaatcttcagatgggtttcgaccgttggatatgtgatatgatgaatgagtaaaactatttgttcaactatagggtagatacataccgagcatctcacaagctactattattgatatgaacacgaaattgtaatcacatgcgaaatacgttggtttttttaagttacagaaaattgctaatcgttattttagtattttgaagttaaattaaaaaaaaataaattgagagtagtttttatagatctccaggatttgccggcccatccttcgaagatgctcataggggtagggtttgcgtgcacgcattcataggggtgagtgtgcatgcgttgtgagtgtctgtgttgtaccgtgtaattcttaaaaaaaaaatcgtgttaagaacttaagagcaaaaagttttgcaatcatataaagatgacatcattctagacaataaggttaaactattgaattgtatcatatgtgaaatacgttggtttttttaagttatagaaagttgctaatcgttattttagtattctgaagttaaattaaaaataaaattgagagtaggtcttataacctgtagctaaattttatcgtgttaagaacttaacaacaaaagtttcccaatcgtaataagatagcatcattttagacaataaggttaaattattgaattgtgtgaactatagttataactaatataatttgaagacgtctagcaatatttgagaagaaaaagacgaataagtaaaatgcaggcttacattaatatactcgctcaatctttacaaatacttttaatcactatatctactacatataaaattattacattctccatttattgaatcaaataatactattagcaaatcaaaccagctcaggctttggtcgttggtaaaaaacgtttttttactagtctggcttcggcttcctgaccagcggtagcgctagcttggtgagtatctgtcccttcaattgaggacaaatttaactattaggtggcaaccctctaaacgcccgattagtgcctctctctccctcttcatctcaccatactacccccttcatgctggtcgtctcaatcttatagccacctcgctagccgttgtagattggtagccaccctaccaattgccggaagcctccctgttaccatgcctgctcattgttggaggagctctagcacaaggtaagcgttgaggccaaataactcgccaggcgataagaggaagtttggtgcaggaggagtccccacttagaagtggaggtatttttttaataacaatgggtctccaaggacaacagttgtgaagagagacctagcggcagaggaactagagggcgtagggttccccaggttaggatgtgacgtcaagctcgtcgccacccaagttccaagatgcacaccttgtctttgtcgagctcaagcggtcacctcatcgtcagggttgacgccctccttcatgttagagctagtttgacaactagcgggtacaacgatagggactttgctatgattaaggtggctgttaggctttaacagctagcgaagaaatgaaatataaagaaattgctaaccttgctatgctagcgggccatgtagataaaagtataacaaaccacctttattggatgataattttgtgaagacaaaattaaaaggaggcatttagctccctctatcaaaatcctcttgcttaagatcggagagacgtggtcgctgacacgtgggcccgatggcaatgggctccacgtgtcagtgagacaaatgactactctcccaaccccgtccccgtccctcccctactctctcgccttctgttcctccccctctcccttccaacttcccaagcgcgcgcggggagacgatcggcgacggcgacggcgaggcggaatggacagcgggaacgtggtggtgtgcgacaacggcaccggggtaagcccgccctccccccctcctcccgcagcctgatccctgatccagcgtggcgacctccctccctccctctctacctccacgctcctgcccctagatctgcaccccctccgtcccggttcttcttcttggacggtttcttggatttcttctgaaatttcctgaatatatacgataggattgtttctctctctttggttggggagtaattagcatctgtgctctagattcatttgtgccgaataagttttgctgcttactactgagctgtaattaatctaggatgaaatgatacgtgtgcacattgcaagaaattgaagggggaaattgctctagtatggtggaattattgttctccacataggcaggaaaaattgctgtaatacgatgagattattgttctctgttgaatctttagataatgtccttccaaatgcggaactggaatagataatgttcattcatataaaccacattagtttgatattttgcggtccaaaagaaattatgctgttgtctttggcttagtttctgttaagtattttccacatcattcctgtggcttgatgttcgatatgcttaaagccttaaacaacagcagaacatatcatattcataggtgatcttgttaatttctaattcggtacctaatggctaatgttgcagtatgtaaagtgtggctttgcgggagagaacttccctacatctgtgttcccttgtgttgttgggcgaccattgctccgttatgaggagtcactccaggagcaggaattgacggtctgaaatcaatgtctatctttgtgtttctggcattccctcattctgtctctctctcagtacaccttataattgtgattgtgttccacgcaggatattgtggttggagcggcttgtgctgacttgaggcatcaacttgacgtatcatatcctgttacaaatgggattgttcaaagttgggatgatatgggccatatatgggatcatgcattttacagtgagctgaaagtatgacttttcatatgatttatattactttaacatcagacccttttaaatttatatgctcataattcatcaacattctccgttatgtgtcttgaaatctcttagctctaggtaaatcaatgtatttctattttgtttctttaggttgatccttctgagtgtaaaattctactgacagatccaccactcaatcctgtgaaaaatcgtgaaaaaatggtaggttgttttctcccatctggctgttctgtactatgaaatttgttttttaagatatcactaactagcaaattgaatcctacgataaatagattgagacaatgtttgagaaatacaactttgctggggtattcatccaggtccaagctgttctttcgctatatgctcaaggtactctctctctctctctccccttccccccctctcagtatacagacacatgtatgagcttgcacacctacaaacacaaaatgtactggttcttttcttaacatgtattatgtttgtatcctttccaggtttgctgactggacttgtcatagac

SEQ ID NO: 2907 - DNA, 30014 bp, Oryza sativa
aacgtgtgtagtaagtagtaagcacaaaaagttaagcaattgaatactgactattgtcaatttgcaatggaaagaaagttttatctagatttacttttgcccgtcatgtttattatgatccaggtgccggtagttgatggattctcttacccacatattacaaaaagaatgaatgtagctggaaggcacataacatcttatcttgttgatctactctcaagaagagggtaatactctttatcatttttatatgtttgtagataaaagatgctctgaaaacacaggcttatgcaattgtttgcttcagtgtttttcttatcaacttaatttcgtgctttaaaggtatgctatgaacaaatctgccgactttgaaacagtccgggaaataaaagagaaactatgttatttaaggtcagttgctttattgttcttaattgttttcgctatagcttgctgtcacatttcatagaattgaaaagggaaaatatgtacagctatgattacaagcgtgaataccagctaggacttgaaaccactatccttgtcaaaagctacactgtaagtatgttaacctgctttgtttctatttggtccctttttgtattattggctgaacttttgtcatcagcttccagatggaagggtaatcaaagtgggcactgaacggtttcaagctcctgaggctctttttactcctgtaagcttgtactcatactattctttcatagcttgctgatatacattaaggcatgcatttctctgttaggatcagtaccaacataacattgataaaacatttgttgagcaggaactcatagatgttgagggtgatggaatggcagatatggcgttccgttgcattcaagaaatggacatcgacaaccggatgacagtatacagcttacccatacaatatgctatattttgttgctccaatcttttcacttgcttttgtttatcttcaagtatttatttgtaacattgttgatgaattgatgagttagatatagaacctctgtagtcttcaattgaaatttcgaaggcacactttgaattcaactacacatggcttgtctagtgaatttgtgcataagataatctttgataatttaggattactttgttttgttatttggtagcaacttgataagaccatggttttgcataaaaaatccacttacatatatacatgatttttatgttgttgtcttaaattagaacttgcacaggtaaacaccataagttgaattactgtcaaatgctgaacacacttccaaatgttgataatttttcatatttagtacatgtgtatgtgttaatgtaaattaagtcaagaagggacaaataaatgccagttatgttagtctctatacttgattaattgtattttaagttgttatgaagtacttctagataagcattggatcatgtgttcttctctcattggatgtctggataacatcttgcagctttatcaacatattgtcctgagtgggggaagtaccatgtatcctggtctgccaagtcggtaagatttgacaaacatatcccgctctgtcttcttttgtttactacagtacatattaacgattagtttcaaacaacactatttttacactgaagctcacatcatttttggtggtctatgccactctgattttttgcctgttctatttcttaccaatgtatgtgtttagctgtttttataagcttcaatattgggtatgacttaacacattacaacatttttgaagactagagaaggaaatgcttgatcgctatcttgatgtggttctgaagggaaacaaagatggactgaaggtaatatttttttgtggttattttgtagctgacaacagttgaaaatttcataagcttattgaaatcaaacacaaggaaattcccaagttttttttccagtgcaacacattttcttattcaataatggatgttgtcttttcagtaaggaatgtgaccattttcacttctgtctatgtgcagaaattgcgtttgcggatagaggatccgccacggagaaaacacatggtttacctgggtggtgcagtactcgctggaatcatgaaggtaatatacttttcccacagcgttatatatctatcggttattataagcaaagccttgggacaaagtagagaggtgaacagaaaaggagcccaaaagatgaaatcatgcattactgtgtgtgcattgtcgcatgggaatctgctcattttgctttattactttgctgacggctgttcacctagcaggattcacctgaattctggattacaaggcaggaataccaggaagaaggccttgcgtgcctaaggaagtgtggacaagcatagccgtcgagtatgttcctatgatcctacctagattctcatcaacagcagatgtgaaaggctctctcattctgtttgcaggagacaaaaaggaaacctatgtttagatgatggatgcacattacttgtagaaagatgagcacatagtgttgtttgttgtccctattgttcaggatacttgttggtgcatgttgtagcctagaagccactatgaacacaaactcaccatataaccatgatgagcaaacattagatatatttcattttctattggtaatatacctatgaacacaacacatatttctacttactatattatgtactggtgagctgatgctcttcatttggtccctgtactgctagggcaaatcaatttactgatagggaaagtcaatttacaacgaagcccttaacattagaattgctttgagatttgtgcggatggcatatatttcaatggatcgcaatattgtattcttctttttagtatatcgtgaatcttaacaaaacatctaattgttcagcatagcacttatattgtaaaaatcatcttctctactgttgtatgaaactttttgctgcctatatttatcttcatccaagaaatctgtgagtttcttaatcagctgcaaacttttagcaagttctgtgctttaactcagcccatttaggaaaggtcatgttccattttccaaaattgtactctttgctcaaatatattttctgaaattgtttcttttccgtgtttggtagaatttgaattattttccgcattttaacacaagatgtttggcagaatttgaattgttcaccgcatttaacacgaagatattgtgctaaatcaatagttaaatgccttgcatacgatgttgctcttggtgaacaacaatccattgtccaatgatgtgcaagcggggaattctgaatttatgagacgcaaccaagccagggtagtggctccaatgattcaaaaatgtaaggattgcggaaaccagaattgaataaccaaaggaatcccaaaattacagagttctagtccaatctgaaacgaacggtaccatcaaattcctctgaatatgcgtgccaggatacctcttttgcctttcttctttttttcttttcgatcttttgccttcctttttttttttgataggaaaagcttttattaacttaacggcctggctaaattgccatccaccatactctccatgcccgtaggcgtgccgtcccaggaaaggccagcattcagagagcacttacaacccaactccgcaagggcatgcgccacacgattacaagatctagggcaatacaaagaagcaaaggaagcagcaatcactcttttaatctcaacgatgacgccttccttccttgatgatagggtggtgatggcagattattagagtcttttaaaatggtatagcttattgaggacacatataaatgaattaaatattacaaagttgataagtttacttattaagacaagttcttaaaaaatactaatgaagtttctgcaaaaaccacacccaagcatattcgtggtattttggtggacataatcaaaacttgctccctccatgttttttttaaataatagtcggtcttgacttcaaaaattttgattcggttttgatttatagttgctctttgaacaactatgtttttaaataatctaattatttagcaacaaagttgtatatattcgaataaaaagcattttactaatatcttacatttgtacctgttcattttgatgttgcttaaacctatttgtaataaaaaaaacttgatctcgtaggaagaaaccaacactactttctgtgaaatcacatactcgcttcaaaaattttaattcggtttttatttatagttgctctgctttgaacagcaatatttttaaataatctaattatttaccaacaaagttgtataattagattcgaatcaaaagcattttactaatatcttacatttaaacatattcattttgatgttgcttaaacctatttgtaataaaaaaaaaacttggatcttgtaggaacaaacctacactagtttctgtgaaataaagtactgacagtcaagagatatcgctgttctacaaagacagactcaaacctgaaccctatcagatgccctgtgctgggacaatataacaagagatatcgctgttctacgaagacagactcaaacttaaccctatcagatgccctgtgctgggacaatataaacaaagtcttgagcatcatcatgcaaatgaagccaacaaccatatccatctccagaagctcgattggttcgcgagaaatttcagccgtgcagtttctccaagtagccaatgcaagcctttgaacctgggacatagccatacctcgactggtaaaaaaggagagtaaaagagatgcagaaattattcacaactggcttcatagaatctttttcactcatgtgaacttcaaagtgaatatctgaactgcagtaggaagaagtagcttaccttcaacttcaagtttctccaaacacaccaaagaattacaatttactcatgttaaattgatgtacctagtattatggcccacatctttaagcgatcgtgcctttacaaaatctggcaacaatgcgacttagttcttcaaccttttctcgcgtgtccttctggtaagacgcactcttttcaattgctcaattaccaggatggatattccattcgagctctactcaagggaaagtcaaatggaatatcttgccaatggtggcggatcaacataatttggaggctatggtacaacttgaaccaatcaaaagaatgaacatatcatatcttgccaatggtggcggatcacctcttgtaaggcttaatgtgatatggtttgaattcttcaccaaattttgctgcttcttcatcaacccttttcttcagccttctccaggtcctcaacatgtctgcttgtattaaaccacgatatagtgtctcaaaggtgatcttctggggaagaaaacctctctctatcatttccatgaaaaactggcatgcttccctccatttcttattgtcacataaaccatgaaccaacaaggtatacgaattgagatcaggaccaacagtgctctcacacatatcattccaaacttgcataacggtgtcatgttggttcaacttgataaacattccaagcagtatgttgtaagtgtgaatatcaggtgtggctggtgaaccaggggccttcatcttattgtacagctgtagggcaccattcacatcttttctccctcgatactctttgaagaaacaattgtatgtggccggcgaggggcatactccctcacttgccatctcatcaagcaagctctcagcatcatccaatctcccacaggaagcaaggcacttgatcacagaagtgtaggttgccaccgtgggacaaatgcctctctctttcattgagcggaacatacagagacatagttcaggtttatgcgcacgactgtaaacatgcaggatgacagagtagcttgtaacattgggttcgattcccctttgatgcatttctttcaagagatcctcagctgcacgaactgttctatcaaaccggtaatcagggtgcaagcttgcatgcctacagataccattgaggagaatgttgtatgtaactatgttgggttctatcccatgataaatcatatcttttaggaacttctgagccatgtcatttcggtttaccttgcaccaaccataaattagaacagtgtacatcttttcgtttggttcatacttgtattttcttttgttgaatacttccgctgcaacctgcagtggtgacagatgagtaaatgacaatgattagcagaagaaaccatggagctgtcccctttaacaaggaatgttcacaaagcagccaaaaaatgagttacaggcagacagttgatcaatgtaattcaaacactagcacgcataaagtatgtgtgactgtctagctaacattgattggctatcaactcagcagcagcaaattctagaatagtgaaaagcatcagaagttcaaaacgcatgaagtagcaaagacgaacaattctgttgtaaaaaaaggtctaacatgtgcaagaaatggttattaggaaaactgaaactttcaacagacaatgaaggttcaaaatcataactccatattcatcctaatattcagagataagcaattgcagcacacttcaatgaaattttgataaacatacgacctaatattgtaccggcatgagtctggtactctggtacctgtcattctagtgttgctctctataggtttctcaacagataacacaattagtggtcaaatccaatcctacactaataacatattactcaaatcagagttgctcggttaatgttgcttggcagcacaataaaaagtttacaaaaatgtacagaaaaaaaatattcacaagaagctaaatgcctaaacatgaagctcatgtactaacgtcatccattaattaagaaaactcctaagaaggaactattcaatataagatgtgaatctacccataaatccttgtgcacaatgaagtgtaacaaaaggcaaacagttctaggatgaatcaacctaacaggcaatatcagacacaaaatattcatcagcgatactagtgcacatcccatgaaactgcaactacaaatgttttcttcactctacaaaccacgtacatgacaaggccttaagctatacaaacagattcatactacgcgaacagtagaaaacacagctcatactcgttacacaaagtacattggtaatttggtatgcttatctgaagctcgatcgatactcaacgaattaatcaaaaccacactttcacaaacggctactcaatgggctaaaattttacagcgtgcagagaacaaaagaatcgaaatgtgtgaagctaaggcatttacactgaactcaatccagccaaaaataatctcagggctgaacagtgaaaacctacgaattcattcagaacatcctctgaaactaactagtgaccaatctttatcaagccaagaaagttagctatgagcaaataacctttggatacttgtacttgcagagggtgtcgagcagcgtggtgaactcggcggcgtcgggctccctcccgacgaacgcctccatgtcgtcgaacgcgcgcaccgcctgccgcgtcatcccggcggcgacgtacctcctcgcgagcaccgcgaacgtgcggggcgtggcggcgccgtccgccgcggcctcgacgacgagcctccacgcggcgtcgaactggcgcgcgcggccgagcgcgtccacgacggcgtcgtaggcgtcggcggcgcgggaagaggcggcggggggagggtggaggcgcgcggcgtggaggagcgacagcgcgagcttggaggcgccgcggaggcggaggaggagctggacgaggaggtcccccgtgagggagacccccccgccggagaggagctggagcggcgactcggccgggtggaaggggttgtggtgcgcaaggaggaggcgggcgagctcgtcggcggccggggacggctcgacgggcggcagggcgaggaggtgggtcgtggtacagaggaggcggcggctggcggcggcggcggggagatggcgcggcatggcaggcggcggcggcgtggccggagttggtggatggaggagcgtggtgaagcggtttggggtttgggctacgaaaatctgtaccgttggttttggttggttggacggctgagattggaggaagccgcgcagttagttctgctgccactgcagaatcgcagatctccaaaagaaaaggaaatgtaaattaagtaaagctgtaaatacttttgccaaactatctcaaaattacgtatttaaatcgctgtgtcacgaaaccatatataaccaaatttatcacagagctacaatgtttaagatggaattgtggagtatcaaaactacattttcttaatattctttaagtaacattttagtaaaacaaaattatagaactaatgatattgcaccaatttgatcagacaactataacgtttatagcttccacagaacaatttggattagggatttaaactctaaacttgcagttttgtaacagcttcaataataaatccttagttttatgataatttatcttaaatatgtagtttaatttgtgataaatttgatactctatagtgacatgatatcttatatttttagttatgtgactatttgctcgaagtatatgtagttttctgaaattcgctaaaaggaaattcagctacaggagcataaatcaaggttgttttttttgtggggataaatcaaggttgttgttaggtgttgttcggttaatccctttcgtaacgtgttccacatctattaaggtgagtaactagttggtaaaattttgaaccagctgatttcctattccatgattatctttataagcttgcgaaatgtggaagattacaaagtgaatacatgactatctttgtgagcttgtgaaatgtagaagattacaaaggtgagtcatagtatacgcttgttacataacagaagccatcttttggtgtctaacaaattgcattgagcaaactgtcgacaataaccgtaacaattttgaccgtggtcgcagtctcgtagagaatgacatttatacaaagtgaggttagcttaattatatgttgatatctccggtctgttgcaattattatatgaggtttggccaaataatttttagagaaatattataaagacccccctaatagtaagggttgaatatgaacctttagtatcaccttactatttgtagagtgacaccttactattattaatggactctctccgttaccatgcaagtaaatttggtaacgtgaaagagaaaagggggaggaaaggagaacattgttgctacacataacaacgactctaaattttgttacatgatggtgaggtaaagaaaaaagggtaataataaattattttttgcagtaatcgttaagaggttttgttgtctcaattattataggaggatagcctttaagtcatatgtattaactaacaacccgtatcaaactctacctttgtacatgccttgaaagggtgagttctccgacacatgcatagatggcgcgcgcgcacgacgtgcatgtgaatgtccgctaaaattggatccttatgcttgcacagacgcatcttagtatttgtggtgtttgaaaactcatcgtattcttgggtacacatgacttaactagtttagttagatcacacgttctgatatctctataaaatactaagtcaccatcttcatgcaacacatatgaaaataatctaggatttgcctcattctctgtactgcactgtcattcatggtctactctgtcccaccaatccgtgtgcatgtgtgatcatgagagcaggtcctcggatccatcatcttcgatgtcctgcatcgcgagaggattttgggaagcgttcaacacgtgtctgcttgttgttcatccacaatggcacatcttcttttacgcttgggcactgcgcatcgttgtcaccattcatagcatgcatcatacgtgcaatacgtgttgcttccttccacaacataatcagaaccgtcgggtatgtatcaattatattttgtatgtttgtatctgtcgtatacatgcctatattgtgtggtttacatatttaatatcgtgatttatttaatccatgtctctatatttccaacaatatcatgacttgatcgaacaactctagtttatattgatctggccctttgttgggttgcatacctgctgtattttctctcccattttttgttcattcatgagttgcgtagcccactgcaaatcctcaattcctcaccaaaacatgaaatctttctgttctacctctcatgtcatcaagttcatgattcatgattcatggatatccatgggatgggttgtcttgacaggaattgacaaggaaaggattgctttatctttctatgggctttgtataattccatgtaggtgagaacgtagtttcccaaaactttgtggatcacctgtcgaaccttttgctttcttcataaagtatcaaaaggttggagcatctctctggggagatgaaactggtgcagataggctagtgattgcttatcgtttgatttttttaagttaaatttctttatgattgactagatttatagaaaaaactagcaacatctataacactaaattactctcactaaatttaacattaaatatatttgataatactttttccaaaaatttgggcaaatataaaaaaaatgatttagaaagcagccaaacgacttagaatatgtaacggagagagtatgttttagcactttgtataccatgctttactgcttttttttttgtttccgtgtatgtaaaaggtttccaaacattctgctgtaacaggaatgtttacatgtgcgaactgtcaactgtttgacgtgcgatgggagaagtgtgtgtgttgccttttcatgacatgaacagtatgcatctccgtgcaaatgaatcaagcaatttaccttcgaaaagccgcatctgcaaaactgttttgcgatcatcttttaaagaaataataattggatcaatctggaatacaaaccgaccttagctcagttggtagagcggaggactgtagtcgttgcagatcaatccttaggtcgctggttcgaatccggcaggtcggaatatgattttaatttttccttttttaaatctcctcatctttgtgcagcaccgggggaattgatgaagccaaatagccaatgtattgctcaagatcttttttttaacaaaaaatcatgacataccgtaaatgcaagtaatgctggttcgaatccggcaggtcggaatctaattttaatttttccttttttaaatctcctcatctatgtgcagcaccgggggaattgatgaagccaaatatccaatgtattgctcaagatcttttcttttttttaacaaaaaatcatgacataccgtaaatgcaagtaatgtttgtatcatgctttgccaggaatcacatggagtaaacgaagttcagcagaagtctagaactccagatccacatagaaattcttttagtctgagaatcccttttttttctttgaaacagatcaagtcaatctcattgctcatcactaaccatgaactcaaaatgcatgtacaatgaatccaggcaagcattccatcaaacccaaccaatttccatccttttttttgttcttgctggtaaagactggagtttctagccattcccagcatttcttttgctctacttcttctacatctacctctctactcttagtttcactatggagaacacaaccacaattacaaccatggtggggatggttagattcactcaatggccggcttccattcctaatgctttagctctccttgcctccaagagcttgtctttaagatggagggaagaaccggttgaggttgaagggcagggtgtagaactcctcattccggctgtcgcctctgaacgtcctgaacctcgcccaccatggcatcccccggtccctcgccgcatccctcacctccagggtgttgtcgaggatcaccgcgacgatcagaccgacggtcgggggcgaggagaagacggtgttgatgtagtcattgaactgccacacaccacacagagaaaagagaaaaaaaaaagatcatgaggtttataagtttcagaacacaacttcagaaaaaaaattcagtttcagtggacatacccatcctgccctggtgtgtgcagggccgtgcagagcgctcatggtgtagcggaagaagtactccgggatggaaatgccgaggaacagcgagacgccgatgatgaagaggctgcgcatcgagttcatgttggtgaactgcatgaaggagagccccactgcacctgagaaaagatccagcaagacatgtgttgtagagggttgaaatcttggtgataaaatgaatagatataagaaagaaagatatgtgagaagaacatcggtaattttgatacctaagacacttaccaacatatccaaacatgacgcagtatatggcggcaaacattgtgaatggaatcgaagcaaacagagccccaaatctccctgaaatcatgagacgtgttgagaaccaggaaaggtgattcaggatcataatctttttgtgcagaaaatgtgctacctagaatggagaagaagatcatgaaaccagcggagatctgtatcactcttctgctgccaatcctggttgatccaagaagaccaatgttctctctgcgttggcgaaatcgtatgcattatgttaggaatacatgatagtgctagaggatatcggagagtaaatagttttcgataaagaaggaaaacacttacacagagaccgtggagccagttccagtaccaaatagcccatcaaacagcagcccaattccctgattgttcacataaagggcaaaagcattatactcctgatcaacagcagaatacagatttttgtagagctactcagatcctaatgctactcagatgattaaattcattctaagaaaggtcttgcattcatgtggccaagattctactaatctgatcacaactaggattttaagaatggccttgcattgtgtaatctttgaatatttgcagaaatgaagaaacaaacctgccatccaatgcctctgctgaggacatatggtggtgggggtgttgcactcgccaaccgcgcagcagccttgaatgctccagctgactgaatcactcaaaaaattgtcaccaaatcagatcagtataatgacatatgctaacaagatacttatcttaaacagcttggtatagatttcacagtaatgaaatgttacctctatcaaggacaccacaacagcagccatcataccaaatgcatgatctgcgctgaatgttggcggaccccattgcagtgggtatgggatgtcaatcctgaaaaaaaaatatattttttttaaaaaaggatgaacattagaaatctactagtaccaaagatcacatgaaaattgaagaaaaatccacaaagtacaaaccagtctgcagaagtgatgagattggcacggtctgttcggcagtttatctgggtgagcagagaggtatgtttgtatgtcccacttgctgtgaggatgtgagcataaacccagacaagcgcgatcgaaatgagcactgagaacctctccaatatcggaaaatggcgcacttgtacatgcttcagatattgggaaagagcaacaaacaggacaagcattggaagcccaatctccacgcacctcccaatctaaaaacacaatgtccatatgttagcttaacaaccaagtaagcagacatagagcatacttattctagtttgtacaatttgataatcctcctaagtgtaaatatgtgtttgatgctactcaaaatatcctgatttattgtaaatgccactgtgtataattcaatcatagaaatgaaacacttcaactttcagttccaactatatgaaatgatcccaaatggtcctgttgaaagctcccaactaggaagcatatgttcgcatagtgccaataaccagttaagataaagatagagagtaagcgggtttagcaaagaaacagcactagagactttaccactgggaatcctctctcgaaaaggccaagccccaccagcgcaaccaccggaaccatcccaagtggactgaagaacctgcaacatgacaccgggaaattttaagattcttatcgtcaatccgaagggtcgcagccatgtcctattacttttggataattggcatttggcactctttgattttagtatattagcatgatgcactttgtctctaaagtgatgcccacttctcacactgagagaaaacaaagtggatgtcttaagggcccagggcaaccagggctattataaagaataaccagggcataatctactgattgatcatgtgctcctaatgtcaacacgcatgatgccaaaagttacacaaacacacaaaaaaggctttggtagaagacaacccttacttgcaatataagtaaaccaaaacactgctcagtctcatgttcacttgtccatacaagttaagaagaggaaaaatacgtctagtatggacaaagcaagaatttggatatttggactatacgatcaaattggacacgaggaagttgtatgtacctggagcatatcccccacaactggctgtagccaagaattatttggatgcaggaggatattattaaagccccctgtatggctctcatagtcatgataaacctctgcaataggataaaggacatttaatcattattatctaagaaaaggaaacttttaataaataaatgaaacttgtgatgctgaaatgaccactaatgatattgactatctagaagggggaaaaaaccatggcatgcttacagtatggtcatcagttatttgtgccagtgatgggtcttttattatcgatataaccgggatcacgaacgcatacgagcctccgatgatggtcggaagccgagttccaaacaaagtttggagcattgtgtttatcccagtcacaaacagcatggtttgcaccacctttgccttgtcatgctggaaacaaaacagacaaacatgtacctatcagcatgcactccatcacaaaagcagtgactaaaaacatcattatctggaaagagagttgctggacacatgcaagtgaagtgaccaactaattcgagggtactatactatcattcatagagccctctccctacgagcatcttatggaacaggaggtaggtaccaaaattcatttatctgatctgcagagtacaacttttgtttcatactattaaattccacaagcttaattacaacggtacataaatccaatgcatttaaccagaagattcatcttgaaagtagtagcatttattattacaggatacacactacaatgatttcaataactagatatgagtatatagctgaatggataaaatggcatggtaaaacagtgaaaagattcttacagcatttccacccatgagtggaaccagtaaggtggggatcatcacagccgtccccaggcaaaggatgtaatgctggaaccccagggcaattgcctcccctgtaccatgaaaattaaatcacacaaaattaaataccagacaaggaacagacagatgaaccctacaatcctagtcacttcagtgaaatcattatctgtacataaaaaaaaaggagcttgagtgaaatgacaaacttaccccaggatgggttggagtctatgcagtactccagcccctgcagctgatccattggtggatggctgatctcctcttgcttcatgtcagccatctctacagaagcaggaacttctcccccttgttcttctgcttgttcagggtgatctaacaattgccacaatgagcaatcaataagagaaatcaggcttaataaatgtgattgagtgggtagttaaataagataggataggaaaggaaagcagtaaagaaggaagctttaagcaactttattggcctataggctatgagaatcagatgccacaggaagaattccccagagaaacaaagcaaaccccttttaagccctgaacaaaaaagaaaaaaaatgtgcctttcaggcctgcaacaatctggcagctggcttgcaaagattgacgcccttaatctcccaaaacatggagcaaacatcgcaaagacaagattttgtttttcatcactgatcaagaaccattccaggacacacccactctacttgcaaaaccctcaaacaaacatcaagaaagccaagaaaaccaacaaaagaaaaagatcaccatgagcaaatgctctcacctgtcaagaatgctcaccctcacaaaaatttcccaaccaacgctagcaaaacacagcgcaaaagaaactaagcacgagtaggaagagcaacccagcaaggcgccgatttatagccccagaatcgaaacggctagctgcaggaatgaatgaatgaatgcctaaaatgaacaagatcagtttcttgcgaatattcagattttcttttccagctgagcaagcggagggaagcaagcaagcaagcagtaacagcagcagcaagagcagtgtctgtagcgcgaggaagaaagagagaatgagagagagagaaagagaagtgctccgggaaacgtcaaaaaggctgtggtggccaaaagaagccacagggatcgatcacacacacaacacaggcagcagcagcctatcagaagttgcaagtaaagatgagagagaaagagtagtagtagaaatggatgaactgaagctgctgtacatgactactcgagtgagtacacgccattactacccccctagcaataagctttctctctcctacacgccattacagcccctttctctctctagacttattttttttttctaggtgagaaataaatccggcagatactttccttgtcataggagtagagagagaccgatagtccattgtttagtttatatttatgcttaggcctgtttagttccaatttttttttctaaaaacgtcacctcgaatctttggacaagcattaaatatagataaaaacaaaaactaattgcacagtttgcatgaaaatagcgagattaatcttttgagactaattagtctatgattagctataagtgctatagtaactcatatgtgctaatgacggcttaattaggctcaaaagattcgtctcgcggtttccaggtgagttatgaaattagtttttttcattcgtatacgaaaaccccttccaacatctggtcaaacatctgatgtgacattcaaaaattttcttttcacgaactaaacataccctcgtactgctagttggtaataaaaaataattcatgggtatttttttacaatgtcctaagcggttcaaaagaaaatactgtgaaataaattatgactgaaccatatataaaatcaacttcacaattaagtttaaaatttttttttttcttacaagcataaaagtaaatgaaaagatgggttctgagatgagaaaggatgcaaaatgtacccctgaaaggtggggtccacgttggtttaaccaatgcactgttggcattcacattttcacagagcaaagaagctgaatttttctctctctgggagagtttttgtctggcacagtgccaccgcaggcagtggagttatcctcctgcgagcatctgaattggcccgttgggatttccctctgaccaaattgccctccccctgcctgacaggtggggacccattgatcgggtgctttgagattcgtgcggtggaattctgcttctggctggctagtggctggaacaggtgtagatgtttggttggttatgcttaaattagtgttttaattaagcaccttgaatgtgctagtactggtttgagtgattccttctttggaagtgctttggtcatattcaattgatttcatgaatgggtgcagggtatgtaccaggaaaaggacaaaaaaaaggttggtgaaacggctgagataatgttgctgaaatgtttttagttttatatagaataataataaatattttttactgattagtcttaagaaaatttacagctgtctgatttttttttcatgaaatagactcttgtgaaatctaagccatccgatctagatccaattgagtaaggttttgtaaaaagaaacttggtagtgaaacatgacactatttatgtaaaatacaattacgctttagaaagaagaaacaaatggaaacaacaactcactatggctcttggcacagacaccgtcctaggcataggggagatcaaaataagaagtcgtacctagatgacgacgcccgtcctgggctacgggaagtagatagataggtcgttcaactcttgtccccgaagataggtaatatgttctcatataatgttgctccaactttttttctcgagggcctaactggtgagattttatttaattgtcatgaactctagtggattcactgtgtaaaccaatgaaatatgtctataaagtgaaactttcatgtagtaatactatttctttattgcaaaagttaaacagatcatatagatgatgatttcaatactactctactagatctccatgtactttttgagaaagaaatgaacatcttgtacgccctcatatccaaatctaccatgataaaagttatgtgtgcagcacaaaacaaaaaaaaaacaatacaactattcaaaagtttggatctttagatctaaactttttgagtcctcatgaataacctaagagatcaaactcaagttttttaatatcatgaacttccatttaaaactaatgaagattgaaaatatgggttgattacacataggtctttgacttattcttcagactggaaatactacgtatctcaaactcagatctagatctgtcaacatgaactgtgcaaaaagaacaactgcaagcttaaaaaacaatcaaatatcatcacaagtatcaaatagtttacccgttgacggttcatggttacgcgcaaaaatgatagcatctttaccataactctcaataggcatgagatggcagctacctgcagtaatagcggtgagagtagggcttgagcaccattccttccaatatagctaatcttcctcatcatgttgtagatctgggatatccgaccacaatttttggccgaacgacacgacgtgctccatgagacctgccattaggaattctaagagagactagtagcaacgaaggagttggtgatgatgaatagctagagtatggtggagatgtgtgctttcctttctgctgaggtacctttaaatagaggggaaaagttgccctgcatactgctggcaacgtaacgcttgaaatgtctgtagtgcgacacaccattttcttttaaaaataatatcgcttgaacttatatcttaaaattattgaataatgctggagataaaatgcctaaagtgtttatggtgcgtacacagtttcctcttcatttttctttgaaaaatttacaattgagccatatgtcctgaattttaccttgtttctttattattattacttcccttttactatgccttccaatatatctcatcttcctcatcatattgtggatctgggatatctaaccacaattcttggctgaacaacacgacgtgcccaatgagacctaccattaggaacactaaaagagactattagcagtggagggtttggtgtctatgaatactgtggagatgtgcgctttcctttccgctaaagtacttctatatattgggggaaagttgcccagtttactgccggcgatgtaacgcttgacgaagaataacgtgcagatgtgcactttcctttccgttgaagtacctctatatattgggggaagtaacctagtatattgtcggcgatgtaacgcttgagcctatatcttaaaattattgaataatactagtgatgcaatgcctaaagtgttcgtggtgtggtacaccgtttcctctttattttttttaaataatttgcaattgagccatatgtcatgacctttgccttgtttctttagtattattacttcccttttactacctgcagcaacagcggtgggagtagggcttgtgcaccataccttccaatatagctcatcttcctcatcatgttgcggacgacgtgctcaatgagatctgccattaggaacactaagagagactattagtagtggagggtttggtgacgatgaataccgtggagacgtgcactttcctttccactgaggtcgtacctctatagattgggggaaagttgcctcgtatactgccggcgatgtaatgcttgaagtgtctgtggcgcaacatgtcatttgcttttaaaaacaatatcactcaagccctatatcttaaaattattgaataatgttggcgatgtaatgcctaaagtgtatgtagtggcacataatttcctcttagttctttttgaaatagtttgcagtcgagctctctatcttgaaattttcaaatgcacccttctttgttctttagtattatgcttccaccctttttttttttactattctgaagtagtagtgagcgcagggttagtcgattatatttgcattgaggcaaaaaagggacaaagattgtgatccacattatatgaaatggtatagtacatgtgcaattaggggcattaatttagtgtgtgttgtataattttgttctacacccatcaaacaaaaggaggaaaaatttgcttccagtttcattatattagaaagtaatgtttaacatgttagtataacaaaaataccttacggagacatctttttattactatagaggcattttcaaaaatatctcattggggccttacggtgaattgcctatacaaatgatgacacattttataaaatgcctttgtatcttgcaatatttttatagtcacattttttatgtctataagagagtagagacatttttctagagggtttggattttgtgacaaacataccaaataattgtgaaaaaaactgtggtagagacattttctagaggcattggattgtgtgacaaacaaaccaaacaattgtgaaaaatatgtggtagagacattttctagagacattaaagtgtgcatcaaacataccaaacaattatgaaaaatatgtggtagagacattttctagaggcattgaactgtatgaaaaacataccaaacaattgcgaaaaatatgtgacagagacattttctagagacattggattgtgctacaaacatttactattgtaaaaaatatatgatacctatatttttcataaacaattgtgaaaactatctgccgctgatgcaatgagcttgccgccccttcgccgttcactcctcacgtgtcgcagctaggagtggtaatgtgccacggcccatgggccctttcacaatccatcttagccttcaaatatttttagctcaaaaatctattaagtctcagcccaactctatttgggtccagccctcacattttataggctaatatgttgggcccattatcacccctagtcacagcaatggctcgctccttggagaggtaggccatccacggcatgtagctacaccatccatcggagccgcgccctcggtttgcgactctggctttagctctttcaggtagctagctgtatgctctcattgcggctcatcctatccccacccccaccattgccaccccacaccaatccccttccgcttctccggggagtgatgactatccatttcctctcctcaaggccaatactgctagtctagatgccattagcaccattaattaattggctctgtaaatctcttttaaatcttcccatcatcgtactaatcctcactcatcatcattccattggtgcctggattatttcaggttttcctctaatgttgcttttctatcctttgcattagccaaactacacttgtatagagtaccacaggtcagtaactgttcttaccatcttgaaagattttaagtttctcattgggttatttctgctgattttccttatacacctttggtttcattgatccatataggaacaaattggttaaaaaaggcagctgctatcttgcggtcccttatttgctagtttgtgcaatttacggctactctctacttggtatccatgtatacaacaaggtctattatatagtaattttggacaagatcagaagacaaagatgtttcgaatatagtaatcctgaaattaagaaggcactaaaatggtatgtatcatgttctaagccaagtatattggattatatatgtttaccataatatcccatatattcattcatgtccatgtacatattaatatatatcagtggagaaaatggtatatccaatggatgttggggaaagttcttcatgttttgcactgggatgaggccgaaggcgttggccatttcatcttcttgtccctcatccagaccatgcttctggggctgaagcgtgccatatggactgattttggatgcccagtttttaagttcattaatactaatttacccttttttttggtacaatatggaaattaactatgcaaatgtaactgcttaccagatcatactcctactcaacttggtcctatactttctctccagaaataaccacatctgctcaaaatccatcattgggcagagattcttccaattcatttcgtagtatgatttcataaacataataaaaagaatcacatattaatataccaagatctccacaacaaagtataccattaccactcagctatataaatatcacaaacacctttttgtttctccttccaacactacattctcttttgcaatcctgatctcaatgcagagcacctcacctccacatgcatggaacatggcaaacgaagcaaaatgttttttcattcttatgatcaattatcaagtgctaatacctacttgcaatattcatgacatacacacttcttctcttttcaggttaccacaaaaatatctgaagattatgctcttcaccctcctgtccataccactcgagataagtacaaattcggcatgcgtgtaattgaagaaatgaggtcatctgcaaacaagaaaacttctatcgctattacaggcaattccacaaaataagtcctcaaaattctggagaagtctcatactccagttatcacattggtgcattccttagcgtaaggaaatattaataattatttttttttgttaatgtagatatattttttgcaaatattttaaatacttttagttcatattggctacacattatgtttaaattgtataattatctttaaattttatttcataatgatatgatctactaaagttctataaatatcttataacataaactagttcccaaagttatgttttggttactgtgtaaatttgaaaatttcttgtttctatgagcagtggatgtactattttcccatatatttttattatttcctagtacattaatagtgtgaaacatctagttggcctcaataggagtggaaaaaaagttagcaatgcataaatatggttgtggcagaagagagaaatgccatttcagtcccagagaaaaaaaaagtcatttcagtgatagctactagggcggaatttggttatgacgtaaaatggaacttttgtatcaaggaagggtgaacagagcatagacatgaatgttgctggtgaggttgattagtttagatgtatgtttttaattaccttctttggtaacaactacaaataaagtaaagtaaaggtagaacaccaaaatatctgttgtgcgtcacgtacttgagtccatttttaaaatagttttcacaaagctaaggtaattcgcatatcgtatatttaatagtgaaaaaaacaattgaatgcttgtattacactgcttctcttgtaagttgtaacatgtagacaggggcgggcccaaagggtagtccaggtaggtccaggactaccctagaattcggcccagtgaagaccaggtattcatttttcctggcccaacaaaaaaaaacctaactctattttctgttctctcccgtgcgctctccccacccggcctcccacccccgagtcccgatcgactgacagcgacggcgctcccgcgagccgtgaggctagcgcgactcaggcgctcttgccgtcccgcgaggccgctactcgcgctgccgctcctcccgccgcttccgtcagtcagtctggtagcctcccggctggccggctcccgccaggcgcgcgtgcccatccggcagccgtggcggcagcgccgctaccttcgcgcgccgtgctggcaccagcacggcctcgccctctccgcgactccacccctggccggctggccgcgccctctccgtcccacgtccggccgtcgcccggcggcctcccggattcccggctcccgcggtcccagcgttctgatttgatggatcattgggaagcccttacacgggcatatggtcagtcggctgcaggtaactcgagcactataaggggaaaactcacacgcgaccaagcatacggcggtgacggtgggagcgttggcggccgcggtggcattgaaggacattgaaggacttgcaagcttttatcctaaggacattgaaggctctgatttgatgaaacttgagctccaacttgatacatatattgatgatatgagagaggatgatagattcaaaggccaaaacaacattggtgagctctctattaagcttgttgaaacaaagaagcaaaagctcttgagtcttgactagtattgtaatatcctatttatctaaagaccttatgttatgtttgaacaatttacattttcatttaggtaagatttaaacttatttgttattttctactacttgtattgaaccatttagagttatataccgtatcgtttaccactttttatatcgaatcatattgtattgcattcggattttttttggctaggcctgggttcaaatcttgggtctgccactgcctgtagatttgggatgtaaatgcttgaattaaaggcaaaattattggagaataaaacaaaataacagtagaagggtttggaaggatgcaaaaatgtagtagcttttggataatcggatgcttacataatgtaagttgcatttgttgggatacgcgtaggctacgatagcataaatcaaaatttttctaccgcgtaaaccaggaaccatacaagtattagatcatagatcattaccactcgacgcgctgtgtagcggaagtaagcgctaagtagccgaaggaatgtcgggaacgtagcgcgcgtcggtgtagagaaagtagtcgatcgcagcagctcgatgttatcctcctcgtgcgttctcttcgccgtgctctcacaccgatcagcaccgcaaaccagcggcacctctaccggtatccacacatacagggacggaacgccacacgcagacgtgctagtgtctgcgcacggctagggttttgctcggggaggggagtggcagctagggtttctcacgtgatgtgatctatccgctggtcacgtccctcacgaatatgtaagatccatgactcgggcttccaaggcccataggacttctattcggatccctatccgaattaagctcatattggatctctatccaatcctcttattccggcttattaagcgtgcaaccctgtaggttcacgtaaactcagctgtaacccgaaaactccttttcggtccacatgtcaacagcagcccctagcagaatgtattgacccaccggacatacataaagatcatatcggttgaacctctagtgtatacttgtatgaacccctttgcctcacgatatcgattaaactcaaggctagatatgtgccatcctctgatagctcaatcattcactcgaacttgtgattgactcctaaatcaccattggcatggccatgcacttccataatctataacatcgagggggccatatatatcgctccataggaggggcaaatcccatcttgattatttatatcccaccacatgtttcatagcatgcccgaaaactatttttataactatccaattacggagtagcgtttagcagtcctaagtaagctactacacatgttgggaaccatgataatctcaggtctaaggatttaataccaacattaaatgaaatcaccgatgacacaacacatatggctcttgcagtgtctcatgttgggtctatctaacaacatgttcccaacatgtgtccacattattaatttggtatctctataccatgatccatgagacataatcatcaattaatacatatgctgatcatttaaacatatttattccacatatgatattttatcaggtatcctttagaaatagcaacatacaacataaagagttttatgaaagaatcacatattcattaaccaataatgagttatctatttcaaggaacaacgtcggataaatatataaacagagtatgtgatacaatcatctctatgattgcctctagggcatatcaccaacaacattcctttctttgtaatttataaattgatgtaagtacttgaaataaagacgaagttgttggagaaatagaataaattgacagtaggagaatttggaaggatgtgaaaatggagataagattggagtaatttgcttatcgtgttacatgaaaggcttcatggtcctaattttattgaaagcatgaaattgtattaatacatgtatactaccttggaataacaatattataggcatataacgcgccatttagcaaatcaccaaaactggataaccatgacagtgaaaaaggcataaatttttgcaccggactccaaaagacaaaaaattcgataataaaaagccacaaaacaaactagacttcaggtcacaataacttggaattcaacgtcaccaccatcatacgctgcatgaagagatagagtgttgtaggcttcttgatgtctggcatcgttaagaaaggggatcttgatttgtacgcaacaaataaagtgtgtgtattgcaacacatggctcactttttttttgagaaatcctttgtataaataatacacaaatgttggaaggtggtttttttcccaatttaacttgctagtttgtcaaaaatattgatatgtgggattgttttacctgtttaacctgcaagctttagcaatgcccatatggccatatctcttgtgatatatgtggatagtcctggaatttagttgaatttcttggcccattattttgtccttgctaaattaatgtctcgatccacattgagacccacttacagaaaattgatccatcaacaacatttttttctatagtggcaggaaatctccaactcttcgatatgcgctaactagttaatctatttacttaatttgatatgggttctcttgctacccaaaaaaaagtattgatctagcttacctggaaagaatggatcgctacccttggagagctaatgataatggactaatagcgcattgattgaaccgaccctgacgtaccactagggaacttataatctgacccaatatgatgtataaaaaatggcttaaatgggcttatctcagctaccaaactaacagatcagcccaacaatcaccctaggcctgaacctgacctaagctagcaatttttcctgaggaataagttcactttgtgtccctctatttgtcgtccagtccgattttcgtcccttggccgtaaaaccgggtatgacgggtcccccaacttacgaaaccatttaaatgaggtcccttggcagtattgtgttcgatttttgctgagatggcgcttacgtggctccttttgactaggtctttgtctaacgtgtcattgacatggcgcttacgtggcaattagataaaaaaataataatatccgtagaaccacatgtcagtcgcacacacaaataataaaaaatggtgggcccatgtggacccacacgtcattctcactaccctcttctctctatccccctctctccctcttctatcgctctccagccggcggagcgggatgggcgggggccggagcggacggcgacggggcagagtggctccgctcgcatctcatctcctctgctagggagggtcttgtagcgcaggtggcgtacatctggcaggggagggtcttgtagcgcggttggtggatgacccttgtacccggttttgagaccaaaggaccaatatcggactagacgacaaatagagggacccaaagtgaacttattccttttccttgaaggcccaaccttcggtacaatggcctacaacaaagcattccactggtttcaaatatttattttacccattacaatttttgtttcctaaccaagatcactgaactaacggctctatcaattatgtcggccacgctggttgaatatatagcacgctgtcatgctgagattatctacgtgtacatggatggattattgatacaatgtataatacatgcgatatacaatactgcagcatcttcgtagaaatttggtcaaacttttctttaaaaaaaagaaatttggtcaaatttaaaaaattttgactagaaaaaaaatcaaaacgacttataatatgaaacggatggagtagtttataggtgattgtaattctctcttaattaaatgaacgaaagcttcctctaaaaaagactacatgggatgaaaaattaacaattaatttgtagatttatgggcctagtcattttggaggaaaagcaaaggatttggattgctaaggattaattcctatgagtgtcattcattcataggaatgtaggtataggaaaaccaaatgaaattttctattcatagaagtcgcagagagaaaatgtaagaatttttccatccactcaaacttcttggaaaattcatatatatgaattaaagtatctacacatttcaattcctctacattttctattcttatgtgttaaaattcttccaaaaccaataggcccgtacatacatagttgtactctcttagttcctagattttatttttcaaaattaaaatctcaacaatctggataaaaattcctaaacgttatgagtaattgcaagtatactaccaactattcctttttgaggtaaaaaaaataaaaacacatatttatatattacacttaagtatggatgtatggaaacaacacttgtttatcgttattaaattgttgtaataccaagggaccgaagtttgcaatccaaattgttagctagcacaccaagcaccaaaccctgcaacgacgacacatatcctcatgtcacgaggagccaacggatatcacctcagagtgtcatcaagcagggatcgttaaaaccaaaagctcatgaaagtcagtgagatgatagggagtgtttggttcgatatattgctaggtgccaagttgtagcaaattgcacgaacggcaaagtgactctagtgttgaggaatgatgacttgccgttgttctttcatggatgctattttccatggtttcttgggatgtgaaaagcactggaaaccttggcctctactcctgttgcttcccatttctaaagttagtttcctcttttcctgataatccagacagttgggaattctgaaggtcatatatatggatttcaagctgcaaaaattcactagggttatttgctaatttgccctatagaaattattggacctctttggagttgggaattattgatgtttgtgtggggataaacttttgggtatgtattgctcatttgttgttaggatagtggaaaagaacttcaggtcgctacacccttatgtagagattctttttatgtgcgtacttaagtagttgtagatgttgaatacatagtacgttgcattaaatgtatacccctcattcgaaatagttttgaaacaattgagtgagccagagtgagacttggaggtgattgtaaatagctttagatgtagttgtagatgtgtaatatacggtactttgcattaaatgaatacctccattcgtaaatatcttttgatcaacttgaaagaaacacaaaaaataattcataaagatcagaattcaaccgtgttttttttatctctttgccttgtaggtgttgtaattctctgttaaatgaatgaaatctcttggcttcttctaagaaaagtacatatgatga

SEQ ID NO: 2908 - DNA, 1687 bp, Oryza sativa
gttaggagtaatcttaagtacagataataaaccaattattagaatctattcgttataaggtaaaacatagaatatcatatttatgcattaccctgaagtagcaaaagaacactaaacttattgttattaaattgttttaataccttaatttttttaaaaccacacatttgacagaagtctgtaatccaatattgttagcacaccaagcagcaaaacggtgaaacagcatatcctcgtgtcttgagccaaccgatagcacctcatactgtcattaagcatggatagctaaaaccagttatgtactccagctttcagtcttgaaggatcatgagggctgcttaacacaagcacgagtcatcgagaaatacatggaatgcatcaactgctgaagccaccactctcctgtgacttgtattgagaagaagtaactccagtgttcctattgcttcccacgcctaaagtggatttcctctttcctaataatccaaacagttgggaaaattctgaagttcatatggattttaagacgcaacaagtcaacaactcgccatgcatggttatttgctaattggcccaatagaaactattggtcttctttgcagtaatgaattcatgtttgtgtggggatatacttttggttatatatttcaccccttttttttgttaggttaatggaagagaacatttcacgcctgatcaacacccttacatagagatttttttttatgtacgtacttaagttgcttgatatcttaaatatatatgtagttttcggataaccaaaagagctagtgagaagtatatttttttagataatgtaagctttattgatctcagtcattctgaggatactctcgtcctttgcaccattgtcgtgcacacagccaacaaactccaacacactcaaaataagagaaaaaaccagcgtgcaagatcaagaccctacaacccgaaaactaggtcgccacccatatgccggggtaaaaaactccttgaccacttgctccaaatgtagataagccgaagtgacaaagtcctgcaaattgagtttctggagaataacccatgatcggagccaatgtgtaatcaaggaaataacctgcaaaggagaagaaacagttttcctatcaaaaaccatgttattccttgagcgaaattgcccagcaagttgttgccacccctaggaagacaagaggtctaaactctttggtatgtcataaaacccattgcctaaacatatgtgatacgttcctaggcgaacaaatgtttgaagcaatctggattagagaccaaacctatcgggctagccgacaataaaaaaaaataaatattttatcgtttcttctctgtggcaaaaacaacagatcttactccctttcaatttccgcttagccagattatcttttgttaacaccactcctcgacatagataccaaaaaaaatctttactttaagaggcatttttaactttcaaatagttttgttaatattaggagctcccatatgagccaaagcaaaataatgagatttaaccaagaatcttccatctggtgttagatttcatttaaacttatcttccatctggcgagaagtacatacaaaatagttaaaatagagatctgaattcaactggattaatttcttgcattttagccttgtcagtgttgaattgtcacacattggttgt

SEQ ID NO: 2909 - DNA, 242 bp, Oryza sativa
ttgtattaaattcctttttgcaatatcagattgctttttatcttgttcttgcttgtttcttcgatttgcttgcaggaataaggttgattgcaccggcaagatcaacaacccacagagaggtgtatcgatcgctaaggcgcaacacaacgtctcgtacggttgtagtcggatcgtcaacgtttctcccaaattgtagttatcacaactcaccgaaagatcgggccaacaaaagccttgagtgt

SEQ ID NO: 2910 - DNA, 773 bp, Oryza sativa
gataaacaattggcatatgagattattggttttgatatttggagattatgggcgaactggttttggagatgattgatttttcaggtgatgaacagggttactatttttctcgggtccggtcagaccgggcaattgctgtcggtcaaaccagcgctatgcgagcggtcagaccggccaacgctgtgttggtttcggtttcgggttgtttgtttggatatccgtgattgtttcatgtttatggcttctagatggatactatacgtatgtaatactgttgtttgctactaatgagttaagttggagatagcttggtctcggaatatggtttctttatttgattcatgtgtaagtgacttgatgcctcgggagagtattgccggtgatggattgggagtcgacttggggataaggcgatgtccatgacggtcaaatatcatgcgggatacttaggatagagttcaatgcacgtggttggtgaagattccatatggcatacgatggaggtattgtgtgcgtataggatgcggagtcgaatttggaaagagtccaaatttggtatgattggagtttgtaaagtttgtttcttttacgggaaggtttcctaggtggattaggacttctagtatgagtttggttcgtggcattaggctgcctacctcatgtataaatagagagggagcgtgaggcttcccagtatcactatcgagagcattgagttgatagtttagttaggtttcgagtttagtcgagattttcgtgaggagatgtcccat

SEQ ID NO: 2911 - DNA, 10560 bp, Oryza sativa
gttgagtacggtggttgtactcagtcttgctcaatttttcccaaactcagaaaaggagttcctggaggatgaaggcttcggtgtctagctcgtgcctgccgtcaagtgcctgtggtcgtcgccctagtcttccgctgttctcgtttgtctttgtgtgtgctgggccttcgctgcccgtgtaataaattaattatttacgcttccgcttgttaaactctgaattgtatcaacttttggtgtaccttgcctcctgggacaaggattaatgcacgcacgtaaggaacgcccgttgggttatttccggtcgtgacaagttggtatcagagcccccttgaccctaggacgagccgtagatcccaaaccttagcaatattttcaaaaataaaaatcctttgttatttgtgaaaactgtctagtctctctctgtcttgctgcttcatttatcgccaaaatctgacctttaaaatgtgggttttctttctgtttttttgtttgtagatggccggcagcgtcacccgtcgtggtttggacatgactggcttcgtcttggagctgcggggcatgtgcgtggtcctggggtatccacatggagtggactaccaggccaggccgcttccggagcaggagggtgacgatgcagagccccacgctggttgggaggtcactgcagtgatcctctctggctctcccgagcggacttcgctggcagtcaccgcgggtggagattccttccccgccgcttgccagagcgccgctctcctcgccatcggcactcttcaccagcgctacccggacgagttgcagcactcgccctaccgctaccaccctcgccgcggaggagcccgcgactacgccaccttccgggatgctagctcagaggatgacgctaccatcgtgcacctggcgcgcatggtggaggcgtacgacgcggctcgtatcgacttccatcagatggtgcgccgtgggatggtcgagaacaacatgaagatcctggagctgcgtcaagagaacctgcagctcaagaaggacctagacgcggtggaggcgcagctgcatcagctcaagatcgcccagggagaggtctgccgccccaagcgccgccgtgtctgccgcagccagaagatcaccgcccgcaagagcacctccaggcccgagcttgttcgtcagtccctggcgtggacttgcttcgtcgagatccctcgtgccgagcccgcgcccgtggttccccaggagggggaagcctccggcgttggtagcacggaggatgcgctgttgctcaccttccgtcctggcccgtcgcagcggtagacgagcagttagtaggcttgcgcgtgtgttctttctcgtttgtcttcttgttgggttgtgtggggcacggttatgccggtgtgtggtgtaactgtgtcggagcctgtctttattttatttgcttaagcaacttgaactttaatgaaccaatttaatagcagtaataaattcaagaattatggtagtcgtgggtggttagctttaattgtcagctctctctgtttgctggttctgtgtggggttttcagatggtgatgaccaggagaagtgctaacaccggtgatggcaaccaacctgaaggcagcaaccaccaccaccagggcagcccacctccacctcctcctccgcctccaccaccaccaccagacaccaacgccattctcacccaaatcctcgcccagcaggccaacatgatgactgctttcctccaccacctccaaaatccgccacaacataatgctccaccaccacccccacaacactctaaactcgccgagttcctccgcatccgcccacctaccttctctagctccaacaaccccgtggacgcgttggattggttgcatgccgtggggaaaaagctagacactgtgcagtgcagcgatgaggagaaagtcatcttcgccgcccaccagctgcagggacccgcatctctatggtgggaccatttccaggctacgcagccagaagggcaacctattacttgggcccgtttcaccgccgctttccggagaacccatgtgcccgccggagtcgtggcccttaagaaaagagaattccgagagttgaagcaaggcaaccgctccgtgatggagtatttgcatgagttcaacaacttggcccgttacgccccggaggatgtgcgggaagatgaggagaagcaagagaagttcttggcaggaatggaccctgagctgtccgtccgtctagtctccggggactatccggatttccaacgtctagtggacaagagcatccgcttggaagccaagcacaaggaactggagtcgcacaagcgccgcttggcgaatttccgcaatcaatagggtgctaaccaaagggtccgctacaccaatccctatccagggggatcctcctcgcagcagcaacaacagcagcagcaacctcgctccgcgcctcgacctcaattcgtggtgcgcgtcccacagccgcagcagcagcagaatcaacaagggactcgtgcgccccgtcctcctacgccaactgtgcagcctggtcaaggccgtagggacgctcaaggtccgcagcgtctgtgcttcaactgcttcgagcccgggcactttgcggataaatgcccaaagccgaggcgtcagcaaggccaagcgcctccccgctccaaccacggtgggaaggatgtcattcggggtcgggtgaaccacgtgacggccgaggacgtgctgacaactccagacgtcatcgttggtacgttcctcattcattccatccctgctaccattctgttcgactctggagcatcccactcgtttatatctgtgccattcgtggggagaaatcagttgggggtagaaaggcttaggaaccctctgctcatcaccacccctggaggggttatgacagcaaagtattatagtcctgccgtccctatagaaattcaggggattccttttccctcggatctgattctgctagacaccaagaacttggatgtgatccttgggatgaattggttggctcaattccaaggagtagtggattgtgcgagacgcactgtcactctgtaccgagggccggaacaaccggttgttttctttgcacccccaacctctgtcagtagttcagaacttcatcagataggactgtcagaaatccccatcgtcagagagttcggagacgtgtttccggaagaactacccggtatgccgcccaaacgagagattgagttccggatagatcttgctccaggaaccactcctctgtacaagcgaccctaccgtatggcagcaaatgaactggccgaagtcaagaaacagttggagagtgaaagaaaaggggtatatacgtccgagtacttcccctggggtgctcctgtgatttttgtggagaagaaagacaagacgaaaaggatgtgcgttgactacagagctctcaaagaagtcaccatcaaaacaagtaccttcttccccggatcgatgatctgttcgatcagcttaaaggtgccactgtattctccatgattgatcttcgttccggatatcaccaattacgtattcgtgaagaagatattccgaagaccgcattcaccacgcgatacggactgtatgaattcacggtgatgtcatttggtttaaccaatgcacctgctttcttcatgaacttaatgaacaaagtgttcatggaatacttggataagtttgttgtggttttcattgatgacattctgatatactcacaatccgaggaagaccatcagcaccatctccgtctggtgttgggaaagttgcgggaacatcaattgtatgccaaacttagcaagtgtgagttctggttgtccgaagtcaaattcttagggcacgtgatatctgctaaaggagttgctgtggaccccgaaacagtgaccgccgtcactgattggaagcaacccaagacagtcactcaagtccgcagtttcttaggtttggcaggatactaccggaggttcatcgagaacttctccaaaatcgctcgacccatgacacagttgttgaagaaagaagagaaatttgtgtggagcccgcaatgcgagaaggcgttcaaaactctcaaagaaaagctggtttcctcgccagtgttaatcttgccggatactcgcaaggatttcatggtgtattgtgatgcttcgcgccaaggattggggtgcgtgctcatgcaggatggtcatgtggtggcctatgcctcacgccagctacggcctcatgaaggcaactaccctacccatgatttggagttagctgcggtggttcatgctctaaaaatctggcggcactatctcattgggaatcgttgtgaaatatatactgatcataagagtttgaaatacatcttcactcagtccgacctgaatcttcggcaaaggagatggttagaactcatcaaggattatgatgtgggaattcactatcatcctggtaaggccaacgtggtcgccgacgctctaagtcgaaaaagccattgcaacactcttaacgtccgtggcattccactcgaacttagtcaacagatggaagccctgaacctaagcatagttggtcgcggattcttggctgcgttggaagccaagcctaccttgctcgatcaaatccgcgaggctcagaagaacgatccggacatgcatggactcctcaagaatatgaaacagggtaaagccgctggtttcacagaggatgaacacggaaccctatggaacggaaatcgagtatgcgttccagataacagagaacttaaacagctgatactacaggaagctcacgaaagtccttattccatccaccctggcagtacgaagatgtacttagacttgaaggagaaatactggtgggttagtatgaagcgggaaattgcagagttcgtggccctttgtgatgtgtgccagcgtgtcaaggcagagcaccaacgaccggccggacttctccaacctctccaagtacctgaatggaaatgggatgaaattgggatggatttcatcaccggacttccaaagacccaaggtggatatgattctatatgggtagttgtggatcgattaaccaaggtagctcgatttattcctgtgaagaccacctatggagggaacaaactagccgagctctacttcgctaggatcgtgagtctccatggcgttcccaagaaaatcgtatctgataggggaagccaattcacctctcacttttggaagaagcttcaagaagagctgggtacccggttaaacttcagcaccgcataccacccgcagacagatgggcagaccgagcgtctaaatcagatcctagaagatatgcttcgcgcgtgtgtcctggatttcgggaagacctgggataagagtctcccctatgccgagttctcctacaataacagctatcaagccagcatacaaatggcaccttatgaagcgttgtatgggcgcaaatgccggacaccgctcttgtgggatcaagttggggaaagccaagtgttcgggactgatatcctgagagaagctgaagctaaagtcagaaccattcgggataatctaaaggtggcacagtcccggcagaaaagttatgcagataaccgtcgccgtgacctggaattcgcagtggacgattttgtataccttcgggtcacgccattgcggggtgtacacaggtttcggacaaaagggaagctcgcacctcggtatgtgggtcctttccgtatcgttgcccgacgcagagaagtcgcttaccaattggagctgcccgcctccttgggcaacgtgcacgatgtgctccatgtgtcgcaactcaagaaatgccttcgagtgccatccgagcaagccgactcagagcaaattgaagttcgcgaagacttgacctacgtggagaggccagtgaaaatcctggacaccatggagcgcaggaccaggaaccgggtaatccatttttgcaaggtccagtggagcaaccacgtcgaagaagaagctacctgggagcgtgaagacgagctgaaggcagcccatcccgatctcttcgccagttcttctgaatctcggggtcgagattccttttaaggggggtaggtttgtcgcgtcccaaaacgactctaaaatacaacctcaaaattgtgcatagaataagtaaaatccatgtgaaagcctccaacaattaaaatgtgcaaagttaaaagtcgaataaggcttggaggatttttgtatatttcctaaaagcctaaaatgcgtaaataaattttagtggaattttcagagcacaaataataattaagaagaaataaacaaagttaaaaaggttttataaaaagaaaaaccctaaaaagtcttttttccccccctccccttcttgggccggctcggcccagctccctccctctctctcctctcccccgcggcccatccggccttcccccgcgcgcgcgccgctgacgggcgggcccgcccgccaccctcgctgacgggtggggcccacccgtcatcccctacctcgcgccgcacccgccgcctcgcccgtgccctagcgccgccgccgccgcggattccgccgcatcccgccgcccccgcgcgcaataaagagggggaaatcactccccgtgattccctctccctttccccccacttttccctctctctctccctcggattcgtttggaaactctcccccaaacttcgccggcgcatcaatggcggccggatcttccgcggccgattccccctcatccggccgctctctccccctcccaaccctatataaacgctccccgtgcctccctccgccgtttccgaccctcgccgctctctctccccgtcggaatcgagctcgcgccgtcgttctctctctccgccgtcgccgccgagctccggtccgccgccgtcgtcgccccgaccctctcccgtttcggcgtcgccttcttcgggttcgccgcgacctcgccgacctcgtccacccctccgtttcgcccgccgaccgccggaacgccgccgtcctcgtcgacccgagccgcgccgccgcctctctccgctccggtcgccgtttccgttgtcgccgtcgacccggggtgagccgtggaccgccgtttcgcttcccccttccctcccctctctcgggcgccgctccgccgcgccggtggtcgccggcggcgaccatcggggcgcgggcgcgtcgcctcccgtcggctgtgccggcgaggcagccttcgggcgcgccccgcggctgccatgtggggcccggccgtcagccgcccgcgcccgcgggtacggctgacgcgtgggacccacggcgccggccggcgtaagccgcgtgcacccggtccaccgtggaccgtgaggctgctgcgtgggccccactcccgtggacccggtccgcgcgcccctcccctcggctgacgcaataaatccgattttaaatcaaaatttaaatgaagaaattcgtaaatatccatttaaagagcatataagcttcaaatggccataacttcgccatttgaactcggaattggaccgttcaagtctctaatttttccttaagaagccaagaacccatttttgtgctttgtttctgcttgttatatggagtttagtagagtaaaagccgtttcttttccgttggtcgtgtagacactgcagcttcggaagatccgctcttcgtggaagttgaagccggcgtttgggaaagcgagcaaggcaagtcacatcatctttgaacatattgaatcccagtttgtaaaattatgttgatttaacttattgcattatcgctttatttaaattcccgcgttatcactgttttatttagccatgcctatttacctttgttatgaccttattattgttattgttattattaccttgttcaccctagaataaacaaaaccccaactagtggacactctactcatggtatcactagtatgattttaggtagatgcttcgcttttaatttggtaaccttaggcgattttacaactctagactttgggaatattcatatcacctggacactatggaatggtttggttattgtggaattggcttcacaccgctccttctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctccagggcaaatgaaggctacacgagctgcggcccggtagtcgagatgtcatggcacagggccggtgtcctgctgctaggggctcagtcctgcctgcctgtcccggaggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcctaacaactaaaatgtggaatggttggcctgggttggcttgggacgagctgggacccagggtcgggttgccagttcggtctgaatcatcgtaggccttgggttaaggcaggttcgtgtgggttcacggccttgataaataatattgcatagtactagaatcgtgttagcaaaatagccctgagcaactaatgtctttaaatgctgtttactgcaaccctaaccctttatagtataactcctttgtactcccttgcatttattctgcacttgtgggtgtgtcttgttgagtacggtggttgtactcagtcttgctcaatttttcccaaactcagaagaggagttcctggaggatgaaggcttcggtgtctagctcgtgcctgccgtcaagtgcctgtggtcgtcgccctagtcttccgctgtttctcgtttgtctttgtgtgtgctgggccttcgctgcccgtgtaataaattaattatttacgcttccgcttgttaaactctgaattgtatcaacttttggtgtaccttgcctcctgggacaaggattaatgcacgcacgtaaggaacgcccgttgggttatttccggtcgtgacagaaacaatcctccagcattgtcggccaaaaatatcctgcacgtcgaagcaaccacttcatcttatgagcagattgatgagtgccacaaattccttcatttacctcaccgattgcaaccttagcctgatcggtactcaagcacttaagcaacaccccatcaatcgtctgataatacagctcatcatccaacaaggtatacttcaaagctttatagcgcaatttccgagaagccgattgagatggattctgtaaataatgatgtacatcatatctccaatcatcagctgttaatgtggcaacctctaccttgacatctttgatcatcggcttatatcccgacgccccttgggccaaatcattagcttcaatattctgttctcgagatacatgcttcaaagtcaccagccgaaattccttcatcaactcttggcacttctcattgtaaactatcaatgtattatttttgcactcatactcccatgccaactgactgatcactagcaaagaatcccccataatctcaatagcatcggcttcaacttccttaagtaattgcaaccctttgaaaactgcctcatactcagcttgattgttagttgcataaggtttaatagtataggcaaacacaaaacatgccccccgaggagaaataataactaagccgataccacaaccatgagtgcatactgatccatcaaagaacaaagtccatggcacaatctcaaccgagccgattgaatcatcacgatgatcaacaataaaatcggctatagcttgccctttgaccgccttcggtgattcataccgaagatcaaattccgttaaggaaaatatccactttccaatccttcctttcaaaatcggagccgataacatgtacttgaccacatcggccttgcatatcacagtgcattcattgggcaataggtaatgccttaaccttgtacaaaaaaatataagtacaagcacaacttttccacaggagaatatcttgtttctgcatccaagagccgacgacttaggtaaaatacaactttttctttcccgtcaagctcctgaatcaagactgaaccgattgacttctcaccggccgatagatataatctaaatgtatccccttttgtggagaaatcaaaactggaggagagctaagatattccttaataatatccaaagccttctgttgctctgcccctgtcggtgatatgggaccgggagtatcatgactagaggcttgaggcagacacaatcgcccacgtggcctggcaccttcggggacgtcgggcccgagggtgaggtgtccgccctcctcctgatttcccccgaggggggg

SEQ ID NO: 2912 - DNA, 20315 bp, Oryza sativa
tgccaagattacacgcggtggacaagaatgaccgatttgcgaccggtctgacactgaccatatcgtcagcgcacagccatgctcccacgacgcgctcacccccggcggaagtggaggtaggtgtgggctgtcccatcggagcgtcattcggacagcaaccgtgctgatctccgcccattcaagagaaaaagaacagtccagtttggaaagagaagggtgcatgtggtatccccttgaagtataaaaggaggaccttgcccatagagagggggttggttgattctttcccagattatgagcttagaacgggggagaagtcagctgacacttgtagctcattcatacacagatccaccaaaacacaggagtagggtattacgcttctcagcggcccgaacctgtatagatcgtcggtgtctcgtgttttctggctggcagacgatatttccacatacagagagagcgagagcttgagatttcaccctaagcccccggccgaactggcaaaggggggcctgcgcggtctcccggtgaggagccacgagctccgtcatctggcgcgccaggtagggggctcagcgtgtgctttcagagctctcagactcttccgtgtgccccaagtttttcttgttcagcctaatggccgagcaaggaaaaacgcacgacctctcgccgagtgtgagcggcgacgacggggagccgaatccacgccgtcgagctcgtactcctccacctcctccgcgccaaagccctaagcagggggaggcgcttgagagggtcgacaagtccgcggcgtcaccggccgcaggtgatgcaggagaacggcgagacggggagcgtcgcctcctcgtctacggcgacggcagcacgcctcagggtgcgcttcaagctgctggcgcgctcctacgacacccgcctgtcgtccatgacccggagtctccagcccaacgatggctggaagacgtggccaacttggtcatgacggcacagcagcgcctgggtgctggtggacggtccgccaccaccaccaagacctccggcgccgctaccaccggctccgtgtcatcaaggcggagggcgcggcgagcggcggcggctgcacgtcattcggctgccactccctcgtctacaccgtcgactcgggaggatcagcatggggagccggatgcccgcctcaacatcgggcgccggtgtaatagccggcgtactccccgtgcaacggagggagcctcctcgtccagagtgtcacctcgacatggacgtgaagatcagccctccgtgcccccggccggtggtgttggctgtagagcctttgtggcgagtcttcggaatgtccgttggcccccaaggttccggcccaccatcaccgagaagtacgatgggagcgtcaaccccaccgagtttctccaggtctatacgaccgggattgaggccgctgggggtgacgacagggtcatggcgaacttctttcccatggccctaaaaggacaggcgcggggttggctaatgaacctgccacccgcgtcggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaacactataccatgcatccctgcacacgcggtgatctacgcgttcagggggggcgtgcggcacaaccgcatgctcgaaaagatcgcttccaaagagccccagactaccgcggagctttttcagctcgcggaccgagtggctcgtaaggaggaagcgtggacctggaactcctccggttccggagtggcagcttcggccgcccccggatccgccgctcagacagggcggcgtgataggaggaggaagaagaggtcggaccgttccggcgacgagggtcatgtcctcgccgtcgagggcgctccgcgggccacccgaaaggggaggcctgcgagcgacaaaaagaaagaggctggtactcccggcagggagcgccccgccggcaggtggtgctccgtccacaacacctccctccacgatctcgcggactgtcgtgcagtcaaaaacttggctgagcgaacgaggaagtgggaggaggacaggaggcaggaacgccgtgacggcaagtccccggcggttccttccgacaaacggcgaagtgaggccaagaagaaggcccccgctgttgacattgatgatggtgatgatgatctaggtttccaagaacctggagccaccattgccaccgtcgatggaggagcatgtgctcacgtctctcgccggagcttcaaggctatgaagcgagagcttctgaccatggcccctacccatgaggcgatgcgtcgggcgcggtggtcggaggttgctctcactttcgaccagaccgaccacccaccgtgcattgcccggggagggcaggttgcgatggtggtttcccccaccatctgcaacgtgaagttgggacgtgtcctcatagatggaggagcggctctcaacatcctttcccccgcggcctttgatgctatcaaggccccggggatggtgctccagccgtcacaaccgatcatcggtgtgacgccggggcacacgtggccgttaggtcacatcgacctaccggtcaccttcggtggacccgccaacttccgcacggagcgggtgagcttcgatgtggtggacctcagtctgccctacaacgcggtcctggggagacccgcgttggtgaagttcatggcggcggtccactacgcctacctccagatgaagatgccgggccccggtggccccatctctgtccgtggcgaccttaaagtcgcgcttgcttgcatggagcagcgcgcggaccgcctcgctgctgcgtccaagcccgagggtggtgacgagaggcttggcccctctgcccccaccgccccgaggcagcggatggccacttgcgacgaggtcccggtcaaggaggttgccttgggcgacggcccatccaagaccacacggatcggtggttttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaagccccggaacgtcaagccttcatccgcgaggaggtggctagacttttggaggccgggttcattcgtgaggtcatccacccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggagtgcgaccttttgtgttttctagatgcatactctggttaccatcagattcgcatggctagggaggatgaggaaaaaactgcgttcattacccccgtaggaacctattgttatacataaatgcccttcgggttaaagaatgcaggtcctacttttcagcgtactactcgaatttctttgggtagtcaaataggacgtaatgttgaggcgtatgtcgatgacttggttgtaaaaacgcgcaaccaagagaccttactttcagatctagcggaaacttttgagaatctccgctccgcccgcataaaactgaaccccgataagtgtgtgtttggtgtacctgcgggtaagcttctcgggttcttggtctctgcccgaggcattgaggccaaccccgagaagattcgagctatcgagcggatgcgcccccccagcaaacttagggacgtgcaatgcgtcaccggttgcatggccgccctaagtcgtttcatatcaaggctgggagagaaggcgctacccttgtttaagctcctcaagcgctcagggccgttcacttggacggaggaagctgaaaatgccctcgcccagttgaaggcgtatctcagctctcctccggttctagtcgccccggagccaaatgagtccctgctactttacttagcggcgaccccccaagtagttagtgcagcgttggttgtggagcgcgatgaggacaatcctcattctgcgcacccccgctctgtgccgacttggcccgggagcaggcagggaggagaggcccccgagtcgaacggtggcctaaggcccccgacgaccggagtcggccctccacccgcttgtcaaacggtgctgggtgcccccgaccctcaggaaggccccaaggccactgagggaaggctgcacttaaagccctttggccccgaggctaaccctgtgctgactcgacccaggaaagagcagggagaagaggcccccgagccgaacggaggccagaggcccctgacgaccggagttggccctttgcccgcttgtccgacgatgccaggagtccccgacccccaggacggccccgaggccactgtgggagggccgctcctgtcatcctccgaccccgaggtcatcagcgcagaagacgagttcgccccgaggggccacttggacgaagaacgccccgggggtacggcccctaacgaggaggatcggccccgccgaaaggtgcagcggcctgtctactttgttagtgaggccctccgggacgccaagacccgatacccacaggcccagaaaatgctttacgctgttctgatggcctcaaggaaactgcgccattatttccaggcgcatcgggtcactgtggttacgtcttaccccctcggtcaaatcttgcataatcgggagggtactggacgggtggtgaaatgggcaatcaaactttctgagtttgatttgcactttgaaccacgccacgctatcaagagccaggccctcgccgactttgtggcagaatggaccccggctcccgagctcgtctcggtccccgaagccggctcgggtccctcgcagctgcctcacaccgcccactgggtgatgcagttcgacggctccctgtctcttcagggcgccggtgcgggggtcacgttgacctctccgagtggagacgtcctcaaatacttggtccgcctcgactttcgagcgaccaataatatggcagagtatgagggactccttgccggactcagagtggcagctggactggggatccgccgcctcctggtgttaggcgactcccagctggtcgtcaaccaagtctgcaaggagtaccggtgctctgacccgcagatggacgcctacgtgcgccaagtacggcgtatggagcgccattttgacgggattgagcttcggcacgttcccagacgggataacatgatggccgacgagctctcacggctcgcgtcctcgcgagcccagaccccaccgggcgcctttgaagaaaggcttgcccagccgtcggcgcgacccgaccccttaggggagacggatgcgcctgaccggcccccgaggcccgtcggagtccaggcctcgggacccaaggggagtgctcccagctcccttagattgattacttggatcgccgagatccaagcatatctcacagataagactctacccgaggaccgcgaagggagtgaacgcgtccgtcgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcctcgcgcaccttggttggtaaagcttttcgccaaggtttctattggccgacagctctcaatgatgcggtcgacctggtccgccgatgtagagcatgtcaattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacggcccggtttggagtgcctaaccgtattattacggataatggcacccaattcactagtgaactcttcggcgactactgcgaagacatgggcatcaagctctgcttcgcctcacctgcccaccccgaaagcaatggccaagtggagcgcgccaatgcggaaatcctcaaaggccttaaaaccaagaccttcaacatactcaagaagcacggcgattcatggatcgaggagttgccagcggtgctctgggcaaaccgaactacaccaagccgagcaaccggggaaacacctttcttcctcgtctacggcgcggaagcggttctcccatctgagctcaccctgaagtctcctcgggccaccatgtactgcgaggctgatcaagatcagcttcgcagagatgacctcgactacttggaagagcgaaggcggcgcgcggccctccgagccgcgcgctaccagcagagcctgcggcgctaccatcagcgtcacgtccgggcccgatcactctgcgtcgacgatctcgtcctacgccgcgtccaaacgcgagctggattgagcaagctctcaccaatgtgggagggtccgtatcgagtggtcggcgtcccccggccgggctccatacggctggacacgggcgacggcactgagctgcctaacccgtggaacatcgaacaccttcgtcgcttctacccctgaggggggggggtcgggtgtcaggtttcgggctcgggccaaccccgcaccccctcgggcgtgcagggttggccgggggctgccacacatgcactttcttatttctcttttttcagaatttcaataaaagcagtttcaatttcctaaaggttgtatctgtgctgttttttccttttgaagaatcttgacttgaaataggtcactcgcgctcaatcctgccctcgggggctcgggtcggctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgtggatctccccaggcactagccccgacccgcgccttttgaggaccagaacctgggcacgagcccttattcaagctaaggcacaaaaggactatggcacagatcatcctcatctcatactcacagcaagatgaaattgacacaaaaatttcttcattttttgattacagattaagttgatctatacaaagcccgaaggccttagaagaaagaaaagaagaaaaaactgaagaatggcgggggtctgggggctcatcccgatgcgcccggatcgccggcctcgacgtcactgtcgtctacaccaccggcattgccctcatcgtcggagttgggggcaaacgcaagccgaggggccgagccctcgaagctgtcgacgatatagtcggcggcgtcccggacttgcgcgcgcgcgcggttctcagtcccaggagggaactcatccagcgccatccatggagagaagttggggtccctggcctggtaactcgccaggacgagctccaccgctccttgggcgaggtccctcgaggatgacttaattgtcttctcgagctcctcggggagccgttggagagccccggccatcttcgagaggtgctgggcgaggcctccctggttgtcggcgtactttacggtccgccctctccagaggcccacttgccgaccggcgcgatctaggcgggagacggcgtcccaaagcatgccgggcccgacctcgcctgccaagcggagggcttcaacctccccggcggacgagtccagcgcgccctgcagaacggcgatggtgtgttcggcatctgcgaggcgggcggctaagtcgctttcgcccgcggccgccccgccgctgagcgccctcgcttccagctccttcgcccgcgcttcgagctcagcggcccgttggttcagtgcggccctctcggcgcgggcaccctccagattgcggcgcgcctgctcctcctgcgctgcctcgcggagggacaggctgtccgccagctgttgcgccgcggcctcggctccctcgagagctcgctcccgctcgatgagcgcgtcctcgcggaggcggagcgcgagctcttcttcggcgcaggcagcgtcgtgcgccgccagcgttgcttcccggatggtaacggcggcctcgcggtccgccagatccctctccacgacgcaggcgcgctcttccagcgccatggcgcgcgcctcaagggcctcttcgcgccgccgggacgtcgcttcggtctccgccgcccgctgttctcgggcagcggcagcgtcaagcaccccctgggcggcgtcgagcttcttccttagctccgcctcccagctcccgtattgaaggcggagggtgtcctgcgcctcgttcatcacggtggtggcgatgagggcagccccccgctccttctccacttccttggcgatctccgccagcaccttcttgcgggtttcaagctccgagacatgccggcggtgagccttacggcccacctccaccatggcctccaccgagcgtcgcccctcttcgacacgcgcccacgcggcgtcgagctccgcccgctctgcctgcagggcctccacctgggcacttaacccgtccaacaccgtggtgtttgcggcggccaaggcttgcagaaggggctctgcgctcagtagggcagcagaaggcgtggggaaaagccgcctcggagaagatgccacgcggctcggcccgccgatggaagtgccggactcggggatgtctcccggacccgtttggtcctgagcgtcgcccgagggagtgggcccaagcgacgcgcccgccgcctcgtcgccagctgccccggaagttgtcgcctgagcgtcgcccgagggagtgggcccaagcgacgcgcccgcagcctcgtcgccagctgccccgggagttgtcgcctgagcgtcgcccgagggagtgggcccgagcgacgcgcccgcggcctcgtcgcgggctgcctcggaagtcgccatcgtctcgtcctggcgaaatccggcttcctcccgagcagcttcctcggcctggtgggctcgggcggcctcatcccgagcagtttcctcggcctggcgggcccgggcggctccctcccgagcgatttcctcggcctggcgagcccgggcggcctcatgggcggcctcctcggcttcccgtaggcgatccgcggcgtcgcgccggtcagcttcccgcctacgggcctctgcggccgccggatcctcggcctcagactggccggacttggaatggcgggagggacgcgacgggatctcgctgaacaaaagaaaagaccagaagacgaacaagatgggtgagtgaaaactcgcgttgagagaatgaatacagccacgatgggtgagagacgaacctgcgagggggtcggttaaacgaccactttggaggggaaatgaggtttccccgagatggttctgtctcctccatcttgcggggccgcttcttcttgcgctccccctcgggctgcgatgctggcgcggccccctccgggcgcttgctgctggcacgcgccgccccgccccctcggggaggagatgggggaggtgttcctccctgcttcctcttcccccgggcgtcggcagggcggctgctccccgggcccctgccacgggacccagaagcacgaccccctctcggggtagattgttccccccggcggctcccgcctgcgccgtcgtggccctttggagctcgctcctctgaggccccgaccgccatcataatggtcaagatggaggcgcggtctggatcgctgcagagggggaggattccttggggaatgagggccgcctccacggagttgagattcagcacccgttggaccaatatcttgaagtcctcaggagcccagtcccatctcactccctggtgggtcctcatgaagtcttcggacccggtgtactcccaggcgccccgagcgcgccgctggagcggcgcaatccgacggcggaggtagtcgccatacaccatggtccctgtgagcccctgggatcgcaggcccgccaggcggtcgaggacggcgtcatagccatcccccagatctaccggcgcccgccagctggaggcctgcgccgggggctggctcggaagtcggaggcgcgcttcgtcggcgaggggagtgtagaaccagtcgctcttccagtcgtcccacttcttgcggagggcgcaggggatgtagcggttcagcgccggcccccgtggctggaagtagcagccgccgactaccgatggcggcgacaccggctgcacggtgaagaaccaccggaacagccgaagagatgggcgcaccccaatgaacatctcgcacagatgcgcgaagatggccaatgacatcaccgcgttgggggtgaggtgcgccatctggagatcgtagaactccagaacatccatgaagaaagaagaaaatggcggaaccagccctgccattgcaaaggggagaaagaagacggaccgccccgggtagtctggcgccgggcgtccctcgcccagcgtaactatctgtcacaccccgaagttttcctccctagtcaaaattgcaatttataattgaccccaagaaaatgcagaggaaatcaggataaaaccctaagaaaataatgcaaataataatcagatttgacatgtggaatttttcttgaattctacatgtcgaaattcattaacaggatttttagtggaattttcagagctctagaaataattttaaccaaataaaaatcactaaagtgcaattgttaattccagggaaaatcctttttctttttctttttcctttttccccttttttccctcctttttgtccaatgggccgtcggcccatttctctttttcctccccctcctctctgttgggccggcgcaggccaaggcccagcccgacagccggccgcccgcccgcctcctctcggggtcgccgacaggtggggcccacctgtcggacccgtctccctcctcccgccgatcccgctcgtgccgccgccgccgcaaccgacgccgcgcccacgtctccgccttccccgggccacgtcgaccacgcccgcgcgtgcgccgcattccccgcgcccgttcccctctctctcccactcgcgcccgcgcccgagatggccgggattcgaaaaccgaatcccgcctctctctcctccccactcccccacgtcggccgtcgaatcccgccgctcccggccacgtccggttcccccatcccctatttaagcatcgccggcaccccctctcgctttttccccattgcgccgacctctcccgagccccccaacgcctccgcgccgtgcaaccacccgccgccgccgcttttgctactccggccgccgctagccgccgctaggctcgccgccgtctcacgccgtcgccgccgttagcttcgcgcggccgaggtccacctcgtccacccctcctccgtcgaggttcgtcgccggaaccccctccccacgtgcacgggtgagcgtcacctctaccgccgccttcggccatggatcccgatcgccatggtccatctctctctctctaatccctctcttctccttccttagggcacgccggagctcgtccgctatccgacgccgtcctcccgtgacttgccgtcgccgtccgccatcgccttcctccgcgccggccaccctcggtgaggcatcccctcccttcttttcccccttcctctcctcctagagccgctaaccgccgctctccgccgccggacgatcgccgtcggtcgttgctttgcgccgctgccgcatgcgcgccgccgccgtgtgagcgccgcgccgccggcgccatggtcgccgctgtctcgcgccgcgcccgcgcgccccggccgcgaggtcccgcgccgccgtccgagggtagatcggggccgtcggttcggccgccacgtggcgccgccgcccctcctttccccgtgccgctgaccggtgggcccgcgcgccgccacccccttcctctctctcccggtcgctgaccggtgggccccgcctgtcggcgccgagccgcgccccctcgctgacgtcagccctggttaatattgcgcaataaatgatttaaggtttttcttttatagtaataaacacagtgaatcttctaaaattcataactaattcatccgagctccgtttaagcccattcaagtctcagtaaatcaaggaaaatgtgtagaatccattaaaaatggttttgttctctgtttcagtagtcttatagcctgtttgcaatgtttgctttgtatgtcgttagattccgatccctccgacgctccggtgtacttcgagatagtcgccgaggtccctccagcagcagagcaaggcaagtcatgcttgtcacttgatcatattgatcctatattgcaaatgtcctaatgttttctttcaaatatcgcatttgttttgcaattatactatgggagggttacctattgttacagctatgccttttgataccatgctcctttgttagcttgggttataacatgattagattttggactaggaattgcttagccatgcttagttcaactagcacacattggggatcttatttaaaacctagactataggtttatatgataatgttggtttaataccaccgctctggtgttggttaaataaaatgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagttcaggtggatggctgggcctgtcgcaacgtgggttagcgttggacagcggatgtttaatactgcttaattattacaactgttttcgcattaaattcctgtttataaatgccagtatttatgcaaatgaaccactctagctcttctttgttaattccctgcatcatacccccattccggtatgacttgctgagtacagtgggtagtactcagtcttgctctatttttcccaaccccagaggacgggtatgtgtcagatgaaggtttccccgaggagtaggcttcgtccgtgccgtcgaggatgcctgtggagtggtgttcccgctgcggtttagtcaaggcttaagctccagtttcttttgttttccgctgcatttttgtaagacctttataatgtttgtaagacgtggatctgtatgtcaacattgtcgtttgtgtaccccggctggtcctggacgggggttttaatacacattctgcttggaattctattcgggaatttctgggcgcgacaagttggtatcagagccgaccttgaccgtaggacaagccaaatggaaagacctaagagccctctgaatccttttcattgcatatcttctttgcaattggattttgtcccgggaaaatggggatctgttcttgtggttcaagggaaaaatcttgtcgcttgtttaagtgagatttttcaaaacgagtcagtctagggttttagtaaaattattgggagtttttcggcagtcagttgggatgtgatgggtgaaatgcattaggtcctagctcggtatcatgggttgcaaggtgtttatacttcgtttgttattattaatatgtatctaatttctcattattttatcgttatgtgagtctgtcttatttattcgctctcatgtaaaatgatctatgcataaaattttgctcttatttgattcctttatttgagtctttattgctttatttaaatttggatttgagcatgcattgatcctactcctttgtcttctctagatggccggtcacccacccaaccaccgcggtgaaggcatgatcgactttgtggcagagctggcacgcatgacactggtagtgggctaccccgacgcgccggagtacacgacgattccgccgctcagtggcgagcttcctcaccgtgtccgcttggaggtccatggttacgtggggacttgcctcgctaacatggcggtcgaggcgtcaggaggcacagcagatcacgcttgtcaggaggcagcctacctgatgatggccagactacgggagcgccacaactacattttccacggcacggcgtaccgctaccaccccagtcgagcccacggtgatggcgtcagctccttccgtccaacagctggcgagaacgacaccacctttggccacatgtgtgcggtgatgaggggtttggacaggatgcactcggatctgcacaaggcgaccaaggccttgaatgatgggaagctcatgaggatcgtcgctctgaaggacgagatagcgcgtctgaagaaggagaacgctcagctgaagggtctcccagcgccaggaggagtccggatccgcactacgccccgtaagaggacgactgcacctgtgcgcatccagcttgcgcccaggaacccacctccaccagcagcccccgcagcagctccagctccgcccgcagttcctgcagctccagctccagctcccgcgttcactctctccttcgctccagcatcagccgccagaggttcagccagtggtaccggaggttggctgtctgctactcccagtggcagcggcgagactgatccgtcagactccaggagtcgctcagagggaccgggtgacgagcaggaggacgccttcgactccaccgaccgcaggagccgttccgagcattaggctcgtttttccactagttcatcgactgtctagtttttgtttgttagtttgtgtgtttaggttgcttgtttggggtcagtcgacggtcgatatcatgtgcctatgatatggctgtcttaataaggatgtttgcttgctcttttaagtgtttttaattcagatcagaacaattgcagttttaattcctatataataaagcttagttcttgagcatctgtttttcttcttttccccgtctgttcttccctccagatggtctacaccaggactggtaaccgcacgacaggcgagggcagcaacggtgaagaacgcgttgatggtgtgcatcccaacggcgatcccggcaacggtccgccaccacctcccgagaatccgaccctggcccaagttatggcgcatcagactcagatgatggcagccatgatgcagcagatgcagcagcagcaccagcagatgcaccagaggatgatgcagtacgctgaacagcagcaccagcagtttggtccccctcccccgcaatccaagttgcctgagttcctgcgagtcaggccacccaccttctccagcaccaccaaccccatggaggcaaacgactggctccatgcaatagagaagaagctgaatctcctgcagtgcaatgatcaggagaaggtcgctttcgccacacaccagcttcagggtcctgcgtccgcttggtgggacaaccacatggccacccgcccaccgggtactgaagtcacatgggcagagttctgccgtagcttcaggaaggcacaggtgccagatggggtcgtggcacaaaagaagagggaatttcgtgcactccatcagggcaacaggacggtgacagagtacctccacgagttcaatcgcctcgcgcgatatgcaccggaggatgtccgcactgacgccgagaaacaagaaaagtttatggcaggcctggatgacgagctgaccaaccaactgatatccggggactacgctgactttgaaaggctggttgacaaggcaatccgtcaggaggatcagcgcaacaaaatggacaggaaaagaaaggcggcgcagttccggtccaaccaaggtagtcagcaccgaccgcgcttcactcctggacagcagggtggacctaccaccatgatcgtccgtcagcaccgcccgttccactctggcaacttccaccagggcgctagcggcagtcagaaccaccagggaggccagcccaaccgcggtgcagctccacgcccaccaatggcaccagcacagtcagcccagcccgcgcaagccaagaaggagacgggagcaaaaccagggtcctgcttcaactgtggcgagcttggccacttcgctgacaaatgcccgaagcccaggcgtgccggaccaaggtttatccaggctcgtgtcaaccacgcatctgcggaggaggcacaagcagcaccagaggtcgtactgggtacgtttcctgttaactcaatccctgcaacagtactttttgattctggtgcaacgcattctttcatctccaagaaatttgtcggggtgcatgggttaataagagaggaacttagcacaccgatgcgggttcataccccagggaatagctcctcttcggttcaattcagcccttctataacaatagaaattcaagggtcaccgtttctagccaacctcatccttctcgaatccaaagacctagatgtcattcttgggatggattggctgaccaagtttaagggagtcatcgattgtgcgaatcgcacagtcaccctgaccaatgagaaaggagaaaccgtggtgtacaaatctctagtctcgccaaagaaaggagcctcgttgaatcagattgagacggaaatcccagtggacaccgaagagaagaacttgagaaaattggaggacatacccatagtctgcgagtatccagaggtgttccccgaagacctcaccaccatgccacccaagagggagattgaattccggattgatttggcaccaggaaccgctccaatctataagagaccgtacagaatggcggccaacgaattagcagaggtcaagaagcaagttgacgaacagctgcagaaagggtacattcgaccaagcacttcaccttggggcgctccggtcatttttgtggagaaaaaggataagacaaagaggatgtgcgtcgattatcgcgcacttaacgaggtcacaatcaagaataaatatcctttgccgcgaatcgacgatttatttgatcaactgaaaggagctaaagtgttctctaagatagacctgcgatcaggctaccaccagttgagaatccgggaagaggatattccgaagacggccttcaccactcggtacgggctatatgagtgcacggttatgtccttcggacttactaacgcacccgcattcttcatgaatctgatgaacaaagtgttcatggaatttttggacaagtttgttgtggtattcatcgacgacattcttatctattcaaagtccgaagaggaacatgaacaacatctccgtctggtactcgagaagttgaaggagcaccagctatacgccaagttcagcaagtgtgacttctggttgacggaagtcaaatttctgggtcatgtcattacagctcagggtgtagcagttgatccatcgaacgtggagtcagttaccaagtggaccccaccgaagacagtgtcgcagattcgaagttttctaggactggctggttattaccgtcgtttcatcgaaaacttctcaagaatcgcccgacccatgactcagttgcttaagaaagacgagaagtttaaatggacagctgagtgcgacaagagctttgaggagctcaaaaggaaattagtatccgcaccggttttgatcctgcccgaccagacgaaagacttccaagtctattgcgatgcatcccgtcacggacttggatgcgtcctaatgcaagagggcagagtggttgcatacgcctcgcggcagttgcgtccacacgaaggaaactatccaactcatgacttggaattggcagcagtggtccatgccctgaagatctggaggcactatctgatcggcaaccgctgcgaagtatatacggaccataaaagtctgaaatacatcttcacccaaccggacctaaaccttcgacaacgaagatggttggaactaatcaaagactacgacatgagtatccactaccacccgggtaaagccaatgtggtggcagacgctttaagccggaaaagttactgcactgctctatgcatcgagggcatgtgtgaggaattgagacaggagcttgaacatctcaacatgggaattgttgaacacgggttcgtagccgctctggaggcacggcctacgctcgtggatcaagttagagccgctcaagtaaatgatccggaaatagcagaactgaaaaagaacatgagagtcggaaaggctcgggatttccttgaggatgagcatggcacaatctggatgggagaaagattgtgtgtaccggacgacaaggaattgaaggatctgatactcaccgaagctcatcagacccagtactccattcatccaggcagcactaaaatgtaccaagaccttaaagaaaaattttggtgggtcagcatgagaagggaaatagctgagttcgtcgcactctgcgatgtttgccaacgagtgaaagcagagcaccaaagaccagcaggtttactccaacctcttcaaatcccggaatggaaatgggaggagattggaatggactttataacgggactgccccggacatcatcgggacatgattcaatttgggtagtcgtggatcgactcaccaaggtggctcactttataccagtacataccacctatacgggaaagagattggcagaattgtacctcgcaaggatcatgtgtttgcatggggtacccaagaagatagtatccgaccgaggtagtcagttcacctcaaagttctggcagaagctgcaggaagaattggggacccgtttaaacttcagcacggcctatcacccgcaaactgatggtcagaccgagcgtgtcaatcaaatcttggaggatatgttgagagcttgcgctcttgattttggtggagcttgggacaaaagcttaccatatgcggaattctcgtacaacaacagctactaggccagtctacagatggcaccgtttgaagctctatacggccggaagtgccgcacaccgcttttctgggatcagacaggcgaacgtcaactgttcggaacagaagtattagcggaagcagaagagaaagtcagaatcatcagggaaaggttgaggattgctcagtctcgacagaagagctacgcggataaccgccgaagggagctcacttttgaggcaggagattacgtgtatcttcgtgtcaccccgctccggggagtacaccgctttcagacaaaaggcaagttggcaccacgcttcgtgggaccatacaaaattttggaacgaagaggagaagttgcctatcaactagaacttccgtccaacatgatcggcatccatgacgtgttccacgtatcccaattaaagaagtgtttaagggtacctgaagaacaggctgattcggaacacattgatatccaggaggacctaacatatgtggagaagccggttcgtatacttgacactagcgaaaggagaaccagaaataaggtcaccaggttttgccgtgttcagtggagccatcattcagaagaggaagcaacctgggaaagggaagatgagttgaaagccgcccatccgtacctcttcaccagctcctccgaatctcggggccgagattccgtttaaggggggtaggtttgtcacaccccgaagttttcctccctagtcaaaattgcaatttataattgaccccaagaaaatgcagaggaaatcaggataaaaccctaagaaaataatgcaaataataatcggatttgacatgtggaatttttcttgaattctacatgtcgaaattcattaacaggatttttagtggaattttcagagctctagaaataattttaaccaaataaaaatcactaaagtgcaattgttaattccagggaaaatcctttttctttttctttttc

SEQ ID NO: 2913 - DNA, 1671 bp, Oryza sativa
ttggatagttcaggtggatggctgggcctgtcgcaacgtgggttagcgttggacagcggatgtttaatactgcttaattattacaactgttttcgcattaaattcctgtttataaatgccagtatttatgcaaatgaaccactctagctcttctttgttaattccctgcatcatacccccattccggtatgacttgctgagtacagtgggtagtactcagtcttgctctatttttcccaaccccagaggacgggtatgtgtcagatgaaggtttccccgaggagtaggcttcgtccgtgccgtcgaggatgcctgtggagtggtgttcccgctgcggtttagtcaaggcttaagctccagtttcttttgttttccgctgcatttttgtaagacctttataatgtttgtaagacgtggatctgtatgtcaacattgtcgtttgtgtaccccggctggtcctggacgggggttttaatacacattctgcttggaattctattcgggaatttctgggcgcgacactatctcccggccggtggcagattccggcatgaagcggcgcggcagcccagcctgcctctcgctcacgatgcgggagggcggcagcacgctaccatcgagcagagcggagccccgtgccatggcgccggaaggaagagaagattaagagcgagcacgagtggcgaaggtagggcgcaggaaagaaggagttagggcgcaagcggcgaagacaaggggaataatggcgaagggaaggaaacaaatcccttcctcagtgcctttatacccttgcccggctcctcgcttctcgcgcccactatttcgccccctcgtttctcgcgcccacgcttccactaatcccattcgcccgcttgcggcgcatgaggtggatatgcggttgtggcagtcgaggtagatcatatcgtgcgcgcgttaattacgctcgccaaccgaagcgacattaccatatctccagatgaaatgaatcgccatgtccagattcgtgtgctactcgagtaatgtggcagtcttgaagagaccgctcattattgacagccgagttactattgccgatgtgcgtgatttttgaccattgggtttctgcccaatggtggagaccggtcccacctgtcaccaggccttaggagtggcgtcacgcccgaccgcttcccttgaggagggcgatcgccctggcataacgccgggggctactgtcggtgacatgggatcgggagtatcatgactagaggcttgaggcagacacaatcgcccacgtggcctggcacccccgggggacgtcgggctcgagggtgatgtgttcgccctcctcttagtccccccgagggggtcgggctgcacccccctcggccccgagggtcgaggcgccccgacccctcgtgggttttcgctccgcgcgtatgagttaggtgagcacagtggggctcacctaaccacatttattgcggattggctgagtgtgtcacgacgcatgcaacgtagtgcattgcactcatttatccggtctgtgaccagtcacagaccggtcagatcgcgggttaggtggcgacaggcggtctgacgcacgcctcgccccatcccgtcaggacgagggcttctaggcgctcgtccccagctggagctagcgtgttacctcccagagatggcacgtta

SEQ ID NO: 2914 - DNA, 3430 bp, Oryza sativa
agggccaacgtgcagattgctaagctgacgcgtggtggacaagaatgaccgatttgtgaccagtctgacaccggtcatgtcgccagcagaccgccatgattccgcgtcgcgcctgctcccggcgaaagtggaggtagttgtgggccgtcccatcagaaggcgactcggacggcaacgatgcaaatctccgtccatttatgaaaaggtagagtaagtccccagggagagggggagaatggtgcatgtggtatccccttaagatatgaaaggaggaccttgcccactgaggagaaggagagattttcgagagctttttcttggactgaacctttccagattaggatcctagaacaaaggagaggctggctcatactttgtagctccttcacacacgaatccacctaaaacacaggagtagggtattacgcttctaagcggcccgaacctgtatacatcgccggcgtcttctgtgcttcctgtctggcgaaccttccacatacagattgggagcttagagtctcacctagggtccccggccgaaccggcaaaggggggccagcgcggtctcccggtgaggagccccacgctccgtcagggtcgatcaatagttgggccgatttggagaagcaattccacagctatttctacagtggggttcatgagatgaagttatctgacttgacggcgattaagcagcggcatgatgaacctgtgcacgagtatattcagagattcagggagatgaggaacaaatgcttcagcttgagtttaactgacgctcagttagccgatctggcctttcagggtatgattgctccgattagggagaaattctcatctgaagactttgatagcttgtcacatctgatacaaaaggtaaccttgcacgagcataggtctgcggaggctaggaaaagctctaagaaggttaatcatgtttgtccttacatgtatgggtcggatgacgatgaggatgactctgaaatagctgcagccgaatgggtgaggagtaaaaaggtcataccgtgccaatgggtaaagaattctggaaaggaagagaagtatgattttgatattactaaagctgacaagatttttgatctgctactccgagagtagcaaattcaactccctgctggtcatacaattccatcggttgaggaattaggcaaaaagagatattgcaaatggcataattctgggtcccattctactaacgattgtaaggtttttagacaacagattcaggtggccattgagggaggcaagattaagtttgatgattccaaaaagccgatgaggatcgatggtaactcatttcccgttaacatggtacacagagctgaccgaacagctgatacggggtgcatgaggggttatcaagtaagttcggctagaattataaacaaatattaaaggaaatacgacaagcaacaagaaaggcgtcatgaagaagataatggtggctttgatcctcattggggctgtgtgttcttcatgttctgttggaacgaaggtatgaggctaccatctatcgaggattgtcctggatgaagtgatgttgcagggggttcaagccgattgtacgatggaggcaatcggccaaaacaaacaagagtacctgttcatcaaagattgggcccagtaaaccaacgtggtgattcggaagacgacaaaaataggaagactcaatggtgtccttctggtatttttacgaagaatcagaaaagaagggttcaaagattgaggagtagggaacgcttccaggaggtcgagcaagaaattaatcatcggctaaagaaagaaaaaccgaggcaggagtggcgtgttaagaatcaggctcctgtagcccatgatgttgcagccgatgaggcaaagaggttggcaaaaggaaagagtgttgtgatggcaccagttaacatggtttttaccttgccatccgaattcgggatcgatcaagccgatgtcgatgaggtggaagaggaatcggcttagttggttctatcaccagaacaggcggtgttcgagaagcctgaggggacagagaatcggcttcataaaccattctgtataaatgctatgtcaatgggaatccgatatctaaaatgatggttgatggtggggccgcggtaaatttgatgccttatgctacgctcaggaagttgggtagaaatgccgaggatctcatgaagacaaatatggtgctcaaggactttggtggcaatccatcggaaaccaaaggtgttctaaatgtggagctgacagtcggcagtaagactattcctaccacattttttatcattgatgggaagggttcttacagcttgttgcttggaagggattggattcacgctaattgttgtattccttcaactatgcatcaatgcttgattcagtggcaaggcgacaatatagagatcgtaccagccgacaggtcagttaatgttgccagtgccgatttagctctttgggagatggatggccttgattgtttatctggaaaagtttggaatggagattttctaaaagtgtccgattctgatatacagccagttgaagatggagaacccaagctattattttgagggcgtcgtggagggttcaaatgtctacgctaaggatacggtagatgatctcgatgacaagcaaggtcaaggttttatgtcggccgatgatttggaagaaatagatataggttcaggcgatcggccaaggccaacatttattagtaagaatttgtctccagaatttagaaccaagctgatagagctcttaaaagagtttagagattgcttcgcttgggagtatcatgagatgcctggactcagccgatcaattgtagaacatcgactacctatcaaacacggggttaggccgcaccagcagcctccgaggagatgcaaagccgatatgctggaacctgtcaaggctgagattaagcatttatatgatgctggttttattcatccttgccgatatgctgagtgggtttctagcatagttcctgtcatcaagaagaacggcaaggtgagggtatgcattgattttagagatctgaataaagctacaccgaaagatgaatatccaatgccagtagccgatcagctagttgatgccgcgtcagggaacaaaattttgagttttatggatggaaatgcagggtataatcaaatttttatggctgaagaagatatccataagacagcttttagatgtcctggtgcaatcggcttatttgaatgagtgttatgactttcggcttgaagagtgctggagctacatatcaacgggccatgaattatatttatcatgatctaattggttggctggttgaggtttatattgatgatgtggttgttaaatttaaggaaataaaagaccacatagccgattaagaaaagttttcgagaggaccaggaaagggctgcag

SEQ ID NO: 2915 - DNA, 651 bp, Oryza sativa
catctcaatcggcttctaggaaattaagatataaggcgttgaagtacactcgattggatgatgagctttattatcggacgattgatggagtgttacttaagtgtttgagtgccgatcaggctaaagttgcaatcggcgaagttcatgaaggaatttgtggcactcaccaatcggcccataagatgaagtggttacttcggcgtgcagggtatttttggccgacaatgctggaggattgcttcagatattataaggggtgtcaagattgtcagaagtttggggcaattcaacgagcaccggcgtcggctatgaatcctattattaaaccgtggccattcagtggttggggaattgatatgatcggtatggtaaacccaccatcaagtaaagggcataagtttatattgatggcgactgattatttcaccaagtggtggaggccattcctttgaagaaagttaattctgagatgcaattcaatttgttcaagaacatataatctaccaatttggtattcctcaaactattacaactgatcaaggttcaatcttcgtatccgatgagtttgttcaatttgccgatagcgtgggtatcaaattcttgaattcttcaccatattatgcacaagctaatgggcaggccgaggcatct

SEQ ID NO: 2916 - DNA, 6525 bp, Oryza sativa
aaaattcacaaggtaaagctttcccttgagaacacacttaaagactaccgaggaatcattccttctatagacggtcacatcaacatcggtaaaaagacaattgtaacccatagaacataattgagaaacggacaaaagattgtagtttagagattttaccaagagaacgttggcaatagaaagatcattagagattgcaatcttacccaatcccataacgtttccctttccatcgtccccgaagactatgttatcttgtgaagtgccatttggatcaagagatgaaaacattgattcttctccggtcatgtgattggtgcatccactatcaatcacccaacttcttccaccagtgacatattcctacaagggatcaatttctagttttaggtacccatacttgcttgggtcctctcatgttagtaacaagtgccttaggcacccaaagaactctcttgatagaaatattcttgccccttgggcctacatacttagcaacaacacgaccactagcattcttcctaagaacataagatgcatcaaaagaacaatgtgaagcacaatcattaggaaggatacttttggccctaacaaagttgctaagaccttggggcctcttgatcatcacactcttgtccacctttccttttggtggaggaacatacccaagaccctcatggttgaagttgtccctttgatagcctaggtactcttttagggccttactacccatatggcacttaagtaggccattgtgaaggagtcccataagcttctcattttgcttttgcaaagcactcaaggaaatagagttagtagcacaagcttcaatatcaatatctttgcatcttgcacaaggttcattgcttggggcaattttggagcatgatgccttgctagggagagagacactattctttaaggtttcaaacttctcttcaagagagaggtaagctttatccaagccatccactctctcttgaagttgagcgtttgccacctcaagattagcatgagactctttggtttgcttgtaaagccgtaccaaagcctcatttttctctctccttagcaagttcgcacttgagttcatgagatcgctctttctcatgaatgagcaattcctcttgcctctcaagtgttgcatattgatcctcaattctcccaagcaactcactcaagtgtggtatggattctgtcacgcccggaaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaattaacggtctagcgatggcttcagctccactcccacaggcagctcaactggggtataagccaaacgtcttctccttctggatcctttatcttcaactgaggttgattgattattgcaagaatgagcatatgacatactcaacaagccacacagcaaatatgcaagtgcacaaggataccaaaggatggcataatataggctcatttgcgaaagcagcatttagcaaagagttaagagtagtaaaacagtagagtaattaattaaaaattttaatcaacactgaacagcacacccatgctgtacaggcccaaccatcctgaacaaccatacccggctgtacagatctaactccaaaccaggagctaagcaaattattatcaggtattaacatccataattattgtgagaggtgtgagactaatcacgaaaaacattgctcaactcgcccataaccgcgggcacggctattcgaatagttttactctggccagaggtgtaccactgtacccacaagacacgattccacacatgttgccatgccccgaaataccaccacggcattgcaaagggggaaatcgtgacaatacccttcgcacaacacaactcaaaacagtgcaccgttcctggatcataatcacccccttataaacaaggcatggactccccagcgacccccatggacttctcgccacttctcagtctggcgcactataatgaatcatgctatacaaaagataaagccgttgcccatgctggcttgtggttggtacggttaatgtttcacaacagtagctcgcgaaccggtccttaattgtcaggagcacgactctcaaaaccatgtgctcacaacccaccattatgaagttttagttggcaagtaattaattaaccaatcacgattaaccatcgtgaactatcattaagccatccttaaataatagtgagtcataagttatcccaatagtgtgctaatgtttctaagcatggctaagcaatcataactaatatctagctgaaccaatatataaagcccaactagtcaagttataataacccaaggtatcaaggaataaagtaatcaatgcaaattggccataacaaaggaataagttcacaccacccggtgacattcgaaaataaatgcacagttgaaataaatagagaatttaaatataggatcaatatgctcaaaggattgtgtttaggatctgtgtgacttgccttgcaataatcggccttcaagtaatcttcttgatcacttccgacgcactcacgaaccttcgcaacgacggaaacgacaagctaacacgcaaaacgaagaaaaagactaataaaaaccaaataaacagtacatataaagtaaacaaacatgtagatcatgattttagatgaatttagcaacttgaaccactcaaaaccgagttacgatgatttagttatgaatttccgaagatttaatctattagaaaaacgggaaaaagaaaaaccgatgacgtcatgctgacgtcatcaatggcagccgactcggatggcaagctcgccggagatagagcgaccggctgcggatttggaggacatgaacacgtagaggacgacgagacgaacccaacgatactcaccctcgtgccaaacgacgaccgacgacggccggcgacgaggaggcgacggcggcggctcgggttgcacggggcggcggagctccgatgaccggcgacggaaaaggaagggtggccgagcttcccctcaccacggcgcacccaacggtggtgacggcgaccggcgacgacgatggagacggcggcgcggcggcactggagatggccggcggcggctgtttgcttggcggcggtggcgacggagctacggagcacggaagaggacgggagagggggcaaacgaaagaggaggactagggggtcctatttatagccttggattgaagagatcggactcctcccgcaagaaatcgatccgggaaatcaaaaactcggttttggagataaactcaaaaacgagttcgattcggataaaatactcaacggtttgctccgattcttgggggtaaagatagaggaggataagaggaatatttcccctcaacaaaattggagaaaaagagcaacggggaggcgagatttggaaggaagaggcggcggcactgtgcacggcacggctggctcgggctctgcctgagttggaagatgaacagtagcgcagggagggaaaatagacttttccggctaggctgagaggagaggaggcggctcaggttgggccggcggaagagagaggaaggaaaggaaggaatgggctgaaaatggcccaagctgaggaggaggattttattactttcccaattaaaataatcacttaaatgatctttaaattattaaaaatacttccaatgctcaaataatttcaagaaaaatcctgaaaatacttggacactcaaagtacttaaaaaaattacaattagaccatttaatgattaatttaatatgtgggtaattactgaaatgctctttgtatgattaaaaattaggaattgagctccgaaaaatctgagaaaattccagagagtataattaaccatgaagaatttaataaaaattaaatccatccatgctttatatttaggaaattttatttcccacatttaacttcacttgtaaattaatgaacatttaatataaattctgataataatttattaaataatttataaatcctgaaacaaaaatcagggtgtgacagattccttggttatggatttaagcaactcatcatccataacttcatcctcaacctcatcctcctcgtcactaataaaatcaacattaaatgacttgagaggagaaggtaccttaggctcctttgccatgaggcaaatgggagcatcctcatcactttagtagtcgaagagtcttggtggtgatgaaggcttgacggcgaacgtggcgactccttctccatcacttgagcttgactcggagtcggagctgaaaatcatcccaaggtgagcttggccataatgttcccgcttgctatgcttatacttctccttcttctcatccttcttcttatcttccttgatgtgggaaccatccttgaggtgagggcaatccgcaatgaagtgcccgggctctttgcacacgtagcacactcttgcggaatgtcttccacttgacttgctggagtgatgcttggaagaatttcccttgaagaagccgcttcgcctcatgaacttgccgaacttcttgacgaagagaaccatttcttcatcatcgatctcctccttgctcttgctcttgtggctctcttcttcttcttcctttgccttcaatgccaagtcttccttcttgatgcttgtcgttgagctttggttgatgtattggatgacctccttggactcttgcacaagaatgtcatgggcaagaatgcgtccgagcaaatcatgaggtgtgagagtcttatagtccggacgctcacgaatgatggtaaccaaggtagagttccttggagtgattgctcgaaccatcttcttgaccacaacctcatcggtcatgtccttggagccaagtcccttgatctcattgacgatcttgctcaaccggtcatacatgtcacttgggctctcaccatccaacatcacaaatctctcaaattgccccttgaagatctccaccttggactcacgaacactatccgtgccttcatgcaagttccgaagcgtgtcccaaatcactttggcactctcaatgccatccacacggttgaactcacttccactcaaggcactaagtattgcattggcggcttgagcgttcttgtgcttattctcgtcgtcctccttggtgggatcttcgggattctgcaaaacatagcctttttcgactattctccaaatagatgggttaatagacttcaaatgcatcttcatcttatgcttccaagcggcatagtccgtaccattgaagtacggagctttgctgctataggtactcacataagatgtggatgtagttggatagtgataaggaaacttagctcccttatcaccatctttgccttcccccatttggcccgacatgatccctccaagcggttagcctaatttggagattaggctctgataccaattgaaaaggtcaattaggcctagagggggggtgaataggctaatttaaaactttatgccgaagctaaaactgatagtctgatccacagtcagactatccgaaaatatcagatagtctgatgttggatcagactgtctgatccactaaaagaacactacaagtagatctagtgcacaaacaagagtatggcccaaacagcgactagatttatagcggcacaaaaaacaaagctaaataatggaagaagagatatcaccaacaatgaagttcaccgagttcttcccggagttcaaatccttgaggggattctactctccgttgaggagctcactaagagccgggtctttgctaacccttttctcaagaggttgcactaagcactcctccttccactaaggggtatctctttccttgtggaggcgagatccggccttcacaaacttctcccggccaaccacatgtagatcggtggctcgggagtgacacctagccgtctaggagtcctcaacctccaagagtaacaaacatcacacaactcttggtcaaccctagtgctcaagatcgagtgaaacacacactaggccctcaaaccccaaatccacaaccaccaagatccaccacacaaagaacaagaggggatttgagagagggagagagagctcaaagatccaaagcaccttagcaccaagctcaacccaaagtgaatgtgaatgaatgagttgggtaaccctagaaaagggttaggtggggggtattcatagaagcccccaaaatgtggccgttgggagagaatcttttcatcccacctcggaaagtccgaggtgacatcggatagtccgatgtttttgacccccaagcaggccagagacagagaacgaaattctagagaatttcggacaatccaatcgatcggatagtctgatgtcatatcggatattccgttatttttgaaccaagaatttcatcctctcacagagactcaagttccattgaatttcttagtctctggatcattagatactccgatcatat

SEQ ID NO: 2917 - DNA, 1161 bp, Oryza sativa
agagtaaacttgattcttgaactgatccttgatcatgaggatacactgatttagaacagaggataatgattaagaagaagtggaagaagaatatttaaatgtgaagcaaggagaaatttggactgggccaaaaggaggtcggatagtctgatttgacgtcggactatctgatgtacattggactatccggcggcatattagacaatccgacggccttttgccctagaccaacaaatctcgattcacacaaaaatatccaatggaatcaaaggatcttctaggtactagatctaggcactaaaacaagaagattcaccgaaggaaatcttgaaataatataccatgagggagatagaggaaaaacaaggaaatacctcaagaaccaccaagagaatcactggggaacaagtgatttggaaggagttgagggagggaaaccaccctaaagagaaggaatagcaatcagagactctgaaacgaagatttttggtggcctagaactagggttttgagaggagaagaggggtggagagagaaacgactgagacaaatgactgaaggggtaaaaaaaaagagttacccccggggaggttaagtccccttgcccttggccccacgtcggatagtccgatttgaaatcggactgtccgattgtggccggatagtctgacttgatgtcagacagtccgacatcctttgtggcagagacaataaaggatggctcaaggaagattttttttttcaacaacatttttataggatgaactcggctagactattacttggacaaatgcagcaaaagaaagaaaactaggcaccctcaagagagggaatgtacgaatctataggaaattgtgcaaggaccaagattcattagagaatgagatccccgtacacatagattcaagttatcctcatagattatgactagtgtttattcatgaattgaatgttcactttgtcatgatgtggcaagcaaacctattctagtaaatgaaaaacaaatgcatgcaaaagatcaagccacattccgaaatccaagatattagctcacttctcaactcacaaaacctagcttcatcaagaggcttggtgaagatatccaccaattgtttgtcgggttttacaaggtggaagtttaagttgccttctgtggaaagg

SEQ ID NO: 2918 - DNA, 530 bp, Oryza sativa
gatccatgcttgaggtagagggaacgtcggcttgggttgatgtaggtggctccacttgtgttgaggaagaggcttggctccctaggacgcacgttcccaagagccaatcttttgattgcttcgcttggatcctcctcttcacctaacacatgtgagtcaacttgctctacttgagagccattagtttcgtcaaatgtcacatcacgcgcgatttcaacaataccggaggttttgttgaaaacacggtatgcgcattcatttgacccatacccaagcaagaatccctcatccactttgggagcgaacttagaggatctagccttcttattaagaatgtaacacttactaccgataacacgaaagtaagagacatttggtttattaccggtaagaagctcatagggagtcttcttaagaaggcggtgaagataaaggcggttgatggcgtggcatgcggtgttggcggcttggcccaaaaacggtccgatgtcttgtactcatccaacatggtcctcgccatctcaatgaga

SEQ ID NO: 2919 - DNA, 18568 bp, Oryza sativa
  unsure (1)..(18568): unsure at all n locations
nnnnnnnnnnnnnnnnnnnnnnnnnnnnnnnnnnnnnnnnnnnnnnnnnnnnnnnnnnnnaagagggccaaaagacttgtgatgcaaaaggcatttgatgtgaccaagggccagtaccagaagctttacaattatcaacaagaactgcttaggaccaaccgtgggagcactgtggcgatcaacagagtgataggtattgaaccacctgtgttcaaaagaatttacatttgccttgatggatgcaagaaagggtttatggctggttgcaggaaggtaataggacttgatagttgcttttccaagggatctacaaatggagagctattgtgtgctatagggagggatgccaataatcagatgtacctaatagcttgggaagtggcctataaagagaacaatgaagaatgtgaatggttttgtgacttgctgtgtagtgatctgagggttggtgatggaagtggatgggtcttcatctctgaccaatagaaggtaatgctcctgatccactgtttgcttttatgttctgtcaattctgtcattacacaatgcatacctaatgtcttgtgcatgttactatcaaatgcagggaataattaatgctgtctctaagtgggctccagaagctgaacacaggaactgtgccaggcatatctatgccaattggaagaggcacttcaatgataaagtgtttcaaaaaaaattctggaagtgtgccaaagcatcatgcagaatgcttttcaacttgccaagagcaaagctggcccaactgacccctgctagagctcaagcaatattgaacacacacccagagcattggagtagggcttggttcaggttaggatttaattgtgactctgttgataacaacatttgtgaatctttcaacaaatggattcttgaggctagattctttcctatcataacaatgcttgaaaccattagaaggaaagtaatggttaggatccatgaccaaaaaaaatgttctaatagatggagtactgtcatttgccctggtatacttaagaaacttaatgtgtacattgctgaatctgcattctgccatgctatatgcaatggggctgacagttttgaagtcaagcataatgagcataggttcatagttaacctagatatgaaggagtgctcatgcagatattggcaattgtcaggtttgccatgtcctcatgcaattgcttgcatctactatagcaccaacacactagatgggtgggttgctccatgctattaagtggaatctttcaaaaaaaacctatgcccattgcctgcagccagtagagggcatgactagttggccagatgatcctagagagcctctcaatgccccaggatacatacagatgccagggaggcctaagactgaaaggagaagggagcctaatgagccagctaaacctaccaaagcttccaaatttggcacaattatgaggtgcagatcatgcaagcaacctggtcacaatagcaagggctgtcacatgcacagtggggcaggtggtagcacatctgcagctgcaacatctgctccaggaaatacagtcactgcaaataacaacttagtgttgtcaagcacacctagcagcattgcacaaagcaggaaaaggaaggcagctgagctcagtactagcacatctgcttgccacactaggaagagaacatctcctacaaaaaaggtatgtcagccagtcctcattcaattaaacttttgaaattaacattcatttgctaacaacacttgtttcttttccttccagtcagcaaacacaaacagttcacttgtgaaggttgcagccagtgctaggctggcaactgaaagaggtggttcaaccagtgtgaaacttcaggccatagtgccacactctcaatgttcttcttctgcttcaatgaggatcacttctgagaaagcaagtgtttatgtgcaagctcaagaaccagccactaccaagcccaagaaaacacctacaggtccactgatgctgattcccccatgggaaactgacaagctgtgatgccatattgtgctaactatgcaatgttatgtgctttttgtgtattttggcagactctaagccaactatgcctactgtgaactttatgtaatttggcagactcttagccaactttgcctatctgtttagtttctgtaatttggcaaactgcttgccaactatgctgtgatatgtgcttgttctggcagactgtaagccagctaagctatgtggattgtatcatctaaattgagtgactttgctcaaatgatgtgtcatagcctaatctgatatgagatggtatttactgagctgatctgatgtgatgaattgactcttatcaatttgttatgctaaaatttatgtgcaaagttacgaatactcagccactgcaaaagatgatattcagtcacaattcaaccaaccactgcaaagtcagctcaaatatatgcaatgtcagtgtcattactgaatatcaatcacaattcagccaaccacaaatccattcacttaacttagatagtcaaagagcacagctcagtttcttggcaaaatgcagcaaaatgctttcagctaccagcattttgacacatagattaacacattgcacctcacagctgaactaaaatcatagcaaacaacacaagcatgcatcccaacgacatcagtacaagccaaactctctgtttctctagcctactgttacttgctctcatagcagccatgttagcttcattctcagctgccacaatcctcaattgtgccacttcattcattgctacccctaattctaggcactgctcttctacctttggcctcagttcttcaacacaatgttgcagctcattcttctcccttcttagcgataacacggcttcatgaagatcgttcaacagctccctcaaaaaactacttgttgcaggctcataccagtcaaaaaaatcgcagccggcgccctgaaaacattacatcccaaatcacccaaccatactgccagctcaaacaaaaaccaagcaagcaaacgaaatcttcatcactcacccgattgcggcatcggtagtaccatcgaccagggttgtccacgctcccggaaatcccccgtgccgccttcgcaccacatcggcacatcaccgccggctgataatcatagggcccaactcgcgccgggatgggagcacgactgctgggatgcgacgaccccgacgaccggtcactgcaataactcgccatcgcctagcctcacctcctcttgtcgcccccgccgccgccgccgccgcttccgccgccgccgccgacctaagctagggtttcagctcgagaagaggaaaatgtcgcggcaacgcctggaaacagcgaggacagagcctttaaccccgtctattaactccccaatggtggactaaccagtgggtcccacagcgcgacacgtcaacaaaaccgggcaaaaactgagtcaatactgccgagggaccttctacggacggatttagtaattttaggggtacacatttctggtattctagtttagggaccttaaaaaatctcggatttagtaattttaggggtacacatttctggtattctagtttagggaccttaaaaaatctcggtgtcaatttgagggacctccggtgaacttattccatgtaaaaacacgaggcctgggagatctgcttaactccagtgtaagtccagaagcttgcctttaggtgtatgagcgtgccagttgatttgatcctgcaatcaacaagaaacaaagacaaagaaaccacggttaaatccataaacgatagccgatcggctaattgccgatgaagtatcatttatcttggagccgatgtcatatgtggatcgatcggcaatcatgaataagtaagaaagaactaattaaatctactcgatcagttgtagatattaacaatatataatccttatgtcgctatatacttaaatcaagtgattgggattgatctgtcgccatgacgagacagtataaatcacatagatcgaagtatatgttaacaacgagactatatatgttcatagcatagccgatcagatagatctagcatgtataggctaatactccgataccactctatatcaagatattaaggcaagtagaatacaccaaacaaaagcctaatatacttaagggcagatttaacatgtcaattaagcatatgagaaaatggtagttaaatcaggtaagatcggctgaaactctgacgctaccctaatcggcagccaaaggcagcctagagattgagattctaatcatcactcataagattaaactcaactgatgcagctataagtatgaaaagaaggacaatatctagacaatcaagtcgttggatgtttcatagagtggtagatatcctatataatctaagtcagcatcgatatttaacctaatcggctgccttctagtaacagacgttagccgattagaggttagatagcgatattgccagagattatataagatatatgaaaactcgacgaattacataaacaagattagtgtatcataaagatggaagcactaatcccgagaacgcaagccgccataacgagttttacctctagttgaagatcgaaaccgatgcagctcaacccgaaagcaagaactcgtcaaaacaaaatgaaagtaaaaagggtggcgatgcgccgagattgtagtgaacgtgtgttagttcgattatatggggctcgggtctatttatacccaaaaattacaaaatatgtccatatcggacacgtttcttatctctaacaaactctaagataccataagtctttgcagcagacttttgcccaaacatatctctaaggaaattacataaaatatcctacttaatagatacaattgccttcttaggactctatccatgtgtggcaatcatcatgaagcacgtcattctaacccgacaacatatgccgtgtcatattgtcggattcggctcaatcggctaaccctgtccgactaacacatgccccccaagtccagaattttggataatgtttcggatttgccatacgtcgactgcgagagaatattgcacttgccgttttccgaccgttattccaacgctttaaatactaaccgttgtccccgagaaatctcacaccgtttcctccgttttcaccgccgaagcaaactccgtcctctctctccgatgatcccctcggtgcacgaagcgattcccaggcgatttcctctccggccaactttctgcccacaacgatgtagacctccgccagtccatccgccgcatcttcaaccgagtacgcagaggtaagtttccattggctagatcctctcttttcgcatcagattagttttccctttccttatcttgttttcttcttctctgttcttttggatccgtagcaactttccaatctgatcgcagttccgagtttgtcgcataaaaaccactactttcttggtccaatcggcaatcccaatcccactgagtttatcattggtgaaaccaataggatccctttcagattagctaacccgaatctaggtcactggaagaatacttttaaatcttggccagccctcgagaaaacttcacccgagaaaagctggaccacatggtacaagcgtgtatcggctagcaagcaaacacactgggatgagattggaatcggtcaagcacttgcccttaccatagcgaattcggctaaggatgaacccctaatagctgccgccacctatttctcgtccaataccatcaacgcctttttgttgaaccaagggccgatgacaccaaccctgatagatatcaccatgatcactggtctagatgtgacctcatcggctaaccctacgagtctgaacaccaagaatcaatatgacttcaagaccaagagcataggcggttggtctggttacgtggcagcatatatgggccaaggatctgttactgctcaagaacacgtggcctttttgctcatgtggctagaaaagttccttttctgtggatccagttgtggtcctacaaccaactggcaatttgtagccgaggctctagaatcaaaaagacaatttcctctaggcaaaatcatcctcggctacctataccaaatgctgaacaatgcatcgactaagatagtcgtcggctcagtagttggagcaggtggaccatggtggctgctgcagacttggctgaatctggtagtcatgaaagctgtcaatcggccatccgtgatagaagccgaattcccaagactgcagccgattgtagaagatgatggagaagaaagcactcatcgtagatgcatgtcatatggagaatatgcattcacaccagccgatgctggagcgaagttatcagccgagctgctcaaagattggttctgcagcttctatgagggttttcaaaaagatgctcgagtttggtttccttatgaagattcagtgcatcttgatctcccatcagactttagattcgaagatatcaacaatgaaaaatctcaaaaatctaaagaagtcttctcagctgcgattagcccatgcattcttcctgtcggcatacatcaagggaggaacattcaggtttcctatgaattttatcactcgatgagctctgccagaccacttgggatgggtcaactaccaatcggcttgctctttgctgataaaattcaatgccgaggagaaatctcatcaaccttgatgatggatcggctgctgaatatccaaggacctcctttgggcagcattgaaaatatagagctggcaaggttcaggagcaagaactttgacagatggtggggtgaatggaagctgtatttgttccaccaaccggcctcaatatatgtgacagatctctttcctaatgttatccctcaggtaaaccttgacttcattaatttcttttgaacaattgtcagccgattcataacttgactaatcttctcttctgttttgcagacaacagaatcttctcctccacaccaaagcaatagtggcagagatatagagtatgccccaggcctcttgccaaatggtggttgaccaacccctccagttatcagctatcatgcccccaagaccgcaagtctgcttcaagggcagatgatagagccagccgataccggcaggaagaggaaacccagggcaccaacaatcgatccattagttctggctcctaagaagaagactaagaaacaaaaacccaaggtagctgatgatctgcctgccctagatccatccattgagcaagccttggatgaactagagattgaagaggatgttgacgaagctgcagccgaggtaagtgatacagaaagaactccatcggcttcacctaaacagactcctccgactccttctactccagctcacttctctagggtaaacagctctctttaattccttcttccaattgttttattcatagttgattactcataaatcttgtcttttgcagaagaagaagttcgctgtgaagaagaaatcggcagcaacccaatccaaaccaactctgccggtaagattcttctgaaaatatttcagttccaatcatactctatgtggactaacatctattttctttagcctcctcctcctccttcacctcctgtacagcatatgtcaagtgaatgaactccatttgctgtaggaagccacaatattgaggaagcagaacaaccagccgctcctactatcccagtaagtttccttttgacacaaggatttagatcggctatatctatttggcatctaattctctttgaattatttttgcaagccttagccgatctgttctcttttgatatcaaggactacttatagaagaggacaccacaaacaaacccttagctcccttatccgatgatgtgaagaagactcttgaagatatttctcatcagctagaggcatcttctctagacaccttggtggtagattgtggatcaattacgactcggctacacgaagttcaagctctgattcctgaagaactagccgatgtcctcactccagctgcttatcttgaaaagcatcaattcaaactggagaaatgacacgcccagaaatttagcccaaatttccagactattttgtgtattaaatccctgtccaggaccagccagggtacacaaaaagacaagtaatacacagttccaaacgtaaataaaagcgtaaatacttacagaagaggcacttagtcctcacaccgaaacgaaagcagcagcagcggaaaaaggctatcctagcggggcttcagctccactccacaggcaaaactcaactgaggtctgagccttggtcttctaacttcgtcttcagctcagaagcactacacttctgaaaaagggggaataatagcaaggctgagtacaaccaccgtactcagcaagccacaccaatgatgcagacgtgcaaggggaacacaaggacggtttgtggctatttgtataaaggcggttgtaaaacattttattgagcaaaacagtaaaactgttgagtaattaaggtaatattaaatctccactgatcaacgctacaccacgttgaacaggcccaaccaacccacctgaactacagtgcattgggttgatttattaaggtggaactaatcacggtgaatctggtcgaccgcccataaccgcaggcacggctattcgaatagttttactctgactagaggtgtacaactgtacccaaaagacacagccccacgacacgtttctgtgcgctgacatgccaccacgaaataccggaaagaggccgtgacaggacccttcgcataaccccctctaaccgattgcaccacaccttagggttcgcccccgtccacagcaagcaacgggtagcccccctctcgtgccgcggtgaatccggaagccaatcaaccggaaattttcccttaaaaaccattggccgagaatattttgcaatattctttgtgccctaaaatactctctgaaatttcccgtcaattttcggagctcaagagataatttcaaagtcacaaagatcatttaatcaatttaaataaaaagaaaaacaaaataaaacctcccttcctccttgggccattttcggcccaagtccctttcccctcccgcggcccgctcaccctatctccctctctcggccagccttcccttcctctcacgggccgtcgacccgtcttcctcaagactgctttgcgtccctgtgccagcctcctccctcctcccctcactgacaggtgggacccacggccccacccgtcaggcccatccccttcctccggctccaactgtcgccatggctgcccgagccaccccactccgccgccttttctgtaccaccccgccaccgccgcgatgccaccggaggaggacacgaggccggaggtcgctcagagcggcggcgagggatggccagaggcggtaaagatggttgcggctcgggttggcagtggaggtggaattccaacgatggaatggggaaacggagtggagaacgagcttgcccgcaaggcggcgaagccggcagtggaggcggcacagcacagcggcggcgggagcggcggtggcccgtggctggaggcgacgagaggctgttgtggctcgggtgcacggtgaaaccggtgcccgggtggtttattgcagaagcggagcggtggacggggtgcggcaatgcgtggcgaggccggcggcgcaaacggcgcggcgcggggacggcggcagcggccagctggagggtcgtcggcgagcggcggcacttgggatcacgtgggaagagcgggagagagcgcggggagtgcgggaaagttggggaaaagggagaggatggccgggggagtgattttataggctcgggagggagtggctcggccgggatgggcggcaacaggcatcgaagtgggaggcgacgtggagctcgtggggaggtcaaactggtgccgtttttttgggggaaagtgggggaggagagtggaggaggtggaggggatgcggtttctcttgattcggatgcggtttctcttgatacggtgtacctcttcgattatcctttgctaactcttcctgggttgacggactattaggccatgcaattgcttttccaaatatactgcaatctgaacgtctattggaaactgcctttgatgttgccgagaatttctgccctttgatcataacaacttcacatttgtatcttcggtaaagatgatccgtcgagaagaggttctctgccatacgccctgctgattacacctttcgggacttgattcttgtatgctgctgacccatgtatggaacaatttctaccaacttccgagaaacatcatgatgatttctagaatttatattagttgccttgaactaaggaaaaccatccatgattcataatcacaccactaaggtgtaattattgcatagttaatttctcaaaactgaactgaccgactctgcattggaacagacgcagcttgacaaagatttgtaacgccccgattttctttcgggattaaaaatcatttaataatgcattcctagaaattaaataaaatttaaatcaatttaatcaagtgaaataatgggagaattaaaatttcctttaaaaatcattggccgagaatattttgtaatattctttgtgccctaaatattctctgaaattttcccgtgaattttcggagctcaagaagtaattattataatacaaagttcatttaatcaatttaaataaaaagaaaagaaaataatcttccccttcctccctttcaggctcggcccaaattccttcccccttcccctccggcccggccgcccataaccgtctttgggccgctcggcctgctcgctcccctccccctccaagtccacttcgcctccctcccagccttccctctccctccggctgacaggtgggacccatgggctccgtctgtcatctcctacgtccagccaccccacagcaacttccatggccgctgaaaccatcccactccgccgcaaaatccgccatctcccgtcccccgtgctcgcgtctaaccccacttgcttccccacgtcggcatcccactccgccgccggttgccgcctctcccaggccgccccgttgccccgagccctataaaaaccatccccgtgccatcctctctcgtttcccctcctcacccaagctcgtcgcgctttctcccgcactctccacgccgcccccatctccgcggctctccggcgagctccagccgccgccctcgccgccgccacaccgcgccgaggccacctccggcttcgccacctcacgacgcacatcggtcgtcgctcattttccctaaacaatcactgttacaccgcttcccccgcaaggtcgagccatcgccgcctgtaccacctccagcagccgctcctcgccgctttaggcaccgccgagccgtgccgccgcaaccgccagcatctcccagccgagctccaccccggcccttactctttttcccctatccgcctacgaaacgccgccgccacgctcaccacctctcttcgtcgccattgccgactccaacggcgtcgcgccgcctctccggtcgacgccgacttgcgctgccacctccttcggcttcgcagggacgagggcaagcccggccaccactcttccgaaacccgccctcttcgctctaggtgagctcctcctcatgtgatcgtcgtcagccgccgttctcggtcaccctgcaccaattctccccttcctaaccctcctaccatctctcccaggccgcgctacactgtcacgcccagaaattcactagtaatttcagaacttatttgtgcataaaatcctcgtccaggaatcagccgaggtacacaaactgacaatttaatatacagattcatcaaaaaaaactaaagcaaataatacttactgaagaggcaattagtcctcacatcgaagaaaactacagcggaaaaaaaaatctagcgaagctcaggctccactcccacaggcaactcaactggggtataagccaaacgtcttctccttctggatcatttttcttcaactgaggtttgattgataattacaaggtgagcatatgacatactctgtaagccacacatcaactatgcaagtgcacaaggataccaaagtatggcataatataggctcgtttgcaaaagcagcatttagcaaacatttaagagtagtaaaacagtagagtaattaattatcaattttaatcaacactgcatagcaccccaatgctgcacaggcccaaccatcctgtacaaccatacccggctgtacagatctaactccaaacttggagctaagcaaattattaccagttatagcacccataattattgtgagaggtgtgagactaatcacgaaaaacattgctcaactcgcccatgaccgtgggcacggctattcgaatagttttactctggccagaggtgtaccactgtacccacaagacacagctccacgacatgttaccatgcgcctcaataccaccacagtacatcggaaaggaaatgtgacagtacccctcgcacaacacaactcaccacagttcaccaatcctggatcataatcacccctaaaaaaaaccagaggcatggactccccagcgaccccatggacttctcgccgcttctcagtctggtgccccgcaatgaaccacgctatacgaaaggtaaagccgctacccacgctgggttgaggttggcacggttaatgtctcacaacagtagctcgcgaaccggtccttaattgtcatgagcacgaccttcaaaaccatgtgctcacaacccaccattgtcaagttttaattatcaattaattatcataacacgattaaccatcgtgagctaccattaaatataaccataaataataatgtagtttgattcatcccattagtgagctaatgtttctaagcatggctaagcaattatgtatatagcaattagctgaaccaatccaatatataaggtccaagctaatcaatttattacccatatgaaaataaagtcatcttcggccataattaattgagaaaggctcaccacccgatgacattcgaaaataatgcataagttgaaataaaacaatagctttaagtaggttcaacatgctcaaagggttgtttgggatctgtgtgacttgccttgcaataatcggtcttcaattaatcttcttgaacacttccgacgcactcacgaaccttcgcaatgacggaaacgataagctaacacgtaaaacgaagaaaaagactaataaaaaaacaaataaacagtgcataaaaagtagacaaacatgtagatcatgattttagatgaatttagagacttgaaccacttaattccgacttcatatgaattagttatgaattttacaagattaattccaattaaacctattaaagaaaagactattccaaattaattaaacaatttacatataatttataactgagacataagcctaaaccatcctccggaaattattggaatgaatttagtagacgacatatagtaaaaagaactaatatgccattgaaaagggataacaggatttatattgattttggacggctgagatcaactttgacctagtcgaccaaaattggatggctcggattgatctgatctaaggttttagatggctgtcacgtgggatctgagagacggcgtgacacttagatggtagggacggcagctaacaaggcgatgacatggcaaccatgcgggatcgacgccggcggctctattcggtggtgaggacggcaaacggcggcacaacggcggaaaccgagagcacggggatgaagaggaggacacgacgatccttactaacacttacgcagcgatgaacagcaaaggagatggccggcgacgagaacgggagtgacgacggggtactgatcgatgatggcggcggagtttcagcgacaggagacgacaaccgaggggtgaacgggcttctcctcggtgctgcgaatccaatggaggcggcggcgaccgaaggcgacgacgaacggtgcgagtggagatcaaaccatggcaacaacccacgggttcacggtgacggcaaccttccggcgggatttggcgcaaaagaactggcggccgtggtagagatcaaccttgcggagcagagggaagtggcggcactgatcgggaacggccggcgcgacgggaaaaggcggctggagatggcggccggagttggagagagaaggcgagcgtggggaggcggctagggttagggaaaacttcgggaaacagagggaaaccgaagaggaggccgaggggctgctatttgtaggcaaaggtggaggagatcggctcgagaacggatgaattcggtgaaggaagttaagatttatcccgagttcacccggataaaaacgactgaaattcgtgagatagataacgaattttaagggagttcttggagataagatagaggagatagagaggaatccgtttttgcaatcaattttggaagggaagcaacggatgcatcgaatttgatggaggacacggcggctctcgggaagaacacggcctctggacggctggctggagcttgaagacgcactgtagcaggagggagggcaatacagactttcagctgggcttcattttccaaggcctgattgaaggagggacaagaaatggacttcggaaaagagagggagagggctgcaggctgagaggagactgggccgagagtgagaggacttttcctaattcggcccgaaaaggaaaaggggaatttaattacttttccaattaaattaatcaccaaaatgatctttgaattgttaaaaatacttccaatgctcaaataatttcaagaaaaatcctgaaactaattggacactcaaagtacttaacaacgttataatcagaccatttaatgattaatttattatttaaataattgctgaactgctctttgtattattaaaattaagaattgagctccgaaaaatccgagaaaatttcagagagtataattaaccatggagaatttaatgaaaactaaatccagccatgctttatatttaggaaattttatttcctacatttagcttcacttgaaaattaatgaacatttaatataaattctaaaaataatttattaaataatttatgaaacctaaagcgaaaatcaggatgtgacatgcacctcggctgcttctctgccttcgccggaaaccgtcgggccgccatccgtgccgcctccccgaggagcgccgtcgctaatcctcgtcgccgactgccttcccgtcctcgcctcatcgtcccgtccgctcggtgagcatccctccctctccctctatctccactttgccggccatcgccgtcagcgaccatccggccgcgcgccgccgcctctcggccggctggcgccgctccgccgcccgtggaccccctgtggtccgggtccacggcgtctcctgggccgcggtggacttggtccaccgtgtgccaacccttgtagccactgacgtctggggcccacatgtcggcgccggcctccccttcgatgacgtgagcgactaccttttccctttgaaaaataaatagtaattgcgtcataattcgataataattctagaaatccatttaaatggctcaaaacttctaaaatttatatctaattcattcgaactccaaattgggccattcaacttgcaaaattcatctaaaattaagatctacatgtttgtttactttttatgtactgttttcttggtttttattagagtttttccttgttttgcgtgccaacgtgtagaatccgtcgttttggaagtccacggtcgcgaggaaaagagttcggaagattgttttgaagaagcaaggtaagtcacacattccccttgagcatgttgatcccaatttataaatgttttaccgtttacaaataaacatgcatgtcttgctaattacatgggatccgggtactacctatctgcttgcttgtgctatgtttacttgatatctgtcttttgtcaaccttgggtaataaatcgactagctcatgttacttatgtgacctagctagaactatatgcttagccatgcttaattaccactagctcagttgatgggataattacagtattagacctttatagtatcagaatgagctgcgtgcttgagacatctggccatgctttatggtcgtaattatccaactaaaatgcgactgaatggtgggctgcgggtgcatggttttgctagttgcacccatggaaattaaggaccagttcgcgggaaaccctggaagaatttatcatgcttaccacaagccagcgtgggcaacggctgggcttgtagtgtagctttcgtctagccaatgtacccaggcgagggtgggcgtgatggagttgggtcggccggggtgtctggctgatcggcttccggattcactaaggcacgagaggggggcttcccgttgcctgctggggacgggggcgaaccttgaggtgtggtgcgatcggttagagggggttatgcgaatggtcctgtcacggcctctttccagtatgtcgtggtggcatgtcggcgcatggaaacgtgtcatggggctgtgtcttgtgggtacagttgtacacctctggccagagtaaaactattcgaatagccgtgccggcggttgtgggcggtcgaccagatccaccgtgattagtcccaccttaataaatcgacccaatgcactgtagttcaggtgggttggttgggcctgttcaacgtggtgtagcgttgatcagtggagatttaatattaccttaattactcaacagttttactgttttgctcaataaaatgttttacaaccgcctttatgcaaatagccacaaatcgtccttgtgttccccttgaacgtctgcatcgttggtgtggcttgctgagtatggtggttgtactcagccttgctattatgccccctttttcagaagtgtagtgcttctaagctgaagacgaagttagaagaccaaggctcagacctcagttgagttttgcctgtggagtggaactgaagctccactaggatcgcctttttccgctgctgctgctttcgttttggtgtgaggactaagtgcctcttctgtaactatttacgcttttatttacgtttggaactgtatattacttttcgttttgtgtaccctggctggtcttagacagggatttaatacacaaaatagtctggaaatttgggctaaatttatgggaatgacaagaaagccatgcaaagactagccaaacgccgagaacgcaaagagaatgaatctaccatctaggccaatcggcaactcgtgcatgaagaaaagtccaagcttgatcagctatgtgaggggccaatcaagtctaatattgatcggctcgaagctcgcaagattgaactcttggcacaatttcaagaatgcaacgccaagctggatctggaacacaaaaagttagccgatctcccacaagctgtcgaagaacagaaggcaaggctgtaatcagccatcaaaaatgttgctgatatgaccaagtccctaaaaatcatctctgggaccgatgctcaagatgcccaagccatagaagaagtagaacaaattagccaaagagctatatcggctatccagcgctacttgtctcagtgacatgttgtgtaatagactctatgaatttttgtaatcggctaagaaactctggatctttgtttaactagtcttaatgtgccgattaatataactccatgtttttgctcaaaaattttacaatttttgcacatatatgccccctaattttacaatgacgaagacattgctaaaattataagttgaactaagggcgatatcataatatcggccattgtacatcggtaaaccataaccgattacaatatgaaaaacatctaagggcgatagaacaatattggccatctcaaggcaatgtgaacacatcggctatcatgcatcggcaacaccagccgatcatgcattgacccaaacacttgggtaatatttcttcaagtatttgccatttagcgatcgtccataaacttctccatcgagttcttgcaacacataagctcccttagacaaaacctgatagattttaaatggtccttcccaattcagcgaccacttgccaaatttgttatctcgagtcccaatcgacaaaatcaatttccatacaagttctccttccgaaaaagacttgggcacaactttcttgttgtaatgtcgagcaactcgttccttatcctaggtaacttttgcaagggctcttaatcttgattaaaccaagtcttccctttcatcgtccatgagattataatactcatcggctatcaaatcattttgcaactccgttcttcttgagccaattctaacttcccatggtaaaacaacctcatgtccataaacaagcttataaggagggacttggatcgatctatgaaaagccatccgataagaccataacgcttcggccaatcgagtatgccattgccgaggataatcggaaatatttcgcttaatcaatttgatcaaactcttgttagatgcctcggtttgcccattagcctatgc

SEQ ID NO: 2920 - DNA, 494 bp, Oryza sativa
ggggacgagcgcctagaagccctcgtcctgccggaatgggccgaggcgtgcgtcagaccgcctgtcgccacctaacccgcgatctgaccggtctgtgactggtcacagaccggataaatgagtgcaatgcactgcgttgcatgcgtcgtgacacactcagccaatccgcaataaatgtggttaggtgagccccactgtgctcacctaactcatacgcgcggagcgaaaacccacgaggggtcggggcgcctcgaccctcggggccgaggggggtgcagcccgaccccctcggggggactaagaggagggcgaacacatcaccctcgggcccgacgtcccccgggggtgccaggccacgtgggcgattgtgtctgcctcaagcctctagtcatgatactcccgatcccatgtcaccgacagacccatacggcagagaagaaaaccaagtaaaagccgatccagacaaagataaccggaacaacctaaccctcaaa

SEQ ID NO: 2921 - DNA, 840 bp, Oryza sativa
agctctcctatttcatttctagcatatctttagggggagctccaccaaaatcctaatcttttattacttctaagtgtgttgtcatcaatcaccaaaaagggggagattgaaagtgcatctaggaccccacatttattttggtgttaatgacaacataattagagggtaactaatgctttttgttgagatgtatgcaaggatgaaaaaggagtggatgtcaacacaataagtattgcagcatcttttgtggtaattgtcttctaatccatgtatatcttgtgttcttgagtattaggatgccttactattaagaggaatgccacatgcatataattggtagaacactagtactcaaaatcatttatttgaagtgttcctgttttatgtctgtcggactatccgatgttgatcagactatccgaaatttcacagaactttgctcactgtcttgggtctgagtgttggctaaaatatatcggactatccgatataaggtcggactatccgatacgtcagactatctgaaatttctcagaacttcactctctgttttgaattgctttttattccttttgaaatttttggttcaaaaataacggaatatccgatatgacatcggactatccgatcgatcggattgtccgaaattctccagaatttcgttctctgtctctggcctgcttgggggtcaaaaacatcggactatccgatgtcacctcggactttccgaggtgggatgaaaagattctctcccaacggccacattttgggggcttctatgaataccccccacctaacccttttctagggttacccaactcattcattcacattcacttt

SEQ ID NO: 2922 - DNA, 2482 bp, Oryza sativa
ctttgctagctgaggacggcgatgctggtagtttctcagccatgagagaacgctgttgtgattctaacttctaatcggtcccaccgggcgtgccaaaagcgtgttgatgtaaaaacacaaggcctgggagatctgcttaactccagtgcaggtccagaagcttgcctttaggtgtatgagcgtgccagttgatttgatcctgcaatcaacaagaaacaaagataaagaaaccgcggttaaatccataaactaaatgccgatgacgtattatttatcttgaagctgatgtcatatgtggatcgatcggcaatcatgaataagtaagaaagaactaaatctactcgatcggctgtagatattaacaatatataatccttatgtcgatacatacttaaatcaagtgattgtgatagatcggtcgccatgccgagacaatataaatcacttagatcgaagtatatgttaacaatgagactatatatgttcatagcatagccgatcagatagatctagcatgtatcggtgtaacaccccagaaactacaatgacaccgggatgctactaaatagacatacatttaacaaagaggagaaatttcgactgcaactcctttaaaacataagcattgcggaagcgtcaaatataagtatagcattgcaagtagccatccacaaaaaaacaaggagaaaggaacattcagggatgaaataaactaatttcaactctcagattcatctagtgcaacttaacaagggtacagttcctttattatcaaaatcatgaacttgaaagattaaggtggcagtgtggaatgcagttgtgcttctactcctgtttcccccaagcgagcatatcactttaagcacctgaaaacactgtaggggtgtgagaataaatctcagcaagagaattgttttatcaagttatttaacctaccaaatcattaaaatatatttataagaaaacaaaggaacataacattaaatataaaggcaaacatctagtgttcataggttcaagagtaaggaggataaaccacatctgcaaagacttcaggagaaagaagccctctcatgaactcaatagagtatataacttccataccccaaaataccaaagtgcaatgcgatgcaaatgcaatgatattcctgccttcacacccaacaaggtgtgaagctgcatcgtgttacgacaatacacgatgctgtatcggtacggtcgcgaccataggttcacgacataacttcaaatgaaatgcatatgaaatgcaatgcaatacaataatagaggaaagataacacatccacaaatccttccaatgatatcacatataataattactctcactaaaagcataccacattaaccatagttagccgagcggagatagctcagagcaagatacataaaataatcatttgcacatatggaattatagtgattgtaggtattaaagtgtcaaggtggaggttggaaaaaataacatgataaaaccgtagcaaaccacagctacattcacttgcctccaatgaagggttggtatcatacacgatctgaaggaccaccacctaatcacaatcaaagcctcagcaaacactctcaaatatgaatatataacagtaaataacatgcatctacggcctcaagacctcaaaacgcaaaaacaagaaacgccgcttggactataaacaatactgttgcttcaaacctttatatctcgaaatataaaaattgtatgactgcaaataaatacattttggaaatctacagaatgagacctacaactttcgtgtagaacccatatttttattctgccatttagatggcctaaagctcaaatcaagacaagcttcagaatctgcccaagaattcagactgccacacttaaaacagccatatctggagttctactcgccaatcaaagtgtactttaccaatatggaaagctaaggaaaaactctacaacttcctagttataaactttcgcagcaaaatcattttgatcctctaattagcgaaatacagagacacaacaaagctgacagggcctagaaacactaatccaaaacacaacacctaatcccatcctctaaccttcgaataacgccgaattacaaccctaaaataacctacaacctctgcacaggagagttaagcctcacctagggtttggagaacttgagagaatatgatgggaaaaccaactcaccactcttcctgctcctctcctcttcctcgatccgtttttccaatcagattcttgattagggctatggttcttggagatccatggagtagggctaacaggggagaaaggaatatgtaagttccataggtgccgagggggaggtgtggcggcgtcggctgggaaggtgggagtcgcctctccctagggtattaggggggaggtgggctggactgctgcgacttggcccaaattgattcggcccaattccaaacatgttattttatttttaatttc

SEQ ID NO: 2923 - DNA, 3178 bp, Oryza sativa
aggtagttaaatcaagtaagatcggctgataccccgaagtaaccctaatcagcaccaaaggcaggctagagattgaaattctaatcatgactcataagatcaaactcaactgatacagctataagtatgacaagaaggacaatatctagacaatcaagccgttggatgtttcatagagtggtagatgtcctatacaatcaagtcagcgttgatatttaacctaatcggctgccttctagtaacagacgttagccgattagaggttagatagcgatattgccagagattatataagatatatgataactcgacgaattacagaaacaagattagagtatcataaagatggaatcactaatcccgagaacgcaagccgccgtaataagttttacctctagttgaagatcgaaaccgatgcagctcaacctgaaagcaagaacccgtcgaaacaaaacggaagtaaaaagggtagcaatgcgccgagattgtattgaacgagtgttagtttgattacatggggctcaggtctatttatacccaaaaattacaaaatatgtccatatcggacatgtttcttgtctctaacaaactctaagataccataagtctttgcggcagacttttgcccaaacaaatctctatggaaattacataaaatatcctacttaatagatacaattgccttcttacgactctatccatgtgtggcaatcatcatgaagcacgtcatcctaacccgacaacatatgccgtgtcatattgtcggattcgtctcaatcggctaaccctgtccgactcaaactctgccgatcttagtcgtagccgattcggactccagccgatcctcactctgtttccgggacagtctctatctcgaactccgtcttgaatcctccttcacatccgatccttggattaccaaatttggtcgttagcacatatctaccatctcttagagagtagctacttttgtctcatatgcttgattgttatgctaaatatgccctttatattaagatcttattgagttaaagtatattaggctttctgtttaatatatcttgtctgttctaatatcttaatatagagtggtatcggagtattagccgatacatgctagatctatctgatcggctatgctataaacgttcgtataatcattatctgaatgtatcttttcacttaagtgatttatactgtctcgacatactgttcaatctatcccaatcacaaaatttaaatatacattgagagaaggattaaatatgttgatatctacagccaatcgagtagatttagttttatattgctttattcttcattgctggtctaatgccaataacatcggctcaatgattgatcatatgtcatcggctcctagccgatcggctatcgtttatagatttaacctcctttttcttgtcttttcttcttgttgattgtaggatcaaatcaattggcacacctttgaacctaaaaacaagattttggacctgcacaggagttaagcagatcttccaggccagtgtgtgtttttcgcatcaacacgcttttggcacgcccggtaggaccgagttgtaacaattcttcaacatggtggatagcaagcaaacttctaaacccccgtcctctaaaccaccgccgacggcagaagtcatccctgagaacatcatcccaataacactagataagctgacgccagaacaagtggcagagtatgagcagatgattaacaatttgaagactcagtacttgcactcattcaagcagatgcattcaggcacagttatccagaggtacaaggtaaaggtggtttctgccgatgatccagaatcaagtacatccaaggatggcaaggtgataaaggtgacaaagatgatgaacctaaggatgatgaaactgggggagaagagcccttggagttcaataacttctaggaccaagtcgagtacactgttcatcaagctctaatcaaccaatcaggagtgcttgtcaatactttgaaaaatatgatcaagtttgtggttgatggcacaattgctgagcatcaggctaagggaccagtctttctgccagaaggcgtgtttccgcagtacaggaatttagtgaccggcaaccaacagcctgctaccaatgtacctccagggcagccgatggcgtcggcttcggcttctagaccaggtgtatcttcatcggcacaaaggccaccggttaatccttatttgctgaccagagaacaacctcaacacgctaggcagaacatcaatcggttgactcaggaacagattgcagcaatgttcaagccacctcaacctgttggagctcaatttatccctgaacaacaaatgcataatgtgcaacaaccgcctcagaactatcttggtggtaatttgaattttcagtatcggcctcattcacctcaggttcggtaccaactagggggatcacctcaacctcagcttctgcctcagttcaactagttcgatccaattcaacagcagatgcaaggagcgtctcaccaaaagccctgggctgacatgattgcatatgtgatgaaggagcagtttgggctaaaaccgaaggatactggaaatttgtatcggcacccctaacctgagtggtttgagagggttccattgccaaaccgatacaaagtcctagacttttcaaaattctcagggcaggacaatgtatcaacttatgagcatgtcagccgatttttggctcaatgtggtgaggcatcggctgttgatgctttatgggtcagattgtttcctttgacctagtctggatcgacatttcaatggttttcttcactgccttataattctgtttatagctgggccgatttagataaacagtttcatagttatttctatagtgggaatcatgagatgaagctttctgatttggcagcagttagacagaggcatgatgaaactatacagaattacattcagaggatcagagatatgaggaatagatgctatagtttggctttaaccgattctcagtttgccgatctcgctttccagggtttgatagctccgattaaggagaagttttcggctcaacactttgaaagcttgtctcaccttgcacagaaggtaactctacatgagcaaaggtttgaggacggtaagaagaattttaaaaaagtcaatcatgtctatcctta

SEQ ID NO: 2924 - DNA, 1897 bp, Oryza sativa
ggcagccgatgggggaaaccatcggagttcacagctaaattcggtaagatcattaacaagtaccaaagaaggcatgataagcaggaggaaaggtatcttgaagatgatggtggttttgatccacattgggattgtgtgtctttcaggttctgctggaatgaagggatgaggctgccatcaatagaagaatgccctagatgcagtgataatgcagggagctcgagccgatcctacaatagaggaaatcggctaaatcagaaaaaattgcctgttcatcagaggttgggtcctgtgcaccaagatcgttttcaggatgaggatgaaggcaggaactcacagtggtgtccttttggtttttttactaagaatcagaagtggagggtccaaaggatgaaaaacagggagcgttttaaggaggtacaacaagagatcaaccatcggttgaagaagacaaagcaagaatggcgtgttaagagtaaagttacaacagccgatgaagttgaagccaacaaggcgaagaggttgctcaaggccaaagctgttgcgtcttcatcagtaaacatggtttttatgctacctgcagaatatggagctaatcaagccgatgttgatgatgtagatgagacctctgctaagttgattttgtcatcggaacaagcaatttttgagaaactagaggggacagaaaatcggcatctcaagccattgtacattaatggatttgttaatgggaagccgatgtctaagatgacggttgatggtggggctgctgtgaatttgttgccatatactacattcaggaagctgggtaagaatgcagatgatatcatccagaccaatatggttcttaaagattttggtggcaacccttcagaaactaagggagtattgaatgtggagttgacaatcggcagcaaaactgttcctactatgttttttgtcatcgatgggaagggttcctatagcttgtcgcttggaagggattggattcatgcaattgttgtatcccttcaaccatgcaccagtgtttaattcaatggcaaggtgacaagattgagatcgtgccagccgacaggtcagtcaatgttgctggtgccgatttagctatttgggagatggatgggattgattgcctgtctggaaaagtttgggaagatgattatttaaaagtgttcaattgtgatatacagccaattgaagatggagagcccaaattattacattgagggcgccgtggagggttcaaatttctacaccaaggacacggtagatgatttcgatggcaagttaggacatggtttcatgttggctgatgatctggaagaagttgaatataggtctaggggatagaccaaggccaacatttgtcagtaagaatctatctgcagaattcagaaccaagttaatagagcttttgaaagaatatagagattgctttgcttgggagtattatgagatgccaggactgagccgatcgattgttgaacatcggcttcctattaaaccagggtataaaccacatcaacaaccgcctaggaggcgcaaagccgatatgtatgatgctatcaaggctgagatcactagattatatgatgctggttttattcggccatgccgatatgctgagtgggtttccaacatagttccagtcataaaaaaaaaggcaagcttagggtgtgcattgattttcgggatttaaataaagctacccctaaggatgaacacccgatgccgattgcggatcaatcgattgatgcagcttcaggacataagattataagttttatggatggcaacgctggttacaatcagatttttatgacagaagaggatattcataagactgctttcaggtgccctggtgcaatcggctgtatgagtgggtcgtaatgacttt

SEQ ID NO: 2925 - DNA, 506 bp, Oryza sativa
tttgcttaccggatttcgtatttacaggttcctttagaagataaaaaaaggttccggattgaaatgacatttagtcgtggtgctgatcttagtcctctaaaggtgatgtttgcaccttcttttgcaacgcaggacatgagctccggtgtgcttgctcgctactagatgcatttgagcaattgagacttactcatgtaatatatgttttggtccaggataaaaccagtgaaaatacttccttgctccaggagcacaccctgccgataatggggcctgagagactgcaggaagttggttcctgcctaacactggacaagtttgagaaaatggtgcgaccatttgcgatgcctcctgaagacttccctccagctgctgcgccacaagccttttctggctacttcaaaggctctggaatgcttgaaagactcgctagtctctggccttttcacaagggcgcgactaatgggaaataagtgaaaaagctacaaaatggtagaattgatcca

SEQ ID NO: 2926 - DNA, 1169 bp, Oryza sativa
agatgcaacttccattcaccccaccatctgtcaaagttcctgctcctgaatcctgctaactcaatattgtcgatactgcctaagggaggtccttggaggttaagcagtcgatccatcattagagttgaagaaatttctaccggcattggatcttgtcagcaaagaataagccgattgggagttggcctaatccaagttgtgtagctgaacttatagggtgacagaattcgtaggagacttggatatttcttccttggtgaatactgacaggtaggatgcatgggctgattgcagctgtaaagacttccctggacgtttgatatctttcatgattgatgtcttcaaatctgaagtctaatgggagctcaaggtctgctgagtcttcataaagaaaccaaccccgggcatctttctggaaaccttcataaaagctgcagaaccaatctttgagcatctcagccgatagttttgccttagcatcggctggtgtggatgcatattctccatatgatatgcatctgcgatgggtgcgttcttctccatcgtcttctacaattggctccaaccttgggaattcagcttctgttacagatggccgattgacaactttcatgactaccaggtttagctaggtctgtagtagccaccatggtccacctgctccaactattgagccgatggctatcttagccgatgcattgttcaacatttggtatagatagccgagaaggattttgcccaagggaaattgtttctttgatcctaaggcttcggctacaaattgccaattggttgtgggaccacagctggatccacagaagagaaacttttctagccacattagcaagaaagctacgtgctcccgaggagtgacaggccctttgcccatgtatgccgctacataaccagaccaccctcctatgcttttggtcttgaagtcaaattggttcttggtgttcatagtcatagggttagctgatgaagttacatctaatccagtaatcatgatgatgtcgatcaaagttggagtcatcggccgttggttaaataagaaggcattgatggtgttggaccagaaataggtggcggcagccatcagaggttcatccttagtagaattggctatggtgagagcaagcgcttggccgatccaatctcatcccagtggg

SEQ ID NO: 2927 - DNA, 21582 bp, Oryza sativa
  unsure (1)..(21582): unsure at all n locations
tcctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatatcatgatagtatgaagtaacagttctggtatcttgttttaaacattgcagtttgttgaacaaaatgtcagcataatacatgggaacataaacatctctgaaatatcgtttcaggtctttccaagattgtggtattttgttatgcctacaaagatgtttccaatcattagaagcatgtttaattaaaacactagaggcacacataaccttttgtttctccgacaagacatgcttttgaaattcactatcaaccgctagctcccaattaatgtaagcacgaggatcatagtctccctcgaaataaggcagtgcagatttgatcttacctagaacatcatcacttacctcataatggtcatgttgatccctcctcatgtctcgacgaagatgtcgatgttgagcgcagctatccccaattatcttgcgtatccctgccattgttagtagaaaacaagaaacatacacaaaaatatgcacgttcctattaactactaggtagtggcagctcaaaaatcgcacacactcaagcttttaaccaagctcttacaagatcttaccaatgcaagtggaatggtgacatacaccgactcaaccaagcaccccaatgaaggttggatgtatcgatgccttggcaaacacttgcggtacagctgtaatcaaatatgtggagctcgggtaggcttaaatatgtagcaaaggaatagcaaatgctcaaatcagataatgcaaagttgaataattgttcaaagtcaagtaccgtgctggtcctaggctagaacgtactagagacgcgagcctagacacaaacgataccacaagatagcactaggaacaactcatgcacaactctgatatatgaagttcagctcaaacataacagtattttctcttttctttctttcttctttcttcttttctttttttttctttccttttcttttctgttttttttttgtgcggctttttttttcttttttttttgcacctttcttcctttttttttcacttttttcttgatttttttaacaaaaactgactcaaggaccttaatgtaagattacagggactcaaacttaaatataaaatttacagggactcaaatgtaaaagtctaaaccccaaatttaaattatccaaaaaaatggaatgctgaatttatgccggttccgtttttccaaacagatctcgaaaccgacaccaaacaaaaattcgccaaggtgtttgacacaactcggaaccgtggaagagagggagggagtcggactcggccaaaggggcgagtgggactcggccaggaggtggagtggatggcagccgaatttggtgtatgggataaaaaggaaactgatttttaaccaatccaatctactatatctttccaaaacaatcttgactacttccaaaatcagatatggtaattcaccttcctcctctcgtgcacgacacaggcacggccaaaacaaacacacacaaggatcggcaaactctagatgcaactcaagaactccaaaactaaccgacagaaacttctgaaaactacaaaaatagaaccgtggcagcgagccgattccgttttcgtaggtcccgacaacaacagagacacggtggcagcaacgactgtggtacaaaacgtgaccagaacttgaaactctaaacgaactagacgctaagaccagcaacacgacgtgacgatgcaacacaaaattcaacaaagcaaaaactgaaaagaacaatgcaatggcacaatatggctaggtaaatgatacgaatttttttgtatggctattttctggttataggaagataaaaactcaccgagcaacgaaagctctgataccacctgatgaaccctgagttcctctcgacactcaaggttgttgttggcccgatctttcggtgagttgatgaaaactacgatttggaagaaacgttgacgacccgactacaaccgtacaagacgttgcgttgcgccttagcgatcgatacacctctccgtgggttgttgatcttgccggtgcaaatcaaccttattcctgcaagcaaatcgaagaaacaagcaagaacaagataaaagcaatctgaattgcaaataggagttaaatacgaatgataagttggggttccgaagaacaagcagacggacggtctagccgacacgcgcgctgcaagcaagtagcaatggctaaactttaatctaacaaaacccgagaaaccctgaaggggtaactagctatatataggggtgggaggacgacctaggggtgcctagggtcgtgctccaccagcttagggcgcaccccacatgggccccacctgggccggggtcccaaatgaagttacaagcccataggcccattataggtgatgcaacaccttgttcctgtgattctggccacacgagatagaattcagagaagaggctggatccgttagaaagagggctccgagagctttccatcaagtactcacgggccgaaaacggaggtcgtatgcagatttggtggccgtttgaagtcagcagtgtagtaggtggccgaatcggattccagcacttggagtacttgatctcgatatcttcttgttcatccatgatgtgagcaatggttgcatccgtggtagccatggtcacatcagactaggtaagccgatgcagccgattccgacagtataatttggtgtatgacatcgggttgaattgaggtgcttcaagatgattgccgcaaatggatagagtcctgagaaggcaattgtatctattaattaggatgttttatgtaacttccttagagatatgtttaggcaaaagtctgccgcaaagacttattgtatcttagagtttgttagagatagtggtcgtgtccggtatggacatatcttgtaattctcgggtataaatagaccccgagccctatgtaatttttaacacacacattcaatacaatttcggcacattgccacctttttgctttagttttgtttcgacgagttcttgctttcgggttgagctgcatcggtttcgatcttcaacaagaggtaaaacttgttatgacgacttgtgttctcgagattagtgtttccatctttatgacactcttatcttgtctatataattcgtcgagttatcatatatcttacataatctttggcaatatcatcatctaacctacaatcggctaacatctgttaatagaaggcagccgattaggttaaatagcgacgttgtcctagattatataagatatctaccactttatgaaacatccagcggcttgattgtctagatattgttcttcttttcatacttaatgctgcatcagttgagtttgatctattaagtcgtgcttagaatatcaatctctagcctgtcctctagttgccgattagggtagtatcggagtttcagccgatcttatttgatttaaccatattcgatctatatgcttcaatgacatgttaaatccgccctttatgtcaagatctcattgcatttaagtatattaagcttttgtttgctatattatacttgttttaatatctttatatagagtagtatcggagtattaaccgatacatgctagatctatctgattggctatgctataaacatatataatgttgttattaatatatatttcgatctaagtgatttatactgtctcggcatggtgaccgatctatcccaatcacttgatttaagtatatattaatataagaactatatatcgttaatatctacagccgatcgaatagatttagttccttactatctatttataaccgtcaatcgattcataaatgacatcggctcaaagataaatgatatgtcatcggcacctagctgatcggctatcatttatagatttaaccacgaattctttgtctttatttcttgttgattacacgatcaaatcaactggcacgcttatatatttcttcgaaggcgagctttggacctacactggagttaagcagatctcccaggcctcgtgttttctgtcaacacgcttttggtacgcccggtgggacagattagaagtcagcaagcaattcttcctcatggccgagaagccaccgctgtcgccatcctcgactagcccaagcactgttaaagaaaagatccagaagttggggttgactgacgtcaatgaaggaaacgtcgtgcccatcgatccagagaaattcacacctgagcagaagaaagattttgaagcaatgttgcagcaagcccgggatcagttcttgaactcattcatgcagacccacaagggaacattggtttagaagtataaagtaaaggtagttgccgatgatcctgggaccagttcttccaaaggtgaagacgggaaacaagctccagatggctctgctcaactgagtgacaaaggtgctaccgacagttctctaggaagtcaaggtgacaactctcaaggggtcgatggagttcaaggcgatggagtgcatggagttcaaggtgatggtgctcaggggttgcaagggggaaatcttaatcagaatagtgatgcggcacaagattttttctataatttccaagaccgggtcgactacgctgtgcaccatgctttgatcaatcagtctggggtgttagtcaattccttattaaacttgatgaagtcaatagccgatggattagtagttgagcatcaggctgcaggcccagtttatttgcaaggaggtgtctttccaaattatcgtcatttgatcactgatgcccagccatctattcaggcagttccccccatcgcaccatcagctcagccgacggcgccggcatcgactcccttacctgctccgtcagcattggcaccaggccagctggtgaaccctcagttgttaatgagagagcagccacagcatagtgggcaggttgcgaatcggctaacgcaagatcaggttgctgccatgtttctgccgtctccacctgctgttgatccaatacagcagcagccgattcaacagacactcccgattcagcaggttgtacaaccaatccagcaacaagttgtgcaaccagttcagcaaatgccaccaaggcaacagcctccgtggccgattcagcaaacgccgttaagacagcaaatctttcagccgattcagcaccaaggctcaatgagcgcatcggccgggtttgtgacgcctggtggacagcctgttcaacaatttttaaatcaagtcgtcccagaacacttggtacagccggatgggacagtaatgcctcaagttgttcccgagcatttggcacgtaatattcagtcgaaccttcataattaccagggggcaacttgaattatcaatatcagcctccttccccacaagcccaatatcagccagggggactggctcaacctcagtttgcgtctcagtacggtcagttcgagcctatgcaacaacagtcacagggagcagctcagcaacgaccatgggccgatgtgattgctgatgtaatgagggaacagtttgggcttaaaccaaaagagactgggagcttgtatcggcagccttaccctgagtggtttgagagagttcctccccccaatcggttcaaagttccggacttctccaaattttcgggacaagatggtgtgtcaacttatgagcacattagccgatttttagctcagtgtggtgaagcatcggctgtggatgctttgagggttaggttgttccggttatctttgtctggatcggcttttacttggttttcttctctgccgtatgggtctgtcggtgacatgggatcgggagtatcatgactagaggcttgaggcagacacaatcgcccacgtggcctggcacccccgggggacgtcgggcccgagggtgatgtgttcgccctcctcttagtccccccgagggggtcgggctgcacccccctcggccccgagggtcgaggcgccccgacccctcgtgggttttcgctccgcgcgtatgagttaggtgagcacagtggggctcacctaaccacatttattgcggattggctgagtgtgtcacgacgcatgcaacgcagtgcattgcactcatttatccggtctgtgaccagtcacagaccggtcagatcgcgggttaggtggcgacaggcggtctgacgcacgcctcgccccatcccgtcaggacgagggcttctaggcgctcgtccccagctggagctagcgtgttacctcccagagatggcacgttagtcctggtcagatatatgccaggcttcatcctaaccattacaggcaaaatgttgtgtgaagaagggccaacgtgcagattgctaagctgacgcgtggtggacaagaatgaccgatttgtgaccagtctaacaccggtcatgtcgccagcagaccgccatgattccgcgtcgcgcctgctcccggcgaaagtggaggtagttgtgggccgtcccatcagaaggcgactcggacggcaacgatgcaaatctccgtccatttatgaaaaggtagagtaagtccccagggagagggagagaatggtgcatgtggtatccccttaagatatgaaaggaggaccttgcccactgaggagaaggagagagattttcgagagctttttcttggactgaacctttccagattaggatcctagaacaaaggagaggctggctcatactttgtagctccttcacacacgaatccacctaaaacacaggagtagggtatgacgcttctaagcgtcccgaacctgtatacatcgccggcgtcttctgtgcttcctgtctggcgaaccttccacatacagattgggagcttagagtctcacctagggtccccggccgaaccggcaaaggggggccagcgcggtctcccggtgaggagccccacgctccatcatctggcgcgccaggtaggggactctgtgagtgatcttctgagctctcgcactccttcgggtgcgccaagcttttcctgttcggcctaatggccgagccagcaaaggcgcacgacctctccccgagtatgagcggtgacgacggggagccaaacccacgccgtcgagctcgtactccaccgccccctccacgccaaagtcctaggcgagaaaaggcgatcgagagggctgaaggatccgcgacttcgacatccacaggaggtggaaaggggcggcgagatggggagcgtcgcctcctcgtctatggtgacggcagcacgccccagggcgcgctccaagctgcgggcgcgctcctacgtcacccgcccgtcgcccatgacccggagtctccagcccaacgctggctggacgatgtggccaaattggtcatgactgcacggcagcgcctggatgctggtgggcggtcctccgccaccaaggcctctggtgctgctaccactggctccgcgtcatcaagacgaagggcgcggcgagcggcagctgccgttcgctattcggccgccactccttcgtcgactccttcgacccgggaagatctgcgtggggggccggacgcccgcaccagcatcgagcgccggcgtaatgaccgacgtgctgcccacgcaacggagggcgcttcctcgtccagagtgtcacctcaacacggacgcgggaatcagccctccgtgcccccggttggtggtgtcggctgtagagcctttgtggcgagtctttggaatgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaaaggacaggcgcggggctggctaatgaacttgccacccgcatctgtccattcttgggaggatttgtgccaacagttcaccatgaacttccaaggcacatatccgcgcccaggtgaggaagcggacttgcaagcagtacaacgaagggatgatgagtcacttcgctcgtacattcagcggttctgtcaagtccgcaacaccataccatgcatccctgcacacgcggtgatttacgcgttcagggggggtgtgcggcacaaccgcatgctcgaaaagatcgcctccaaggagccccagactaccgcggagctttttcagctcgcggaccgagtggctcgcaaggaggaggcctggacttggaacccctccggttccggtgtggcagcttcggccgcccccggatccaccgctcagacagggcggcgtgacaggaggaggaagaagaggtcagtccattccgacgacgagggtcatgtcctcgccgtcgagggcgcttcgcgggccacccaaaaggggaggcctgcgagcgacagaaagaaaaaggccggcgctcccagcagggagcgcccagccggcaagtggtgcaccgtccacaacacttcccttcacgacctcgcggactgccgtgcagtcaaaagtttggctgagcggacgaggaagtgggaggaggagaggaggcaggagcgccgagagggcaagtccccggcggttccttccggcaatcggcgaagtgaggccaagcagaaggcccccgccgaggacatcgatgacggcgatgatgacctaggtttccaagagcccggggccaccattgccactgtcgatgggggagcgtgtgctcacgtttctcgccggagcatcaaggccatgaagcgagagcttctggccgcggcccctactcatgaggcgacgcgccgggcgcggtggtcggaggttgccctcaccttcgaccagaccgaccacccaccgtgcgttgcccggggagggcagattgcgatggtggtttctcccaccgtttgcaacgtgaagttggggcgtgtcctcattgatggaggagcagccctcaacatcctttcccccgcagccgttgatgccatcaaggccccggggatgatgctccggccgtcccagccaatcatcggtgtgacgccggggcacacttggccgctaggtcatatcgacctcccggtcacattcggtggacccgccaacttccgcacggagcgggtgaactttgatgtggcggacctcagtctgccctacagcgcggtcttggggaggcccgcgttggtaaagttcatggcggcggtccactacgcctacctccagatgaagatgccgggccccgatggccccatctctgtccatggcgacctcaaagtcgcgctcgcttgtatggagcagcgcgcggaccgcctcgccgtcgtgtccaagcccgagggtggcgacgagaggcttggcacatccgcccccgccgccccgaggcagcggatagtcacgtgcgatgaagtcccggtcaagcaggttgccctgggcgacggcccgtccaagaccacacggattggtggtcttctggacggcaaataggaagacgcgctcgtctctttcctgcgggcaaacgctgacgtcttcgcatggagaccggcggatatgcccggggtccccagggaggtgattgagcaccgtctcgccgtacggccgggcgcaaggccggtccggcagaaagtgcggcgccaggccccggaacgtcaagccttcatccgcgaggaggtggcgcgacttctggaggccggattcatccgcgagttcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccacagcggggtgcgaccttttgtgttttctagatgcatactctggttaccatcagattcgcatggctagggaggatgaggaaaaaactgcgttcattacccccataggaacttattgttatacgacaatgcccttcgggttaaagaatgcaggtcctacttttcaacgtactactcgaatttctttgggtagccaattaggacgtaatgttgaggcttatgtcgatgacttagttgtaaagacgcgcaaccaggaaacgttactttcagatctagcggaaacttttgagagtctccgctccgcccgcataaaactgaaccccgataagtgtgtgtttggtgtacctgcgggcaagcttctcgggttcttggtctctgcccgaggcatcgaggccaaccccgagaagatacgagctatagagcggatgcgcccccccagcaagcttagggatgtgcaatgcgtcaccggttgcatggccgccctaagtcggttcatatcgaggctgggggagaaggcgctacccctatttaagctcctcaaacgctccgggccgtttacttggacggaggaagctgaacgtgccctcactcagttgaaggcgtatcttagctctcccccagttctggtcgctccggagccaaatgaacccttgctactctacttagcggcgaccccgcaagtggttagtgcggcgttggtcgtggagcgcgatgaggacaatcctcattccgcgcacccccaccttgtgcagacttggcccgggagagagcagggaggagaggcccccgagccgaacggcggcccaaggcccccgacgaccggagttggccctctacccgcttgtcaaacggtgctaggagcccccgacccccaggaaggccccgaggccactgcgggaaggccgcacctatcgccctctgaccccgaggctaaccctgtgccgattcgacccgggagagagcagggagaagaggcccccgagccgaacggtggcctaaggcccctgacgactggagttggccctttgcccgcttgtccgacgacgccaggagcccccgacccccaggacggccccgaggccactgtgggaaggccgcccctgtcgtcctccgaccgcgaggtcgtcggcacaggagacgagtgcgccccgcgaggccgctcgggtgaagagcgccccagggatgcggcccctagcgaagaggatcggccccaccgaaaggtgcagcggcccgtctactttgttagtgaggccctccgggatgccaagacccgataccctcaggcccagaaaatgctttacgctgttctgatggcctcgaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatgcccgaggccagcacgaacccctcacagctgcctcacgccgcccactgggtgatgcaattcgacggttctctgtctcttcagggcgccggtgcaggggtcacgttgacctctccgaacggagacgtcctcagatatttggtccgtctcgactttcgagcgactaacaatatggcagagtacgagggactccttgccggactcagagtggcggctggactggggatccgccgcctcttggtattaggcgactcccagctagtcgttaaccaggtctgtaaggagtaccggtgctctgacccacagatggacgcctacgtacgccaagtacggcgtatggagcgccattttgacgggatagagcttcggcatgtgcccagacgggataatatgattgccgatgaactctcaaggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccgaagagagtgttccaagctcccttagattgattgcttggatctctgagatccaaacatacctcacagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgctgacatccatgagggcgagtgcggagcccattccgcctcgcgcaccctggttggcaaggcctttcgtcaaggattttattggccgacagctctcaatgacgcagtcgatctggtccggcgatgcagagcgtgtcagttccacgccaagcaaattcatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaatttattaagggcatcacggcccgttttggagtgcctaaccgtattattacggataatggcacccaattcactagtgagctcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagctgcgcgctaccagcagagcctgcggcgctaccatcagcgccacgtccgggcccgatcactctgcgtcgacgacctcgtcctacgccgcgtccaaacgcgtgctggattgagcaaactctcaccaatgtgggagggtccgtatcgagtgatcggtgtcccccggccgggctcggtacggctggccacgggcgacggcacggagctgccaaacccgtggaacattgaacaccttcgtcgcttctacccctgaagggggggggtcgggtgtcaggttttggctcgggctaaccccgcaccccccctcgggtgtgcagggttagccgggggctaccacacatgcatatatattcctttcagcatttcaatagaagcagtttcaatttcctaaaggttgtgtctgtgccgttttttccttttgaagaatcttgacttgaaataatgtcactcgtgctcaaccttgccctcgggggctcggttcggtcagctaaaatcgccaaacggggcccagaaccgagccgtgccccggggcgtggtgaactccgggggggaatcggcaaaaacccacaatcgggtcacccatacccctcggtcaccacgttcccggcctggccagtctcgacatgcggatctccccaggcactagccccgacccgagccattcgaggaccgggacttgggcgcgagcccttatttcaagctaaggcgcaaaaggaccatggcacagatcatcctcaactcatatatatagcaaaataaaactaacacaaaaatttttcatcatttctcattgcagattaagttagattgtacaaaaaagaggcatgaaggccttagaagaaagaacaagaaaaaagataagagtggcgggggcctgggggctcattcatatgcgcccgggtcgccggcctcgtcgccaccgccgtcctcgctgctggcgtcgccctcctcgtcggagctgggggcgaacgcgagccgaggggccgagccctcgaagctgttgacgatgtggtcggcagcgtccccgacccgcgcgcgcgcgtcgtcctcggtcccgggagggaactcctccagcgccatccagggggagaagttgggatcccgggcctggtaactcgccagcacgagttcaaccgccccccgggcgaggtccctcgaggatgccttgatggtcttctcaagctcctcggggagtcgctcgagaacccaagccatcctgttgaggtgcggagcgaggccttccagattggtggggggcaccgacgtctggcctccccagaggcccgcttgccgaccggcgcgcttcatgcgggagaccgcatcccagagcatgtcgggcccgatctcgcccgccaagcgaagggcctcggcctccccggtggaggagtccagcgcgcgctgcatgtcagcgacggtgtgttcggcagccgcgaggcgagcggctaagtcgctttcgcccgcggccgccccgctgataggcgccctcgcgtctagctccttctcccgcgcctcgaggccagcagcccgctgctccagcgcggctctctcggcgcggacgctttcaaggttgcggcgcgcctgctcctcctgcgccgcctcgcggagggagaggctgtccgccagccgttgcgtcgtggcctcggcctcctcgagagcccgctcccgctcggcgagtgcatcctcgcgaaggcggagcgcggactcctcctcggcgcaggcggcctcgtgcgccgccagcgtcgcctcccggagagcagtggcggcctcgcggtccatcaagctcctctccacggcgccggcatgttcttccagcgccatggcacgggcctcgagggcctcctcgcgccgccgggacgccgcttcggcttccgttgcccgccgctctcgggcagcggcggagtcgagaaccccttgggcggcgtcgagcttgctcttcagctccgcctcccagcttgcgtgctgaagacggagggtgtcttgcgcctcgaccatcgcggtggtggcgacgagggcggcctctcgctcctcctccacctcccgggcgatctccgccagcgccgccttgcgggcttcgagctccgagatgtggcggcggtgggccttacggcccacctccaccatggcgtccaccgagcgccgcccctcctcgacacgcgcccatgcggcctcgagctccgctcgttccgcttgcaaggcctccacctgggcgctaaatccatctagcaccgcggtgtttgcggcggccaaggcctgcataatgggctcggcgctcactggggcgacgagagaagaggagaaaagccgccttggagaaaaggcgacgcggcttggccccccggaggatgcgctgggctcggggatgtcccccgggcccgtttggtcctgggcgtcgcccggtgaggtaggcccaggcgatgcgcccgcggcctcgtcgcgagccgcctcggaggatgtcgcctgagggccgcccgagggagtgggcccgagtgacgcgccagcagcagctgccgcctcagcctggcgagcccgggcggcctcctcctgggcagcttcttcggcttggcgagcccgggcggcctcctcccgagcagcctcctccgcttggcgaacccgggcggcctcccgggcggcctcttcagcttcccgaaggcgggctgcggcttcacgccggtcagactcccgcctccgctcctctgcggccgctggatcttcggcctcggactggccggacttggggcggcgggaggaatgcgacgggacatcgctgaagcagaagaaaaaaccaaaagacgaacaaaatgggtaagaaaaaacttctctttgggagaaaggtggtcgcaatgagaatgagacgaacctgcgagggggtcggttgaatgaccaccttggaggggaaattaggtttccccgggctggttccgtctcccccatcttgcggagccgcttcttcttgcgctccccctcgggctgtgacgtcggcgcagccccctccgggcgccgaccgctggtacgcactgccccgccccctcggggaggagatgggggaggtgttcctcccagcttcctcttccccggggcgtcggcagggcggctgctccccgagcccccgacgcggggcccagaagcacgaccccctcctggggcagattttttccccgggcgactctcgcccgcgccgtcgtggcccttaggggctctctcctctgaggccccgacccccagcataatggttagaatggagacgcggtcgggatcgatgcagagggggaggatctcctgaggaaggcgagacgcctccgcggagctaagattcagcaccctttggactacgatcttgaagtcctcaggagcccaatcccatctggctccctggtgggtccgcatgtagtcttcaggcccagtgtactcccaggcgctccgggcgcgccgttggagcggcgcaatccgccgacggaggtaatcgccgtacaccatggccccggtgagcccctgggatcgcaggcccgccaggcggtcgaggacggcgtcgtactcctcccccagatctaccggcgcccgccagctggagacctgcgccgggggctggctcggaagtcggaggcgcgcttcgtcggcgaggggggtgtagaaccagtcgctcttccagtcgtcccacttcttgcggaggacgcaggggatgtagcggttcaacaccggcccccgcggctggaagtagcagccgccaaccaccgatggcggtgacaccgactgcacggtgaagaaccaccggaacagctgaagagaggggcgcaccccaatgaacatctcgcacaggtgtgcgaagatggccaatgtcatcaccgcattgggggtgaggtgcgccatctggagatcgtagaactccaggacatccatgaagaaatgagaaaatggcgggaccagcccagccattgcgaaggggaggaagaagatggaccgccccgggtagtctggtgccgggcgcccctcgcccagcatcacaatctcccgaccggtggcggactccggcatgaagcggcgcggcagtccggcgtgcctctcattcacgatgcgggaaggcggcagtacactgccgtcgagcagagcagagccccgtgccatggcggtggaggaagagatgattgggaacgagcgcgtgtggcgaaagtagggcgtggtagagaaagagttagagctcaggcagcgaaggcaagaggaacaatggcgaaaggaagggagcaaatccttttctcgatgcttttatacccttgccatcgctgggcctggctcctcgtttctcgcgcccactacctcgctccctcgtatctcgctatcttgctccctcgtttcccgtgcccacgcttccactaatcccattcgcccgcttacggcgcttgaagtggatatgcggttgtggcaatcgaaacggattgtatcgtgcgcgcgttaattacgctcgccaaccgaagcggcgttaccgtatctccgggcgagacaaatctgctcacccagattcgcgcgctgctcaagtgatgtggcagtcttgaatagaccgcccattatggacaaccaaagttaccaataccaatgtgcatggactgggaccgttggggattttgcccaactatgcagaccggtcccacctgtcaccaggctttaggagtggcgtcacacctgaccgcttcccttgggaagggaaattgctctggcataacgccgggggctactgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggtcgggttgcgcttgccctggccccgagggccggggcaccccgaccccctttaggaagtctgcgccacgtatatgggataagtgagcacagctgtgctcacctaacagcatttattgcagtctggtcaagcgtgtcacgctgcacgcagtgcagcacggcgcgtccctttatccggtctgtgaccagtcacagaccggtcagatcacgggttaggtggcgactggcggtctgacgcacgccatgccccatcccgtcaagacgaaagcctctaggcactcgtctcaagccggcgttaagcgtgttatctcttagagatgacacgttagccccgatcgatatatgccaggcttcatcctaaccattacaagcaaaatgttgtgtgaagaagggcaaacatgcacgttgccaagattacacgcggtggacaagaatgaccgatttgcgaccggtctgacactgaccatatcgtcagcgcacagccatgctcccacgacgcgctcacccccggcggaagtggaggtaggtgtgggctgtcccatcggagcgtcattcggacagcaaccgtgctgatctccgcccattcaagagaaaaagaacagtccagtttggaaagagaagggtgcatgtggtatccccttgaagtataaaaggaggaccttgcccatagagagggggttggttgattctttcccagattatgagcttagaacgggggagaagtcagctgacacttgtagctcattcatacacagatccaccaaaacacaggagtagggtattacgcttctcagcggcccgaacctgtatagatcgtcggtgtctcgtgttttctggctggcagacgatatttccacatacagagagagcgagagcttgagatttcaccctaagcccccggccgaactggcaaaggggggcctgcgcggtctcccggtgaggagccacgagctccgtcagcccccaagtaaacttttgatcagctttcaatcttaacaatggcataaaaggctctaatgttccagacaaattagaaataaatcttctagcgaaatttatcttgccgatcatctcctgtaactccgtcttgttctctggaggctgaattttcttgattgcaataacactcctttgagttatgtcaattcccctctcatgaacaagaaatcccaaaaactggccagccgatacaccgaaagcacactttgttgggttcatcttttggccatatttcctagttctctcgaaaaacttcctcaaattggctatgtggtcctctatctctttagacttaacaaccacatcgtcaatgtagacctcaaccaaccagccgatcaaatcatggtatatataattcatagcccgttgatatgtagctccagcacttttcaagccaaaagtcattacaacccactcaaacaagccgattgcaccatgacacctaaaagctgtctgatggatatcttcttcggccatgaagatctgattgtatcctgcatttccatccatgaaactcaatattttgtgccctgaagcagcgtcaaccaactgatcggctactggcattggatactcatcctttggggtagctttgtttaaatctctgaaatcaatgcacaccctaaccttgccatttttcttgataacaggaactatactagaaacccactcggcatatcggcaaggatgaataaaaccagcatcatataaacgtttaatctcagccttgacaggttcgagcatatcggctttgcatcttctcggaggttgctggtgtggtctaacccctggtttgataggtagccgatgttcaacaatcgatcggctgagtcctggcatcttataatactcccaagcaaagcaatctttgaattcctttaagagctctgtcaacttggttctaaattctggagataagttcttactgataaatgtcggccttggtcgatcacctggacctatgtcaatttcttccaaatcatcggccaacaagaaaccctgttcttacttgtcatcgagatgatctactgtatccttgttatagacgtttgaaccctccacgatgccctcaaaataataacttgggctctccatcttcaattggctgtatatcacaatcggatacttttagaaattctccatcccaaacttttccagataagcaatcgaaaccatccatctcccaaagagctaaatcggcactggcaacgttgactgacctgtcggctggcacgatttcaatcttgtcgccttgccattgaatcaagcattgatgcatggttgaaggaatacaacaattggcatcaatccaatcccttccaagcaacaagctgtaggaacccttcccatcgataacaaaaaatgttgtagggatagtcttgctgctgaccgttagctctacattcaaaactcctttggtttctgatggattgccaccatagtctttgagcaccatgtttgtcttgatgagatcctcagcattcctgcctagcttcctaaatgtagcataaggcatcaaattcactgcagccccaccatcgaccatcattttagacataggcttcccattgacatagccgtttacatacaatggcttaagatgccgattctctgtcccttccagtttctcaaagactgcttgttctggtgataaaatcaatctagccgattcttcctcaatttcatcaacatcggcttgcttgatcccaaattccgcaggtagtataaaatccatgttaaccgaggcagtcacaacactttttcctctagccaatctctttacttcatcggctgtaggaacttgtttcttaatgcgccattcctgcttcgaattcgttttcttcagccgatggttgatctcttgctcaacctcctaaaaacgttccctattcctcaacctttgaacccttctcttctgattatttgtaaaaataccagaaggacaccattgggtcttcctgtcttcactgtcctcttggtcacagtcttggttcactggactcaatctttgatgaacaggaactcttgtttgccttagccgattgcctctattatacgattggcttgaactttctgcaacattgctacacccaggacagtcttcaatagatggcagcctcataccttcattccagcaaaatctaaagaactcacaaccccaatgaggaccaaaaccgccatcatcttcttcataacgcctctcctgctgtcgcgtcccaaaacgactctaaaatacatcctcaaaactatgcatagaataagtaaaatccatgtgaaagcctccaacaattaaaatgtgcaaagttaaaagtcaaataaggcttggaggatttttgtatatttcctaaaagcctaaaatgcgtaaataaattttagtggaattttcagagcacaaataataattaagaagaaataaacaaagttaaaaaggttttataaaaaagaaaaaccctaaaaagtttcttttccctccccctctccctcttgggccggcgcggcccacctccctccctctctctcctctcccccgcggcccatccggccccctccccgcgcgcgcgtgccgctgacgggcggcccgcacgccaccctcgctgacgggtggggcccacccgtcatccccttcctcccgccgctcccgccgcctcgcccgtgccctagcgccgccgccgccgcgaatcccgccgcctcccgccgtccccgggcgcaataaagagggggaaatcactccccatgattccct

SEQ ID NO: 2928 - DNA, 739 bp, Oryza sativa
ctgcagcccttttgtttggtatattatacttgttttaatatctttatatagagtagtttcggagtattagccgatacatgctagatctatctgatcggctatgctataaacatatataatcctgttattaatatatatttcgatctaagtgatttatactgtctcggcatggtgaccgatctatcctaatcacttgatttaagtatatattaatataagaactatatatcgttaatatctacagccgatcgaatagatttagttccttactatctatttataaccgccgatcgattcataaatgacatcggctcaaagataaatgatatgtcatcggcacctagccgatcggctatcatttatagatttaaccaagaattctttgtctctatttcttgttgattacatgatcaaatcaactggcacgctcacacattcgaaggcaagctttggacctgcactggagttaagcagatctcccaggcctcgtgttttctgtcaacaaatgtaagtatactatatatattagaagtataggaatatattttctttctgtttttttcccagttagcttagataatatattatgagaatgagtagctaatgcttgtgtgtcactctacccttggattatcttaacccctgcttagaatatgattatcacaagtaatatataaattattagtcaagttctctctacatgatctttccatgggataaaataaatacgatgcccttg

SEQ ID NO: 2929 - DNA, 1128 bp, Oryza sativa
ctacacaggaaataaaaaatggtggggccatgtggcccacatgtcatcctcgctccttcctcttctctatatcccctctctcctctctctcttcttcctcatcctccctagtccctccttctttcttccagcagcacgccgccgctgggaacccacctccgccgcaagcgcgtcccgagcatgctcctcctcgagctccgcgaggcatgtggctcaggatggtgtggccagcgccggcggaacaaatgagtcatcagggacctcttccttgcctccgcgaacccctcgcctcgcgacgctgccgctgccgccgccgcggcatcgtcatccttgtcctccgcctcgtcgctacgggggaggatgaggagaagggtgggggtggtgtgcgcggcggtgtcgtcggggcaggagggaagtggcgggggtgcagccgttggtggaggcgttgccgccggtggcgagagcggcggggtatgtggtcgggctgcgcagggggggacgcggaccacgacggtgctcggggcggtcaacgtcgccgaagcagcttcggcgaactccgccgtgcccggggtcgccgcggcagggctgcacaactacgtcgccggctgccgggagaggagaaggcggaggcgaagagcagcggcgcgacggggtgtggccagcggacgacgaggagagggatcccttcctcctccttcgtgtcccgcgactgcgagctcgccgtcgcacgtcgccaactcgtgcaaatcgatgcagcggcgcagcaggagtcagcggcggcggggccgaggtcgtgcagctccgaccgccgctccctcctctcccgtctcccgtttgccaccgcacaaagctccttctgccatcggccaccacgcgccgctcctcaaccgccaccacgcgccgctcctcaaccgcctccacgcgccgatggctgtcgccccccgtgcttctccccgccttctccctctccgcgtgcgctcgccgggctccccgctctattgctgccgtgtcgtgctcttcttcccgccgtccagcggccaccgcccttctccctctcggcgcgcctgaagagaggagaggaaagaagagagggcagatcgggagaggaggaagaagaggaggggttag

SEQ ID NO: 2930 - DNA, 619 bp, Oryza sativa
atttaagccaacttatttaggttggatgcttgtcattcattatatgatctcatctcataattatccttgttagaaggcagtaaggtttctatctccattatctcctcacttgcaatcttttaccgtgctttaaaagatcactgcatcactgttttagagtctgattgttggggaaggtttccagtacttctgattctccactgacatggctgtgtggtttgctgattaaatgatcaggtggcattctgttctccaaagagcagaaacatggttaatgcaataaaggggttgttcatctcctggtaaggtccttttacaatcgataaaatttagctcgtttttcttcacctctatgtagtttgcacaatcaactcataaatcctttttttttccagcgatgtaccgatggcacagttcattgttaatctgaatgcttcaatgcccgcttcggacaagttcatcctgcacatgcttgaccctacacacatgtttgtgcagcctcatgtggcggagatgatcagaggtaagatatcagagttcagagaccaaaacagctacgagaaagccaacatgaaagatcattctaccccacagtaagatatcctgtgtgtacaccact

SEQ ID NO: 2931 - DNA, 2006 bp, Oryza sativa
  unsure (1)..(2006): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgtaacaacgaggttttttttagataatggattgacaacaacaaggttaggcgacagatttgccacatcattttccttcaccgtcgccatcttcccttctcttctacgggtggtgatggcttcaccagcgaccgcggctgcctcgcacgaggcgcaggagcatcgcacggggccacaccttctctcaactcatcgccggactcatgtctcacctcacctgacaaacccagacaaaaaacacgtgtctcactttggctacgcagtctttaggttagtagccgcacatgcgtacgaggaggcgaatctccaatgtggcctgctgaggctgaacgccaaataagtgccctgtgaaagcccttatgggaatcaagtacctcactccggtctgtacttgtgtttctctttatatagaagttgtactaactttatcctaaaatactttctgccgtctctttttaggattcaaacttcgtctctccattttaaaatttatctctttatgattcaaattttattttaaaatagttatcactataaaatttttcccgtttcaccttcaatcacaattccactatcaagcataggagtacatcctattatttaataaagggtattatagttttcagtattaaacgttaatctatcgtaaacaatcttggataagtatcatgagtcgagggagtattttgaattgaatttcatagaaatgatagatgtatgcgttatattttacattttctaaggatttttttacgctatttatatatgttggaataacctactactctatctaaaaaactgatcctagctacaaattttgtattctcaaatgtctattagaattgggttttttataggatggataggggtaagaatgtgaggtttggatggacggacggatgtggctctgtcactgcatgtgtcattgatcaattttgtcgtcaggatttgcgaccgagccataactttttgaatcgccttttgagtctatccaacattgttggagaaattttatgggaattaagttccttgctccctggtacaaaattatagggcgtatcgtaaatctttaagagaaaaaaggtaatttcacaaaatatttggatcattatgtcacaaaattatagattaaaaaattatatcataatctaaagatttaaaatatcgtatcggaaaactacatatgtaacatcatttttattaaaaaaaactacatatgattttttaatctcaatagtgttatggatatcaactctaaaatctgcagttcattaataatctaatcactgaatctgtagttttatgatacaatacaataaatatgtagttttctgtaaatttagcactaaatctatagttttgtgatacacatatttaaatctatagttttacgatagttttgtttaactatatgtagttttatgaaatttacgacgttaagtgttttgataaaatagttcgagtcataagttatttttttctcatctatatcttaaattattgaaaatgattcagcttactcgctagtggtattttctctttagcgtttatgccatattttacactgaatttggtagaattgatatatgcattataacttactagctacttactactactagttatatggataaaatctcttataactaggtagtaatagtatgttgaaacttgaaagcacctaagactaatttgaacatcgatatttaaatttcaagaaaatagtcataaaaacatttttgaactttgatgatggtgttatctatggatatttgtttttctcattttaaaattgaaataatgaaaacagtttacctttgctcacttac

SEQ ID NO: 2932 - DNA, 3799 bp, Oryza sativa
ctttgataataggcgttatctattatctaaaaattaaagcttaaaatgtgacttgtctaaagagaaaaatgttattaagtagagtaaaccatttttactagttcagggataaaataagtgtactaatagtttaggggattaaatgatcccggaagtaaaataaacttttttctatttttaaaaagcctttagcacaatacttcaaaattgattaccttaatgagctaaaacaaaatttccaaatatttagaaaccactggataaaccggccaagttaaaaaagatttgaattgatccttaaaaaattgtcaaaatttgtctgattttttttaaggttttcatcgataatcgatcaattataacaccacggttatcattgaaaccaccggggagtagtattcaccaatcggtcacattttgaaaccctgtttgtttgccacaggggagttatgtctgcatggcgcgtactctgaaccttgtgcttatgcaatggaattaattatcattagggtagctattgtgtttattgaagacacagcgaatcacagatgtgagctacggaatattagcaccccatattcctgtagatatatactgtaacagacaccattagggtaatttgtcgaatttgtgaccgacgtcaatgttatgcatatgtaatacggaggatgttcattatgaaattcccgtcttgttgaagaggataacaatggtacacccaacaccgaacttcttacgtgcggaaaaacgagaaagatgggttgggaactcaattgaacacagccgttagtgcccaattcttgcagatgagagctacaaaatggctaaggtctcccgttcttcagctctcctttggtattatgggccatcccttgtcaaaagctgcaatgctagcttcatcccggatgcatcctaaccctaacaaacaatgtaaacatgtgagatgtctgaaccaatgtagtttggtcgccatggagaggtgttgtaaatgagacacacagccttttatggtgcccttcacattgttgttattagaaaaggtttctcttctgacaatttaatacagtatatgagaacgtttctctaccttcattaatacaacgcgagcaacacttgatggttcccaaaaaaaaaagagatgctagacaccgaaaaaaattagagggatgtcatttgttctactgatcttgttactcgtgccaaatgactatagtttgtaactttgtataaaaggaatgaaagctgatttatatgttcattggatatggtcatgtttgaagcaagagatgatccacctgtctggaatgtggaaaaatctaaattgttatattttagtgttttctgatatattacatcgaccctctcatgggatatatatagaagtacataggagatagagacttggagtacaatacaagaaagaaagagtagatttatctctaggattctatctctagaactctattttatctctaggatatatcttatctctatatttgtattttactcttatctctaactaacatattcatacttctaacatgcaagatggaggctatcttttgctcagttcaaggaagcgaacataagtagcttgggctaaattcctcatgcttctcaatcctataaactgcaccatttattacgccactgtaatttgcatgagacctattgcagttggtagctaactgtacaaatctttacgagcgtttggcctgaacattcatggacatatatagggggggggggggagggggggtcataaaaaatgaggtggccctctgtatgacgattacagtggccatgtgtccatactggcttcgaattgctatttgattctaactgtcaatttttcggctttcttattgaatgctcccatatgtcatttttagatatcttcgaatggaagttaattctggatttattcattctcacccagagtaagtttaataacgtagactataaatgcacgctaaattatctgaagataactctgtagatagatagagtatatatgcaataagcaactcctaacacaagatacgtaatttgctagcatgctatccttcagagctatgcggtcgtgacatgaaacctgtatggtgcattttgacacgtatgtatatagtccagaatttatcggcaggcaagttattatgttgttgaagactcttgaggtacaaaacaatcagaactatgtggttcttggtcatgcactttagtgtactttcggccttgacagtttctgtcgttttttcttgtaaactttatttcttctggatatattcggaggtcctccttcagccttcccggcgaatatagtgttgcaaccattagtgcaattggctgaatcggtgtgatcgacatgaggtcgtcagtgatacatggtttgtaacaatagggaaatcctttacttttttgtctggtcaagatatttttggtacatactataactttaacataagaatgctgtgtaaaccacaaaacttctcactagtggagcgtttaaaaccgagcaacatcataagagaaatgcagtggccaaagactaggaaatactgacattaaacatgctggactcaagagatcattcgagcatcagtcctaaggccagccctaacccaagacactagatatttgtctttttatagtagtgagtcagcaccagtttccaaggtccaacgacgacagcagcactcactatagtgataacgggattttctctcatagtgacggctcctgatccatatttggagaccactcgataaaccagccaagttaaaaaaatcaaactaattaagatttaaactcttgacaaaatttatctaaatttcatcgattttcatcgataacctctcagtcatcattattatcgatgaatacactagggagggttattcgtctactgatcacattgtgaaacctcttgtttgtttgaccgggcaagaatttgtctagtgagctagctgtaaggtggtgacatatgtttgcatgcatggtttgtattgtgaagtatatgcaagtgcaatgaagttaaattagctgtagccggccggtaggctaggtatatattgtgcttattaaggacacattaatgaagcccagatttgaactaagaaatggtgttagcacgacaaattcctatacatactgtcagaaaataccattaggggtagtttgtagattttgtggtggatggtagcgttatgcatctaatatatgtgtgcactaagaaattccgttctcttgttgtgataacaatgttatgtcgaactccagatttcttaccactagttgagtggtgaagaaggacaagagcaaaagtagccgcagactggatcgagtaaacttgatgtgtgcatttgtgcaagagacgaaaagcagtggattccagggtatttccttgcacaccagagatccaaaatggctatccctctcatttttagctctcttttggtattaccgatcatcccttgtaaaaagctctcttcatccggatgtctcctaacccaaaacatgtaaaatgagatatatatatctgcacatatatactccagttttttattgattactgcaccaactagattgatcgccaattcaacatgcatgtagtgtttttttttcttaaagagtcttagagaggtgttggaaaggaggtacatgcgtgcacaatcttcagtcttttatatgtgtcattctagttgttgttaccactactccatctcttctcaatcttaaataacatgaaagctatttatctataacttccattaatacaatggcaacaatgttagctagc

SEQ ID NO: 2933 - DNA, 17714 bp, Oryza sativa
tctagaaacttcctctgcccttgcatatgccattacactagcttgcttgtctagaccactcagtcactcagactatgtttccgttcaaaggcacccactgcagaaggcctcgactcttttgcatatatgcaggcaagacactagtagaggctgaggtggagtttcatgtaattcaatattatgcctcaactattcagctgtttgggaggattgaaggtgtttttttttctaatttcaatgagcagaaggtttagttggatctatgttcttgatacctctcaatcctataaactgagccatggataacataatgcctttttcgagggacctatcttgcagttgatagctgactatgcaaatgcttacaagagtttggcatgaaaatgatggacatatagaggttgggtgctatctgccatagcaacagtggtggcactcaaactatatatggagagttctctagggagccaatattaatataccacttaaagtggccatgtgttaatgctggctttgaattgccatttgattctcattaatttgtcaacttttttattgaatgcccgggattttgtcgacaatcttcatgcagatattaatttccacttatagtttttaggatcgtaggagaatgaacgactttgatccataggatttttttcctatagaggtcccttaccaaaggattcgaacttgttaaattctacaggaatgcatttctatgcctcaatctcatagcattttaaacatgtgctctaacctaattgtttttctttcctttaagaagtccgatacaaattctctctctaatataagtagcatataatataattttttttttattttttctatgagccaaccaaatatatattctgacttttgagtaatttatgcggttttgtttcatgtagtatttaacatgtgatatttcaatcatgcgctttttctatacctacatttttacattcttgcttcctcaacgactccttattcattctcactaagggcatgtttggaagtccagtttccacccaaaactagtttaaagttccggcccgaattattgtactggggaggggatacaaaatggctttgctctgatgggagtgtaatacactaaattttagaccgcttcaatccattacactcaggtaactaagatcgcctcagcaagtcagcaggccacatttttttattataaatgtcgagtcctctctcattggctcctccgtgctgttctccgatttgctcagccatgtgttccacggcgaccctcctctataccctcaccttactccaagccaattcaatccatgctattggcctcatcctagactctctagtgccctagattctcactagcttgcttagtaccacctgtgtcgtgtagtcctagtcctagatctgcattgccaatgtcattgtagcctcacttctcatcaccagcatcatcccatcctcgatccacatgtacaatatcatctcgacatctcttcaaagataggagtcccttcgatttgtgatattgcataattgggccttaggctcaaatgggcagacaagaagaaaccaaaaagagagacccaccacacctaaatccaatccaattatgcggatctcttctcctttttcccaagaatcctccattgcttcctgcgctgcgatgctggcttgcttgccaagccatggcatcgccacagttccattcacgtcagccagccgtgaatggaactgaatcgccacagttccattcaagtgcataaaattgatgcaaattggtcactgaatcggcatacgaagagaatgagatttaatttacaatgttgagatagaaatgcacctaaatgttcatttgaacatatacaattcaatcaggaaagcaaccccaattcattgcacatggtattctagcgtaccgagttggtcgatttactggattgctgtgaagatatgataggtgtaaaaatcaggattagcctcttgacaatatgattaataaccgagtaagttgaaaactttataaaacataaatggtatctcacctttagcagacttgaacctttaagcaaagctagtagaactgcaactcaatcctagcaagtagcaacatgactgccttcctctcatcctctggataaggctagcctacatgaaggccatatttatagcatctctaaccctgtattccaagaaatctatatatattttgaaaccgaattcatactgaaatttgtggtttgagctcgttaggtgtacaccaaatttgagaaacgtggtgtactttgcccagcatccattgggtaagacctttgttttttatttcaatcaacagagctactggttaaatattttcaaattattgaaactttgcaaattcaatcatgatggatactgaatactttctgacgtaaacatgcccttgctgaaaaaaaacaatggctcctacgttcacgtgcacgtaaaccctccacggcttaacgtacgtctcgcgtgcaacgacattatgagcagtgagcatagaatgggtgtggtttcctgacgtaggcgtaattggtggtgcgtaacccattcaccagtccatcctgcgctcacgtacgcgtaaaccgtgcacggcctacgcgtactgggtggatcgagattcaggtggtgtctacatggttcacgcctacccgtggaacgcgggcgtaaaccattccatcctacgctcgaaagctttaaaaaaagggtgcacatcgagcctacacatatctttggggagggagagtattatgtttacgtctgaaataccatatttactctccaaatgtaaggtgtacctagatcgatatatgttcaccatgcagggaagggggagtgatggattgtgctgggctcctggcgtgctgcgtctacacagtgacacaaatacgatgataccatcgtcttattgctcctccccgtcgtcttccctaccacttcttaggggacctgtgtattcatgtgaattatagttaggcctatttagggaagctttcagtagctacagcttcttctagaatgtcatgcaccaaacaatccaaattctcgcatatattctctggcatagtttctccaaagaatctcaagccccctccaatagagccttagccttagaaacttttcacaaatgtgtacactactgtactacatgaattaaactgtttttttttggttgaaatgctccgaaagattaatgcatgcaggatgcctgaaaagttttgaggctccaaatgccagtttggtactctgaactctgcagggtagccttcccgtgtagcctgtaggcaatggtagcaactagcaaggcaccagctttccaaagaggctggaatgcaaatgcaatgggacaaacaatacacgacgtacttaagtatacattactagtatggcatacagcagagagaaagctcgccatctttctacttggcacaatcttattgtactttcccgttttcactttcaccgagtaaattatcatggctaggaggaacacagccttttcatcattaaaagaggcaggaggagcagatcagctctacaactccactccagactcaactcctagaactaaatttagaagttagaactgtaccaaacagacccttagatcttagatctgtaaagtaacgcaactgtgtggatagcctgaattgctcagtagggagtattagtagtagtatttgcagtgaaaaccatacgtgtttacggtgaaaacagcagtgacgggccggcattgaagacgataggtcaggaggcagcggcggatggggcggcgtttgttttcttcttgcattgacgcccattgcctgaaaattccaactccatgttcctgaattcagagacaatttgcacctttcctgcttcatgctcttgacttttggtagtggtacagtttttgattatctggtgaaccttctatttcaattgcatcgtttgtttttatagatcacataagaacataacaggaagatgaatacacataaagttaactgattcttcagaaatatgctgtctctcaatgctccaacgctaccaaatggacaggtgattattatcactgaaaacacattaagtcataagccacaacattttctgatactgcaagtttatcattcttgaacatcatcatgattgatgagtggcacatgaagctcacatcacacacgattataaaccatagacaagcgttggtatcttttcagtggtgtacacacaggatatcttactgtggggtagaatgatctttcatgttggcttctcgtagctgttttggtctctgaactctgatatcttacctctgatcatctccgccacatgaggctgcacaaacatgtgtgtagggtcaagcatgtgcaggatgaacttgtccgaagcgggcattgaagcattcagattaacaatgaactgtgccatcggtacatcgctggtaaaaaaaaaggatttatgagttgattgtgcaaactacatagaggtgaagaaaaacgagctaaatttatcgattgtaaaaggaccttaccaggagatgaacaacccctttattgcattaaccatgtttctgctctttggagaacagaatgccacctgatcatttaatcagcaaaccacacagccatgtcagtggagaatcagaagtactggaaaccttccccaacaatcagactctaaaacagtgatgcagtgatcttttaaagcacggtaaaagattgcaagtgaggagataatggagatagaaaccttactgccttctaacaaggataattatgagatgagatcatataatgaatgacaagcatccaacctaaataagttatgcttaaattgcttactgctaccacacaggtacataatacaaaggtgtgagctatgcttgaagaggcaataagtttaaatcatactccactaccgaaagttggtaactaacaaaaatatgcaaaacattgtagtggccagtgattgtgctcccgtgtccaggggcggatccaacttgggaactttttggggaacaaacaaactgatctagaagagaagctagggttaacgaacgaacgcaagcaaattctagtcccgatgggaatgggggagagagagatgaatcagaaagaaagaggatgtggatgctcaccatgatcctctcccctgctctgctcgcccgatggagatcgccggccacgactcgtcccggcggcgcaaggagcggaggagaatgctcacaagtgtcaagacttgcagtagtatgttgagcttgctgtactacaatagttagattggcagttgaacattagtgaagtagtaaggaacatgattgaactgaagagcaaaagagcgaactcttctgaatacaaatatttcacttgaatcaaattattcgtataatgtcatgtgggttttgtacaagaaaccataccggtacagtaggctgtgacggctgccgcgcgacgtggtgctagctggacgggcggggcggcgaggcgatgcggcgcgcgccgccgtcggagaagccccggtgccgggcgacgcggtgctgggccggaccggcggcggggcgatgcggcttgagcacgggcggcgcgcgacggcggcgtcggcccggcggcgcaaatcgcctgcagggcttcggtctcgcgagaaggggaacgggaaagaaacggaataattaattatttgccactcttacatatggtgataaataatttgccactggatccacatgtcatagacacatgagggcccatatatcataaacagcaagtggcaaataattaattgacacatcttaaaagtggcccaaagttaaatgtcccgaaagaaacagccaatcgtttttttccgtaatggcataggcggtaattttttcccctcaaaagccagtaaaaacaggggtatggactgttttcggatttgtactaagagcaaggttaataatacagttgacctgttggctataaggtttcttatagtattttctcagcctacccatataataactagctctttacaattaatatagggtccacttgtctctcacagaatttcttgaatttcttggttcttttgtctaagccggctataagtttatagcccgcttcttctctctcctcacttttctcctccacctcagcatttagccagcttatagcctaatattatacttgctctaagcagctttagagtaaaagcacttgtggcttttggactatttggttggtttttgatttttgtaaaagcaaaaacacgttgaaaagcccacccaagcccaccctaaaacaaatattttggtgcatgcatcgtagtaaaattataaattgtaggagtttgaaaaattatagatttctaatgacctaaaattacacaatgtacattgtttaattgttgacagccaagcttattacccccatcgatgccctcaagcagctggttgaacctgtgagaatccgatcggcttatcctcttactcttctccctcagcttatcatccaaacctaaaagcgtggatctcctattacctgcattttgaaccttattattcatacttttatatatgtccaagttgtgcaactttctatttacagatttacacaattccaaatagagacaaaaactatatttatatggactattttagatgctgacgataggattagttttcatacgctgtatggacttgttgctttgttccacaggtttcaaaataaaacgataaccgagccggtccatatataaaaactgttcgataaaccggctaagttcaacaaaatttcagactaaacttcaagttctgatcacatttccaaattctgtttgcaattgggcaagattttgccttgagaacttttgtggtgacataaatgtgcatcatgtttaattagctgtaggctagctagctatgtgcttaataagtacacaatgaagcacacagtgaactacgaaatgatttgaacgacatatatattcatgtacatacggcacaaaataccattgggccccatttgtgtgtgttttggttgtgtgcattctacttatgtagaaatcggagtgtgctcagtgcctttttattatgttgatgtaatttactgggttcaataaaacctttcattcctaatagagttaaaacacatggcaaacaaccaactatgtagtcgatgaagataaagtgtttttgacagaaactgtagtttatacggcaagcatgtttagaatttagaccgattttggcactgtaactccacttaaccatgcatgtttgatataaatttgattacacttttgagagggttgattgcgcccagtacttctctattttcatcctctgcttccaatagaggctaaaatctacctgttgtgaagaacagaggaagatttgaatttcatgaagctaacatatatccaggggaggagctacagtacaaccaccggagtcaggtgaccctctgacaatgttctacaaacttgtgtattaggtcaatgcttatgacaactaattccaaatgtcacaagcgaatgattaactattgacaccggcggcttgatttcttggctgcagccatcaagatacctgttgaggctaatatcctggctgatacctctcaatcctataaactgcaccatgaataaagtttcatggatttaaattgctatctttgcatgagaccaactggagtggataactcatcgtgcaaatgaattaaagagtttggctagaacacatcatgggggtatatatatatatatatatatatatatatatatatatatatatatatatatatatatatgggtcgggtgctatctaccacaataacaaaggtggcattcaggtacaaagagttcaataagtgaataacaagccaaaattagcataccattacagtgtggtcagtgctggatttaaattgctttgattctcctattcttttgttagcttttttttattgaatagccatgtggtacgggatttaattcccacttatgtattttcatttacagcaagttcaattagcaccaaaggttaaaagtatgtgccaagtcatctgaagataacttcgtagatagatagagtatataataaggttgcgttcgtttgtgccggtttggaacctttccttctggcatggaaaacagaacaactcattagcacataattaataaagtattagctaaaactaacttgaaaagttgattaatatgatttttcgaagaaactttcctataaaattatttttgaaaaaaaacccgtttagtaatataaaaagcatgcacgcaaaaaacaagagggggttgagaacacagacaaatgaacgcagccaatagttcataaaaaacaagatacaaagtttattaatatatttgacagctaattttatctcctcttatgccccttcttactttgcaacattcttcataaagaactcgctgcccgcactttgctagggtaccagagcaagcttgccaatcaccactgcaagaacgaatggcccgtacactactacccttgagattgtgagaatgtcatgaaatctgcgtgctgctttttgacacaatgtatattgtaacatggagtttacatatgttgtaaaattgtttgttgtgtttattgaacacacatgaactacgaaatgatcaacaccacacattcctgtaaacattctacattagtgtcgaaataccaccggtgtaatttgccaaattggtgaaattgacttcagatcatcagctatgtgtggcaacactaggaaattcccctattttcttgttccagtcaatatattctggtgcctgtaactatgtgtgaacattatcgtcccaaccacataacttcttctcactagctagagagtgatgaaataatctgagatagatcgcctgatcaaagcaacgaccaacaacttgaggaaaataatactcaaattaaacatgttcgcatcagatatctgaagtatcttgtgggcttgcttctcatacgaagcacatatgcatcagtcacatccttcaagcaatccatgccatagcagtttgaactccatagagtagctccatgaaggggcgagtcatcaagatcagagctacacaacccggtacattgccttcttcagctcttcatctgcattcccaccatcccttgtgacaatatgcaacactagcaccattctggatgtctcctaaccctagatttttcttgttaatcaacgcttaccatcattctcgcaatcggttgcacactcttataatagtatggttgtgtatacttcagggtgtggtcttgcttcaagaaaacaagaaatctccatggagagttgttgtaaataatatacacagacactcttctcggccttttgtgtgccctctagctaggttaattattatcaccagaaggcatctctatgtaccttcattagtacaatgcttgtaattttttatctttaaaaaaaaactgctagacacttgatataccaattttcccccctctttaaggagatcgattgctattgcagatgatttatcactattatgtgcacactattcacacgcccattttagaaggtagaatacacatttctgttagctggcacccatttgtctgctttggatagcgcaaggatgtaaaatggttggtatcagagttttttttttttttgcggggttgttggtatcagagttgaaggggtaaatcggattttcacaatagtggaacctaaatctgatatatgccaccttgaaaactaatcaaactatttgttttgtttattgaaggcacatgagctacaagcctacaacatgatcagcaccatacgttcttgtaaacacaatgtcataatacattaatacttctagtgtaatttaccaaattggtgtgatcgacgtcaggttgtcgattatgcatggtgtgcaacactatgaaattcccatgtttcctagcgatagaatcgatttcgactgaattataagcaactagggattaaataaggattaccattgcagcgtgtgctcatctatgttgtgataaatcgatgagcttgggaatggtaatccttatttagtggcggcaagcacagccggcgggctgtggcaacacgttgatcggcagcgatcaatctgtcgacggctacggaagataggtctacgcggccaggcctcatgaagtcgtgatctctacctcttatctcttcctttttagttttttttataatggggaatcataaagaggccttaattgaaatccaataacctaaattcatcccatcatcatggatttgtcgaaaatcctatggtagaaagtataatctatttaatttgtcaatgtgatgaactctacctatgcacgatccccgaccatatatcggagcaatggtaaagagtcgattttttagcccctcttttgattattttttcgaaaactatgaataaagcctgggatattacaggaggctagctatcaattgaagaaggtgaggaattagctgtattgtgtataggatatcgtgctttagacattactattgcagaggattcctcttgtgcatttttttgttcatatctgagccacacatccaagaaagaatggttgcgaaagttacaactcccaacagttgcttcttcttcttcccaatttcttcctagttcacaacctgaaacaagtgaaagcaaggaataaattgtgagttattttccaccaaaaaggtgcctacaaacccaagccgctagaatttagatagactggtccaagatgtaggtggtgaacctgaaaactgagccgtagcaaatccaggaagttcagatattgcaaagcagaggaaacagagtagagtttcagtggaaaggctgagagttgtggggcaaatttctcctccattattttctggaattcagaagtgcgtataaagcaaggtagaagaaagagtaaaagtttcagtgcaaagcctagctatttaaacaacaccaagtcagggtctcgtgccatcccaaaggactgtggtactgcagaaaagtgcatcacaactatgagcgtggaggttcatccctatgttatcgtctttagctcttccagtacattcctatcatccattgatagaagatgcaacgctagcatcattgctgatgactcctaatcctagatttgccttgttataacacttgttttatcattctcatggttagtcgcatatgtaagatcaaagtgtgttttgattcttattctgtgatgaacaattggcatctgtgattattggttttgatatttggagattatcgtcgaagtggttttggagataatcaattttcaggtgatgatcggattcactgttattttatgtgaccggtccgaccgggtggtgtatgccggtcagatcggtggtgatcgagcggtcagaccggccggcccacggtctgaccggccgacgctgtgtcggtttcggtttcgggttgtttctttggatatccgtgattgtttcatggttatggcttctagatggataccatacgtatataatactgttgtttgctaacaatgagtcaagttggtgatagcttggtctcagaatatggtttctttgtttgtttcatgtgtagctgactcgatgcctcgagagagtatttgcggtgatggaccgggagtcggcttggtggtaagacgatgtccgtggtggtcagatatcatgcgggatactaaggctagagttgatgcacgtggttggtgaagattccatatggcatacgatggaggtattgtgtgcgtatgggatgcggagtcgaatttggaaggagtccaaatttggtacaattggttatgtaaagtttgtgtcttgtactagagggtttcttaaggtgtttaggactcttagtatgagtttggttcgtggctttaggctgcctacctcatgtataaatagagggggagcgtgaggcttcccggtatcgtttttgtatcgcttttgagagcaactgagttgctagtttcgttagggtttcgagtttagtcgagatttttgtaaggagtgctgttggtgcactttgtaaacacagagagaagtaataaagttgttgtctactttgagagttcttcgatttgtgtttcatcgggtttcgacggtctaaccggcgacataccggcggtcagaccggcggcaggtggcggtcagaccgacggaggagaggcgatcagaccagcggcgacttcacacgcggcaggcaatcttcaggcggttggaccggcggatcaacaccggtcagatcggtggcacaagctcggtcagaccggcggatcaacctcggtcagaccgatctacatcgaatttgagggtaacttttatttccgctaaaagtttgggtttttgggtatatcaaccattcaccccccctctggttggcttagttcttgtgattcgatcctacaagtggtatcagagctttgtttgcttctttggattttaaccgatctagagtttttgccatggctgcttctaataagttttcaactaagcctcatgttttttatggaacggatttttctcattggtgtagtaggatgcaatcttacattatggctgagaattatgatatttggagaaaagtttctcttccttatgtgattcccgaagttattaatactgctgctgaaaaaattgcttttgaactgaattgcaaagctcgcaatattcttttgagtgggatttctcgttcggattatgatcgtgttgcttatcttcaaactgctcatgagatttgggttgctttgaataattttcatcaaggtacaaataacattaaagaacttcgtcgtgatcttttcaaaaaagagtacattaaatttgagatgaaacctggagaagctttggatgactatctttctaggtttaataaaattttgagtgatcttaaatctgttgattcttcttatgatgctaattatccacaatctgagatttctcgtcactttttgaatggtcttgacatgtctatttgggagatgaaaattacatctatttaggagtctgtgaacatgtctactttgactttggattcgctttacacaaaactgaaaactcatgagatgaatattctttctcgtaaaggtgattctaagtctagtgctttggtttcgtcttcaatttctttggatgttggtgcttcctcatcgaagtcttctgttcttgctttatttaatgccatgtccgatgatcaactcgaacagttcgagggggaggacttggttttgctatctaacaaattttctcgagctatgaaaaatgttaggaacaggaaaagaggagaaccgaatcgttgttttgagtgtggtgcacttgatcatcttcgctcgcattgtcctaagcttgggagaggcagccaaggatgatgatggtagagtcaaagatgatgacgtgaacaagaagaagaacatgaaagagaaggagaagaagaagcattgtatgaagtggttaatccaagaactcataaaagtttttgatgaatcggaagatgaagatgagagcaaaggtaagcaagttgttgatctagcttttattgctcgtaatgcaagttctgatgttgatgaatttgatgatgataatgaagaaaagcttagttatgatcaattaaatatgctgcttacaaatttgctaagaaacttcaaacatgttctattgtgcttgatgagaaggatcatacgattgagattcttaatgctgaaattgctaaattaaaatctttgattccgaatgatgataattgtcaatcttgtgaagttttattttctgaaattaatgctttacgagatgtcaattctgttaattgcaaaaaattggaatttgagattgaaaaatctaaaaagttagagtcttcttttgctcttggatttgctttccatactcgtgttgttgatgagttgattttgacaaagaacgttttgaaaaaaatacaaagttgctttttgtgcaagttctttggtcaatgcttcatgtgcaaataaggcaaaacaaaacaatggtgttttgatttctcaagattgttcaaagtgtgttttgaatgagttgaagttgaaagatgctttagagcgtgttaaacacatggaagaaattgttaaacaagatgaggtgttttcttgctcaacttgtagaaaacaaaaaggtcttttggatgcttgcaaaaattgtgctattcttactcaggagatttcttatttgaaaagttctttgcaaagattttctgatggtaaaaagaacctcaacatgattcttgatcaatctaaagttagcacacacaattatggtttaggttttgattcttatgctcatcatactagatatcctcctactgttttgggtgttgctaggagaggtgaaattttgattgaaattgagcctaagaacactgtgtttaaatatgctggcatcatgtcttctttgaatgcatcttcttcgaaatcaaatgttgtgaatgcaaaaccttctgttgttgcaaaaccatcaatttaaaaaccatctacctcacaaacttgtcgtgagaagtacacttgttctttttgtggaaaagatggacatttggttggttttgttttagacttgcccataaacagaaaaaggaaagagaaattgcttttgcaaaacgacgttggcaaaaattgggttttaattcgaggaccacaattagaccgacactgaccagtcggtcagaccggctagcggtcaaactgcagatgaaccagtggtcagaccggttgccaggcccggtcagaccgtaggtacaatggcggtgagaccagcctcggggcaattttgtgcgaaattcaactcggacttttgtgaagcaaaaaaggtaagttttctggtaagtctgattctgattttgtaagtgcgtatgtacctattggttctacaggtcgtgtaactcagtgttggattccaaaatttcttatttctaaccccaacacggaggcctcgacatcttctcgttcgtaggtattttggcggcatactccccatgagtgttcaattttgagatgacgattgcttcacaaggtaacatcaatttaattttggattgacatatttttggttctactttcttaattattagcttttcatatgctagtgtttgaggtagtagtttttgttaatacaagtgtatacatgtcaattcatgagaatcttggtgatatcattggcaattggatgtctttttcaaaatatttgatttcttcttgatttttgttcggggagaatggaggttattttgagggggagttagtgctttttatgactttcttttggcatgatttgagggggagtttgtacctcatggttttatcaagcaaaaatatgacaatgaaaaaaattgataaaagagagctttgtttatacatatggtattttcttgtgcatgctagtaatactttaaaggtttatttgtctgtagcatagcttgtatgtattctagtctcttcatgagatttagattttgcttttaagggagatgatgcatgacacttaaattctatacttgaattaagcaaatatgcaatgttgatgctagcatatggtttgatttataaatgctttatatatatgctttattgacttgttattcctcaaatagctttaattgatcattgtgaaaaagagaataaaaatatcaaaaaaaatgaataccgaatccttggaaacagtcttgacgacaaggacgttttcgatgtgagcaaaataatgggtgccgaatccctggaaacagtcttgacgacagggacgtacccggaataaaaagagaaaaatatgagcaaaaaggctcaagaaaaagaaaaagttaaaaattctcttggttgttttgtgctaaaggttatttgagaaagagtgataaatgcaataggtatatgtgtttagtgtttattcttcaacctatgtgcttgtaaaattgttgcattataaatcgtatgaaatcatgaattttgattgttgattcaagcttaattgtaaaatctttggtttatggttatactttaatgcatgcttgttctattatagatgggttcatcttctttttgttgcaacacaagacttgatatgctatgtgtatgctaagctcttgaacattaatgaacataattcctatgcttgatgaaatcattgtcaaaagggggagaagtaatgtgaaaatttttggatttttggagaagcaaggtgaagcaaggtgaattttgagagttgttgagaagagcatgtttttggttcaattgggggaatttctttcttttggatttttgagcacgatgtgtacaattgagaatttctttcttttaaaaagggggagaagttttcttttggatttttgagcacgatgtgtacatttgtacgaagtgtgttttttaccacttttgtttttatttttccaaacatcaaaacattccttttgatgaggtttgccaatgtgttcatcaagagggaaattgtcagatcaaaagtgtgtttcgattcttattctgtgatgaacaattggcatctgtgattattggttttgatatttggagattatcatcgaagtggttttggagataatcaattttcaggtgatgatcggattcactgttattttatgtgaccggtccgaccgggtggtgtatgccggtcagaccggtggtgatcgagcggtcagaccggccgacgctgtgtcggtttcggtttcgggttgtttctttggatatccgtgattgtttcatggttatggcttctagatggatgccatacgtatgtaatactgttgtttgctaacaatgagtcaagttggtgatagcttgatctcgaaatatggtttctttgtttgtttcatgtgtaggtgactcgatgcctcgggagagtatttgcgatgatggaccgggagtcggcttggtggtaagacgatgtccgtggtggtcagatatcatgcgggatactaaggctagagttgatgcacgtggttggtgaagattccatatggcatacgatggaggtattgtgtgcgtatgggatacggagtcgaatttggaaggagtccaaatttggtacaattggttatgtaaagtttgtgtcttgtactagagggtttcctaaggtgtttaggactcttagtatgagtttggttcgtggctttaggctgcctacctcatgtataaatagagggggagcgtgaggctttccggtatcgtttttgtatcgcttttgagagcaattgagttgctagtttagttagggttttgagtttagtcgagatttttgtaaggagtgttgttagtgcactttgtaaatacagagagaaataataaagttgttatctactgtcacgcccagaaattctcgaatagaatttcaagcagaatgtgcattaaatccccgtccaggaccggccggggtacacaaacgacaatgttgacattcagatccacgtcttacaaacatcataaaagtcttacataaatgcagcggaaaacaaaagataactggagctaatccttgacttgaactgcagcgggaacaccactccacaggcatcctcgacggcacggacgaagcctactcctcggagaacccgccatcggacacaaactcgagctctgggattggggggaaaatagagcaaggctgagtactacccactgtactcagcaagtcataccagaatgggggtatgatgcacggattcaacaagggatagctaagcaggttcatttgcataaatactgg

SEQ ID NO: 2934 - DNA, 9193 bp, Oryza sativa
ccggccgacgtgggggagtgggggaggagagagaggcgggattcgaaaatcgaatcccggccatatcgggtgcgggcgcgagcgggagagagaggggagtgggtgcgggaaacgcggcgcacgcgtgggcgtggtcgacgtggcccgaaggaggcagagacgtgggcgcggcggcggttgcgagcgcggcggcgcgagcgagagcggcgggaggtgggggaaggacccgacaggtgggccccacctgtcggcgaccctggagaggagggcggcgggacggcctggctgggcctcggcctgcggccggcccagcagggaggggggaggaaaggagagaatgggccgacggcccattcgaaaaaaaagaggaaaaagagaggaaaaagaaaaagaaaaaggaaaaaggattttccctggaattaaaatattgcttgctcaattttaattggttaaaattatttctagagctctgaaaattccactaaaaatcctgttaatgaatttcgacatgtagaactcaagaaaaattccacatgtcaaatccgattattatttgcattaccttcttagggttttcttttgatttgcaccagcattttcttaggatcatttataaattaaattttaggcttgggaggagaacttcggggtgtgacaaacctaccccgcttaaacggaatctcggccccgagattcggaggagctggtgaagaggtgcggatgggcggctttcaactcatcttccctttcccaggttgtttcctcttctgaatgatgactccactgaactcggcaaaatcgggtgactttgtttctggttctcctttcactggtatcaagtatgcgaaccggcttctccacgtatgttaggtcctcctggatatcaatgtgttccgaatcagcctgttcttcaggtacccttaagcacttctttaattgggacacgtggaacacgtcatggatgccgatcatgttggatggaagttctaactgataagcaacttctccccttcgttccaaaattttgtatggtcccacgaagcgtggtgccaacttgcctttcgtctgaaaacggtgtactccccggagcggagtgacacgaagatacacggaatcccctgcttcaaaagtgagctcccttcggcggttatccgcgtagctcttctgtcgagactgggcaattctcaacctttccctgatgattctgactttctcttctgcttccgctaatacctctgttccgaacagttgacgctcgcctgtctgatcccagaagagaggtgtgcggcacttccggccgtataaagcttcaaacggtgccatctgtagactggtctggtagctgttgttgtacgagaattccgcatatggtaagcttttgtcccaagctccaccaaaatcaagagcgcaagctctcaacatatcttccaagatttgattgactcgctcggtctgaccatcagtttgcgggtgataggccgtgctgaaatttaaacgggtccccagttcttcctgtagcttctgccagaattttgaggtgaactgactccctcggtcagatacaatctttttgggtactccatgtaggcacatgattctcgaaaggtaaagctccgccaaccttttgcccgtatatgtggtatgtactggtatgaagtgagcaaccttagtgagtcgatccacgactacccagatcgaatcgtgacccgatgatgtccggggcagtcctgttataaagtccattccaatctcctcccatttccattccgggatttgaagaggttggagtaaacctgctggtctttggtgctctgccttcactcgctggcaaacatcgcagagtgcgacgaattcagctatttctctcctcatgctgacccaccaaaacttttctttgaggtcttgatacattttagtgctgcctggatgaatggagtactgggtctgatgagcctcggtgagtatcagatccttcagttccttgtcgtcaggtacacacaatctttctcccaaccagattgtgccatgctcatcttcgtggaaatcccgggcttttccgactctcatgttctttttcagctctgctatttcagaatcatttgcttgagctgctctgacttgatccacgagcgtaggccgtgcctccagagcggctacgaacccgtgttcaacaattcccacgttgagatgctcaaactcctgccgcaattcctcacacatgcccgcgatgcatagggcagtgcagtaacttttcctgcttaatgcgtctgccaccacattggctttacccgggtggtagtggatgctcatgtcatagtctttgattagttccaaccatcttcgttgtcggagatttaggtccggttgggtgaagatgtatttcagactcttatggtccatatatacttcgcagcggttgccaatcagatagtgcctccagatcttcaaagcatgaaccactgctgccaattccaagtcatgagttggataattcccttcgtgtggacgcaactgccgcgaggcatacgcaaccactctgccctcctacattaggacacatccaagtccgtgacaggatgcatcacaatagacttggaagtctttcatcgggtcgggcagaatcaaaactggtgcagatactagtttcttcttgagctcctcgaagctcttatcgcactcggttgtccatttaaacttctcatccttcttaagcaactgagtcatgggtcgggtgattctggagaaattttcgatgaatcagcggtaataacctgcaagtccaagaaaacttcgaatctgcgacacggtcttcggtggggtccatttggtaactgactccacgttcgatgggtcgactgccacaccctgagctgtaatgacatgacccagaaatttgacttccgtcaaccagaagtcacacttgctgaacttggcatatagctggtgctccttcaacttctcgagtaccagacggagatgttgttcatgttcttcttcggactttgaatagataagaatgtcgtcgatgaataccacaacaaacttgtccagaaattccatgaacactttgttcatcagattcatgaagaatgcgggtgcgttggtaagtccgaacgacataaccgtgcactcatatagcccgtaccgagtggtgaaggccgtcttcggaatatcctcttcccggattctcaactggtggtagcctgatcgcaggtctatcttagaaaacactttagctcctttcagttgatcaaacaaatcatcgattcgcggcaaaggatatttgttcttgattgtgacctcgttgagtgcgcgataatcaacgcacatcctcttcgtcttatcctttttctccacaaaaatgaccggagcaccccaaggtgaagtacttggtcgaatgtaccctttctgcagctgctcatcaacctgcttcttgacctctgctaattcgttggccgccattctgtacggtctcttgtaaattggagcggttcccggtgccaagtcaatccggaattcaatctctctcttgggtggcatggtagtgaggtcttcggggaacacttctggatactcgcagactatgggtatatcttccaatttcctcaagtttttctccacggtgtccactgggatttccgtctcaatctgattcaaagagaccccttgctttggtgagtctggtgatttgtacactaccgtttctcccttctcgttggtcaaggtgactgtgcgattcgcacaatcgatgactcccttaaacttggtcagccaatccatcccaagaatgacatctaggtctttggattcgagaagaatgaggttggctagaaatggtgatctttggatttctattagcactgaagggctaaaactgactgaggttgaactatttcccggggtatgaaccctcattggtgtgctaagctcttctttccttaacccatgcatcccgacaaatttctttgaaacgaaagaatgcgttgcaccggaatcaaaaagtactgttgcagggattgagttaacaggaaacgtacccagtacaacctctggtgctgcttgtgcctcctccgcagatgcgtggttgacacgagcctggataaaccttggcccagcacgcctaggcttcgggcatttgtcagcgaagtggccaagctcgccacagttgaagcaggaccctggttttgctccagtctccttcttggattgcgcgggcgggcctgactgtgccggtgccattggtgggcgtggagctgcaccgcggttggactgacctccatggtggttctgactgccactggcgccctggggaaagttgctagggttgaacgggcggtgctgacgaacgatcatggtggtaggtccaccctgctgcccaggagcgaagcgcggcctctggtgacttcccggaggtgccctgaactgtgcggccttcctcttcctgtccatcttgttgcgttgatcctcctggcggattgccttgtcaaccagcctctcaaagtcagcgtagtccccggatatcagttggttggtcagctcatcatccagacccgccatgaacttctcctgcttctcggcgtcggtgcggacatcctctggtgcatatcgcgcgaggcgattgaactcgtggaggtactctgtcacagtcctgttgccctgatggagtgcccggaattccctcttcttttgtgccacgaccccgtctggcacctgcgccttcctgaagctacagcagaactctgcccatgtgacttcagtacctggtgggcgggtggccatgtgattgtcccaccaagctgacgcgggaccctgaagctggtgtgtggcgaaagcgaccttctcctgatcattgcactgcaggagattcagcttcttctctatggcatggagccagtcattcgcctccatggggttggtggtgctggagaaggtgggtggtctgacgcgtaggaactcaggcaacttggactgagggggagggggaccaaactgctggtgctgctgttcgacgtgctgcatcatcctctggtgcatctgctggtgctgctgctgcatctgctgcatcatggctgccatcatctgagtctgatgtgccataacttgggcaagggtcggattctcgggaagtggtggcggaccattgccggaatcactgctggggtgcacaccgtcagcgcgttcttcgccgttgctgccctcgcctgttgcgcggctaccattcctggtgtagaccatctggagggaaaagcagacggggaaaagaagaaaaacagatgctcaggaactaagctttattacaaaggaattaaaactgcaattgttctgatctgaattaaaacacttaaagagcaagcaaaaatccttattaagacagccatatcataggcacatgatatcgaccgtcgactaaccccaaacaagcaacctaaacacacaaattaacaagcagaagctagacagtcgataaactaatggaaaacgagcctaatgctcggaacggctcctgcggtcggtggagtcgaaggcgtcctcctgctcgtcaccaggtccctctgagcgactcccggagcctggcagataagtctcgccactgcctgactctgagccactgggagtagcagacaaccaacctccattgccactggctggacccctggcggctgatgcgggagcgaaggagagagcggacgcgggagctggagctgcaggaactgccggagctgcgggcggaactggaggtgctgcgggagctgctgatggaggtgggttcctgggcgcaagctggatgcgcacgggtgccgtcgtcgtcttgcggggcgtagtgcggatccggactcctcctggcgctggaagaccctttagctgagcgttctccctcttcaggcgcgctatctcgtccttcagagcgacgatcctcatgagcttcccatcgttcaaggccttggtcgccttgtgcaggtccgagtgcatcctgtccaatcccctcatcacagcacacatgtgaccaaaggtggtgtcgttctcgctagctgtcggacggaaggagctgacgtcatcaccgttggctcgacgggggtggaagcggtacgccgtgtcgtggaagatgtagttgtggcgctcccgtagtctggccatcatcaagtaggctgcctcctgacaggcgtgatctgctgtgcctccagatgcctcgaccaccatgttagctaggcaggtacccacgtagccgtggacctccaagcgaacacggtgaggaagctcgccactgagcggtggaatcgtcgtgtactctggcgcgttggggtagcccaccaccagtgtcatgcgtgccaactctgccacaaagtcaatcatgccttctccgcggtggttgggtgggtggccggccatctagagaatacgaaggagtaggatcaatgcatgctcaaacccaaatttaaataaagcaataaaagactcaaacaagggaatcgaataagagcgaaatttttatgcatagatcattttgcatgagagcgaataaataagacagacccacataacgataaaataatgagaaattagatacatactaataataacaataagagcataaataccttgcaacccatgttcctgagctatgacctaatgcatttcacccatcaaatcccaactgactgacgaataaatcccaatagttttactaaaaccctagactgactcgttttgaagaatctcacttaaacgagcgaccaagatttttcccttgaaccacaagaacagatcccaattttcccggaacaaatccaattgcaaagaacatatgcaatgaaaaggattcagagggctcttaggtttttccatttggcttgtcctacggtcaaggtcggctctgataccaacttgtcacgcccagaaattcccgaatagaatttcaagcagaatgtgcattaaatccccgtccaggaccggccggggtacacaaacgacaatgttgacattcagatccacgtcttacaaacatcataaaagtcttacataaatgcagcggaaaacaaaagataactggagctaatccttgacttgaactgcagcgggaacaccactccacaggcatcctcgacggcacggacgaagcctactcctcggagaacccgccatcggacacaaactcgagctctgagattggggggaaaatagagcaaggctgagtactacccactgtactcagcaagtcataccggaatgggggtatgatgcacggattcaacaagggatagctaagcaggttcatttgcataaatactggcattaaaaacaggaattgaatgcgaaaacagttgtaataattaagcaatattaatcatccactgtccaacgctacaccacgttgcaacaggcccaaccatccacctataccatccaaattcattagactaaactaatgtgagtctaatcacggtgaatctggttgaccgcccgtaaccgcgggcacggctattcgaatagttttactctgatcagaggtgtacaactgtacccacaagacacagccccacgacacgtttccgtgcgccgacatgccaccacgacatcccggaaagaggccgtgacaggacccttcgcttaaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacgctacaagcccagccgttgcccacgctggcttgtggtaagtacgataagttcttccagggcatcccgcgaaccggtccttaactgccatgggtgcgaccagcaaaaccatgcacccacagcccaccatgtgattcattttatttaaccaacaccagagcggtggtactaatccaacattatcatataaacctatagtctaggttttaaatgagatttccccattgtgtgctagttgaactaagcatggctaagcaattcctagtccaaagtctaatcaagttataacccaagctaacaaaggagcatggtgtccaaaaagcatggctgtaacaaaaggtaaccatcccatagtataattgcaaaacaaatgcggtatttgaaagaaaacattaggacatttgcaatataggatcaatatgatcaagtgacaagcatgacttgccttgctctgctgctggaggaacctcggcgactatttcgaagtacaccggagcgtcggaagagccggaatctagcgacatacaaggcaaacattgcaaacaggctataagactactgaaacagggaacaaaaccatctttaatggattctacacatttttcttgatttactgagacttgattgggcttaaacggagctcggatgaattagttatgaattttagaagattcactgtgtttattactatagaagaaaaaccttaaatcatttattgcgcaatattccagggctgacgtcagcacggagggggtgcggcgccgacatgcgggcctcactggtcagcgactcaagggtggccggtctaccgtggaccgggaccacgcgggtgatccaccgccgatccacgggatcgacggcccggatcggcctggggccgatcggacggtgcggcggcggtcaggctaggctcggctcggcacaaagccggccgaccggtcacggcgacggcgcgcgcacgcgcacgcgcgttgccgacgacagcaaccgacggcggagacggcggcgcaaaggcggcgccgaagggcggtgatgctaaagcgacgactaacgggcggcggcgctaaagcggcggctaggagggagagggaggggaaaagaggggagggggtgcctcaccgagggtggccggcgcggaggaagacgatggcgaacagcgacggcaagccacgggaggacgacgtcggcgggcggacgagcttcggggtgccctaaggaaggagaagagagggattagagagagggagatggaccacggcgaccggaaaccatggccaaaggcggcggtggaggtggtgctcacccgagtgcgagggaacgagggctccggcgacgaacctcgacggaggagaggtggacggggtggatctcggccacgcgaacccgacggcggcgacggcgcggcctggcggc

SEQ ID NO: 2935 - DNA, 967 bp, Oryza sativa
aaaaaggaaaaaggattttccctggaattaaaatattgcttgctcaattttaattggttaaaattatttctagagctctgaaaattccactaaaaatcctgttaatgaatttcgacatgtagaactcaagaaaaattccacatgtcaaatccgattattatttgcattaccttcttagggttttcttttgatttgcaccagcattttcttaggatcatttataaattaaattttaggcttgggaggagaacttcggggtgtgacatctactttgagagttctttgatttgtgtttcatcaggtttcggcggtctaaccggcgacataccggcggtcggaccggcggcaggcggcggtcagtccgacggaggagaggcggtcagaccggcggcgacttcacatgcggcaggcaatcttcaggcggttggaccgatggatcaacaccggtcagaccggcggcacgagctcggtcagaccggcggatcaacctcggtcagaccgatctacatcgaatttgagggtaacttttatttccgctaaaagattgggttgggtatatcaaccattcaccccccctctggttggcttagttcttatgattcgatcctacagcatactcttctaatagtatgaccgtatacatcccaaggtgtggagagggtggaagttttaagaagatgagatatctttatagagagcgggtgaaaataagatacatggacacttccctcggccttttatgtgcccttcaggccggttactgctaccatatggcttcttctcttctcatgctttaatatatgatgagagtccttttctaccttcattaatatacagtcccatcaatgcttgatctttcaaaaacaaaaatgatgataagacacttctgttgtacccattatattttggcaaaattggttatatagcattaaaagttcacgttttttgttttatagcgcccaagctt

SEQ ID NO: 2936 - DNA, 18192 bp, Oryza sativa
cgatgctatataaccaattctgccttatattttcctctctttgagaggatcaaatttccatattactattataagatgatagtctacttttcctttttgaaaaagtgtttttttcctgtgtgattttgatgtagcgttgactgctttatgatgtagtcatctgccgttattcaaagatatctactacactcttatgcgcatgcacaatccaagtgctccatccgttttaggacatgaaatatgcacttgagttagccaacgcatagtttacttatccacatcccactgatcaatgaaataccctccttgttttcgactcatctagaattccatgtgatattttgttgctaggcaccgtaccaaaaaaaatattcatttttggttgaatagaagagagaaatagtgtaaaaggtcataaataccccttgcccttcaagtcagggtccacatctcccatctcctatctctctttctgctatctcttaggaaaccggtggcgcacgcgagctggccggcaaacgaaggtgtagttggcaacgcggcgctgtactgatccatcccttgccttcccgatcctgcttgaccttgctgccccaacgtggtccctcttatgaaatcaaagtgtgttttgattaatattttgtgataaacaattggcatataagataattggttttgatatttggaaatcatcggcgaagtggagctcactgactctgtggacctgtcagaccaggtggactaggctagtcagaccgacgtgtgttacacggttagaccggccaacccaatggtctgaccagtcaactctgtgtcggtgtcgattttgggttatttatttggatactcgtgcattaattattgtctctctagcaatgtttctttatactgtgcataatactgttgtttgttcaagttaagtcaagttgggaaagaacttatgctcggatatgatttcttgtttgagtgttgccggtgatagatcgagtctactttggagaatatgatgtctggacgatcagaatatcatgctggattcttaggctaaagaacaattcatgtgtttgatagagattccatgaggcatacgacagaacattgtatgcatatgggatgaggagtcaaatttggaaggagtccaaatttgggaagtttggaattcgaattgtgatgagataagtttgtttcttgtacagaaaggttttcttgttgattagaatttcttgtacaagttaaattcatggctttagactgcttacctcaggtataaatagagagggggttgagtcctcttggtattattttctgtgagttgagtttagggtaaagttagggttttgagtttagtcgaattgtgtgagaggtgtgcttttgttccactttgtaaacacgaatagaagtaataaaattcaatctacttttaagatatttcaatttgtgtttgatcgggtacaacggtcatatcggcgaattagcgacggtcagaccggtggcttcatgatggttagaccagcgatgtttcagcggttagactagtggtggtgacagacggctgtggcttgattgcgcgatcagactgatgcatccacaccggtcagaccgcaacatatgtactgttagaccggcgttgaacctttggtcagaccgatctccatcaaatctcgagggtaacttttattttcgctaaaagtttttagtttttggtgttgctaccatttaccctcctggtaggcttagttcttattgttcgaccatacacctctcaccgatcccatgctcgccatagctccacaacctcgtcaatttttcatcgctgtcgcggtctatggccacatctgcgtcctctttgtggctccggcctcgacccctcaccctctactgcggttccagatcgatccacctggtgtagaggccggccgccctccaagggctgcacatgctgtgaccccttggcgtggtagtctccatgttgctccttagattcgagggaaagggatcctaacggatttcatggtgatcactatcaccgacatcctagaaccagcagggaccgcttcttgtgggtgcagcgtggcccgcttgagaacaaccatggctcgacagctcagctgctatcacaggcacacatatggcaacctttgagaagttgtgctcgagatgaaacgaattggaagggggcattttagacatttcatggtgttctctctccttacatggctgaaatgaatgaaatagtagggggcagtgtctactatcaaatatccaatttaattagttttttttccaaacttgattttgcgatgttctacaaataatttcacaaagtgatgatgtcatctaacaaaatttgcctttttaagaaaatagcaatataataccctttattctttacacacctactctaacctttttcttcttgggactatatggttgttttcgctatttcggaaaggactcgatcatggttatcttggccatttccacgaaaactgacttactatatgaccccatgagttcggctcgaacaggacaaggctgctatggcgatgatatggagtgaacctctattattctccccaatctgctgaaactgggttgccgatagaagcattgtattcgacactagcttcgagactgaaaaacagtccatgcagaaggagttctgaactctgaagagtggctatatgaaacggctagtctttcagatcaagggtggatatatataggacacggatactgtgccttggtcattactattgcagagaattccttatgtgtattttatcagatttgagccactcatccaagaatggacgggaaagacaactcccaactgttgattcttcttcccaattttccacaacccaaaagaagagagaaagaaagggataaattgtgatttattttaaactgaaagaactatgcagtgcacgtaagtgcttcacaactagtattaatgcagaggatttgcatccctatattgtagtcttcagctcttccagttcattcccactgtccattgttagaagaagcaatgcaaacatcattcctgatgtctcctaaccctagatttggcttgtcctaacactcctgtatcattctcgtgattggtctcatactcttataacagcatcgtcctgtatatcttaaaggtgtggagggtggaagtaggagatcagagatctctccatagggagctgtcgaacaaaaaaataagatatatctgcacttctctcagccttttatttgccctttaggttgctgttaccagatggtttctcttctgatatactcctacttctgttaagaacaatgctttaattgatatgcgaacctatctctaccttcatttcattaatacagtcccaacaatgcttgatcttcccaaaataatgatgacagacaccttttgtataccaatattatttttatttcttttagaaggttgatttgcaatattactattgtataacataataatatgttttttttcctcttttaaaaagtatgtttctgtttctcaaaaaaagtatttttctgattgattttgagagagtgttgactgctctaagatatattcatctggggttaagttgttaaacatgcctactacaacgaattaggtcatgaaaaatactccatgtatccgaaaatatagctaccttagtagtgcgaatttccaaacgtggttctaaaacgtagctacattttagaatggaggggatagtttaccagaaatttgtgaaagtaaattagcaggcctaggcccgcaagaggcagaaaaagaagttgaagagaaagactacttttgactcctacggtttatggatactcttttgtgcacgctctgtccatatgctctgttttaggatgtgaaatacttgtgttatcaaaaacgtattttacttatcttctccttgtttcggactcagctataattctgtgtaacataaagatctccatcgagagtttgctatacccacatgtgagaattgtaaggtcgtgacatgagatctgcacacgatgcattgtgatgcacatgtgtatggtgacatggggtttatctgttgacaaaatattttggtatggagcacacatgaactacgaaatgataaaccgtccctacatattccttttttaagataatagaagtttttattaaactcggtcaattagcccacatagtgtcgtaatacttctactgtaatttattgaattggtgatctacgtacattaggttgtcagttatgtatatatggttgttaacacatggaaattcgactgttttcttgttctggtcaagatatttttagcaccttatcataacaaatattgtgtgaaccactcaacttctttgcgctagttgaccagcgaagtcaagccagatcatagagcaaatgcagcaatcaaagactaggttaaaaaatactaaatctgaagatgctacagaaaagaaatacgtggagcatcagtcctagaggtttttgttcctatgcagagcacatgcatcatttcaccttcaacactgagatccatccatggtagcggagcactgaaccctataggtcttgcaatcagggtttgaaatttcgtttcaaaatttccgaaatttcgcccccccaaccagcaagcttatatctcgcctgaattttgggtttttttttccaaatttttatgaatctggtcaaattttattcaaattcattcaaaatcagttaaaatttcaaataatttcggccaaaaaagttcaaaatttccgaaatttcggtctcgccccccccccccccccccaaagcagaaatagcaatttcgagatttaaaaccctgcttgcaatgaagagattttcgactggacatgcctacgttttcagctcttctgttgtgctctgatcatcccaggtcaaacgatgcagcgctagaatcattccggatatctcctaaccctagatatgtagatttgtctgtagagtacgtatagaaggttttaagaaaatgagatatatcctcatctccatggagagctagcttttgaaactaagatacacacgcagacacgctcttctcaacctttaatgtgttacagagtgattcttcatttcatactctttaatatatgagaacatatctctaccttcattaataccagcaatgcctatcttccaaaaaaaatgctgctggacacgttttacgtgtttgttttcattttgagaatatcaatttctgttgtaatatgatactgtactctttattttttagatgtgttttttagggataaagaatattgattgctttgtgaataataatctgaggccaggcaaaagggctttaagaaaataactacaaacaaatatattttaaataatagatagaaatccgacttctaattactagtacaaagcaaatttgactagggaccaaccaatgacagcgtttgaaacaataaaatagagaggaaagatttctcgatcttcacacacacgtttcccgagccactgaacgtcttttgaaaaaaataggagagttttttaataaattatattaatctatttttaaatttaaaataattaactcttaattaatcatatgtcaatggttcatctcgttttacttttgggagttttgaacctcaccggtttgtttatgtacactaaaatccacacgatagaaaggaggaagtttccagtatctcacccttataaactgcaaccaatacaacgaggataatttcattcttgtccttactttcatgtttatttttggttttgccctgttttttttcatttttacctttgttttttctaaaggaagccaaattatgcctctactttggataaacaggccaacgatgtcaaagttattggtgaaaggacatctatatccttacttccggttgcacaattatctctctacttttttcattaattgtgttttttcctccatgtcgtacatgcatattgcaatttgatttttacgacgatgtttaaaattaaatgatttttgactaactttaatgaatataacaattttgatagaatatcaataaaattttgtgacaaatttgacacgattttgtcacaggtttgatatcattttgacataatttggacagaattttgacagcattttcacatctttttacgcaactagcagttgtcacagctcttcctgtgcaacctgctcgctaccgagccaagccattagccgcagggtcaccgccatggcaacctgtacagttcattgccatgatggccaggtccccgtcgcctcgccgggtggctaatcaccgcggcaacatgtggcggattagaactatccctcgtcgaaagatagaatgctagcttcattcctgatggctcctattcctaactggagttggctttattcactactagagattactcatcttttatctagtgccccagatcataaaaatatcggatgtatcaataaccggtactaaaaactctttaataccggttctaaaaacccaagtcccaaaaaatatctaaagatcaccggttggtgaccgggactaaagattgtcccagttcgtgttatcaaccgacactaaaaatgtatttttagtatcggttggtgttaccaatcggtgctaaaaatgtctctagtgttagtttaaaaagaatgcatcactatccatccaagttagatgtgtgtagtaggtgtgatggtagcacgtgtaagggttgtggtgagagattttgagtttaaatcccctcacatcccacattttttttacttagtatataaatttagtaccggtttcttcaaccggtacttaaaaaaaatcaagtactctcgattccctacatcaaacattaataggggttgagaaccgatacatgagatcatatctgtccaagtgatcattgtcatgatttgtcgtatacacacttataatataggttgtgtatatatacctttaaggtttggaggttggtagtttgaaaaaaaaaataagatctccatgcatagagacctaatgaaaataagatatatggacactcttctcagacttttatatgtcctctatgttgttgttattacggaagacttctttgtcttctcgtacttgaaactttttatgggtgcattaaagaattcaaaattttaagatatcattttagaagtgatgagtaaagaaaattaattaacaacgtggttttgtgaaactcaagttccataatactaatacacaaggtcatgtgcaatataggactataatatctgggttacatgaaattcactctgtattttacataaattctagtaattcttttttcttgtttgtttacaaactttcgttatccaaattttcctcttggaccatatagttgtttttggctatttcgaaaaggatcgaagcacggtaatcttagccatttccaagaaaactgacttgcgtacttgatatactttgacggattcagctcgaacaacacaaggctgtaacagcgatgacatagaacgagcctatgtttctatccaccattctgctacaacttcaattccagatagcagcattgtacgtagttgacgacacttcgacgtgtgtctttcatattcttctttttatttgtagtggatgtcttacatggctaaaacctatacatgtttggcacaagcgctatcgatcttggctatgtataccaatttacagaataaagaccgaatttctatctattattagaaaaacaaatgacaccgatttcgtgaacggagaactagggcaattggcacagctgaaactgattacacagtatgtgccaattgccgttcttcagttctccgtttacacatattctcatgcagctgaaactaatttacacaggatggcaatatacacaggatgtgttagctgtatgatcatctcgatcgcatacctaattagtagtaggatggagtattcagttagcattcgactctgattcgaccacttcaacgggaacacatagatacataaccactacctgtagagcacaactgcttctgaaattgtatccactaacctaccttttttgtatatatagaatacctacagaatacttgtgtacggccaggtacatcacagaatgtcaggatcacgcctaccaaactgtggttatgcacaataacagcagatgcaggcatgcagctggagtgagtcataaaaaaataattaaaaaaacttcattgaacataaacatatatactcaacaacaccttgctattattatcagaagattcttttataatgtgctcataaaaataaaacccgggtatctacaaaattcattttttttaagtagagtgtaatatttagagatgctcccaataggattagtttcgttacgttgtatagacttgtagctttatcaccatggttcttaaaatgaaacgataaccgctcgattatcgtaattactccctccgtcccaaaaaaagataaaccctgagtttccgtgtccaatgtttgaccgtccgtcttatttaaaaaaattatgaaaaaaattaaaaagacaagtcacgcataaagtattaataatgttttatcatgtaacaacaatgaaaatactaattataaaaaaatttcatataatacggatagtcaaacgttggacacggaaactcagggtttgtcttttttttagacagagggagtatgccggttcatatacggtaactgttcaataaacatgctagctagctaagatttttttaaaaaactcagaataaacctgaagtttctgtcgataaccactctgttactgcaatattcaactagtagtgctaaccaaattatcaacccatgttaatttaccttgagaactatggggcggttagttagctgcaagctatctatgtgcttattgtggacacggtgatgcgcagggaatgatctgcctacatattcttgttcatactgtcacaaaataccattaggccccatttggatccctggaatttcgaggaatggatttcttttctattcctaatagagttaaacaaaacatggcagtcaaaccgataaagcgtctttgatagaatctgtagtttataaggcaaacatgtttaatctagaccattttttagggaaaatctagaccaattttggtattgtaattcacttggttttgcaactccattttaactctcttttaatttactttgaattcccaagcactcgtggagggttgatttgttgaggctaagatcccaatacctctcaatcctataaactgcactcacagaaggtatctttgcatgagtcctactggggtaggtatctgatcaagcaaatgcctatacaagagtttggcctgaacatcatggccatatatatggggattggatgctagcagccacagcaacaaaggtggcactcacagtacaaagagttcaataacaagccaatatattaacataccattgcagtgtgtcaatgttttctttccattgatatttgattctcgtattcttttgtcagccttttattgaatgcccatgtggcattttgagacaaccttcatgtggaagttaattcttacttatgcattctcatttagagaaagtttaatacaataggctaggctgtgttctttattttcccctctttctcaactcacttccctcgttttccgcgcatacacttttcaaactgttaaacggtgtatttttggtaaaagttttctatatgaaagttgcttttaaaaaaatcatattaatctctttttcaagttttttaggctaatacttaattaatctcactataattgcgtgctttattttccgtgttaggaggtaaggttcccaaccttgcctcccgaatacaacctaaaagtacatgccaagtcatctgaagataactccatatatagatgtaatatacaataagtagttcctaacccaacaaacaggatatgcgatttattattaatatatttctcagctaattttctctcggcctcttctatcccttcttcctttacaacattgtccatcaaaaactcaccacccaaagtaccccagcttgcttgccaatcaccaccagcaatgtaagtacttctcaaaccggccatcgaacttgagcaaactggccgtcgaacttacaacgtttgggcggatggaggctctcttctgatcactgttcaacgaaacaagagtatagttggggctaagttcccgatacctcttaatcctataaattgtaccatcaccatgcaattgcagttgatagctagatgactatgcaaatgcttttgcaagagtttggcctgaacatcttggatatatatataggagctgggtgcgttgtcatcacaacaagtacgaagagttcaatttaggaacctacagtagccataggtgtcaaattaagctggctttgaatttgtcatttgattattttggtatataatttgatagcttttttaatttttgaattaatccgtgtgtgcatgtatggcattttgagacaatattcacatggaagttaattcttacgtatgcattctcacttagaggcagagcaagttcagctataacaataagcaaaaatcgtctgaagataaagaagaaatataatttacaaatatatttatcagctaattatatctaatagatgcatatatataatgacatgcatgtacctatgctgccaatgcctgtgaggtcagtgcacagatatctagtactatataggaaagttgttctagaaaatcagattaatctatcttataattttttattaacacttaattaatcatatgctaataagctaccttgtttttcatacaggaaaaatgggttacgaacccacatgttcgagcacgacctatcttcatacgcccattctaactgactctggagcagcgcatggcagctaacttgtggcccgtacactgctcctgagaattgtgaggtcttgacatgaaatttgttgaagcaaagaccgagtttacccattatctttaaaaagttaaaatataaatggtacgttgtgatgcttatgtatataaagacatgcagtttaatttatgtgtaggcaagcaattgtgttcattggataaaaatgtgagttacacaatgatcagcaccctgcattcctggaaacactgcatagtgttgcaataccactagtgtaatttgccaaattggcatgatcaatgtcaggtcacaatttggaagcttaagatgccgcttaagattaagatcttcatgtggtacttacttaaaggggttatgttaacaaagacaatttagcaagacggaattagaatggtagtttaagatgttgtttttgtatgaaaaatgagaatattcaacatcttttcatagattgccattatgcaaagtttatatggagaggaatacaatattcttttggtctatgcccttctagtagtatatcacatatttttgatggttggcttttgggggtggacaagaaaaggagtaagcttatacttgtgggagcctctgcaatatgttcgactctgtggttgagcaggaatgatttggtttttgacaaatcaccatctattacatatatgcagggaattttcagggcaacatattggctccggtgttgggcttagctacaaaggtgtgatgaagatgacaagtttatgaaggttgcatgccgtaggcttgagacgacagttatgcaactttttgccaattatggttggagattcacaaatagacttcaataacatgttctccttattttagatgggttattttttatttaaagtgtgtgttctcaatgttttgttgaactacactatttttttagtgtaacttgtaataattggctgtagctcgttttgagcaaagaccgggatattttattccattatctaaaaaaatttatccccgcaaaaaaaatgtcaggtcacttgtggcaccatgaggtcaccctagctcatcactacacttgctgatccgagtgccccacaactacaagccagtaaaattggagaagattggtgacttggtgacagatgaccatggttttcaattttgattttgtcctaaattttgctcattttggttctcccgaaagttcagaattttcggcatattttggatcgaccttttttgaaattttagcataatttagctgaatttgactaaattttgaccaaatttgtaaaagattgagaaaaaccaaaatttttagccgagataatcacttgctagggggtccgaaattttgaaccgaaaacgcaatccctggagacgacctataatggtggaaatcggtcgagagaacgatttgcacaacagggttaccgaaaagcagtggacaaaaggaataaattgtgatttattttaaactgaacacaaattactaccaacaaaaccaagcgtttgagcataggagagcatcacaactactaatgcagatgatctgtgtgcctatgtgccatatttagctcttcaattgtattcacaccgtccaatatcagaagatgcaatgatagaatcattctatatgtctcctaaccctaataaaagctagtaaaactggagaagatttgtggcttttggtacgggtgaccttgaactgtggagaacggtcaatagaaaaacttgctcaacgaggttaccatgtgaatatcgttttatcttcttttgtgtgtttgctgctcctgtaaaggacttcttttaagtctcttctcctaatatgaaatggcagagctcctgcccgtttcctcgaaaaaaaatgatggttaacagaaaccaaggacttgagcataggattgcatcaaaactactaatgcagatgatctgtgtgcctacattgtcatgtgtagctcttcatttgtatccgcaccatctcatgtcagaaaatggaatactggcatcattccagatgtctcctaaccctatttagcttgtcatagcacttgtttgtcattctcattattggtcgcttattttcttataacagtatatggttgtcttaaggtgtggtgtggagggtgcaagcttttacaatatgagacattttgatgaaaataagatacatgcacactcttatcactcttttatgtgcccttcaagttttgcggtttccacccgatggtttcctctcttctaatgctttaatattaaaacctatctgtaccttcattaatacagtctgagcaatgcttcttgatcttccaaaaacaatgatgataggcacctttcttgtaccatttttttctttttgagattgttggttttcaatattactaataagatgataatatacttttcttcttttaaaaatatcttctctgaccgattctgaaagagtgttgactgctctgtgataatgtggtgttaaggtctctaagatacctacgataaaccacaactcgtgagttacaaggaacaatgcctaaagtctaattgagcttcctgagatagagcaaggagaaggaaggaaatagatcttcttctcgtagggtcgtaaaggggaaatagatcctctaacttactgccttcttataggattgtaaagggctttctcaccccaaaagctagctaatgaggtaagggactcccccctaataatattagatccattgcctcccacaatctatgggactatttaacaatctcccccttcacacattggtctctctcagtcgttcaccgccctttcaccgtacacgacggtccctcaggtatacaggccccgtaggcacccactgtctaacaagccttcatacactttgtccctcggattagagatgttgaactagccaggctttgataccaattatagtatcgtcaagagcctttctcacctcaaaagctagctaatgagatgaagagcttctccacttatatattaggtctcttatccttccacaattaatgtgggattattcaacacttctgactctaagtagctaacatatgagctccatagctcgttgatctacatgtcagcgacccatgtttgagaacaataggtcagatgagcctcatctgagaaggaaggttgtgtgctttagttaataccggctgattgagagatggaacaacgagagtgaattctctgacaaattggtgccaaaattttgagttccgtcaaacaaacttcagaaactacggttccgtgttgctctttataaaagcctttgttctttacacacaccttgtcgcctcctggacaaagtacatatggctgttttggctatttcgaaattactaaagcatggctatttttatcatttccacgaaaactaacttactaggtaccccttcatttcaaaatattgcaagcatttgattagatgagacctaatttagtactaaaaatcttaacatagatttgtttaaatttttaatattatgttgtgtctaatccattaatagcttacattttgaaaattcaatcggtttgaaaacgagacacagttgtgcttaattaggatggtaattaaaaggcctgatattttatcctacaaaatttaagggtagagtttaatatagggtgagctgactaggctgtggcggcgatgacacggaaagacacagctgtttgtgtgccaaattttttttatatacggacacacatttacattacagtattaaatatagactaataataaaataaattatagatttcgctggtaaactgcgagacgaaactattaagcctaattaatccgtcattagaaaatatttactgtaacaccacattgtcaaatcatggtgtaattaggcttaaaagattcgtctcgtaatttacatgaaaactgtggaattggtttttttccatatttaatgcttcatgtatgtgtccaaatatttgatgtaatggaaaagttgaaagtttgaaaaagaaagtttaaatctaaacacggcctgggtttattcccggagaagcattctactattcatcactagcttcgacgtctgtctttcatcttcccttttttagttgtacatcagacagatcagtggatgtcttccaggtttaaaagttaagtagtacgtgtttggctcaaacgccatcgattttgtcaaccaagatgacgtgctgcttcgacgacattagtttatcagaagatttagagaacgaaagaatggcaattggatttgcactgcttataaactaatcaatctcatgatgtgtaatctgtaggctcatctatcgcatattttattccaggtggtattttttactccagttctgccattacatgagatgcgataaaacctcggcaagaacagttggataaccgaaaactgcagaacacaattgcctccgaaactgcaatttacagattttacagtagtagtgaactgtcaggtacttgttccgttcaagaataaatgtagggatttcaagatttctatattttttgagtaaatatgaatgaaagttaaataagcatttgtaaattgtttagtaaatatgaaggttaaaccaaaagatttttttatgtcacttcagctgttaaaatttgaattttaaattgcttatattccttttctaagcatctgatcagttttagaatcatttgataagaatccataagccataaggaatctctatatcacgtacaaatttaaatcctacaaatccttatgttaacagagggaatatacatcacataggaatctctatattacgtacaaatttaaacccttatgttaacagagggagtatacatcacatgatcacaccaatcgaactgttgttatggacaatagcagcagatgcagagatgctgctggtgccaattcatttaaaaaagataaacacctttcattagaaaaaggaaagaacaaaaaaatatatatactcagccaacaacactctccagccatcaccacctcacataagtcacattagcaacacttgctgtggtgatcatatggttgggagcttgggggcagtagtaggagctacaagcaaaagctatacatatgtgtacattacaatgccccggttttctatcagcgccagattagtctcacgcccatgaaaaacagggcatgttgttgtgatatgagccaaaagctgctactactactctgtatgcgttgttgtgcaactatcttcaaacccatggcctctggttttcaggcccagattgcaagggatgacatggagagagcgccgaggaacagtgcaatgtatgccatcacctgctgccgtgtcgatcctgtcattttcccgccaaggaagtccgcggcgatgagatcaaccagcgacatgtatattaggatgccggccgacacggagtcgaggatgccctccaccactagagcccgtgggctattggcgttgtagaatgacgccacaccggcaccagctgcgatcccagctggtgttgtgatggcgaagaaacatgccattatagctgctgatagtgtcttgaattgtgcctgtggtcagaagatttgttagtgtgtaactaagttatactgatgagaaaggttttagaaccactaagatcatcaagaaaaataacaatgaagcaaaagtataaaaaaggtgctgtactcagcagatagacatctcacttaattttctgatagtacccacttgaatattattggcaaagtagttggccgttatgagaagcatagcagtctaatcaatttatttgcattgaccaattaagttttaagagaaaaaaattataatcccaaactattcataatattgaactcaaatggttcaattgtcatacatcaatacctttcaacttcgagagtattacaaagtggacaaatacaacaagaataatatttctgggaatatcaaagtccgattagggtcagaactcctgctgtcaacatcatggcatgctgccaacaattacgctattatgccggagataatattgattttccccacgaattaaaattctaaaaataaaagttcaacttcttacggttgctatggagagtgacagccaatttgaagcttggagacttagattacctagactacgagacatatagtcgtatggtaataccagagggacctaatagtaccaactaatttgtgaaccagattttttttatagcaaaattccaatcacaaatggtggtagtgaaaataacaggatagctaactgcctcaaacaaattcactgttctagaagccacattttatacatcatgaaagatgatttgctcagatggaaaatgacgtctatgtaaaagcctgcatccatactatcaactctatgttcgtcttaaggcttgcaagttgaatgtcccatgataactttttaaataaaaaggttaatcatttaacagtaaataccatctggacagaggtcaacttgctagtaaaaatatagttgttgcacaataattacaacaaactttaacaagatgagcatacgacatctgaatccaaatgtcacgccttcccgaaattcaaataggtggaccccatgtgccaaaaggccaatgccatatacatacaacaaacaaacaatcaaacaatccctgacaacaagaacataacatatagtcacatgtaaaattgttatgtataaactatactcaattggatttaccacggttaagcatcaattaaataatttcatcaatagaggaaaatatgtaaataatgagaattgatgcatgacgttctgctgaatttcctcacctgagcaatgcatccgccaagcgcgaacccctcaaagaactggtggaacgagagcgccgccaccaacggcctgatcgtgcaggggctccgtgacaccccgagcgacaatccgatgatcaccgagtgcgacacgatccccatctcaagtatctgcaagaaacaaattcatcagacatcatgcattgcgccaaaaaagcattaatgaactcagcctccaattcagagaacagatgaaacacctgcgacaccacgacggaccgcacttgcgccggcacctccccctcaccgccactgccctccggttgcgccaactcgtggccatgcccatgcccatgggggtggctgtgtgagtgcgagtgaggttgcagcagcggcgccttgttgtcgttgtcgtcctcggtgacggtgaccacggtgatgtcatcgtcgctagccgaggaggcggcgagcgcggcggcggcggcggccttgacgcgttccgtctcggccctgtgcttgccctcgtacaacctggtggcgaggaagtcgagcacgagtcggggcgagcgcggcgg

SEQ ID NO: 2937 - DNA, 1659 bp, Oryza sativa
gggggggacatgtgggaagcaaatgtcgacatagtgtggtgagagagaagggacggtgatctgatctgattgggttgggtggtactttccgtgtacgcgcgggcgtggttgctgggcccactttggtttgggcttttctgtgtgtagcggctcctgttttacggcccatggagttggagtcgtgctcccccccgtgaattagtgggccaccttggtaacaacattttgtggttgttctgccgttaaccccgccaccaactcaattttttttctttaggccttattcggttacgctttgatttaatctagaccaagaatgataaatatagtaagaaatttataatagatacaatgagaggtcgggatttattccggaccagaaaccaatttacttatgatagggacaataagagaccgtgattagttccacacctcttgaccagttgattgattcccggtctcttattgtccctattataaataaattagttccctgcccagaataaatctcggtctcccattgtatttatcgtaaatttcttactatacttgtcatttccggtccgaattaaatataagcgtaaccgaacaaggtgttaaggaaaaataatatgtgaggctgatccacgtaccaatgattcatggtatgagattaaagggtccacatgtcaataactaatatatacagcaattaagatacagtaataatatgttaatgataattttttttgcaacgtacgagcaatatgctattaactagtaaaggcatccaatatttcaacgtcaaacaaagtcacagatcaaatgacgataaaaaaagtcacagatcaaacttttttttccaatcaattgcataagtatctatcctatgtactacatctagcatttgaaccctccatatataaccgtattatcacctttggcacctagccatttgtccgccatttctcttcttttgacaaaatgatattgtttacatacacacaagagaaaataatatgtatgattgcgctcatctttacacgcattcgctgaatggaaagattcatacacttatgactaattctaaagttctaaaaaaaatactaattctaacacctaaattaatggaacataacaaagacattgtggccattataagttttatactctgccatggtgagctacgactaaacaaaatgacattacacatgttttattttttgctaattgtaaaacaaaattaaataggggtttgaaacaaacaagcatgtccaaaaggattaagtgtatttattttaccctcaactcttgctcctgattaaatcgtctcccttaatattttcatccaatgtggtgttgggacccacaagttaatcctcccttgctcacccttacctcttctctccctaccctccctggtctccctttcttctccatgggggactaattgacagagaccgacgaggaagcatagggtggcgaccgtcggtggatgatggagacatacgaggcagcctcggagagcatgaagatcagcgacatccaatgctagttggaaaagcagtttgcgagcgatagctccatcacgaaccagagagcgacaaaccccacagggggaggacgcggacatggcagtgagcggaagcgccagtacgcgcatgaggctagcgagcccca

SEQ ID NO: 2938 - DNA, 1770 bp, Oryza sativa
agctctcctccaatggaagctccaggcgtcgaagacgctctgctgcctctttctgccttcgcctacatttgtgagagaagaaggggagagaaagatagaaagagaggaggagggagatagaagagaggaggttagggagaagaggagatgggacgaaaatcgctaatatgtgtatcccacgtgctgacttagcaagtcaatcgtagttaaactgccacattagcagaaaatcgcttctaaaacatcaaaggagtagatttgcactggaggcgttatatcctggttttgccattaaggggggcagttcagccaggggcaatacgtcatggaggtaaaatagacttattcatgtccaaataaaattgagggctggagagattcctcagtaaataggcccattatctcatacaactagctgatctggactaaataggcccattctcttgacagcccaaaaatgcttttccttctgtttcgagatacttttgggcttactccggaggccctgatgatttgggctaatccaagagtacgaagaatatctactgctgtactgtctgcagcaaagaacaataggatactacggtgccaaataatgttgaccgattagggctcctctagaacgcctaaattttatacgattttcatcgaaatgaatctgattcccgtaagtcctttgaaaattggaatttcattcgttccatgcaaggccttaccctggtttctacctaattaagcatctgattattactagtagtattagcctaaccaagtcttattgagactattacacgcttgcatgcatgtcacaggctcacatctccggcttcagattcatgcagtgataagcaaattgaactttttaaattaattattgcttgctgaaagatcaaagatgcgtgtacgttgggtatctgacgaggtaggcaggcaggcaggcaggcaggcaggcaaggggtggctggctaatttgcttgatgcttagctacgcgtgcagatatttctcatccttaatttaattacttggcaaaggcacctcataaaaaggttaatttgcgtgtaaaccgctcttaattagcaggaaattcacaaagcttttgcgtatatacttgacttagctttagctaagatcatgactgtttgcttttgggtgacgtacacaccaacaccgtcacccaccccttcactctactttaatatcttatctccctctcactaacatatagtccactccaattatacattttttttcttacatacacgagcactttgcacatacatgtgtatacatcattaattatatatggtttgtatatattgcagatataattaattaattacaagaggtttatgaaaaatcaagattcattaagctggaaaaaagggatggtatatatgttatttatacatgaaagataatgaccaaaaatacttacagggtaattaaagtgcagtaacaagcgagcaaacaagagaatttgctactacagaggagatgaattaacagctgtaataaaaggaaaaaaagtattaattacatttagatccagacatttctgtcaaggccctccactttaactaaccttctcatcccagtccacccctctcggctcagtacactaccaagctgtgttgttattcaccgatgtatttttgcagccaaccccctctccttgactgaaattacgtacgtaacgtgggctgtgtatctactcaactacatggacaggattgagctagcggcggcggcggcggcggccatggccggcg

SEQ ID NO: 2939 - DNA, 6346 bp, Oryza sativa
ggcgcctgggagctgcacgagccagccatcacctcctcctccatctcctcatcttccccatccacctccactagttcttgcgctcgttggagccgtcgtctccaggaagccgcccttctctctgcggggcctcgcccttctccccccaccactcctttgcccccaccaccgccggagggatgggcccctcgctcttcggtgagccggcgcggctgcgaaaagggttagggatctgtccgccgccctccatccccgcgccgccgccctgtggccttgcgcgcgcgcgagagagggggggggggagagatgcggtatgataggtgggtcccacacttgtttttataaatatagagctgacgtacgccacgtaggacaaaaccacttcggattaggttgaggggggtaattcgtccgttatcaaaagtttagggtgagcaatgcccggttttatggttcggggggtaatttagacgaccgcgatagttcggggggggggggtaattcatactttttccttacatatatgtcatggtatatacccctaagatataccatctggaaattttaaatagacggtatatgtagttatgtagtacatactacttagacaaaaaggaggggaggaagcgcaagagcatgcatgcggggtacgcatgctacgaacacagaggcatcttttgcataggagcaagttcgtcttttccataaatctttataattatgactgtctccaaaagaatactcttatttctcatacgtgcagctagtattaccacgccgtcacgtgataaattagtctcgttgtgaacttgcattatatgcattatataggctaatttactgcaaatatatgcttgtataggctaatttactacaatttcaaaaatgggccttttttaagataacagaatataaatgtctaaactctgcacaatttcgaatggggcttgaaatgtggcctgtcgaatcacgggaaactatttaaaacctatgtttttttaactcaaattaatactgccgaattctaactattgaagccgatcgacaacattaagtcggatagatcgatgcatgggcggatataagagtagggctaattaaagctctactcctaaacccaaataccaattgaaaatacacttcaaaattaaaagaaaagatatagaaaatgaaaaacaaacttacgtaaactctacaagtatccaattctactcttaattaattattctgtctctgccatcgatcgatgatcaataaccgtgaatatctcagggggttactttatgtgaatttccctagctcacggttagcaaccaagaaatctggatttccccgactcatggttagtagccagaaaatctaaatttctacttgaggggtggccgtcaaaatatattgcgtgctttggcggtttacatgccatctttagcagtttttgagcgtcaaaaaattatgtattcttctagcgttggcattgaaggaatctccatctaccgctgtacgtacatcgcatgtgcagatgatgtgcatatgacacggctagcttggtggcagtttctctctctctctgcctgcagtcagaccaatcattgccgccacgtacgtactccgactctagctgcagcagctggggtacgtcgtcttcttccttcgtcctttattttaagctgcaatgggggtcttcttctagcttcgtctcgatccgtgggcagcggcgaatgtgcagagtaaatagcatctcgactcgggattccgtcgtgacatgagtaatcgccgccgctcgcgcctggatgctagctacacgcccctgcactgcacgtgcatcaccatggtcactcgcgatagatcgtacgcgcggctgcctcgatctacccttcaattttcaccacaagatgcagttcttttcactatcagaaaaaaaaatcatttttataacatttcctgttcatttttacctgccgacaaaatatactgcgtggacatattttttgccactgctcgtttgtaaagaaaattttctaggcggtcacctgcgaatataactttgtttttatggttagacggccctctcgacggttcatttgtaaaaatctgatttttaaaagtaaaccgttaagatggtcgtttgaaaaattttacaccatcgactactgtaaaaaaaaaaagaactcccatcaatatttatcctctcctctaccagactattactatcactcattatttatccttatcatctctctctccttctccatctctcaccaatcaccagagcgatgccgcgcatgcataagagttcatcaccgtcctcttgccactctccttacacagaagcagccacagaacgacgactcagagagaagagggcggcggtttggtgacgaggaggacccccaacaactttgtagatctggcaaccaagtgcttaacgatggagacggcaaccacggtaagagcggggtggcgaggggaggtgtggggcgacaatggtgaacgagggcaggagctcgggagcagcagcaacgaccttgaccgtgacttgatgacacactgctacgacaacgacgatgcccatcaaatgttgtttatttgcttgttgatattgaactacttgtagatgtttgtttgcatgtcaatgtagtgtatatgatgttgatttgagtatgataatagtggatctaatatggatttgaatatatatgatacttgcatgttgtgaaaatcaatttttttcctttttttttcttcgatcaaaaccctttttgtatgtgggtgacttaattttcacaggcgggtctttagagtgccttcttgagaaaatcgatttttctagacgggcgaaggcctacctgtgaaaattgtcgatttttagatgcctttgatcgcacacggagtatctagccgtctgtacaaatatgttttgtagtagtatttcttaattttcgacacattttaatattggaattacaccaaagactcacatggatatacaccatcaagcacaaaaatgtataccccatccataaatataatcatttctatgagtttttggggaagttaaggttgtgatgaaattactttgatacctgtggtggattcccctatcgggtaggatggggagtagttgaaaaatattaataaatatttatatttgtaggtaaatgctaatatttgtggatggatatatagaatatagaactcgcaagtacagctcttcccattaacgtgtgcttaaaagatggagggtagaacaataaattaatttgaccttgttgaatccttactgggtactcgactgaacttcatcaccataacaaagatgcctcccctctttacaatttttggttcatttggaaggcagaaactttaagtttcggactatttttatgcctctcggaaattcttttatgtgagataaattaaatgatttgccataaattatctacaaacaaaaaaaagtcctctacactaaacttggcatgcatttgctgttatagcacaacactcatggtaatcgctcagttatctatttcgtcgacaccaatttacttgtttttcttaaacaacctctacaagatagtgcaaacttattatcattttctttttcttaatgataccttcttctccatcattgcctgcctcctgatcatccctcatgaatcttccaagaaaaaagatagaggaattggatgatcatgcccaaaattaaagctagttggcacttagcacctcatatggtaagtagtttcttcactaccttagctgctgttcctcttttgatcccctggctgccaccgtcaccatcaaaagacctatgcaagcttcaacatagaccagccaggaaacaatttagtgctcacaaccccagttagttgatcttgatcatggagatgtacatagcataatacatatatatagaaatatgtgtgtgtgtgtgtacagccatatgtacaggtcattctattttgttttgcttcctgagatcacttgatgcgtcatcatatatagacacttgtaagatgtgcagctggacatgtacaagccaagtgataaaactatgtaccaaacactactacctaatgagccaacctctcaagtaataagcacctttttgatgtggggttgacgtaggactaagatgtttcaaaattcttatgatcataatttcgtatttacgtatgtgcggatgcgcttttagtagaaatttagtaagattactcgtatttatcgctggtttctacctcgatctttatcctacctaaggaaaacaaaataaaaagatctatatttgcatagtgatgtgtgtacatgcgcatcttctacctttcatgccctaaaatttaaagaacattcatctatttttcctacttgtttacaagagtatatgcatgatgcatgtaatgccaaaggagcaagtaaaaaaaaaaactggagtagcacatagactaaggaacccctaatgatgggaattaaacttgtccttagtgcaggaaggtcctcagtgtgcttagttgctgctgatcccttcctaataattaaagcaaactgttctttatatggacggctgatcttaagaaatcaacttggtccattatgattgccaaatttcttcccagcactgtttcaagcaatgattcatttcaagctatataggtaaataattagacaaatataatggttgatacacccaattattacttgggtggggccccatgttgcaaagtgcatgtttgcattttggtgacatcatgttgattaggcagtgataaagaacagttgatttgcatagacattgatcagttttaactttagactactgcttcatcaacttactttctgaaaaggtggtaaggaaggaaggaaggttttggtgttagggggttctaaaatagcttttcggttcgagtggaaactgctgttcatcatctttactttcttggctagtgaggtcatggagtaatgtgataatgtactcatgaggtggtgagctgcatgagtgggtaactgttttcgatactagaatattccagctgctggactctgctctgtcccttcccccccttcttttttgtgttctatgaaatcttttaggaatccgttcgctctcatacatgcaaactctgattcagtcggtgtttatttgatctctgattgtttcagtggttgaaaataacatgtcattatcgggcaatgaatgtctgccaccttcaattcattaaaattggttctgccgtgtaaacttactcctctggttctggttctgttttcttttaaattggttagttcatttttaaaccataacttttttcaaacgtgcaaaagatattgcacgttgatatattagaagcaagattattttataactaacgtcatataaaaggatggaaggagtatttactaaaccagtgaatatcgctatgtgaccaaatggacagccaattatacagtttatactaccgactgaaaatcgttatacttgtgatattccagttaaaacctaaaagtttgagtttgtgaatggaaaatttaatttgcattacaagtttgagattttgaatgacaaattcgtgtgattcccattgaaagtttgatgtcatgaattgaaaattttgcataatttaagtcgaaagagtaagaaataacgaatattttgggttgaaacttagaaccatgtccaagttggataaatcacgcgcgtgtaacttagcggttgacatgagtaacaccctccaaggtcccaatttaaaaggctggatataccggttggatatagaggccgcgtaaaaattatccttctctaaaaaaaaaagtcacgcgcgtgttcgtgcattaaaatttttataacatccaccttataatgaaaaaaatataatatatgtaggcctgatttactcacgatagatgatatgatttccgcgtgatctacaaccttgttgggctaagtttctgggacatgttaagagcttcagtatgaataaagtgcaaaccttgagttcagagtaatgcacccataaataatgctatcgcagtgcctataaatattacatatccacactatgtatgttactcctatattttcggtctctgtcattttgagcatggatagtaaatgcactcgtaggtgtatacacgtgttgtgcatgtgtactatagtgcgtgtcttatatgtgcaccttctgtgtaaccgaattatttatttatttagtttttgaaatgaattcataaattccggcctctgtcggcttctcacggccctgtctttggcccattagatccggcggcaactcatactgggcctgataaattgggccggttgctctcaagctaggaataagtacactttgactcc

SEQ ID NO: 2940 - DNA, 5336 bp, Oryza sativa
atgcactgaaacgtgcgattgtttcctgccaaaatcatcacatggtatcagagcctgatccaatctaatctagccatgttactcgatggcgtcctcctccaccaccagtagcgccaatcgtctccagggaagcacggtgagtgagaagcttgggaaaaccaaccatgcactttggaaggtgcaggtttgtgctgcaattcacgacgcgcgtctacaggggcacctgactggcgcagcaaagaagcccgacgctgagattgccgtcacagttgacggcaagacggagaagaaggcgaatccggcgtttgaagattgggaagccgtggatcagcaggtcctaggcttcctcctcgcatctctttcaagagatgtgctcatgcaagtcgcaaggtgcacaacggcggctgaagcatggacaacaattgatcagatgtactccacccacaccagagcgcgagcaatcaacacatactatgtgctcaccaacaccaagaagggaaacatgtcccttcctgagttcttcggcaagatgaaggcgcttggtgacgagatggcggctagcaccgggcgacctgttgaagaagaagagatgatcatgcacatcattgctggccttggcaagggatacagcgaggtcatctcggcagtgtgtgcacgccccgaaccaatgaccgtgggagaactatactctcaggttgttaatttcgagggtcgcatggcactctaccgaggaacccaggagaacgtcgtcaaccttgcaagccgtggaggtggcggcaatggaggaggtcgcggtggcggcaacttcagccgcggcagcagcggaggcgctccccaaggcggtcgcgggcgcagcaacaatgccggaggccgctgaggccgcgggcgtggacgagcaccaggggctgcagatcgccgaccaacatgccaagtctgcttcaaacgaggccacactgccacagattgctggtacaggtatgatgaagactatgttcctgacaacaaacatgttgcagcagctgcggcagcgagctcctcctatggcatcacaccaattggtacatcgatatcggcgctacagatcacatcaccggtgagttggaaaaaactcacggtgaaagacaagtacaatgggaatgagcagattcacactgccagcggtgcaggtatggatataagccatgttggtaatactgttgttcatacccctaatagtcgcaacatccatcttaaaaatgtgctatatgtccctcaagctcagaaaaatcttatatctgttcatcgtctagttgagaataactctgcttttcttgaacttcatcgagattatttttatcttaaggatctggtcaccaagaaaatgctccttagaggaagatcacattgcaggctctatccacttcccaagccatccttgaagtatgcctgcaatgccgccaagatctccttccatcggtggcacagtcgtctaggtcatccctcctcgtcagtggttagacaggtggtcaataaaaataatctctcatgtttagatgtgtcaaatgagtcagtttgtaatgcttgtaagcaagcaaagagtcatcaattaccatttcctgttttatctagtgtctcccaacaccctctagagcttgtcttctttgatgtatggggtcctgctccagagtctgtagggagaaagaagtactatgttagtttcattgatgattttagtaaatttacttagatctatatgctacagcataagtctcaagtctttgaaaagtttcaggagtttcaggttatggtagaacggctgcttgacaagaaaattctagccatgcaaactgactggggaggggaatatcaaaccctaaactccttttttttttctaaaattggcatagttcatcatgtgtcatgtcctcacacacaccaacaaaatgggtctgctgaaagaaaacatagacacatagttgaggtaggcctctctatactatctcatgcctttatgccattgaaattttgggatgaagccttccaggcagccacctatctaattaatcgagtccctagcagagttatccaaaatactactcctttggaaaaaatatttcatcataaaccagattattccgctctacggatttttggttgtgcatgttggccaaacctttgtccctataataaacacaagtttcaattccgctctactagatgcgcttttcttggttttagcaacatgcacaaaggtttcaagtgtcttgatatatcctcaggccgtgtctatatttctcgtgacgttgtctttgacgaaacggtgtttcctttttctgaactccatgctaatgcaggagcttgtcttcggtctgaattatctctcttgtcacctaatattattagtggggatgaacaggtattccattcatgggctaatccacctgctaatccgcctaatatgtctcacaattttcctcaagatgctgcaacagatcaaacagccaaagaagatccgcctggcgctgactcccatgatgattcctgctcccgccctgacggatctgtgcaccgctcccctgcgcgcacgcctgacgcgtctcctgtccgccagtccagtgctgacacgtctctgcaccagcatccgtctgccgccgatcgcattattctgcaggggccaccgccgcatcaggagacaagggggcagcagtcaggcacaatgacaggcacagcgacgggcgaagagacgttgggcagtcctgtaacagatgttgaaatacttgacatgaatgacattgatactgatgtcacaggtattaatcccgatgccgacactatactgcctcatgttcaacagatggagactcaggaaccacaacaggtccgtcccagaacaaggctacaaagtgacattcacaaggaaaaggtatatactgatggcacagttaaatactcctgctttactagttcaggtgaacctagtgatcaaagaggccctaaaggacaaaaattggaaattagccatggatgcagaatatgaagcattagttaagaataacacttggcacctagttccacctcagagagggaacaatgtcatcgggtgcaaatgggtgtataaaattaaaagaaaggctgatggttctctagatagatataaagctcgtctagtagataagggattcaaacaaaggtatggtatagattatgaggatacctttagtccagtagtaaaagcagccacaattaggataatattatccattgtcgtgtctagaggatggagtcttagacaactggatgttcagaatgcttttcttcatgggtatctagaagaggaggtgtatatgcaacaacctccagggttcgaggatgtcaccaaaccacactatatatgcaaacttgataaatccctgtatggactaaaactggccccaaggacctggtttgctagactgagtcagaaattgattgaacttgggttcagtggatcaaaggcagacacttccttgttcttcctgaataaaggggaggtcactatctttgttcttgtttatgttgatgatataattgtagccagttcatcagagagggcaattgcagctttacttcaggatctaaagacagactttgccttaaaagatcttggagaactacactactttcttggtattgaggtaagcaagatacataatggtattattttgacacaagataagtatgctactgatttactaaagaaagtaggaatgatgaattgtaaactagcagctactcctttgtcagtaagtgaaaaattttctgttcatgaagggtcccctttaggtccaaatgatgctacacaatatagaagtatagttggtgccttgcaatatttaactctcactaggcctgatatagcctcctctgttaacaaagtttgtcagttccttcatactcccacaacagtacattgggcagctgttaaaagaatcctaagatatataaaacaatgtactaagatgggcttgaatatacataagtcagggtctacactggtcagtggattttctaatgcagattgggctggaagtatagatgacagaaggtcaacaggtgggtttgctatatttgttggctcaaatctagtgtcatggaatgctagaaaacaagccacagtgtcaaggtctagtactgagtctgagtataaggcgatagctaatgcaacagcagaaattatgtgggtgcagactctgctttctgagttagggattaaaagtccccgtgcaggtaaaatttggtgtgacaatcttggtgcaaaatatttatctgctaatccaatgtttcatgcaagaacaaagcacatagaagttgactatcactttgtcagagaaagggtaagtcagaaattgttggaaattgattttgtttcttccggtggtcaagttgctgatggatttactaaaccactgtcaactaatcttctggagaagtttaaagccaatcttaacctagcaaggttatgattgagagagggtgttagttgagtctgtttctatctctatgcatgtgataatgatcagtttagttgtgataagataggattagattttatctcttcctttacatttgttatcgcatgctagtttctctcccgagttggcgcggttgttgccgatctcgtgggcttctgtaatcgccacgatgaaggctattctaatcatatattaacgcgtaagcaacgcactgaaacgtgcgattgtttcctgccaaaatcatcacacgttcaacgccgccgtcaccgccatctgcatcgcaccatgtacgcaaaagcatgtcaaccatggaggagcacggcaaggtgaagggaactttgccatgatcatttggtcggcattcgtcgccgccgggctgctggcctactgctgctgttcatgctcatcatgaccggcatgctcgactctgccatcccgacgacgagcagtagaagaagtggacggaggtgatcaactaccggttcctcaacacgctcttcaccatcgcgtgcctgtaccagcagtccagcacgtcaagatcttccaccacctcgtgctgctcctccggtggcgccccagcaccagcgacgaccgcgaggatatctgcaaggtgtactgcaaggattgcgcgccgcgggcgcacgaccgcgtgcacatgctcgtcgtggcagtgcttcttcgcgtcacctgcttggcgcagcacttctgctacactctcttctggagctacgcgtgcaaggaccggctaggctgggctccatgatgccggcgtggggagaggagagagaagggagagagggaggaccaaagagggaaggagagaggatgacacgtgggccccgcatg

SEQ ID NO: 2941 - DNA, 8663 bp, Oryza sativa
gcaccggtttaacagtttaggcagttaagatatctggttttgtagttcagggtcacggattagattcgtgtcacttaaaatatcttgttttgtagttcagggccacggattagattcgtgtcaattttaagggagtcaaattgaacctattccctcaagctatgcaggttcttcttccttctgcactcgcttccagccctaaccctagccacgcgcacttcaaaatttcctcatcaaggagatcttcttcttccgctcgtaatgctggatggatggatggacgtgctgatgtgatgatcccttcttattgttgcgccaacgccgcgaacgagccgccctatgatgggtgagggtgagttggttctttcccctctctgtgggtggggaattttctttctttgttcgatcgccaaaatgggccgcattgatgaatctgatatttcctcttccgttcttgattttttagcatagtgaatctgcccctacctgtatttggaggcggacaggaataacttgtagggcaatcgcgcggtgaatcggcagttgaaggtgccaaatgacaaaaccgcatttggttttactgttcatgcagggcttatttgtattgttcaggactcaggagattagtcagggttcagagtcattggatctaattcatgtgatttgtgcgttcctctgtcagtataatccacgctgatgacaatgggcataaattttccccaagagatgtcttcccatcaaattgagctatctaatacttattttttagattgttagtgcattgaaatttaaaagaaattaatttatcggttgattattttctttctccccaaccttttcatgatagcagttttcttaatcactatttgaaagtaccgattttcatttcttaacagatatgttgactgaacaatatgacaatactgatgatgttgacattgatgagctagctggttccatgagggcagatctaaatcgtcgcattgcactgaatgagtatcgagggaatggaaacaaatgctgccttatatgcaaaatagtatgctgaattcgtcagaatgataggaacgcatatgaaccaagtgttctctcaattggcccttatcaccattcagagttgcctctgcttgccatggaaacagagaagtggatatgtgtagactacattcttaagctaaaccatcatgttagcttgcgtgagtacccgagcttgctttctgggctggagaaacaggtaagaggctgttacagtgaggacatagacatggacagtaaggagttcttgcagatgcttctgctggatagctgcttcattcttgtttatcttggaggtatgcaagggatttgcagggctaaagacacacatgaagcttctgttgatggtcatgggatccaagaagatagtgatactgttgatggtataatagttctgctgtgtatgacctactgctgctggagaatcaaattcccttcttcgttattagggccatttatcagctgttctctcgtgataccatggcgactacaccattacttacaagtgatatttctgaattcatggaaggcattctttaccatttcccaaaagcaatcactgaggagaataggccagtagacttttaccatctgctacatctgtgccgtatgtacctgaagcctggtcacaaggtggaggataaacagcatcatggtcatgctggaaagtctcactactttgactatatatctgattttggccaaaaggtcttctgtgttggacaggagcaaaacatgttatatgaattaagcaagttgaattcaccagagcatgtttatcggtggcgtagagcagtggactatcatgaggcaggaatagaattcaagaaacgggactttcatgaagaagaccctcattctttgttggacattagattcaggaaaggagtcatggaaataccatgtttgccaatcgatgataaatcttctttgcttttcagaaatcttgttgctcttgagcaaacatgtcctcaagtcagcgacgacatcactgcttacattgtgctcatgtctgaatttgtcagtacagctgctgatgttgcacttcttgcacagaaagggataatagtccatcagatggaaagcgatgaggaagtgtcgactctcttcaccaaactttttgagtatgtggcatttgactttagaggtgaacactacctgaaatccttatattgtgccatggaagcacattaccaaagtcgtctaaataggtggaatgcatggctgtggcacaatcatttcagcaatccgtggttaggttttgctgcaataacttccgctttcatagtattatgcagtattttgcaaactgttcttgctttcttatcgtacacagcataaacctagataaagcaaaagagtatgtttcaggtgcatcccgccttcgcaccgcttttttttttttttatatggaatgattccattacctcatagacccagtgatatcactgctcaccaaaacctccacccctgggggaatatcgtcccacctaaggatgtcatagagttccacattacatctcagcaccgcttttttttttatcaacgcgtcctcgagtagtacctgttaatgaccaaatttggtaatatcagcatcggaagaggagtctagatcgaggtggagtcgaaggcggagattgattcgagaacagagcaagaatcggctgaagtccagatcggctacgattaggatcggctgggtctaagtcgggctaggtaggccgatgcagccgattccgacagtataatttggtatatgacattgggttgaattgaggtgcttcaagatgattgccgcacatggatagagtcctgataaggcaattgtatctattaattaggatgttttatgtaacttccttagagatatgtttgggcaaaagtctgccgcaaagacttatggtatcttagagtttgttagagatagtggtcgtgtccggtatggacatatcttgtaattctcgggtataaatagaccccgagccctatgtatttttaacacacacgttcaatacaatttcggcgcatcgccacctttttgctttagttttgtttcgacgagttcttgctttcgggttgagctgcatcggtttcgatcttcaacaagaggtaaaacttgttatgacgacttgtgttctcgagattagtgcttccatctttatgacactctaatcttgtctatataattcgtcaagttgtcatatatcttacataatccttggcaatatcatcatctaatttacaatcggctaacatctgttaatagaaggcagccgattatgttaaatagcgacgttgtcctagatcatataagatatctaccactttatgaaacacccagcggcttgattgtctagatattgttcttcttttcatacctaatgctgcatcagttgagtttgatctattaagtcgtgcttagaatatcaatctctagcatgtcctctgattgccgattagggtagtatcggagtttcagccgatcttatctgatttaaccatattcgatctatatgcttcaatgacatgttaaatccgccctttatgtcaggatcttattgtatttaagtatattaagcttttgtttggtatattatatttggtttgatatctttatataaagtagtatcggagtattaaccgatacatgctagatctatccgatcggctatgctataaacatatataatcctgttattaatatatatttcgatctaagtgatttatactatctcggcatgatgaccgatctatcccaatcacttgattaaagtatatattaatataagaactatatatcgttaatatctacagccgatcgaatagatttagttccttactatctatttataaccgccgatcgattcatagatgacatcggctcaaagataaatgatatttcatcggcacctagccgatcggctatcatttatagatttaaccacgaattctttgtctctatttcttgttgattataggatcaaatcaactggcacgctcatacattcgaaggcaagctttggacctgcactggagttaagcagatctcccaggcctcgtgttttctgtcaacagtaccatgaggtaccactttttttattataaatttggtacctcatagtacctacctaggtacctctacctagataccaagaggtactaaattttacactaaatttttggtacctcatggtatctcctcaagaaccgtagaattgctcaacaacttctattaagagctagttaggtgctaggattaagatcacaccctgttatggtaatacattgttttcaaatgttgttgtaatagatacactgttattcatttttaggttaagaaaacgtgcaattccttatatttatatgtcactaaatacttcctaatatttttcatatactaatgatgccaaattgatatatagatgcagtttaatgacctcttcggagacctggtaagtgcaaaaacaaggggactacatggcgattagacacagataaattattgattttcgtttcctcatgttgattagtattcttacactccatgtgataccctcatccccattgtaatccagtccccggtgtaatatattactacctcctcgatttttataggccgtattttatttttaaaaagtctaaaggatcacgctttggccattgatttctcataaatatattgttgatacctttaaaaccaacattttgttaaagtattttgagatgttaatatattggtataattttggtacattaaattgactaattgttgctcaaaatccaaaagaagttgaccttttcaaatcaaaatacaccttgtaaaaatctacagggagagtagtgatccttagggtgggttcgctcacctccaccgtacgtaaaacgaagcgacacattttgttatccctaagtattttttttttgaaaaatagattaatatgatgttttaaagaaactttcgtataattttttttttgcaaaaaaaaaccttttatcaatttgaaaagcatacgcgtggaatacgtggaaggtgagtgggaaagttagtgaaagaactcggttcccgtacttttaatcgttggtctgatcagcagggcacaagtcccttccttctacagccctagcaatctggtgtaacaaatcaaagtgcattttcatattctcttctttatcaggataatttatcaactcatctcatgtaatcatgttatgccgtacattaccactgatatctctgaattcatggaagagattctttagcatttacttgaagtaatcactgaggcgaataagccaactttttaccatcagctacatctctgtcgtatatgtacccaaaacctggtcggaagctagagaatgaacaacatcatgataatggaataaatgatagcttttgtttcaagaaaactatagccacttattgcataattctctcaaaagagagtaaacattcaggcgacccataaagactggcttctaacaaacacactttaagagaaaataattattgaagtatgtttgtaaatctccagccgaaaattctatatctgatattggccaaaaactcttctgttttggatgggaggaaaacatgctgcatcgacgattagtgagtttatttcacccctgcaggtcaatcggtggaatagagcaatggaggacacgtccaaacactagctgcttccgtccagaatgtcatctttgatatcccaaaaggctgtcctgctgtgcgcgacttctggtaaaaacaccttgttcctttcctttcctcagcaaagtgcgtcgaaggatttctggtagctgatccggaacgggatactcgcatcgagccaccaatctctcatgctgaggcctgagtctcccgaagacctgcattttcaccttttaatgtttttggattctattctaggaatatacctctaaaaaaacttattctaggaatatatctctacaaatattattctataaatatattcttttcgacacaccaatgtcattggcgccgtccccattgctcctcggtgaaaactaattcactaatatgaaggggacgacgccaatatcattggcgccgatgagctatttataattttttgaaaaggggacttatttgtaataaaaaaaattacaaaacaggacctatttgtaatttttttattacaactatatccttttatgttacaaattggttctttttgagtttttttggaaataggtcctcagcgtcaaagatactagtgtcgtccccgttcacattagtggcttagctccaccgaagggcaatggggatggcgtcaaagtcattggtgccgtcatattggatcacgacgccaatgacgtagccgatgcgaaaagggatcatttctagaataaatatttttaagggatctattggtagaataagtttaaaggaataaaaggtaaaaaaaaatccaggttggaagactgaggaattgatgacgtaacaacgcgtttcttttcccctaagtgacaactgaatgagtagtatgcagatcagcagatgtatgcacaatgcacacacgcattttttgtttcaaggaagtgtatagggacgcattcgcatatataaagtagtgatgtaaatgggttggcccatgggtttgtaactttttaccgaccaaaaactagggttaatcgaacttaaccctgaaaacaacgaggtagaaaaaaaatctacatttggtctataatttacctaataaaaaaaagaagtgggataaaaggttctagaataccgtgtgtatgaaaatggtaacagaaaatataagtggaaccattttctaccattacctttttgtcacgcataaaacttaacttttttagtgttgtatttatatcaaaactgaatagttaaattaacaaatatgatcaattaccaacttatcaaatgtcgttttgaaatagattttatcgattccaaacgtttttgaccgtttttatcctcaagtaggcaaacttgtgtgcctaatatgaggtgcggtggtgtgcgtgcagcattggactagaatgagtggtgcaacgatacgtgtaagagatcagtttttgaagcaataacaaacaacgtttggaatgacactccaactgcttcaggaatacataagcgtttgggaagtacttagcaacacgggaccgtgatctaggaagggactgaggatacaatccaatggagatggtcggccagcggctcgtacacggcaagctctgtgtatatcatgcaattatgggaaaaacaagatcggaatcagcgggcctcgtatggaagacttgggcaccggagaaacacaagttcttcgcttggcttcttgttcaaaatagaatatggacagcagaccgcttaggccattcacaatgcatcgccatggcgttcagcctcgacacgccaacacggatttgagccgccacgtttgccactgtcatactcctgccaggaactcggagcctaaggccctgtttagatgggactaaaacttttaagtccctatcacatcggatgtttgaatattaattataaatattaaacgtagactattaataaaactcatccataatcttggactaattcgcgagacgaatctattgagcctaactaatccatgattagcctatgtgatgctacagtaaacattctctaattatagattaattaggcttaaaaaaattgtctcgtgaattagctttcatttatgtaattagttttctaagtagtctatatttaatactctaaattagtgtctaaagacagggactaaagttaagtccctggatccagacaccacctaagttggctccccgttcttcgtcagaattgcgtctgggcccacaacattgtttcctacgccatcaagaaacagagagagaggacaggaagggaggcaccacagcgccgagctcgtcggggtggtggcggcgacccatcccgatctacgccgtcgttattaggggaggagagggcgacggagagggagaggaagacatgagggaggagagggcgaccgagatccgcagctcggcgccaccaccgttccactgccgctctgctcggcgcctcgccgccgctgcgccgccgtcatccacagcttccgcccccacgaggagaggtggaagcagggagagctgtcgcggcggtcgggaaaggggagctgcgccggcgatggtggggaaggggaactgccccgggctagatccggtcgccctgctgctgctccgcctagcgccgtcaccgctccgcccagcgccgtcaccgctccgtccggcgtcgtcgccgcttcggccaactctttgcccgggcgccgtcgccgagaaggacgccccgagccaccgccttccagatccacctcgacgcggtgtggtagggagagcggtggagggggagaggggcgccggcggtgggtgggagagagaggggcgctggcggcgcaatgactgaaggaggagggggagcggttcatgggatgtggggaaaggcagagagagagagaggggagagataacaagtgaggagagagaacgggtgggacccactgtgaagaaaaaagtagaccacatgcactgtggaggatgttgctcacgaagttcttagtctaggtggcagttttggctcctca

SEQ ID NO: 2942 - DNA, 8898 bp, Oryza sativa
ctttcctgctcctctgttcttgtacagtttttccctcatctataatataaaaccagcatgctgtattcttcaaaaaaaacgtgtaacaaaagagaaaacgattggacattggctgttaacaaactgcaacatgttcagatggttcaaatatgcccagctaacatagcactcccctgttcaaaaatattttaaactccaatcaagattcaaagattaggtgatatctaattaagtactagattgttatattaagattagacgatatctaaacaaaaactagattgttatgttatgaaacaaaagagtagcattctttttttctcatgacatggaagacatgcaacaatacacatacacatcacaaaaacaccgtgtctcctaacacagaaagtcataccatgcacacacctgttcttttagataatacacgcctgttgagtgtcccctaaactaaataggttcttattggaaatgtacttacataatacaaagaaacgtatacagataatacatacttgtttagcgtatactatggtgccaaatctagttctagatagctatattttggaacggatgtgttatcagggtgcagcttcatacgaaaaatagcaatcataagatccacaccgacacaacctttatttccgaatcaccgaatcagacagcagtatatttttttcagaaggcatggcactattttacttttaattggctctctttaacaaagcttctctctcttggtgcccctgcttgggtgtagcgaggccgttgaagcgcaaggtggaagataaataggacgagtagtcggtttcagaagaacaaagcccttgtcttctgagaaaccgggcttctgtcctgagaaagaggcaaagtacgtttgcacagggaacataatttagcaaaacagaacaacgcaggttgggcaagccgtaagcaagtctctatgaattgacgtaccgttcatgctagatccagaatggctcctttttatgtgacgcttactgatattgctgtcctccgggaggtctagaacatctctcccaagagcagaagcgatcatcagatcagcgatgagtagaaacaacactgccaagacgagagcgactgtgttcttcattgttgctatgagtgctgggagttgttcttcttcacaatttatacccaatagaacttgttacctaggtggtagcttaatgtcattgaattggtaaaggagaagccccatttccatgtcccaacgagcaatgaattgtttagcattaaatgaacatcatgcagcatgtggggaacgagaatcaaaatctcaagctggggccatagagcaatagctccctaatttcccaacatgtcataataggccctgtttgaaatatgggaaatcaaaacctaggaaaacaaacaagaaataaaaagaaaagcatagaaagtatatggatacgtgtgtttggaaaacaagaaaattattgcgatggtttctaggacttcaattggaaattcagaataagattttgtggactggcctgatgagatgcggttctacctgcatagcaccagttatcagagggcatatcaggatgttgagccccatcgtggacgagtgcagtaacccagtctggaaagttctctccagtttcaccaaggtaaggaaggttatggcttttctttcttcttaatataaaaatatgcagatctcctgcgtatttaagaaaaaaggaaggtaatggctgaagttgcatcttgaagaccataaaaagttattttaaaaacatcaagttaagccgaatggagatatttcgctcaaaagaagaatgggggttgtaatatgaaaaaacagcatgtaaaaattgttttttacgataactgtggggctgaggtaagaccacatatcatgcatacctgggcagttgatatgtggcagccatcttatgtgtgatgtgtccctctggtcttctaggagggaaagaaagcatagaaatattttgtttaaattatcacaggccattccatggctgagatatacaacttctcattggattcatgtttcaaagaagtgtatctgggtagctattcactaacctggctataggcaccaaatggattcactaaattgaatgcatgaaagtgaagcagctcaggatacccttccttgtcaaaagccccttgtggaatcaagaaggaactgaatagattgatgaaacaacgatagaagagactgactcccaggataggaacctgtcaatctgtggagattgagggcagtcaacattcagagagagcaacaaccatgattccctgaatgaaatccaagagctgagtctgacatcctcttcaatttaagttgtctataaaacagatagctaacgtaggtgcaaatttaatgcacaaaactatcactgtagcacgtgcctgtttcaggtgccagcattcttgctgcaatgacagcatatcgatagtaattcacttggttaataaagaggaaagctcttagtctagaaaaaaaaattaagaatatttaaaattgctacgttaaataccaaaatattcaacatttctgacagaagtagcctcataaacgaaaactaatcaaggtgaacattcttgaatctggacataccgaagcatcatagatcacatggtcacattgtagagtagttgcactcttgaaagtgcattcatgtttcctccaagtgtgcagattttatttagtgtctcaaaaactaccaacacagtttccatgtgttgtcaagaaaggggaatgtgtgtttgtgtttctccacatttaggagaactgattcttgatggtaattgcaactactgagttaaagcagaccttttattccatgtcctacggatagaatacacaagttaagaaaagtctgttccaggccttattccttctgttggaactcaagtggatataaataagacatggtaccaggtacatctaattttacctgtaatctttgagtcagacagactgttggccactgagtatttacctgggatcaacataagacaagacagtaaggacagtctgtgcaacagtgcagaaaagcacgataacaccagccaaccctgccacggccagccaagggttactaagatggttgtgcttcaaccatgcaatccacctgtgcagacgattctggtaatgtgcctccaaggctaaagacaggggcatgaggtaataattcccatagaaatcaaataccacacctttcgtcagcttcgtaaagagctgcgatacatctctgtcagtgcgcaaatggtgggcaatgatcccctttctagccaacagtgctacatcatcaggcatgttcataagcttagccatgaaaataacataggcagtaacatcgtttcctacttttggacatgtttgctccagcgctacaaagttcctaaaaagaaagctggtgctttcatccacaagcaaaaatggaatttccaagacagcatctctgagctttatatccaggagagaatggcgattggactcgctatatgctctcctcctaaattcaatgccagcttcatgatactgcgatgcccggcgccaccgatatggaaaatgaccattctgtgacgaacctaaattagctgcctcctgcttgtaagtaagatgtagataatcccatcctagctgaagaaaatgacgaatgtggtgccccgtatgaccatgatgctcatcctggtttggactgggtctgacgtacatatgacataagtgtaacaaatgatcaaaatcttttggacgattggattctcttattgcttttggataacatggtacaaactgttcaatgcattgaacaatactccttcttagtgcagtagtagttgtcaatttacttgcaagttttgaaacaactatctcgtgtattccctgaattacaaaaagtgaaatttggttctctaacaggagcaagtcatgtggaacaaacatgccataccactgtccaatctgctggctggggtcctgatactggccactgatttccgaagataactcaatatcagagattgaatattcttccatagagtgcctgtcatgatccaattgagtgttcttcatcgcactctgcttccccttgtttacttgttgactttcatttctcccagttactttctgatgatccccaaaactcaaagctccctcaaatgttttgtcattcgaaggagaaggtatatatctgagggaatcaggccacaaaaattcattgtattgacttagagagacaagtacaaagcatccatcaagcaagagagtctgcaagaactttctcttattcattttaatatctccagaatagcatgaccttgctcgtttttctagtctgtttatgatggtcaagtaatctttcagacctttttgacagcttaacttaaggatatagtccaagcagttccatttttttctctccatgaaagaaagtgctgaagacccattgtgatatgggccaatcgacaaaattagtggttcataagaatctctgtctatcatacggatatgctcatggattcttggaatcaagcagaactcagatccatcagcatgcacagtatccaatgacatgtattttttcagtttatccttcattgagttacccagctcctctatctcaacatcagatataccgtcttccatttcagtcattttctacctctcctaaaagcctttacatttccttcttaactgatcgacagagctcatgccttacattttagaaaagagaatcattacattagtaaaatcaatgtaatggaagaagcccggattacaaacaagtggaggtatagcttgaaggagagattctgaaccctggcctggcacattgaacataagctagtaaaaattttccaagagtgaagaagaagacgagcttgccgttgcgaaaattgtagagtggaggctagttgcaacgcatccgaaagataacaacaatagccgagggaaacaaaacaagtgaataaccctaaaacattactacctcgtacgaacgagaatagatccacgaaaagttgatcgattattttactttgttcacggtgagatccgacagaatgccgtacctcgggacacggagcgagctccagcggccgcgggaggaaaaatacgccggtgggaagtggtcgccggtgtccggagaatccgggaggcggaaggtgatcgaagatggggtgagggtagtggaatgcggtggacgacagcgtcggagggatcaatgtggtgggagactttgggctcctttgggccgggttagccgggccgcgtgacaagggacccgacatgaccgggttttggctgatgtaacgactaagtggctccttttaactaagttttcgtgtcacgtggcattgacgtagcacttacatgtcaatttaacctggaaaagtaattaaaaccatagaacctacatgtcagttacacatacaaaataataatagatagtggggcccacatggtcccacatgtcaccatcacattcccgtcttctctcacccatgccaactcgccacttcgctaggaggcggagcggagcaggtggggtgacgtgcgggcaaagccggcaaacgggtggagtggctgatgaggatgttaggtcccgatcttccgataggtattgataaatagtcgatttgggcggagtcgagacacaactcgattcggcttttgaacgaacacgctcttgagccccacaatcgcaacaccacgtctcctctgtttatcaaccgtgccgaaacccagttgacctcgccgagaaggctaatccctgcatgcgaatcgaagaacacaagcaagaataacatagattgcaaaacaattgcatatgaatgattaagcactcgaatttggggtttcacaaaccgatctagcggcgaaactgttcttgacagattaatctaagcaaaactccactccaaacaatgacggttactgaataaatattattagggacgtcctagggttgtcctagggcgcacacccctatgggctaagcccacgacacaattacaaggcccaaaactcaaatcagattcagactggatgaggtacatgacttattttgcagattcccaacagctcggtaggaattttgacgtgggaccaaaaccatatgaaagtggactccataagctttccaacaagtactcatgggccacgatcgaaattccttctagatgagcggctaggtccgtttgaagttgatgctgtcaggaggcccgaatcctaatccaaaacgtatagaactttatctcttgtcttctatgaaccaaaagtaacatggtgaggtagaagtagacttggagaaggtcttggtttggtctctaatcaatttctttaatcatccatgtattccttacgcacggtctcttttctttcgcccaagcaagtacctctgtaaacgaaaacatacaaaactcatttgtgtagcaacgtttgttcaaatatataacaagtaaaactaatatagaatatatacacctttggttgattaatacataaggtagtcatggttatatctgagctagttgtgtccttattagtggcggcggtggacagagcagtccagcggagccgagcgggcgacggcgagcgaaaccggcaggcgggtggaggagaccagcggagccgagtgggtggcggcgagcgaaaccagtaggcgggtggagcagaccagcggagccgagcgggtggagagctggcggcggcggggtgagtaggccggtggagccgagcgagcggagctgtggcgcgcaaagccgggcttcccgccaacgggctggcgagctcaagctcgtggcaggcacgaagtggaggattagggggtgctgcccgtgctcgttgccgttgccgtcctcctcaccatgctccaatggccgtgaatagagatgcacagagggaggatggcgctcaatattcaatgacaagtaatttctcagttcatccttcattgaattacccagttcctctatctcaacgtcagatatactgtcctccatttcagtcattttttaattctccttaaaacatttacattagccacacgcaaagattaaacagcaactgttatgacaaggtggttattatggtcatatggtttatttggttggttcagaatggcaagatttccaatgggattgatgagccattctttcaagcatggaaatatcttttcaaggaattttccatgattatccgtagagtgcaagcagagtaatttctgattattgagaaccactccctccgttacaggttataatacgtttttactttgatcgaaatcaaaccgattaaagtttgaccaaatttatagaaaaaagtagtaacattttcaacccaataaaaatttattataaaatatattcaattattaatttgatgaaactaatttaatattataaatattactatatatatttgtctatggacctagtcaaccttaaaatagtttgactttgaccaaagtcaaagacgtcttataatctaaaacagagggagtagctaactagcttgccgtgattttattttttaatagccttgcatattataatttcttaaatatattaatacactaggagtcgctcttcggaaaaatcatttgaagtatttagattgaatacatcaaaatcgtaagtgtagatttatctaaaaaaaatcatagtattatagttctgtagggtactaaaaataaatttgcaatataaattagcggtcacaatattatattccgaggaccatgctcatgttgtaatccacatatacttgtgaccggatgggtatttccaatgagctaaagggcataacctcccactttttggaattagttgtgaactaacccccaccatcttcaacctcggcatgcaatgacattcaaatctatctccagcataggcatgtcctgttgtggcgacctttttagctcacctttggtgcgtccttgattcgaacgacacctcccacctaggaggagagagtcactttcacgtgttatgatggaaagatttcctttcatgttattcagcaacttcaccatgctgcagcattatctgatcgtccaactaatcgcgattaatcgtcctgatcaattactgtgatgcacaaaggaaagtttatgcagtttgcagttcagtacacaagtactctgttgtaattgtaaatctccctcattactgtacttggtatataacattcgaaagattttgggatgataaatttgcagaagaaggcaagtgtgggggtaatgggagcagagtgaaggagaggttaagccaaaattctggtgaagttctgattgaacagaaaccagtaaattttcccataaatcacacaatcacgtatgtttgcaatcgtcaacaatggcatgcatccccggatgacagagcattaacgaattaatttcctgatatctaggcgttccaaaagcgctggaacaaaggaagaaggcgcccttgtattcgttgtaaaaatagcagattaatcagacctgacgacgcatccaaaaaaaaaaaaactcgctaatacctagcgaggatcacgggaaaacaatctaaaacaccaatcactttcttcaaggcgcactgcgacagaatgccgtacctcggagaagcggaggagatccgtcgccggcggccgcagcagcagcaggagacgccgttgcggtggaggcggacggcaacgtccgacgatgtgggggaaatggggatggcgagagacactgggaattggggatggcgagcggcggatggaacaagttcacctgcggtccctcaatttgttgctgagttcgaaattcgtccctgagcgcagaacaaggtacaactcatcgcccaacttacgaaaccgtgcaaataaggtccctaggcagtatttgtgtccggttttggttgtcgtgg

SEQ ID NO: 2943 - DNA, 2866 bp, Oryza sativa
  unsure (1)..(2866): unsure at all n locations
cacgtcaacgccacgttaatgccacgtcaaatgaagaccgagtcaaatttgccacgtatgcaccacgtcagccaaaaccgccgtctaaatcactgagggatctcatctgtagtggttttgataattgaggcacccgttgtatctggtttcgtggttgaatgacgaaaatcggattcgttgacaagttaagggacctcagatgaacttattccgcggcggatcaagcgatgtgaacatgggctcactgggccaatggacacggcccactaactcagcccaagtgccaagtccgccgggatcttcatccgaatctccaccggcccagttagctttcggcccaaaacagatttcaaaataaacaggccacttcaattcttttgttactacacggcataagcacatgtacacatactactacacatgcaacactatgcttacacttcggcaaatacgacatctaacacatgcttaaagaaacgaaaaccatcaacatatttctgatctcactaaaatcttattggaaggctacttgcgtgttcgtaatatttatgggcacttcatatccataataatcccatcaattatatatgggaagttttctttaggtatttttaatattggaaaaagtacggattacccccctgaactatcatggttggctgaattaccccctgaacccgaaaaccagacatagcgtaccctaaacttttaataccagacgaattacccccctcaatactattttgagcggttttgacttgagcttgtacacgtggcgccaacgtggcaatctagtcagaaaaagactcctcggggccacatttcatctctcttccttcccggtctccctctcctcggtcgcgctctctctctctctctctcccgtgcacacggctgcggacgggcggtgggcggcggcgcgcgcggacgtgccgtgggcagtggcgcggggggacgggtgaggcgatgggcgctcgccgccggcagcctgccatccggtttcttgtggtgatgagctcaggtagctgcagagaaatgagaggagcttgttggccaaatgaccatcgccggcataggaacagcagcagcaacaggccttcgacttccctggctacagcacgagcagcagcaacatcacttggcgcagcagagccgcctcgacaagctgaggcctgagggtgcagcagggcttcgacccgccggccgggtgagaggggaggccatggcttgctccgcatcgacggcgatgagcacgcccagcctgccgccatgtacgaccacgcagaggcgacggccgggcatggatcgtgcgcgttcccggagatgttaaacttcccatcgcagcgtccaacggggccctccgccaccgagctgctcgccagccagatgaacgccaactaccggttcgggttccggcaggcggcgggaggggtcgccggattggctggcggcgaaggcgccagtcggctatccacaaagcatcggacgggcggcgttgaggtggtggccgcgcggttccaggtcaagcggcgctggagtcggcgcgcgagggccggtgacgggcggcgccgaggtggcagccgcgcggtccctggtcgagtggcgcgggggtcggcgcgcgagggctggcgacgggcggcgccgaggtggcggccacgtggtccctggtcgagcgtgagagtggatatggctcaacgcgataatcatgttgatacacgaagagtattacatataggcgccaaccttccatagaacactcgaccgatttatggaagcatgatcgggaggttttaggaaagagggctaattagagatacatgccatatacagtctaacacccccccgcagtcgcaacggcgctagcagacgttgagactggagcgaaactcggtgaagaccggtgtaggaagccccttggtgaagatgtcggcgtactgcgatgttgtgggaacatgaagaacacggacggcgccgaccgcgacacgttcccgaacgaagtgaaggtcgatctcaacatgcttggtacgctgatgctgcaccgggttggaggagaggtagacggcactgacattgtcgcagtagaccagtgtagcccgcgacggcggagaatgtagctcctggagtagctggcgcagccatgtgacctcggcgaccgcattggcaacggcgcggtactcggcctctgcactggagcgggagaccgtgtgctggcgcttggaggaccatgacaccaagttgtctccaaggaagacggcgtagccagatgtggagcgacgagtgtcagggcagccggcccagtcggcgtcggagtagacggcgaggtcgcaggcggaggaccgctgaatgtggagtcctaggtccacagagccacggatgtagtggaggatccgcttgagggctgccaggtgaggctcgcgagggtcatgcatgtgaaggcagacttgctgtacagcgtaggagatgtcgggccgggtgaaggtgaggtactgtagcgcaccggcgaggctcctgaagtctgtgggatccgctacaggagggccgtcggaggaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 2944 - DNA, 405 bp, Oryza sativa
tgctcgcttttttctttttctacgagcctacgacttggacttctcctctccattcttcctttttccggcgactcgcggaattgcgggtggatttgctgcttccctcgctgtcgactcggctcgggccggtgcttttttaagtgacgtgagaagaaagcgaggcatcgaatccaatccaatccaatccaatccagagtgggggtaaaaccagcgatctttgagggggcattttctttcatttttttactttttggttggcttgggattcgccgccggtgtccgatggagcggttcgtgcagttcttgaggcggggcaatggtaaagattggttgatttgggttgaatatgtttgtgcttgcgaggtgtttgattggtgttcttgggggtggtgcagggttgatggc

SEQ ID NO: 2945 - DNA, 1714 bp, Oryza sativa
taattgatgattggcgaccatggtatgctgctggacaagttgccgggtaagaagtaaatatttccgttgacagtcaatttcaagagtgattataatttcagtggatatattgcactttctagtgtgagctactgcattttgtagcatgagatatgtttggagtaaattttggtgtattcagtgccttcataaaaatcatgtgatggaatcccaaattaacgtcaaaaattatgataaccccattaccaagcaaatatcatgcaaaacacgaatatttctagtattaatttggtgtctactggtacctccgaaacagaacacaatgccacaaattagacgattttggttagccgttaaggaaataccattgtttctacagttaacctaccatgaggtgcaaatatattagcactagaaataattatactccatcgcattataaatttgaacaagcttgatgaagtttgactcccaaaataacttacaatatgaaacaaagggagtatctttcaatagcttcttaacaatcgtaaaaattaataaatgtgaagattatcatacttataactaataagttctgacatatcatgaaggccagttgggaaagtggctgatgagtggaatatgtatttacagttattttttaatacaatagaatttattctgttctttattacaatgaagctacaaccaactattatagaattcaaaccggacgaattactgcgaattagaaaattatggtttgactaaaaacaagaaaactactaacaatatcacctcaaaagacgaaatttctctcccaacggctcacaagttgtagatagtccttgtcttcctcagaccacaaaagcatctttgaattagcgtccaatatttcactcccaacatcgctggcaatatatatatgcttttcctatatttggcgcatgttgatattgctatctcttattttatgcaacataaatattccaattcactacatccgagctgcttgggacatctgccgatatgcattgcggccattgcctatatcttcgcctaatatggttactttgttttatagattcacgagaagctatgcgaataataacctgatatatgcaactgtgaaggtgtgtttttcatacatgcaagttattagtatttttacatttttgtaatattgtacttattgagcttttgcaaaaaaaattgacaagttgctttttcaagattatctccatgtccaaaatatttacacttgtgactgctggtaataataagagatttataaccttcacttatgtgtacaccaatacttcagggtgctgggcacactgctccagagtataaacctaaggagtgtctcgagatgtttgctagatggatttcaggcaatactctctgatgtatattcctcaatcagatcaagtcaactatgaaaacatgagtaaatgataacatcagagatatgaagaaaaacatttgctgcatgtaatattttggaaaaccttaagaactctcactagtacatagatatctatgacggagaccagtggtccataaaaggggcattcatctgtgttgggccgaaaataatcccgttgaagattgggcttcacggccatgcccgtcaccgttgtcccctcatcggtgatgggattcagttgtggcccgacacaggtcatctatgatgggcttcacgcatgcaatccagcatacatgaagatat

SEQ ID NO: 2946 - DNA, 3976 bp, Oryza sativa
tgtgtgtgtgtgtgtgtgtgtgtgtgtgtgtgtgtgtgtgtgtgtgtgtgtgtgtgtgtctgagatatgtatccaagccatgtaatctatatatattagccctccgaagcacgatacaatgtgtccaatatcttcaatacatctatctcttcttataatattcaacatggcatcagagtaggcgacctatgccagccactgcttaggcttccgccgtcatcgcccttgggatggttctgatctctcggaggcaaccacccgtttatgtttttctttgttgccgtcatgccttacctaggggattgatcgtgatctcctaggcatgccttgttcttcgtcatgttgtccacacaacagcaacatgccaacattgtacttcatcagcaccagcatcaatcgtcatcgatctagatgtggtagtcatcgttctcctcgccgatctgttgcagctggccttgaacaatcgtcaacaccccatgtagcaggttgtaacttgtaagtggatattacctagttgaactcaccagactatggcaaagtccttagacttagtagtgttgacagtggttaagtgcaaacttccaccgtcaacttctgcataaaagaatataaaatataatatcaaacttagtgatagtgtttttttactaaccttttccactagtcttggtaaatattagtatgcaggtgatttctgaaggaaaatacactcgccatgcgacaaaatgtatctccgaccaattatacacaagaacaaggattgccgggcccacatgtcagtcaaaatcgactgaattttagctaatccactactaaccggcatcagggcccaccagtcatagagtggagagcgtctgtggcaagaggcggtatgcctgttcgaccgaaccaaggctaacccccatgttcacctgctcgcacgtggtgaccccctattggttggtaatggtggttgtgggtgcaccgacctccacaaaccgtcatatggaggctataaaagaaggagctcaactcacttcgaaaacatacaactcaagggaagtacaactcactttcatattttaggcatcactttagtatgtggaattaggtagagagtgagaggaagctccggaaagagtgtcccaaaaatcggagttcacttcgggatgtttaggaggagtgtcgggtttgttgacattcttccactggagttaaggagaagcgccagagttgtcggtctttttctcttgcttgtacctcggcggatgcttccttcaataaagtaagtataccagatctccttatgatatttaatttatttgcttgaatcagatatattcccaccgttgtgggctcatcgcttagttgatttattaagtgctataatactaggactctggataaagaaggaagtttctaaatgaggctagagtagaaatcaataacttagacgtggtgtctaggttagcggttaccttcgtttgttgtatgctccacaataagtgaggtatgcgataggtggtgatagcctggttcgtcctttgtatccctccacgttcgggtacatcatagagccataggtcggactcagcttggcagactaggggagagcaggtgcccaaagcaatcaacagggttttacctttaactcaagtatagtaaattaacccataggtaacatctttaaccttagcctaccattagttgttgcccttagatagaattatgttcttacatatatacacacgttccccgtgattcgataaccttggaatactctgtggtgaagtactacagcgatatccatgcgcttgcggattaatcaatgaccgtatcaattaccaacaagcatttttggcgctattgccgggaaacggttgatgtgtcatctccgaacctgagtcatcctcgtatctcttcttcctttctattcttaccatggagcacctttctattcaaaacattactactccatggggcgagttctgtgagccacctttttcttcaagacctatccgttcatttggccatgaacttcatcctagctttttagccatggttcgtgaacaataacttctaaagacatgaaagcgaaatacctaccatcatctacatgagtttgagcaattgttctcgtgcctaaaaatagtggacatgacataagaaatcttaaagtggaaattgtttttcttctctattatagagaggatgaagcaatggtacgtccatactgtgagaaaactgcatggtgaatgggaggaattaaaagctagctctgccttgttttcttcccattaaccactgtagtctcttaatgtaagaaggttctcagctttcaaaagaataagaaggaatccattggtgcagtctgggctcgtttctccatgttaattcaagatggccctaacttgtctctacccgatcacgggttcttgtaacatttccacttgggcttagacaaggagtttgtcatgtatctcaatatttttgccggaggtttgtttgcacacaaaatgacgttagaagatagggaactcttggattgtatcatggagaacacctccttcgtttgttgtgaaactgtcctggaaatcgaggatacgcatgaggaacctccgatggccaaatcggagaatacaacctctacatcccatgattcgaccgttgaatcatcacccgaaccacgggaaccgaaggtagaaattcagccttcggaatttccattccagtttgagggtgatctttttgaagattatggaagcccctcaaactattcatgccaaaagagtgcaccggtcctgcgtagttctcccatgccactcaaggagattctgttcaaagagatgcaacaggaattaactaccatcatgagggatgagtggttaagggaggtggagctttcttctgaagtaattcggattaacaccccatccttaactattacatgtctcatgagagaggccatggtgcaaactctttataatccaactattggcgcaaacattatgtctacaatctttgcattaaattgcttaggggatgaaccattggcaccaatagaaaaaacactttcagatcctatctggtcctatcatcgaaggttatgggattctttgtagatgccaatccggcacaatgatgtcgaggctatcttggacttccatgttttagaagtctttgacttcgatcttctcatgggccatcccatagagaaacttcgcattgatgtgccgcatacaagagtcctcaacatcaaacttgggaaaatggtgttttccatcccgatgttacgattgaaaatttgttggacgtaacccattgccaattccgagtcaactgaggaattgttggccatctctcctttcgagtccaatgaatccctcgtcgaagatgatgacaatccatttattgaagaggatcggaggacaatcctggagagctgatcgagttacccaaagctgatccatcctcacgacctccggttgagctcaaaccacttcctttaggccttcgctatgccttcttgtatggtgctatggattcactcgtcatcataagcgtcaggctttcgatggcgagacctcaaaactcacagctgtgttagaaacgcatcgctctattctaggctactcacttcaagatcttaaggggattagtctggccctctatactcatcatattcctttagatcattcttgtgcgtcctcttgagagccacaacaaaacctaaataatgctgtgagagaggtcatgaaaaaagatgtcttaaaactcttacatgtaagatagtgagtgggtcaacccagtccaggttgttcctaaaaaggaaagtatgacagatgttgaaaactcaaaaaaacaagttatttccacaacataccgtcatggggtggagaatgtgcatagactatagatagttcaacaaggctaccaggaaggaccacttcccgctgccctttattgaagaaatactagagcggctagcgaatcactc

SEQ ID NO: 2947 - DNA, 2417 bp, Oryza sativa
tcaagctcgccctcgacggcacacggcctcaggtggaggcgctgctcgcgaggctccgcccggacgtcgtgctcttcgacttcgccacgccgtgggtcgccgacgtcgccaggcagctcggcgctagggcggcgcacttctccgtcttcaccgcggtcaccagcgcgtacctgacggtccccgcgcgccgtcgtctccaccacggggcggcgtcgtgcccgaccgtcgacgacctcgccacggcgcccgtggggttcccgccgtcgtcgtcgctggccaccgtgccgacctaccaggccgccgacttcacctacgtgttcaccagcttccacggcatgcccagcgcgtacgaccgcgtcgccgcctgcgacaaggccagcgacgtcctcgtcttcaagacctgcgccgagatggaaggcccctacatcgaatacgtcgccacgcaatacgacaagcccattctcgtcacgggtcccctcgtgccggagccgccgcatggcgagctggaggagcggtgggagacatggctctcctccttcccggacaacgccgtcgtcttcgcctccttcggcagcgagacgttccttccaaccgccgccgcgacggagctcctcctcggactggaggccaccggccagccgttcgtcgccgtgctcaacttccctaggagcgtggacgccgaggcggaggtgaagaagtgcatggcgccggggttcgaggagagggtgaaggggaggggtgtcgtccactcggggtgggtgcagcagcagcacatcctgcggcaccgcagcgtcggctgctacgtcaaccacgccggtttcagctccgtcgtggaggggctcgtcgccggctgccggctggttctgctgccgatgaagagcgaccagttcttcaacgccgcgctgctcgcgcgcgagctccgcgtgggtaccgaggttgcgcggcgagatggcgacggatggtttggccatgacgcggtgcgtgacgcggtgaacgcggcggtcgccgacgccggtggaggggacgacgacgagaggaagtggcgggagttcttgacggatgacgccgtgcaaaggagattcgtggaggagttcgtcagggagctgagaaaactcgtcctctgaagaaaatcaactttggccgagtttagttacaaacttttttttcaaacttgtaactttccatcacatcaaaacttttcttacacataaattttcaacttttctgtcacatcgttccaattttaatgtaaactaaacacacctaaaagtctgtcgtgaaataaggcgtgtaaaaatatggtgtcatgttattgtttgattttagtctcttttttttttctaagtctttgttgatacttcgtatcaaagtactccttgtcctaaaatataagtacttagttataaatctgtacacacagcttaaaacgtaagtatatttagttatgaatcttcatataaaaaatgtaagtatttttagctattaatcttcatattttaggtggtatatatttataaggtgagttctggtgtggtggcggcgtggcgttcatgggcgagccctcgagcacggccttcagtcgtgtatgtcactgaccagtggtagtggtcccaacgtggagtggagaagaagataagtcgtgtcatcacttaaacgcgacgcgacgtggcgccacttgtgccgaaggacacggtgtcgatcgagcaggttaattatgggcacgggagcaacgggggtgtgggcgcggcaacgtgcacgcgtgggctgattgacgatggaaggaagcggcgtacacggctttggtcgcgcgcgtgaaggatcgtcgggagagctcggcatgtccgttaggtaccgcatggtaaacggggaatttaactatttgctatttttaggttgggcaattatccaaatactccttttagatttacacataattttttgccacttttacgagatgacttcttaactatttgccacttttgcccacgtggcatgccaacatggcaacggagggtagaaaccggtgtgggacccactagtcagcctctcctctctctccttcctctctcccttcggtccgatgtggcagcggacgaggtagagcggcggtgccggcggaggtcgaagcagagcggcggcggacaggctcctcgcggaggcgagcagcggcggcggcggaagaggaggtgtagcgacggtggacgggcttctcgcggaaacggagaaggcggaacggcggcgtcggtggagaaggagtagtagcagcggcactggtggaggagaaggcatagcggcagcggatgggctcctcgcgacggcctaggaggcatagcggcggcgccgacggaggagcgccaccggaggaggaggcgtggcggcggcgccgatggaggaggaggcgtggcagcggttaaatt

SEQ ID NO: 2948 - DNA, 20003 bp, Oryza sativa
tgctgcctcctcctccgctcgcccccactgcccgtccacgccgccgtcacacgctcccacctcgttgccgtcttcgctcccatgacgaccggcgcatctcgccgggggctcatcctagccggcgactgcgaggagcccgtccgccgccgctctgcctcgttctccgccggcgccgtcgctctgcctcgtccttcgccacatcggaccggagggagagaagaaggagagagaggagaggctgacaagtgtgacccacactggtttctaccttccattgccatgttggcatgccatgtgagcaaaagtggcaaatagttaagaaggcatctcgtaaaagtggcaaaaaattatgtccaaacctaaaaggggcatttggataattgtccaacctaaaagtggtaaatagttaaattcccccatggtaaacgggcacaggcgaagttgcgatgcgcgcaaaataatatcgtcggcacgtaagtctccgtgtaggcacacagggcgtgtacttttgattccctcgtatttgcggttgtggcgacccggcgcggtgtgaaggggtgatgacccctcctggcacgcacgatgcgtcgcgcgtgaggtgccattggaggtggtggtgatggtggtggtggccggcttgcttgcttgctgagcccatcgttttggtggtatggcacacggcttgcctaagtgtagtgctgcggtttcttgggcggtgcgtgaggcgtcgatgtgttaccgcgcgggaagtcaagcgcggtcgtcgcgaattgcagccacgagtacgtgaaccctttgttgcgctgtgcaacggtacgagaagacgatgaagtctttgtgtgcggtggcgtcgctgcagctcagtcggagtaggcagttgggcatcgagatgtacagagcgttgcatgaaacgatggcatgatgatcttgccggtcatgtttcaaggattgtgtgaagcggagcggcacacgagttggcacagcgcgactcgctttgtcttggcgtgctggtgcccgcggcgtggcgtggctcgcgattgggctgcgcgagcagcgggtgggagcaggcgacgcgcatcggcgcgtgcgtcctgcctggtgggctcgaccgcgatatcggccggttggctggttgggccgcctagccgagggaagaagaggaggaaaattggaaaaagtacgccgaaggtacctcaacttgttatcgagttaaagaattgtccctcaactgtaaaaccacatacagcgtatctcccaacatacaaaacctgtgcaaactagctccctcagcggttttcaccccgattttttctgacgtggtagctgagtcagcgtagaatccacattggccccgcatgtcaggatgccacatcagcacgccggcatatcccttcctctccttttctcctctctctctcacactcttctctctggacgcaggccggctggcggtggggaggaggtcaccggcgtaaggaggtccgacggtcggcaggcgatgcggcggcggcgcgctcgtactagtcgtgcccggcgcccatgagcctaccccaccgctccaggtccccaacagcgaagccgctgctgtccaccgctgcgagctccacgccaatcgccgcgtccgtgccggccatccagatccacccggtctccacgtacagcgtgtacacgcactcgttcttgtcgttgtccccaccggcaaccagctggccacggcgcggcagcgctgccatgccgtccagcgatctcgatccggcggcctgcgcgcgcgtatgcaattaacatggtcagatcaactcacaggtcacagcagagcagagagacgatccgaaaagaaaatgcacgtaccaagaccaccatggaaacgagcgaggcgaagtgcaagaatctgtcagcagccattgtcgtcaaaggcttgaagaactccatctatttggactttttggattggatgtgcccttttgtgagctaagctgaagagtgtttatatattggcagtaccagatctaacagtgacttgttagattttcttatagagagaacagttcgtgaacctcaagctccgcgcgcgtacgtgaacctcgccggcaacccggggatgaggacctcctcgtcgtggccgtcgtcttcttcgccctgttggtccttgctcacatacgaagcctgctgcgacgacagcatcggcagcttgaaccagctgcggccgtggcgctgccctcccctgtcccgtgtctctgccctgccgcgtcgccgccgccgtatcgccggctggccgtcggacctcctcgcgccggtgacctcctccccaccgcgggctggccggcctgtctagtctagagagaagagtgtgtgagagagagagaggggagaaaggagaggaacagataggccggcgtgctgacgtggcatcctgacatgtgaggcccacgtaggtcccacgctgacttagtcgtcacgtcggataaaatcggggtcaaaaccactaaggaacttagtttgcattggttttgtaagttgtaggatgcgctgtatcggttttacggttgggggacgattttgtaactcgatgtcaagttgagggacattcggtatactgggaggcgatagaaaataaaagaaaggaataagtttaccagtagtccatcaactttacatcgagtttgcattatatccctgatcccctataccaaaatcttcacccgtaacctatataaaaccgtgcaattttggtcctatggtagtatggatctctgcatttgcttacgtggcatcgtagttagtgaaaaaaaataaaaaagttgtgggacccaaatataagtggaaagaaaaagtgtgacacccacatctcttctttcttctctcctctcatctcttttcctcttttcttctcctcttctcttcagcgatttcagagagggaagaggcggctggtgatcccgaccaagctccgccgtcgctgccctgatgggaggagggaaagggggagaggtggggcaaccggcatgaaatgagggaggggagaggtgtggtgatggggacagtgaggcaatgggggatgtggagcggagcgggcgggcatcgcgagtggtgcccatggtggcgagctcctgcgtgctatgtacttgctgcatgggcggtggcgtggtagggagctgtcgatgcgaaaaacacacactggccttagagatttgcatactttagtgcaggtcctaaatcttacttttgggttcagggcgtgccagttggtttgatcctacaaccaacaagaaacatcgcaaacaaagttaaatccgtaaatgatagccgatcggatgggttgccgatgacgtatcgtttatcctaggccgatgtgatatggatcagatcagcaacgaagtatgcagcaaaggaggagttaaacctgctctatgggctgtagatatcaataatatgtaatctacacttcagagtacgtttaaaccaagtgattaggatagatcggtcaggataccgagagacattataaaccactcaagtttagagatacttcaaagcgaagattatatatattcacagcatagtcgataggcaaatctgacgtgtaactactagtgctccgatactactttatactaatatatcaatatatatcaaatattctaatcaagagtcaatccagtgttaggatagcctaatagactgacatcgagcttaatatattttatccaagtgagatcctaatataaaaggcagattcagtatatcaagaaaacaagacaactaaaccatgtaagatcggctgaaaccccaatgctatccttattagctatcatggaacaagctatatattatggttctagatattacttaatagatcaaactcaactgatttaacattaagcataaagagaaacacaaaatctaaataagttaatgagagcctttttgggatggtaggtatcctatataatctaattcaacgatgatatgaggtcccgttgactgtttttgatgatagaggcgggctgacaatgtcacatagaaaagtcgataagcatacatgataactcgacgatttgtgtaatcaggactagagtgtcgtaacgatgtaagcactagtcccaagaacacaagccaccataacaagctttacctcttgccggagatcgaaactaatgcagcccaactcgaaagcaagtactcatcaaaaacaaagaaaagtaaatggtggcgatgcgccgagagtgtactaaacttgatgttttttgtttacacggtctcggatcatatttatacccaaaatacatagaatgtccttgccagagatgactccacttctattacaacttgaaaatacgaacaagtcccttaggcagactcttactgaaaatatctataaggaaactaccaaaatatcctaattaatatatacaattgccttcttcagactcaatccatacttggcaataattgtacaacacttcgaccgataccgacaatgattctatgattatcttgccgaaatcggctacatcggcttccccgtatccaattcggtgtcagccgatgcagacaatagccaatgcgcactctgtttccgtgaataacgatttcctcccaaatccgctttggttttgacttcaaatctaatttatgatttaccaaacttggtcgttaacaggagcccagcaagctcaagctcgctccacgcgcgccacatcaccgggggcacgacgacgggtgggtgtgggcggtcccgctgctggatgccaatgacagcaacgatggtcgagacgaacacctggaagctcgtggatggccgtgtcgccctgaggtggtcgtactcgtcgcacatgtaggcgagctcttgccagagttgaccgacactagcaggtcctcgtcgaggcccttgtcgacgaggaggtacctgatcgcggtgacggcaatggcagagacactggctttctctgcctgtcgtgccctcaactcgcggaagggacctcgtgcggcacgacgaggaaggcgagggcgtcgggaggcgcctcgtcggggcagtccaagtcgtcatccggaggcggcaggagtggcggcggatgcgctccctatgctgcagacgcataggccgcgatgccggttgtggcgccgtcgccacgcctctcccctcccccatctcccgccgggcgcctcctgtctcctactttctgtcacgtcctgataaattcatcccgaaataaaaatcattctctaaaaggaataatagaattaattaaaatttaaaaagaaattagcaaacattaaaatgcgtacaagaaaaattcgaatgtggcccgaagaatttttgttaaattctccttggtctaaaaggagccctcaaattttactttaatttttagaacaccggaaataaatattaagcaacaacaacaattatcagagtttttaaaaaaagaaaactaaaaataatcctccttcctcctttgggccgagtctagcccaaagtcttcccctctctctctctccctcagcccgcggctgaagtccctctctcctccctcccttttccctcctctcccgggcctcccctcccctcggcccagctccctcctctcctcctcccgcctgggcctgccccggcccaagccgagccgcagccctcccgcgcacgcgcgttgaccgcgcgccttccgcgtgggtcccgcccttcaggcgtccccgacctccagccgccggcctccttcctctctctcctgtgaaccctagcgccgttcctccctccaatccgctcgattcaaatggctaattacaaaattgattagggggaattaaaccccattgattcctctctctttccccctaattacccccttgaatagcaccattaattgcccggaacagccgtgccatccccggccgccattctcggtgccgttccgccctatcccgtggccggctctcttccctccgctataaaatggaaccccctctgtgcgttctctcgtttttgcctcttcccgagctcccccgtggccaccccgcctctccctgccttccacctctctctcccgtgccgccggccacctccagccgcctctaccgcctcgcccgtgtgccggccgtgccgtcgccacccgagagcaccggaggcgcgttcctgccggcgtccagtggcgttgccgccactgcaccatctccggccggctgctgttcatcgccggtacgccgatcaacgccgttgtctccttcgtcgacgtcgtagcgtcgccctccgccccggcctgccctcagattcgtcggaacaccgtcgtccgcgccgcccctccttcggtcacgtcggcacccactccggcagccccttccaccgtgccaatgcgccagccgacgtcgccgtctccaccttcggcatcgcagtggcaaggtcgtcctcggcctcgcctcccctccatccgaaccccgccggtcttcgtcgtcgtcctcccgttgttcctggtagtcgtggtattcgtccctccgtcaagccgtgctgttcgtcgcccgcctttcgtcaaggttgctgcagccccgtcgtcgtcttcgtcctcagctccgcatcgtcaagcgttgcgccggccgcgtctcgccttcgtccaaggatagccgccgaagtcgttccctcgccgtttgcttctgtcgtccctgagctgtctccgttcccacgcctcgtcgcgtggtggtaaggatccctctccctcgttgccccgtcctcgtcctttcggtgtcgcccatgcccgttgtgcggttgtcggccccggtacccgtgtatcggtgtgggcagtcgttcatgtgtgcgtgtggtgacctgttagtgtgcccgctcggtagccgtgtggtttccacgtgtgcatcccgcgtggtgtctagtggagtccgtttgtcagccacttgcctcggttgacacacgggatccgcttccgtcgacccgtggaccgtctctgtgtactcggtctaccgtggtcccttaggttgacatgtggggtccgcatgtcaatagcgcagccttcctgtcttttccgggctagcgcttacacatgttttatagttgcaaagcctaattacaataattcgtaaatctccatgtaacagcattaaacttcggatgaccatatcttggtcatacgaactctgaatcgacccattcaagtctcttaatgtttgttataacctaaagaaccgtgtgctttctttttatgtattgttattgcttctttttaggcttgtagctttgcttgtgtacttcgcgtagcttctattgttctggaggtttctgaagcgtgcttcgctgtcatcgccgaaggttcggaaggccgttctctctgagcaaggcaagtcgcatcacccttaagcatattgaatcccagtttataaaattattttgatttaaattattgcattaccgctttacttaaatttccgcgttatcactattttatttagccatgcctatttacctttgttatgaccttattattattgctattgttattattaccttgttcaccctaggataaacaaaatcccaactagtgggtactctattaatggttccactagtatgaatttaggtagatgcttcgctgattaattaggcaacactaggtggttttataactttagactttgggagttctcatatcatttggacattgtggaatggttggcttgtgatggaattgaacacacaccttccccccccctttattcaaaactcccaaaatggttttaggctaggctcgaggtgcatggttctgctagtagcacctcggccactataaggaccggtcttcgggcctctgttgcaaaacactaccgtactaaccacatgtctaatgggtaaggcttaactcagtgctcagtctagtcctagcaagagtacacggatggagatggacgaagtcggggctcgatggacatctctagggcaaatgaaggctacacgggctgcggctcggtagtcgagatgtcatggcatagggccggtgtcctgctgctaggggctcaatcttacctacctatctcgggattccggccgtaggcgaggttgggtcagtgcttttgtcacgactaggatgggtaaaggggttatgtcacatcctttacgacggggttccacggccgtggaatgcggagtaaagatgtgtcttgtgggtaaagatgtacacctctgatcagagtataatctattcgaatagccacgccctcggttatgggcaagcctagcaatgtacccaagttagtggtttaattcttaaaacttgcttaacaactaaaatgtggaatggttggcctgggtttgcttgggacgagctgggacccaggtcaggttgccagttcggtctgaatcatcgtaggccttggattaaggcaggtccgtgtgggttcacggccttgattaataatactgtgtagctctaggatcgtctttataaaatagctttgggcaactaagtgacttttaaatgttgtttactgcaaaacttaacccttatattattaccccttgtaccccattgcattaatcatgcatctcccggtgtggcttgctgagtactatggttgtaatcatttttgctctatctctcccccctttagtaacagaagctttggagaagaagtcctaggtagagccctggcttataccccagttgagcacctgtgaagatggagccgtaggcccgctagtctgctgctgtttatttttgattgtcaggcctgaagcgcctttgtaataatgtaaatattatcgatggaataaagatgtgttttttatatcatgtttgtgtggtgtaccccggcttttcttgggacagggattaatacactagcgttcgggaaaatgcaaattttctcggtcgtgacactttccctcctccagttgggaggcgctcgagacggcggtggtggcggaggcactccgttttcttgtagtgaccttggccgggcttgcgggccgcctctcccctctgtgccatcgctaaagagaagagaagagaagagaagtagaaaagataatagaggagaaaacaggtagtggcggcctctcccctcatttgtttgccctcaggtacaaaattggagttctcacaattagtttttacacttcttcattattttgataagggagtttgagttcttttccttcatgtttctctttcattctttagtccattttttctccatccctcatgatgttgcttctcttccttttcctaatcttcctctagctcgctgctgcccattccgatgaccatcctcatgtccttctaagatgcatgttttcaactgaaaaacatgtaatatcttttaggtaaagcatggcacgctaaatgaatcattttttttcgaaacgctaaatgaactatagtagattgatgagtaccggaaacgctaattagcgcagacgcgctagctagcgatctagcgagcgtttttggcccatgttgttccggcccaccagcgcaccagcgaggaagcgggtcttttttttcgcggcacgcgcgcatgcatgatgactaagagaaaaaaatcgtgaagaggattaagagaaaacgtgattagtttaatcttttcttccgataatcacatattagttaactttttttcaggaggttttttcttcttttactaaaagtttaaaaatctctacgtaaaatttgaaacttttaacttcagttttgaaaactttcaacccgaatttcaaaaactttcaacccgaatttttaaaacattcaagtcaaaactttaaactttcaactcaaatttaaaaacttccaactcaaacatgaaagttttcaaatttgacttgaaagttttaaaattttatgttgaaagttttcaaatctgggttgaaaattttaaatttgaattgaaagtttccatatctaggttgaaagttttcaaatctgagttgaaagtttttaaatccgagttgaaagttttcaaacctgagttaaaagttttcaaaatcttgagttgaaagtgttcaaaatctcgaattgaaagttttcaaacccgagttaaaagttttcaaaatctcgagttgaaagtttttaaaccatagtggaaagttttttcaaatttgagatgaaaagttgaaaattttcaaattttggcttcaaaaattcaattttcgagttgaaaagcttttaaatctagactgaatgttttcaaaatttgacttcacatatagatttgttttcaatctgttacttacaaatatgttctagaaaaaaagtcttatcttaattaccgtcgttatctaaaactaacatgttagttacgttagatatactcgtcgaaaaaaattctacggaaaaaaatccaccggcatacgcgataaaaaaaaccacgaaaaaaatgaaaatccaaaagtgaaataaaagtaatagaaagaaaaaaaaaagaaaacctacctagggctgcgtgcgcgttgccggcacgcacacgccaactaggaagccccgaagagtacctatagttcaatcttcatccggtaaagcatggcacgctacggttgggacataccatcaaaatgagcatagagctggagatactaaagaacctggacattttggtttacgaaaaattgtaaaacttgaagtttcatatttcatcctataagtcattttattgtaaatacctagttatctatctcaacttagttttgttgaaaaaccgcacacatgcttaactgaatcagcccgttatcgttgatgtagagttataccactagctaagttagttgagttaattttgtccaagtgcttgaattagatttatttttcatgtttggttgaactttatttttgcgcatatagcgaaactaagtatcataatgtttaagctctcactgacaaaatgacttataaggtggaatatgaaacctcaagcgacttatgaggtggtttttgtattttcccttgtttttttttaaagttgcaactaagcataggaagaactacaggaaaaaatgtacaaaatttttgacaggagcagaaggcctaatgcacatacggcaaaataatgaattttgacaggatctggaccaagaattgttagactactctataggggacaaatagttaatactcctgcttttaccacggtttgctattctacattgttctattatactccctccatcccaaaaatagagctatttatgaagttcaagtttatttctccatccacccctcatctcaactaacgagagtcatccactagtacagaaaacattttcctgtgcgatcaaaatcgatttttccatacggaggtagcgcccgtctgcacccatatgtctgcgaaaaatcaactttatctcgtgcgggcggcccaaccgcacgggatcagtcagattaagtggaccgcacgagatatctcctatttaattcttcacagctttctcatctcagtcattcacaatcttccaccaccattcatcttccacccccattcaattttacctgcttgcttagttccaatgaaaccatctaaaatccatctaaaatttcttacattttaggatggggagaatatggtttaagtttttataagacatagatagtttgttggtttgttaacagacagtcgtacaatcattaaatgcaaacctaaaacaaataattatacatacaacctattgcactagttgtcatatatcatctcagagtctaagcatgacaaaaaactatgagcatcactacggtactttattggtagtactctttctatcctatatatattataggtctagttatactcggcacggtatccaaaactaatgtttaacttataattttccatatacaataagttctctaacaacaaaacaacaaccatatgaaaataaatttaaatgtcaatctaactgatagtttttttagcaaatataaattcaccttatattataataatttttcgtcaaatgttttcaaagttaaatctaaaatacgcgcgtgtgctacgttattggattgagagagtattatattaccagtataatcgatctgaaccgatgttttgtaagggcatttattttattcatctagtgattagtggtaaggttggtatttaggatattatacatccttaagaaaaagtttttatctacttagatagtatcgcttgggtactcgcactagtaaaaaaaattatttgttcagatgggccaaaattagttttcgtgtgcggacctccggcccatctacgaaaatccaattttttcatgcagatgattatgtcatccgcacgcgaagacaaaaacccaaaaagaaataaaagtcgcatcctcgccaccggatccgggtgaccctgtctgtccgccgccgccagtctccacccgtcgcagcggccgttctcctcctgccaccgccggatctgtgtggaggatggctgtcgactcctgccgaattcgttgccgcccacccgccaccgcatgtacgccgccgtgctcctcccgccaccgccgctgcctttgttgctttccagtcggctgccgccactcgtctaggagagagtttgagagagagagagaggagtatgaggagaggagaggagatgagataactagataagtacaagtatgaggtaaggtgagaggggatgattgaaaaaattgaattgttaaagatgaaaaaaaggaggaggtaactcagacatttggatggacctttaagaggcccgtatggaaaagttacccggtttttttgcatatggctccctaggagggccgtctgcgaaaataaattttcgcgtgcagttctctcaaggagtcgtatgtgaaaataggggaccgaattttttcaaacacgggcacttatgataggtctgcaatctattgcggcggctccggtggtcacgctcacacggccgttctttttcacttcttatcctccattcgttgcaccgtttcagacaggaagtactcctagaagatataaattgttggtcagcaactgtagcctagtcgttggcttagtaaatttcatgcataatgttcagccctgattctttccgcaggcaggagattgccgaccgtagacataagctaccatcgataggtgatcagccgccgccatcgcccgcgtctacgccagcatcatgtacgctcggcccaaaaatcccagggtttctaactgatatgcaaatttacaaaatcatcattcatgttaatatgataatagtgtaaatagagagcacagtaatatatgattaattgagtattaattatttcagattttaaaaaggattaatatgacttttttaaaaataaattttatataacattttttttcaaaaacatacagtttagcaagtcggaaagtgagtgcgtagaaaataagaagtttttctcccaatgggctactgccgaatgctaatgttcgaacagaactaaagtagaaactgaattatctgaattttcctggcatttgagacagcaatcaagcctgtgtacaagtcctttacacatgcctgaaattgtgagacactaacaacccagtccatgaagtccaccaaaaatacgcatgagtactactaaaacatttggacagcagtgacaaatataagaatttgaactttgtcagaacatactaccgatggccaaggccaaatgtttcaagtttttcggctttgtcatgtctaaggtcagaattaaaatcacatttacaaaaatataaacggaggaatcgctttttaaagaccacttagataatttgtacagtaagagcagagaaatcgagtgcaccaaatgcttagatcccatttggaagagaacattaaactctcacgtgagcctgttgaagtccaattccaaacaaaactttagtattttcatcgcagtacataaacagaagagaaacagacacctatatataacaggaatgcagagctagctggaaacgctccggataggcacggcaaatatcatatggacctctttcttcagttggagacagtgtgacatatgcaagtcttccctcaaaacataggattggtaggcaccgggaactccttgagatctcaaacacagaaccttagccatctagctagtatgatagcagcaacgcagcacacagtttcctgcctcatgactgttttcagctccagcgtgtgatctccatggagcacctggaggaaaattggctgcagacctacaataaaagaccagttaaaatttaaaaagttcagagtacagataaacctttttagtcaatgtcatctccgtagtatttgcggcgaatatttgttttttcattatctaaaggagctgaaaatgcaactgcaagaaactattacatggccagcagcttctacagcactgtggccgacatgtatccgtggatccatagtaaactccattcatttcatcagaatctaatctctctacaagaaaaatgttcctcctcctaatagtagccaggcacaagaagacacagcctcaacaccctgataccataattcaactctggcagcacatgggctgtttgcagatacccgatctccagcacaggggtgcagcaatgtgtggagtagttaagcagttaaatgatcctacaaagaggacaatttatttatgttgtcaaagttagtacaagaagtagcaatataatgtgtggagcagttaaatgatcctacaaagaaaaaaaaattatgtacatgttgtcaacgtttgaaccaatcatataatatcccagctactttttctgttttttaggaacacataacagtaacagccccacttaacaactccattatgtattttttcataaataacgactccattatgtagtagtaccccaaaaacagtcaacaaatggtcccaacactaataccttcattaagaagcaagaggcataggaattacggtgtgacaaatgtttaccactgttacctaacaaggaccaggctggtgttcacagaacccaaagcagagcttgaacaaagagcaataggttaaaccagaagcattcagtgagaattcgaaaaaactgcaagcagagggatgcagccaagcatgccctaccatctgaaagtccatgcactgctcacacagagtcaaagaaaggatgattaagatcccagaatagaattttactccataaaactttacctatacaagctaaccactccaaagcagaggtttgcttagtgcacattacctctactgtaccagtctacagaagctggatgcatgacagacaaccatgcagtcctgcaatgcaaaacgcattatcacaatccatctgctcccaacaactcagaagattcttcattcttgttctcctccccctctcctaacccctgcttcagcaaggagatgctcaccttctccacttcatcctcatcacagccacattgcattcgcaaccactccaccatctctcgccgatggagcaggcacgcgttggctcagccatgatcttcctactcctcgctttcctgtcagaggtttctgcatccatatcgcagcagcagcagcagcaatgcggtggtgcatcgtctgcaggagtgagagctggcttctggctgccatcctcgagccactactcgcctctcggcagcatcgacacctcgctgtacagccatctctactacagctcgctctccatcgacgagacccgctgcgccgtcgcgccgccgtcctccggtgaagagagctccattctttccaatttctcgagcagcatcaagtcctccggtgggggtttcgctgtcaagaccatcttgtccattggcacggatgagttcagggaggatgtgtccaatgccgccttctccaggatggcctcggagaagaaccttcggagagcgttcatcaactcgtcgatcgaattggctcgtgccaatggcttcgatggcctcgacttggcgtggaggtttcccgcaacgcagctggacatggagaacctcggagatcttctcgcggaatggcgagccgagatcatggaggattcgacgaccagatcgaccgagcctctcctgctgacggctactgtttacttctcgaaccacctgttcggcatggccgacactaacctcaactacccgatagacgacatgtcgagcagcctcgattgggtgaacattatcacgttcagcctgcacaagaacagcaacgtcaccacggctgacgcgcctctctacgacaaggattctcacttctcggctagctatggtgtcatctcgtggctggatgcagggctccctccatgcaagcttgtgatggggatacctctgtttggaaggtcttggttcctcagaaacaaggacaagaacgggctaggagcaccaactgcagctgctggaacaaagcagagaaagagcaaccagatcggcgtaatcgcgtacgcagagatcgaagagtacctgaagtctcagagtgtttttgttactcatgacaaccagtcagtggcagactacttctacagcggtgatctctgggtcagcttcgacagtgccgtggttgtgcaggagaaggtggagtttgtggcgaagtctcagttgcttgggtacttcctctcgaccatcagctttgatgactcaaactacacattgtccaagcaaggttagtgattgtcaaattctcatcacagatgtaattaaatgcctcagctaatccttccaaattttgtaatgcagcatcacagtcctggaatcaatatcatgtttcttcatatgcgcaaggtagttttggaattatgcaagaaggagctataatccaagatctgcatgcatcaacagggtcaccaagtagttggtattcaaaaactctcagctacttgttattgtcaataatacttgtattggaggttctataataccaagaacagccgtaatttgtaaacaggccagattgcacaaatagtttcagatgataaggcttataacactacatttatgaacagatgctctgttttatgccttccatgtggttcagagacattatctgaagttcaaataaacaggttgcacagatcatgtacattaccaggacttttcaagttttaccaacaagtgaggttttgaaaagagctatttgattttactttccggcttatgttgttgacttcttcttctcataaaagtaaaatcaaacagattttttccgaaaccccacttgttggtaagacttgaaaagccctgttaatgtacatgtcctgtgcaacctgtttaatgtcctatgggggtttcatccctcatagggcgttgatgggcattgatcaaaatttgcaatacgatttttgatggcttatgtgggtggtcttcgacaatcacaacctctgatctccggaagctgagccagcttgtgtggaagaagaccttctgacattctcgactcctagtgcttcgaggttgcatgtgaagtaaatggtgttaagctagcgagctggtttagttctcattaggagtttggttatgtgatcttgttggtggaaaacatcaggcacctccccccctctctctctcatttcttttatgccccctttgattcaaaagaaattcataggaattttagaggatttcattcatataggaatttttcctacaaagctctttgaattaaggaatgaaccctatggaattttatgaaatttctacggaatgtctcttcccatataaattttggaggaaatttaacaagaggtagaactcatggaaaaaaatcctgtctttatctctcctcaaattcctgtgtttttccagtggtccaatcaaacaatcattcctacgtttttcatgtcggaattctatgttttttttattcctctatttttttttttcattcctgtgattcatagtggcccttagtgcccttgggggtggttgtgttccccttttggtttctcttcattgtattccctcgtgtactcactctcttattctccaaggctcatgcgcttgcgcaatcggagttttcccctatgtaagttcgtttgatgcaatatattcaggtgggcaattcccccctagtgacccgtcaaaaaaaatattgttgactttttagcaagcaccaattctaaaagatatatatatctacaaagctattgaaatgtgcaagagattgtgtcatagatagccgagatggcctaaagcaaaagatcatggtgttgattggttaagaagatcctcatcatgacactgctactagaactcaccatgtcccctactcttttttccagtagggaatgagctgaaactagtagggaaacaagctccctaggctttttcatagggaaaactttcatgggatattattcaccgggaattagatgtaccttacgattttagttgtgaaagcgcagggaaaaaaggttccctgcggtttgaaatggtagagaactaggcttacatggcattatattcagtatgtaaagtgattctgattcccccaaggtttctaaaactgtagggttccaaaatagagagcttgcagctagcaatataacacaaaactatccaagaacaaaagaagctgcattcaacacttgcatcaaggttcacacttcagtgcaattcttccaaacattctaagatcaaaatgggccaagctcttccaaagaattccaaaggacacctgcaggtcgttagagtataagtgttttagattatatgttgaagggtattttagtcgtttcactttcttcttgtacacaatatatcgctctttagagctaactcaatgcaaagattcattctccaatttcctctaaattgtgacatggtataagagccttacacctaaatctagccaccaaatccccatcgccggcgcggcggctcgtcgtcgtcactggtcatcattcgtcatcttggtttcagtagcaacagcagtcagtcgtcatctttgtcttcaaccagcaaagcctttggcggccatcgccgaccagcctccattaccagtcgtcgtcttcgtatttgaatcttcaagcaacagcagccgcaaccgaatcagtcgtcccgcgcggtccttgtcgcgcgcccgtcgtggctccacatctcgtcagtcatcactgccagtcgccgtccattgcggaaccccctcgaggctgctccatcatcgccgggccatccgtgctgccccagatctggggcactgcatcatcgattgctcatctctatgcctgatctgttccgcatttgttgttgccggctgtagtcgtcaatctgggtcctccgtcgcctgcggtttcatctcgtcaccgccttcctcgggctcctgcgctgagcacgtcggccggcctgggtaccactctgttctgcaacctttgctcttttgtgtctttgtcgtcagctagtcacattcatcttcaagcagcatcaatagcagcagccagcaggccgatcctctgcttgctgtctacaagcacaggccctcatctggccatctcatctactacagctagcattcacagcaccagccctcattgtgtcattctttatcgagtggtgaaaagttttgaggtgtcacatcgaatatacggacacacatttaaagtattaaacatagactagtaataaaacaaattacagattccacttgtaaaccgcgagacaaatttattaagcctaattaatccctcgttagcatatgtttactgtagcaccacattgtagcaccacattgtcaaatcaagaagcaattaggcttaaaagattcatctcgtaatttacacacaatctgtgtaattagttatttttattatatttaatactccatgcatgtgtccaaacatttgatttgacacggtgaaaatttttaccagaggatctaaacagacccttcgctttagttcttatgcttgcttgccgctgctatgaatatatctactagtatcaggtgccttttgctactatgctgatgtaatcaatttcctatgtgtcgaggagtgatcctctctagcgggaggtcatgagaccccccctttgtgagttcggccggggaagcgagtgagatccgaggttcctcgagacaaaagagacacgagggattt

SEQ ID NO: 2949 - DNA, 999 bp, Oryza sativa
catacatggctatttttgtcttagcatataagattatttgagttttaatataagattattatatttctaattagacttagtatataataattgactagctagggtcctacaatatacatcacctagacttagcatatatcatcactatttgagttttagtataagattattagatttgtaattagacttagcatgtaagattgtgtagggttctaatatatgacagttacacttagcatacatggctatttttgtcttagtatataagattatttgagttttaatataagattattatatttctaattagacttagtatataataattgactagctagggtcctataacatacatcagctagacttagcatatatcatcgctatttgagttttagtataagattattagatttgtaattagacttagcatgtaagattgtgtagggttctaatatacgacagttacacttagcatacatggctatttttgtcttagcatataagattatttgagttttaatataagattattatatttctaattagacttagtatataataattgactagctagggtcctacaatatacatcacctagacttagcatatattatcactatttgagttttagtatacgattattagatttgtaattagacttagcatgtaagattgtgtagggttctaatatatgagagttacacttagcatacgaagaagagaggaacgaggatccaaaccagtatttgaatgaggaagggaacgtggagagggatgcggaggggaaccaggaggggcacgtggaaagggatgtggaggggaaccaggaggaggaggctagtggaagtcaaccctccgttggacagaagagggcacgtgggcaacgaggtgccgcgaagaagcttgagggtcggcacatcataacgaaactggaagaagatggacgacctagtgctccggcagaagccgccaagaactatgtacgtcacagcggttggg

SEQ ID NO: 2950 - DNA, 5494 bp, Oryza sativa
gatcatgagagctttgtcccagattcggagaaagagattctgtggaccacaatgctcgagacattcacccttcccgcgggtacagaggacaaagtgaaaaggtggactctgaagaaaatagcagaacagattcagagcttcaagggagagctgtacaagaaatatatcctgaaggggcagacaccgaacttcgacacattcccaaagctaagggatcactgggacaagttcgttgcatataagacaggtgaacaagggcaggcgatgatggaaagaaacaaagaaaatgccgccaagaagaagtaccatcaccacttggggtcaggcggctatagcgtcgcgatgccgaagtgggaggagatggaggctagcttgcttgagaggggtatcgaaccggccaccgctaattggccggaacgatcgaagttctgctactatgctcatgcgctcaacccagctgatggctcactggtcttcggcgatcagatacgagaggctgcgcgtcgactaacagacacagtggaagcctcttctcagggcacattccgactggatagagagagggacgagctgtcactcgccctgcagactccagagcatccaggacgaactcgagggaaaggggtgattccttggaagattgggttcaaggaggacatctacacgtacaggagtcggatgaggagcaagagagataccgaggcaaagattgcagatcttgagttcagggtatcgagctacgagctcagcattcaagaggaggtggcaaggaaggttgatgaacgcatggctgcacatcggtccaatgatccccagccgaccattcctcctgcaatggtgagcccgtcaggaaaccgtagcagctgcgcctcaacggggcaggtaggatcacagagcatggacgccatgcaaacccaggacgaatccacctgccccgttgatgacatcactcagcggacaccatgtgagctgcatattcctttcaagaacttatcaataaaggtaagctcatagtttatatattttagatttgcccattccgctagttgctgcttatatatgttgattactaataaataacctctcaccacatgaaggtggcgtcgggcatggccatcccaacggacccttcaggtacttaccactgcaggccgattccagtaggatactccaaggtcgaagttgagttggtcgaaggtgcgtatgacgacctcgaactggattaccctggaggagaccgtgagatgcatctacgagacacaagccatgccattattctatggcgtaggcggtacatcatcctccttgggcgacaagcggcgtctcgtgcaccatctcctccggctccgccatctcctccttaggatcctgcaccgtctcctcctcatgctccagcaccgtctccacctcaggctcctgcaccgtctcctcctcatgctccagcaccgtctccacctcatgctcctacaccgtctcctcatgctccagcaccgtctccacctcaggctcctgcaccgactcctcctcgggctcctcctactcaagcttctgcagtgactcctcctcaggctcctgcgccgactcctcctcaagctccttgtccggctccttccaagtcaaggtcccaccaagctccaccgcttgtccgcacaagggcaacaaagaaggtgaaagttgacgccgccgaaaacaaggacccggggtacgattgcacgcaagaggagcttgacgcttacatggcatcagaagtcaagagacaattcaagcctcgaagtctagaaaagaagattcctatagacccgagtgtcatgaacttcttcaggggtatgtctgcacctgccaaggaggccattaagctatcggactatgagcgaacgctgaagaaagcatcttctggaaagtccaaaccagtccctcagcttggagagcaaccaaaccaggagatcgagccgttggtgaccggtaaagaaatgatgatagaagaatttattactgacaccggtctaactacggatcaattgctaggagttgcaccaatcgaaaaggcgaaagtgaaatacatgtacgaactcggtaaaccgcttgtcaagcctgagctgctgcagtccctacccacacaaatgtacaagttccatcagctgtacatggagatgagcgccaccggtagagagatgattggagcgaggatcagggacacggacttcttgaaaggagatgacattctctggatcaatttcaagggaatctacgaattataccagctggacgccctcgacgtctctattatgagttgctggattttgtaagtatatcgttcagttagatttcttactacgtatcctttaattaattaggtccttgtatataagtagactatagaaaataatatactcccttttattgttgtagaatggagattcaaagggcccgacggtggggggttttcgatactggattcatcgaccctcggaaagtaaacgtcgcaatgctcgaccaatatccgcaagccacagaggacaatctcgtccatctcctgaaggcgcagcattacaagacgttcatactgttgccgtacaacacagagttagtttaatttactgtcttcctataccaaatttcattcccgtacgaacttgctaagtgtttcatatgtaatgcatcccacgcacattgcagattccactgggtgcttttagtcttcgacctgtcggcctgcaccgtcaacgtatatgactcaatggataaaaaagagtctacgtttgacaaggtttttgaacttatagacaggtaccgtcataaattcctctgttaattaagaaaatcttgttatgttaattgctactacgaatcatagctttaaactctatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagaagggaactaacttgtgcggctattacgtgtgcgagtattgccactgccttgcagaccaaatcatcaccacaagagagctcgatgtacgtacaaataaattcaaaatttcattacgtatcgatttcttgtttaattactaatcaatttcatacattcatatagtttattcgcatgagggataacctgaccacgcacaaggaatttatcgcggcggttcaagaacaactcataggattcatcaacgaacaaatccttgatcccaagggtaaattctactacgacggaaacacaattcatagatccttagcttctgagcaagcgactactactacgtcgaaatcgtagctagctaggacatataatggattgtaattaatacatgactacatatgtttctatatgcatgtgtacacattttctataatgtaaacatattttggtcatatatatatatatatatatatatatatatgcatatgcatttgcataacatatatatgtataaatacatatatattatgcatgtacatatgtattgaaacatatataaatataatataatatatatatatatgcatatattatatatgcatatatgtactgaaacatatatatgcatggtttatatatatatataaaccatgcagcaatagggccatgcaaaaaaaaaaaggtcagctcgatctttagtcctggttggtaacaccaaccgggacggctgagccatctttagtcctgattattttacccggattggtagtcccggtttgaaaacctattttacccgggactaaagatagcgatctttagtcccggattgatagtcccggtttgaaaaccgggactaaagaggggttacgaatcgggactacaaagggtttctccaccagtgtaacctgaaacggaagcgagtagaattttgtctagtaggtcagacatatactgttggcccaaaaccgggagaaacccttactacaccccaaaagcaagcttaagaggtgagggactcccccacttttaagttggttcaactccgcctaaataagcaatgtgggactattcacaacatatactgccgtgatctgttattcatactgaaacaggtgcttttttttggaattaatgcctacaaatatttgctgaatgtactataggaaacatataatgttattactggattatggattacctcataaagttcattggatataagtcccatgccatggagaaatggaattttaccaccttcatcaaattggcgttcggtccttggattgccagcaacgtacccctgcgtcatgtacacaaggtaaagaaattggtggaaggcaaaagttaattgcaggccacattggtactacacattagcaagcaatttatgtagactattgacgtaattaagattccaaatataaaatttcatgattgatatttatctgataagatcgatcagaccatgagattcaaaattggtttatctcctgaatcattgcctgaaaaatatagacacatggtccgtagttagtagttggaaacacacacaatattaatccacgcagaaaatgaacaacaaatttgttttaataattcatgaataaaaaatatatatctcagtcctaatatttagatggagagaattccatatatatcacttgaaattggctcattctcttatataccattcgaaattagctctttccatctatgccactggtttaaatttctcgaccctcttgtgctgttaccaccactccattatctgtccatagtttaattcctctttttcgtttccttgtgcatcttctgcctaaaatccaatattgccctctaacaatgctggatccatcaaacaaaagttgccaaactaggaaaaaagcaggacctcgctgaaacttcgtcacggtcacaaccaacttgttctatagcaactttcaagggcaactgcatctttctacaatggaattaattgtgaatagacgatggagtgatggtagtggcaaaaaagaggataaattcgaaccaatggcatagatggaaagagctaattttgagtggcatataagagaacgagctaattttgagtggcatataaggatttctctcatttagatgattgccaaaacaatagtatttagttagtaacaaaagaaaaatcttactagtaattgttgtgatagtaattgatatatggtgatcaccattacccatatgagagatggtattatttactgaaatatattccgaaactgcaaggtgatcaaatttaatgttgtgtaacactgtgaggatgtctaaggaaattatccattcacaatgcaagaagcttactttcatcaatcgctagcgcaagtgtaggtacaatataaccactatatgagtcacctccaatatacagcggattcagcaagaactggggatgatcatgaagccactgtataaa

SEQ ID NO: 2951 - DNA, 4902 bp, Oryza sativa
acattgtataagatataaaacttcgtttcttcatttttcgtttgtcctaagtcaaacttttttcatctaaccaagattttaaagaaaacatgctaacacctacaacaccaaattaatatcattaaatctatccttaaatatatttctatagtatatttatttcgtgttgaaaatgttgctatattttttataaagttagtcaaacttgaagaggtttgaattagtacaatgcacttggtgtagtatgacagttctaatatatttgatacatattatccaccaatgttttgttttggggaggggacgtattgcttcggttactatagagcatgtgaaacattgaaagtcttgatttctctttcacaaattttgtaagtcatttcgttatattttacatagatcatagcaaattgaatgaaaattttgcgcattcaatgatgtggatatttaaatttctacatagtaaatgttagtcaattttaaatatattttttgcatattttccaatttgcaggtttaaagttcaacattattttgtagcccttgccaaccatctaggtgctcagatatttgtccacagatcatcaagttcatttgtacctaagaagtccatccatgatcgccacatatgtgaaggtatcctactcagcgtacctacaatgcacataggtattccgatccatcgatttgtacagtcttaataatatttagatactctaattaactttatggttcttaaggtttgttctagaatacttttctaaataaatataaagtcgttattattaggttaaaattttcatatttgacttataataagtggcatgaagaatgaattaaataattcctgacaatgaatggaaagtaaaaaagggaattgatatgcatccaaaacaattttggattacaacatatttcagagatgcaaatccaaaataagaactatacagtatgtcctacacctatctcataataatacatctaatactccaatttttaaattctaagcaatattataattaatatggggtcaaataactatagttaagaatccatgaaggtattcacaggcgtaggacaatttaaaatgctcatttgccccaacaaactaatctaagtttagtatatagtatatgcttactattgatgtagaggtggtgagactttgaatctttatgtcaattttatatgataattaatagttttttacatcgttctatactattagtttagtcaaataatttatcatttaattaatattcattgtcttagtgactacatgatttcgcgagcaaatataatttagcaatataatttttataaaagttgaataataaacacaataaaaaatgttgatgtttatatataatatcaacattcaacaatagtacaaaaatgtaaagaatgttgggtctcccgttttttgtttaccagtatgtcacaattaataagttgaaattaaatataaagtaataattgtgaagttgtatcaatattaattttaatccaaaaataaggtcatcatcacgtcattattaacttgaaatttttttctaagtccaatatgtatgtcaaatattttatattcatgttatgtataaataaatagcccgtgcacggattggcgactagtctatgctaatcgggcgctctgaggaagctctcacgttaactacaagaatctggtcgctgattatttagatcgttcaatcatgaccatagatgttaaaattttatctattgggcctgttataaattctcatgatactgtatatattttatcctctatctagcaattctacatcatacgagagagagcacagatcggaatgattctacaattgtaatgatacagaacagatgcgatctcaaggagatgtggaacgcggcgcgtgagactttgcctgcaactagcttctccggtcatcgtgcctgagcttctccagtcatcgattgctcatgctgatcggcggcgattggaaattaagaacacttgcaggccgctggtgtagctcaatcattgtttggcgtaccttatgttgcttctaaattaattccttgcaggattgtgacatatatgtgcacaacctggcttattgactataattaagatggtgattttctgctgctgttgccgttcctgccgaaccaacaaaccatgcaattgccacaaccgcactttatcggtgtttcttataacagtacaattcttgcctgtttttcttttttttttatttgttatcttgctttagacaacgatatttaatttcctttttagaaccagtattttagcaggatagagtacaagctagatgtgctgcaagaggtaaaactaatatttcactctgtatcttaattagaccttcttggttaactcctttttttttttgcctatttaccgaagaagcacgaatgactaaacttcccgtttcattaattagaagcttacaaaatcataatagtactctctttgtcccactgaatatggcgttcacaagattcaaattttaagactgagttcttttattgaggttgaaaactaacctttcacttacgcaaaacatagttacttattagcacattattaattaagtattatcattttttaaaaaatagattaatatgattttcaaagaaactttactatataatttttttttgcaaaaaatacactgtttagtagtttgaaaagtgtgcacatggaaaaagagaaatgagtgggaaagtaaatgaacgaactcaacctaaatgttggaccaataattattttattaggaattaaatttttttatgaaaataatatgattagattaacctttggatttacaacttttgtttataatatataataaatttaaagtcaaatactagttttgaagagcgcgcattagtcagtggacggagggattacaaatcaacctcgctcaatcttcagcatgcacttaaatattttccacctgtccaggcagcatctttaaacggccagtaagtgaatcttttcttaattatattttatatatcgctaagttacacatatttcatttcaattggcatcatattgaataatcacgagaaaataacaaacacacgaatacatcttttatattatattccactagtagttaatttgaaaattaaggccattagttagttggatggtattatttactatagaacaggatcagaatttgttttaaaataaatatacctttggcgaaaacaaattagtgattaattattcacagtggaactattaaatcatggaaattctataattggggctccaaactgaatacatatgtggatactcactaatatcgaatttcagaatgattaaaacatgaaaaactacaattgagactcttaatcaagtacaactcgatagttgataattaacaaattttggaattattaaaccataaatggctataattgtgatcccaaaccaaaaatgcagttcaatacacttattaattatgagctttagaattattaaaccatgtaaaagataatcgaggcacaatcaaagtacaacttgatatctcttatttatatgttttggtattattaaatttaaaatgatatctaaactgggtttactgatactcactaattctaaatttctatattacatgatagcaaatgctgcggacccaacatcagcaatgtaacagcagaaacataaggatccattctatataagtatttctaattaataattttgatttttggaacataataacaaagtaaattgttccttcttcagaaataaaaaaagtccaagtgttcgttcaccgaaatattgccaacttattcaacatattatttaaaatataatatttacaatttcagtagtaataaccagtgcaacttaattacgtgccgtacaagcactttctcattctctctccatttcaaaatataagtatctctaggattccaattttatatcaccaatcagatgtttggaaaggaaatctaagatatatatttaaactttaaaaattgataactcaagtgacagaaaagaaatctttcgtcctaactgtagtattttctaagcaacctaaaaaaacataatattttgtaacggatggtggatgttactgaaatggcattcgaagcctgcggatgttctcgaagaaaaccataaggcaaacaaaaaatatattaaaccaattccatacaagataggtggtgtaaaaatctgaaattctggggcattggtcagcaccgagttacctttctgaggaaaataacaagctgtttcactgtcttggtatcgctagtcttggagccttcctgtgttgccgcgtatgagaatcctgcccctacgggagaatccacaaaaattatgttgctcacctgcaaaaccatgcaaaattcatccattaaaacctggatatgggcacatgcctttttttcatttgagacagagatacaaataatttgctttgttgccacgtccattaaataatgtaagcaaccttagtccaagtctctggttgatagataattttcggcaatcctccactgtaataccgttttgcggcgaattggaatggtcctataaatgtatgcacatgaataatctgttaaatacaacaaacgttattgtaacatgacctataagcatggtttaccatattgtttatccgaaggaactcggtggaattttttcaataatctgaaaaaaataacctgctagttaatttacctatctcgtgggttaggccagagagactagaacagccaggcccacctgatagccacaataaaagtgggtctacatcaggatccttctctgactggacaaagtagtagaagagacgcacgcccgtactctcgttcacctccacgtatctgcaagagtcatatgtgtgcacacatgatatatatgga

SEQ ID NO: 2952 - DNA, 18449 bp, Oryza sativa
  unsure (1)..(18449): unsure at all n locations
cataggtgaaagactagcactatgatgtacgtatacgtgaataaaataatttataactattatgatcgttattgcctgcacacacatttttatgatgcataactctgtcaatgtgttgaggctattggattttttaaaaataatattatttgatggaaaatggtaaacaataatttctgcctcattataatcgtgaaagtagaagccaatcgaactcgtgtcgtgataggaggcttgtcgaacagcacaagttcgaccgagccatattgaccgttggaaacacggcgagccagaccaatcaaactacgagtggtacaataggggcttatcgaactttgatagttctactgggcccacaactaacagccgcaggccctgtcgaaccacagtagctcgactggccccagcatatcccatatcgaacaatgggcattcagtacaaccctttaaattccttccccacagctcgacaagggtcattttgatctgtagagggaggactagttagagggcagatcggcatctgcaggggatggggagtgaggagaccacacctgcggatagcgggagaggagcggcggtggaggcccttcctcaagtgatattaaattcccaatccctaagttacatgtttgatgttagcacaggtttaaattagttttactagattagttagagtagttaaatttgaagttagtacttggtgagtacatatcttttttagttagtattaatttattattatagtgaaaaaggtttttgttagcacgtatgtgactttgtgcttagttggtggtagtaaaaattgacacggagtattaagttgaagttgaacgtattttaatgaagttgtattgcatgagtaaaaaccacatgtgaaattattgggtagtaccatggtaagacaatttttcatgttctatcaagaatagatttagaatgatttaggccaaaagcttgctctagttataggataataggatggcaattcaaagctttcaatctcagcctcgctcaaacgaaaaatcctttttgcatacggccagatcaatttttcgcatgctcatgtggaccgcatgcaaagataaaaaaccaaaaaaattgcaaaaaaaaaatcacgccggccgctcccgctgtcggtgacgtgccagtgtcgcgccgtccggtcccgccgtcgaatctgggtaggaggagccctaccgcccgctgtcaaccgctgctaccgagccgccattgcgccgtccacttccgccgccggatctgggtggaaggagccccgccgctcgccatcgcccactgctgccgagcgggggatggccgctgccaccggatccgggagggagaagccctgcctcccgccatcgaccattgctgctaagctgctgtttcaccgtctgctctcgccatcacgggagccgctgcggacaccgctcccgtcgccgaattcgggcaggaagagtcctaccgccagccatcaatcgttgttgccacctcgtcgtcatcgttgtcggtggctccaggtgaggaaagggatggtggcggcggcgcggcccctagccaccgccttgtcattgtcctcggagatgaggaaggggatggcaggcggcggcgctgccgtccgccggccgcccactcgaagggagagagagagattgaggagaggaagagagaggaggagaggagagagaaatatctggagagggagagagcggagaggggtgaaaaaaatttgaagtggtgaggagggaaagaaagaggagtggagaaaaaagagcagatatttttgcatgcggaccattttaagggcccgcatgcgcatgcggcccttcaggaggactgcatgcaaaaaaatattcattttcgcacgcggctccttaagacgtttgcttgcaaatattgatttttgtatgtggatctcttaaaaagctgtatgagaaaataaatgttgatttttgtagacacggtcagttatggttcatctgcaccctaacgtggatctcgtccaggaaattcgtctaagtagtagtgtattgctactgatagtagtgtcaattgttctgccaatgctgtcgccgctgttgtttgtgaaggttaataacttatatttctgttaaacagttttgtcacctgtgttgttatttgtcactttgtcaatcgtgttgggtgctggtcgtggtcggtatcgtgaactatgttgggttgtaagtgaattttttgtcatatttctttttagtattcttaacatcacaactggagaactgatctttcgtgggtcatgcaaaaaccacattagtcccggttcctattcgaaccgggactaaagatcatcatttttagtcccagttaaaaagcgcaacgggactttatgatctttagtgggactaaatatcatttttagtctcagttagaaaagacgtcaggctacaggatgtagcgtgtcaggccccaatatctttagtcccggttgtttacaccaatcgggacgaaacatcgagaaaatcacgccgagccacacgcctccccgcctcatcttatctccttcacacgtctcctcctccttaactctttcgcacgcctcctcctcctcctccccctccttatctccttcgtcgctccacctccactcctcctcccggcccgcttcacacgcctcccctcctccccttcccctttccgtcggcggcatgcgaggcggaaggcgccagcgggcagcaagatctctcctccccctctcctctcctccccctcatccccttcccctctccgtcggcaaagacgacggcggcggcatcaggcggaacagcgttggtggcgggtggcttgccaagccgccggggccctcctcctcctctcccccatctattgtcggcgaggaggatgagaagcaagagcaaggaaagaagagaataaagaaaaaaaattgtgaatgattttgttgtagattttgtggatgattttgttgttgcattcgatctgtgatgttaattttgatgttgttgcattcaatatgtggcattggaaaaaaacaatatgcaagcaacaaaaaagcaatggaaaaaaagaaaaaaaaactatagtccgggttagtgttaccaaccgggactataaatggtagcgctagccacgtggcgctactatctttagttcagattgaagttactaaccgggacgtcccggattcggggtcccagtttacaaccagggacgaaagggagttataaaccgggactaaaaaccacatccccaatattcatcttccccaactgtcaatattttgcatttacatgaacttaaggatgatgctacaagctggtgctaaatgtgttgaatgtttgcaacagccaacaatgcaaagaatatagtactagtcgatcttttgtcggtaatctcattgttttacccagttatagtcctcatatttttttataatatattccctccattctaaaatataaggcacaaccacccttaatctaaaggccaagaaataattattatcagcttgtagtttggatcactctaataaatataatgcatgcatccaatagaattagagaatgtgagagtaaaggatttaaaaatgtaataatttaatggagaagatgccataattaattgcatgcatgcatgccttatactatggaacatcttaaaaaaagtggttgtgccttgtattatagaattgagggagtaatatatagatagctacatatagatatcgtataatctaaacggagaggcctctccgtttagtcatatcgcgagacacgcatgggagccgtcgatcggtgcgcgggcgacgtggctttcatccggcgcgcgcgcgtgtcccgaccgcgtgtcggcgtcccaatcgagcgcacccgcaccgcttttctgtccaaccgcaagagagagagagggctttcactgttcaaaattttgggtggcgctcgagagggagaggggtggagagagggagagaggcggaggcggcgagaatctctagcgaaatcatcggtggaggcagcggagacgttgccgcagcggcggtgtgggaggcgggaaggtgcgcttgttttcatggcgtcgcgccggcggcggacggaggcagcggtttttttctccacatctcgccggcagttgtggggggaagcggaggctgcggcttaggtggttttctgtccaccaaatccggcggctgtgctgtaaggtgaggcgtgcatagaggtggttgccatttttttttcagctggggagaggtcgattgatttttttttgtgcgatttttgtgccgggagaggtggagagacttttggtagtttcactgcacaatttttgtgcgcgatttgtgtgtgatttttgcgccgggagaggtggagagattttggtagttttcgcttcccatgtgtgcgattttttgtgctccacaaacggcctcttggtttgttttctccccctataatagctctatcccctcatttcccctctctagctctccctcatttcactccctctctatctcagctaagttacttccaaaatgtactgacttacttctaaacacataaatgttacttcctactagttgttaagttgtaatttggttagtttttggtgaaactaatatttaaaatgattttataggaatggctaggaagaaatccagtactgttaacaagtaattcagtacatattgtcattctggaagtaagttagtactgtttagaagtaactcacacattactaggaagtaagttgacacatttgcagagtaactaattacagttttgtgttgctgaaagtaaatcagttttgtttttgaagtaattcagcacatattgtgattttctagaagtaagttagtgtatttctagaagtaacttacacactactagaaagtaactttgcataaaacaaataccaacagaagtacctgaatagattgcccatgtctgtttttttcgaagtaagtcagtgtagtttgggaggtacttctgaatagattgtccatatctgtttttttcgaagtaagtcagtatagtttaggaagtaagtcagtgcagtttgggaaagtaagtccatgcaaattatggaagtaagtcagtgtagtttgggaagtaagtcagtgcagtttctatggttttttggatggatctcaaaaaaacagaggatgaactttatgtgtacctgtgatcttttttttttggatctactatactttcttctcctcatcaacttccaagttgatggtttcctcttcctctcccctgttcgtgcttttctgatttttttttcaccatggcggctgcgtgtggattgacgccgccggctgtccggatttgatgggttggaggggggaaggaggcgcgcagcgctctgtcctagccgggcccatgccagctataccatgcgaagcgagagccgtgcgttgcacgctttcctcttttggtaggggcgcgcggttgctttttctggcaggggcgcgcgtcgcgcgatagagctatcgcgagaccgatttcggtctagtcgcgtcctatagatatatatactcgccgtattgacgtattgatgcttttgagacccgtaacgcgtatctctgcatatcgcgaatcaataagaaaaaaaagaagaggcatatcgcgatcggaacaacagtcatgcgcgcattgtatacagtatacatacccggtctcgagggagaatggcagtgggccgtcgaatccaggaaggctcgtcacggcgacaccggccgccggcgccaccgtcgccgccgacgaggcaacccaacaaacgaagcagcaggcgagaggcagcagccaccaccaccacctcctccaatcacggcggctggtgcttctcctcgcaaccatcgcgcttgcttcctttcccatctcggctccgtaagtacaagcaactctatgtcctcatgctaacgatataggagtataaaaataatgccaggttacccaaatcgaatttatggtatcgaattgtatttatttgttgtattgattacgttggacacgtagctgtattgtatttatatcgtatacgatagtgttgctgtcagctttgattaggcgttcttttcagatttcagacagctacattatggatgttcaggccctgcttagatagtaactgaaaatttttcaccctgtcaaatcgaacgtttgaacccctttatgaaatattaaatatagattaaaaaataactgattatacatattgcgactaatttacgggacaaatcttttaagactaattgctccataatttgacaatgtggtgctatagtaaatatttgctaataacagattaattaggcttaataaatttgtctcgcggtttactgacggattctgtaataatttttttattagtgcccaaacaccccatgtgacacaccctatatagtactcgatgtggcacctgccgtcacgatcgacatttctagacaatttcaaatgcactgttcacgtttcatatttatgctgtgaagatttgatgcatgggaggatcgaagggactattggagtgtataaagtaaattgcccgtctttccctatcagcttaggcttttaagtgcaactggctggtgcatgcaacttaatatggtatcannnnnnnnnnnnnnnnnnnnnnnnnnnnnnnnnnnnacaattaaataaataattgcagcccactccaatattccacgcttaagacttgagagggtctcgtgtgagggggagtgttggagtgtataaagtaaattgcccgcctttccctatcagcttaggcttttaggtgcaactggctggtgcatgcaacttggcggacctgacaatgacggtgagggagacagccaatcggagacgatctcccccagagcggcggcgacctaggcggagacaaggccgtccgtcagccgcggagcccggcggaggtcgataagctgacggttgccatcggaggtaggggcggtggaggtaggacgacgagcaaaccgatgatgaccggacctgacaatgacggtgagggagacagccaatcggagacgatctcccccagagcggcggcgacctaggcggagacaaggccgtccgtcagccgcggagcccggcggaggtcgataagctgacggttgccatcggaggtaggggcggtggaggtaggacgacgagcaaaccgatgatgaccggagactcagctactgctgcttgatgacgatgcaaacgcccaagagatcgatctctctcaggacatcgacttgacaacgcgaaggaaaaaaaaacggtggccgcccccaggagattgaaaccctcctgggggcgacgagtggaagcgtgagagagaggcgactagatcgcccgctctgatactatgttggatagtataggagaggtatactgcgtatcgtggaacgattgtattgagcctcaaggagccggtatatataaaagtacatggggaggagataaggaaggattacagatatggaaggagtccacacaaatcaatcctatcctaatatgactctaactaccatatactctaacaagaagacattggcattcgaatatttgttccagactgacgaacactgctattctccaagtcgcaatcgatcatcagtttatcaatctcttgtacgttgtcatattggcacaccagtttttgaggtttccttcggtttgaaataccctctgttttatactccctccatcccactatataagcgagcaattttagaggggtgtaacacatcttacaactacaaatatctaaattcgtagtactaggatgtgtcacatccctcaaaaatcaggacggagggagtattaaaagtcattttgacttttttaaccaaattttgttaagtttgatcacatgggaaacattaacaaaatctaaaacactaaattagttttattcaatttaacattaaatatattttgataatatgtttgttttgtgttgaatttactaactacattttatataagcttatcaaacttactaaaaattggtcaacaaaaaatcaaaatgagttgtaatatgaacgagggaagtgttatactagatcaccatagaagtttgttgaatctctctcttatacctattggaaataaagatttgttatatgacccatgtcataaatgtagttagtatatggcatggatgagagtccacatgctatatactatgagtaaaaaaagttaaatatcccctcggaagttgatgaggagaacaaccactagcgcatcaatcttttgtcggtggccgccgccccccgacagtgaacttttatgatgctggttggcccgtattaaattgcacatgtgtactgtgtactgcaacgggaaagaccagcgctaaccagcatcattgccaatttttggatcggctgtgcacagccaccagtgtaatctttcatccatgcaaacctgtattctcgaacaagagtcaaatcatttcttcctactatatagtagttggtagaagttttacggtgttaagagatgtagaggtattaaaaaatagagaaacgtaaagtaattaacttgtaaaacaagtgtatttcattgaaggggattattgtcaactcaatctaatcggtagtaggtaaacgcaatgtaaatcactcaatcagttatttagatcggtaggggaaagaaagaacaaagatcttgcatttagtttgttagagtgcgtagcccggctcaccaaccgtgggccacacaggtcatattgggcctgctccaccacaggcccaaccggagccataactttagatcctggacctacacaacctaaaagactagtctgatgggtgaggaccgcccccaccttttaaatcgtgctcccccatcatcaattaccgatgtgggactaaacccaactttccccccatcacacatcgggcccaacaatctccaccatgtgacccatggaaattgttccgggtttcaaacctttggctctgataccacttgttataaaagttagttgatatagcggaacgacgactaaccttcccgatcgcttcaatcattattcacccaagacatgccagatgacgacacaggaaaacaaaaatatttgttaacgaggtttagtcgaagcctacatccccggagctctgattatgcgcgctcctccccaaccaatatagcttctagccgctacgagtccatggccatgccgccatcgtctccctgtgtgtctacgctacattgtagtcgccatggttatattgtggtgcgcccctctctatttaagagagatgccggattacagagtccgactgtaactccaccccctaacacctattacaactctaagtccaactgtaatcaaataggactagtatattcgacacctattctaacaacacctattctaacatagttgtgttgaagtgggttaaaatctttacttgtttgtggctaaaaaccataactcccgaattcctgtttcccttatctaccattgcggtctgtgtcaagtgcggagactcgaacggtatctgtatgacagcgggagacgaccaacgatagcaaacaccaagtaggcgtggactggcgatggcaactggcatgtgcttgttcaacggtgagggctttggcaactaacagggcagccggcggcaactagcagtgaggcaaaggcccagccaagcaagattcagtcatattttaactgatgcaatcacttatattataatctatcatatttttaggcacaatacataaatctgaaaaaatcacgcaaataatgtaatggatatgaggacgaattaacccatactgaagaattaccaatactacccttacctatgtatctatcactactgtcaaagacaatcctactcttacttattgaccagtaaaattatctttttatccttcctatctaagtatctcaatcaagtataagtatcttttgcatactacctttcactacgaagtgttggttctttactttttatttttatgcaaacaccattaaacttcttcatagttggaacccactgtagagattatgccaaccgtttgattgatacatctttcttctcagccattaggttaacagaaaagtacgaattgcccctgaactatcacggccaatcgatttacccctgtcgatgtttgatagtcacgactagggtatttggatgtatggggatcgttggtactagggtatatgcgagattgaggtaaaagagatggagatatggatttttatataggttcgggccccttatttgacaggtaatagccctacatcctgttggccgaagccggtgttgcttctttattcatctgaatcatacaagtacaacaattgggataacccatctagctgttgttgacttggcggctagataaccaactcgtagtcgacgacaaggtagtcttcctcctcgaatatgaactcgtcgagatcagagatggcgctagatccctctttctggccttcgtaggcaccggatggggtatgtctaggctaatctctgatgtcgagatctggcggcgtgtgttggctttgtgtatgttgcgtcttgtggctttgtggcatcttgtggcttcgtagattatggtgggtgtgtcctctctcctcctagaggggcttgtatttataccatggttgcccacttgtccatgtaagactagagagaccaatatggatacaatccgattagtctttatcgtttccatgtagaactatatttgtcatttcttatccgaaactccttttatatacgaggtttgtttccgtataagacatggtatgtggtgggccctgccaagtttagttaactactattaggtttgtggtatccataaacatgacaatccccttaaactcgaaaatcagacatcgattaccctgaactttcaatatcgaataaaacacccttttgcgagcggtttggggttcaactagcatacgtgacagtctagtcagtaattttttattttaaaaaatagtggagcccacctatcatattctctgttctctctatcccctctcacctatatgtgtctctcgtcgcctcgtcggaggctcagcactctgcttaattacacactaattccaaattaagttgtaagtaatcacgcaaggcaatgagcatctctaatcgcttcagctggagagctcgggagcttggacacgatgctggacatggcgaaggtggcggagccaccaacgacgcaggcgagggcgaccacggcctggacggcgacctcccttgggtactcctccgtgacgaggtagacaacggcggggccggcggcgagcagcagcagcgcgacgccgagcagcgcgccgggtgtcccgtggtcggtcgccgccgatagcacctccagctcttccgccttgtagagcaaacccagccactccaccgccgacagtgacagcccggcgcgctccgctgccgacaggagcaccgtcgtccccgccttcgtcagcagccgtagcttctccacgttcattagcagcttcaccggcggcgccgccgccttccagctcgtcgtctggcgtggccccggctctcccaacgggaagtacactgtcgtcccttgcaccgccgctcgccgctgttagctagctcgatcgatctacaagctcacacaccatggggaagaagaaaaatcgctagtcggtcagtcacttacccttcttgtgccggaggtgggcttctggtggccatggtggcgaccttgtgaatgcggcggtggctgctcagcctcgccgcggttgccacgactttgccgacgacagtgacggcatcgcctctcacctctctgtctcagttagaatttgtgtcgaatatgtgtacgtagtgagttacaatttaggacttggagttgtaataggtattaggactagagtatgagtcggactctatcctaggatctctcataaatagaggagcgtgcctgttgtaaccgcatggcgacttagcattgctgtaactctgatacgcacggctgccggcggcgaccggccgtgagtcgttgtaactttgatacgctgtatatgctggatcggggaggaacgcccgtaatctgtgccccggagatgtaggcctcggctgaactccgttatcaaatatcgtgcctcggtgccgtcatcgtgtttggatctcctatggtgtttattccgtgttttgtttccgatgtgatttcgggccggttttaaaaacaagtggtatcagagcctgtgggagatccatggtaacggtcggaaaaacggcaataagcgatactctcggagacacgggcatggcaaatccgaaacaataccaaatattccggacttggggggcatgtgttaataaccaaatttggtaatccaagtatcggagatgaagatagggtcaaagcggaatttgagatggaaatcgttccggaaacagagtaaggatcggctggagtctgaatcggctgcgactgggatcggcagagtccgagttggacaaagttagccgattgagccgaatccaacaatgtgacatggtatatgttgtcaggttgggttaacgtgcttcatgaggattgctacgcacggattgagtcctgagaaggcaattgtatctactaattaggatatttcatgtaatttccttagagatatgtttgggcaaaagtctgccgcaaagacttatggtatcttagagtttgttagagataagagtcatgtccgacacggacatattttgtaatctcgggtataaatagaccccaagccccatgtaatataacaacacacgttcaatacaatctttgcgcatcgccaccctttactttcattttgtttcgacgagttcttgctttcgggttgagctgcaacggtttcgatcttcaactacaagtaaaacttgttatggcggtttgcgttctcgggattagtgcttccatctttatgatactctaatcttgtttatgtaattcgtcgagttatcatatattctatataatctctaccaatattgtcatctaacctccaatcggctaacgtctgcaactagaaggtagccgatcaggttaaatactaatgttgacttagattatataggatatccaccactctatgaaacaaccagcggcttgattgtctatatattgttcttcttttcatacttatagctccatcagttgagtttgaccttataagtcgtgattagaatctcaatctctagcctgcttttggttgccgattagggtagcatcagggtttcagccaatcttacctgatttaactacttttatcctatatgcttgattgacatgttaaatctgccctttatattaagatcttattgcatttaagtatatttaggcttttgtttagtatattctacttgctttaatatcttaatatagagtagtatcggagtattagccgatacatgctagatctatctgatcagctatgctatgaacatatatagtcttgttgttaatatatatttcgatctaagtgatttatactgtctcggcatggtaactgatctatcccaatcacttgatttaagtatatatcgacataagaattatatattgttaacatctatagccgatcgaatagatttagttctttcttatttatccatgattgccgattaattcacatatgacatcgtctcaaaaataaatgatatgtcatcggcaactagccgatcggctatcgtttatggatttaaccgcggtttctttgtctttatttcttgttgattgcaggatcaaatcaactggcacactcacacacctaaaggcaagcttttgggcctgcattggagttaagcagatctcctaggcctcgtgtttttacatcaacaggctatagcgtcacaatgccgaagtgggaggagatggaggccagcttgattgagaggggtatcaaaccggccaccgctaaatggccggatcgatcgaagttctaatactatgctcacggtggaacgcttaaccccgttgatggctccctggtgttcagcgatcagatacgcgaggctgccagtcgactaacggacgcagtggaagcctcttctcagggcacgttccgacccgacagagagaaggacgagctgtcactcgccttgaagactcccgagcattcgggaagaacacgaggaaaaggcatggttccttggaagattggattcaaggaggacatccacacgtacaggagtcggatgaggagcaagagagatactgaggtgaagattgcagatcttgagtacagggtatcgagctacgagctcagcatgaaagaggaggtggaaaggaagatggatgaacacatggccgcacatcggtgccaggatccccagtcgtacattcctcctataatggtcagcccctcagggcaatcgtagcaactacgcctcaacggggcaggtaggatcacagagcatggatgccatgcaaactcaggatgaaaccacctgccccgttgatgaaatcatgcagcggacaccatgtgagctgcatattcccttcaagaacttatcaatcaaggtatgcccgtagtattatgttttttggacttgtacattccgcaagtttctgcctaggttgattactaatagataacctctcatcacgtgaaggttgcatcaggaatggccatcccaacggacccttcagggacttaccactgcaggccgattcctgcaggatacttgagggtcgaaattgagctggtggaagccacgtacgaggacctcgagttggagtaccctagaggagacggtgagacgtatctacgcgacacaagccacgccattatactatggcgcaagcgctacatcatcctccctaggcgacaagcggcgtttcgtgcaccatcccctctggctccaccgtctcctcctcaggctcctccaccgtctcctcctcaggctcctgcactgtctcctcatgattaggctcctgcaccgactcctcctcaggctcctgcaccgacttctcctcaggctcccgcgccgtgtcctccagcaccttccaagtcaagaactcaccaagctccaccacctgcccgcacaagggcaacgaagaaggcgaaagttgatgccgccgagaacaaggagccaccttacgactgcacgcaagaggagcttgacgcttacgtggcagcagaagtgaagaggcaattgaagcctcggagtctagaaaagaagattcctatacacccgagtgccaagaagttcttcaggggtatgtcggcaccagtcaaggaggccataaagctaacggactacaagcgaacactaaagaaagcatattatgggaagtccaaaaaagtccctcagcttggagagcaaccaagccaggaggtcgagccgttggtgacctggcaagaaattggaataaaagaattcatttctgacactgggctaactagggctcagttgcttaaaggcgaaccaatcccaaaggcggaagtgagacaccagtacgaactcggtaaaccgcttgtaaagcctgagcagctgcagtccctaccaacacagatgtacaaattccatcaacggtacatggagatgagcgccagcggtagggagattatcggagcgaggatcaagaacactgacttcttacaaggggaagatgttctctggatcaatttcaaggatatctacaaactataccagctggacgccctcgacgtctctattctgagcgcatggattttctaggtatcgttgagttatatttcttacattcctttaattagctccttgtatatatgtacacctcatataacaattcctttatatcgttgtagaatggagattcaaagggcccgacggcggggggtttttgatactagattcatcgaccctcggaaaataaacgtcgaaatggtcaccaagtatccgcaagccacagaggacaatcttgaccatctcctcaaggagtagcatttcaagacgttcatactactgtcgtacagcacaacgttagtttttactgtctaccgaacaaatttcgttcctgtacaaatagatgtacagtgtttcatatatcacctcacacaaattgcagattccactaggtccttttactctttgacttggaggaatgcagagtcaatgtctatgactcaatgaataaagatgagtctacttttgaccaagtttttgaacttatagacaggtaatgtcatatattccagtgttattattacgaattttgctattgctagtacgaatcatatctttaaactccatgtagggcttggtatcggttccgtcatttggtctgcgacacttggaaagaaaatttttcgccggaggttcaaatttgcattgagtacatgatctaaatttatattcaatctataattcaaatataagtgtatattaattaaatctctcgtcgtttgtgatgtatgtagtgtgcaaagcaggaagagggaactaacttgtgcggatactatgaatgctagtattgccactgccttacaacccaaatcattgccacaagagagctcgatgtacgtaaaaataaatcattcaaaatttcattgcgtacgtattgatttcttttatcctaattaatttcatacattcataggttattcgcatgagggataacctcacacacaaggaatttatcgcggcggttcaagaacaactcatgggattcatcaacgaacgagtccttgatcccgagggtaaattctactacgatgaaaatacaattcataagtcgttagcttctgagataacgactactacgtcgaagtcgaagctagctaggacataatgaattgtaattaatacatgtctatttttacatatgtacacatttactttaatgtaaatatatattttggttatatatgcacataaaatattaagtgctttaatatatacatatatatatatatatataaccatgcagcaacaagcccatgcaaataaaaaaaaggtagctcgatatttagtcccagttggtaataccaaccgggactaaagacgactcagccagccacatggctaacccatctttagtagtcccggttatttcacccaggactaaaaataacgatctttagtcccggattcgtagtcccggttggacaaccgggactaaagggtggttacgaaccgggaggaaaaagggtttctccaccagtggatgttccacaaagtatatcggaattgtttcactaagtatatcgaaaatgtttcaatcgtttaaatcgggcgttgtttcaccatatataaacacaatgtttcagcaaatagcgaaagaatgtttccattcactccaacatttgatccatacatagtgaaacattataagtgcactagttgaaacatttgtggtggaaaaaaaaagaaacgaattcccttaatagtgggtttccaaaatatgtgggtgatttgttaaaaaaaatgtttcagttcactgtaatatttgatccatatatagtaaaacattacaagtacactaggtgaaacatttttggtggaacaaaaaataaaacgaattcccttaatagaaggttttcaaaatatgtgggtgatttgttgtaaaagaatattttaatccactgcaacattagatctatataatgtttcaacattgtaagtacattaggtgaaacatttttttggaacaaagggagggacaggtgggtgcacccagcggggtgcgcgtgttgggggagggggagcgaccgatttcccccctcacccggtcgaccgatcctaagaattttcgtgcaaacgtgtcacagtttttctgttgttactaattaaatgctaccatcatgtgtattactactccctccgggttgataatacttgttgttgtggacaagggcacagtctccaaaaaacaattttgaccactatttttcatcataatatatataaaattgttagcaaatatatgatcttattaaagtattttttaagactaatctatacatgtagtcatcatatttggaagacaaatatttttaaaatgattcataatcaaagattctagagtttaacttcactcttgtccaaaacgacaagtattatcagcccgaacggagtaattattacaagcagcaaatctttattttacctctcatatgatcgtttgattatgtttttacaggtgacttgaacaatatacgtcagagaggagtgcctgaaatccatcttgcaaacatctcttgacactccttgggtttatactctgcagcagtatgcccagcgccctgcattggtatacacatatgtcaagattataaatattatatatccaaatcacgactaattgtatcgcttgttttagtatattgatatttttgcatgaactaaaaaaatactctgtatatatatactctaataacatgcatatatgaaaatgcaccttcacagttgcgtatgtcaggttattactcnnnnnnnnnnnnnnnnnnnnnnnnnnnnnnnnnnnnnnnnnnnnnnnnnnnnnnnnnnnnnn

SEQ ID NO: 2953 - DNA, 5428 bp, Oryza sativa
  unsure (1)..(5428): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatagattactttcacaagagtggtcttgcccaagcctccaaatccgaaaacggagacgatcttcaacttgctctgatcccccatggacagcatctctatgacctcatcccttggtccgtcaatgccaacaagctttgttgacattgcctttgtgtatggatcatgggtaggatgaccaacagcagtgtaattgcctgcgccatgcttggtagccacatatcgaagtcgctgcttcgcgacggcgtcggagaacatctgaccgtactccacgctcccattgaacagctgatcattcatcttcgccacgaggcgcatcagcatctcaaggtcggcttgctcggggtcagagccgacacgcaaggagatgaggacggtgtcgacgacgtcctccaggtcgtaggacagcatgcgcacatcgtgagcccagagcctgacctgctcgtcaagctgatgatcccgtggaatgttggccaccaagcgtagggtggtatccatggtcttgagacccctagagaactgcctgacccggttccttacgccctcctgcagctggttctcctccaaactgagcagctcggccagcctagagagcaggctgcccatcgccgcggttgctagctccatgctcgatcgatccccttcttgacacacacggcagttggttgagatgattaattggttacttggatgagtgatcgcttagctcctctcgccgttctatcgccaatatttctccaatatctacagaattacaaatgaaaggcatttaaggaagtgaaattcataaagagaggtagctatgtggaattggggaaaaaaatggatgaacactactcaccaagctaacagcaaaccaccatatgcaatttcatcgatccttaatttacttttgcttgtgaatagaatcagaaggttctatcttcttcagctgaaatagtaaagatatagaagctcacagttttgttgtaggtcagacagacgaagctaactgatggatgcgtgaaaggatgatttagctatattgtataaacacacgcatgctgattacaccaatctcgatctgtactgtattattataatttttttcaattggtgtactgtattgtaagttgtaacgccttgagaaattgcatgcaacaatacctccttgtttagtgattaacccttacaaattttgcatatagggactccaatttcacaaggataacagcaaaaataataaatgcataattagtcctcagtgcattatattaaatatgtgcaaaaaagcatccatgttgtctataccaattttttatggaaatctataatgcctattatctggtgagtcaagattatataactgtgcagattgcttgaatgtataatgaactaataaaactatataacgattgcatacccaattctatgatatagtcttagtcttttataaatagaaagaagagttggcacacacaattctaataatctaataataaactataacctatctttgtgcagttatgcggaaaattaatttatctacctatctgaatgcgtatgtaatatcattatattttctagtttaccaaatataagccattagggtatgcctctaaatttaaggagtaaatcatggaagactttctagtattccatttgtaatttaatttttcagcttactttttgatggatgtagtttcagcttattgcgtcttttcaataaaccatgtatatatatttacaaaatgggaagccgttatattgctaagttaacgtaaacagcccataaaaagagttaataggaataataatattgataagcaagcacgtttgctctcactacagaatatttatagcattaggggtacggtggatcaagattttgatgggagcagattgcaaaaagggataaaaaagtgattcaattcatcgagatatccacagttccacactaaaaagtaattgcaaattgctttgaaactactagcggcccaccgataactagctagctgcataaccacaagtaattttcaatggggcagattgcaaaaaaggattataataaatgatttatttagtattactcacttaaaaaggtacagttggtctgaaactactaccgacccactgataacaagcctagctaacaacgagtaattattccagctgaaaaattgaagtacgaaatacgaagtcaacgctaataatatatatccccttgctagcccaagagagggatctatggttctttctcttattatttttcttaaaaataaccatagctgctctccacagttcatctatcacccgaactaaccctgatatcttctactccatggctccatgccagctatatttttctgtgctctctttctcatatccaccaatttccgcaaggagagaaattaatcagaagcggcgagagaagaatcaagcatgagaagaattagcaatatccatcaatcaagtgcaagctaggcagaagtgtgaagtttcggggatggagactgctgtgctgagcactcttctgaacatgctagggccgaagctctacaccttcttgcaagagaaccatgagctgcggcggaacctggaacacgacatacggtacatccggaacgagctccggatgatcggcgcggtgatcgatgagcacgaacgcgggcagatgaaccacggtggccctctgcagggggcttggatccatggcgcgcgcgagctggcctacgacatggaggactgcatcgaccgcttcatgcaccgtatgacaagtggccataggctcgccacaatggccgtccgcaccaagtttgccaccgtgatccagaagctccggaagaaatcggaggatctgtctaagctgagagcaaactacacaaccgctggcaacggcaatggtgattgccaagcaagcacctccgggaccatgtcgtcatttgagacgacacatatccccacagctgacaccgtccctgtgggaatggacgggccaagggatgagattcttgagctgatcatggaaacacaaagccagcccaatcagctcaaggtcatctcccttgtcgggtttggcgggttagggaagaccctcctcgccaagcaaatctatgagaacaccaccatttgcacacaattcgaaccacaggcctgggtttccgcagcagggaagagtgcgagggacgtcctcaaggagatactatgccagcttggcttccaatcgcaagcacaggaggacgatgtcagcaagctcatcacaagtctgaaaaaatgcctccactccaagaggtaagaaatgagaattcattattcatatttctgggagggtattctctcctgtaatgaatatgtgaaggtttaggacaatatttagtcaaactttaaaactttggttataatatttttactagaacagttttataaaatctaattatgatagtactttttgaaggcggatatatgcataacgtttctttacaaaccaggcatctgataaattattcatagccaaaaaatcaaataaaaattgactacattttactcgacgagtaccattaactatataataaaaaaatccacgtgctcactttcttctcatgttgtcattataacatgactcaacattactaccaaagcgtttgtctgcattttaacatagggcaaataccacctcttcaatatgataatctgatgctgctgcaaattacacaggaatgaaaaagtcactaccacaagatggaaagtttcccgagtgcccacaaacacgggaaagttcatgttcctgccgaagtgtgtccgttgccacccatcttttcatatgtcacaaatgtacactcgggaagtctatccatcccgtgtatagcattctgcacacggaaacgtctctttggtttctaaaatactccataatgttcaggacactttcccatcctggtagagaattgagaataatatatacaatccaatattatacatatagctcagtatattaaatttctcattctattgttacaactactgttatttgtttcccttacacagcttcatcaagcgacaaccataaaaattagagtgttttcatggtccttaaggagattgttttaacactatctccctgtgaacaatagacaatgtcacagctcctaaagagcagtaaagagctctacaaattaggctattcacttctttgtgacttgcatccgttttcgatgcatatcttactcagaccactgtccgtgctactagttacaacttacaacatcaatgcttgaaaaccagtatgaaaaaaaaaaggactcataatggcaaaacacaaatcaaattaagaagcaatctgctgaaatgacttatcagtggctaaaacacaaattaaggttgcaatctgcagaaatgacttatcgatggcaaaaaaacaaattaaagttgaatctgttcatggactaattccaaggtacctaagatgacatgaatattgcacatcgagagtgaagattaaataattaagcatagggaaaaggacaaattaacaatgtaagaatatttggtgcaatcagcacaacaatgtctggccttattagacaattattagtaacactatttcatggttccgagaactaatagaaaagaatatgcctaaccatctagagtaaataacctagatgaacacatgtaagacaaaagaaaagggacaaaccaaaagttgcaaatgcagcctacatgtgtggtaagtttaagctatggattatgtaagtttacatgactaataataataagaaaaaaactgctattaccatgtctactaagcactgatccatttaccttatttctaaatacatctctataggttcttcattgtaattgatgacatccagagggaatattggaacagtactataaaagatgctttccctgtagatacaggatcaagcagcatagtgctggtgacgacggccatccattccatagcaaatgcctgcagctctggtaatggtcatgtatatatgatgagcactcttgacaaaaaatactcaagaaaactattcttaagagaagcatcatggggtgactacccacctggttcagaaacagtgctgagtactaaatgtgatggtttaccacttgcccttgtatcaacagcccaattcttgaaaagtaaaggtcaacagctaccacaagaatatgcaaagttgtgtggcaatctgggtatgcatctggaaagagaggatactttagaaagaatgaagcatgtacttgttcacaactataccagccttcctggccatgttatcaaggcctgcttgctctattttggtatttt

SEQ ID NO: 2954 - DNA, 8537 bp, Oryza sativa
cttcggagaggcagaagactctgttttagaattctccagttatgaactactgagagttttggatcttgaagaatgtgaaaatttgaaagatgaacatctcaggaagatatgcaagctgttgctgccaggtatttaagccttgggggcactgttacaatgctcccaaaggagatcacaaaactgaaatttttggagacactcgatgtacgaagaacaaagataaaagttctgcccatacaagtcatcaagctgccatgcttgacacatctatttggaaatttcaaacttcaagatgtaggccagaaaattagcaagctacagaagtatctgtctgagaaaagtaagctggagacactagcgggattttttgccaataatgaccaaggatttcctcaactcattgatcatatgaaaaacttggccaaggttaaaatatggtgcgagagcgagaccccttccaattctagcagcaacactattcacctttcaaaggccattcaagttttcatccagaggggcaccaatatgaacgatgtccgctcgctttctctgaattttggggggtgcttccaagaccaagagaatatgctgaagttttccctggaagattcctgctacttaagctctctgaagctaaaaggcaaaataaacatattacctccatttgtaaccttgctgaaaggtcttactgagctgtgtctatcatcctctgataagctcaacagggatgttcttgctgctctaagcaatgttcgctgtttgcattacctcaaactgattacacctaatctggaaaagtttgtcataggacagggtccactcaaaagcctacgacgcttgtgcatcatggtgcaaaccatgaccgagccagaaatccaacagggggctctgccaaatctggagtcattccggctgctctgtaaggatctaaatgggctatgtggcatcaacatccagtacatcggccccgaatgcctcaaggaggttgctcttgacaaaagaattagcgaagaaacaaaaaagaagtggaaggaaacagtgaagaaccatcctagatggcccaaggtctcatttgttaatacaggagaggttggtcagatgcagaatatggaggttgctcagcctacagaggatgctgcagcactggctttggctgccggctccctaaggccggttccggtttttagacgtccaaaggcagatcaagaaaggaccttagatctctgttccatgggccaaacctctagggaatcttgcagcaatactgagccatacttcaaaactaatgggacttcaccaggcaagctgaaccctgtgaatgatgaatgtcaccatttctgctagatagcgagaacatcctctgggctggctctgctcactgtcgtcatcagttactctctttctatctcgctcttcaccacaagctgcatcatggtgacaccactctttccaagttacagcaaaagagtggtgtacagatatacaagaatctgtagttgattacaaatttgactgcacttctgtttcaacattattatctgctcatatcttgctacactgtgcactagctgcatattataatcagtagagcaagcatgtgtatttcagtgttatcacaattacatattcaaatggcagtattgatccataaatttgtcgatttcctagcggttgttaaaattgtttctataaagagtgaaaccctacttgggaggacaattgtgattattgatttccacgagcctttgccgttacgaatatgttacatatacaaaggtatgatgcatatatcataaagaaggaatatgcagcgggtagtgggaatcgaacccgcaaccccacggttatgagctaggagggatagatgataagggattactagtaacctacactacaaaagaacccttctttcgtaacgggtggcaacatacatccgatgacttatctttgtcgagtggtaagttaccactcatcacggatgagtcatccatgacgattcgtagctcatctttgtcgggtggtaagttacaacccgtcatccatgacgattcataattacgaacattcacacatgagaatttacgatttttgaattttaatgcacaaaaaacgctaaaaatattctatacattactaggacattccaatatctatctatttatttatttatttattttagagaagggtatttttttacccggcctctacatccaaccggatatatgtagcctttttaaattagtaagttagcctatcaaacagggaacttagccctcaaataacccaatctgaaattcgctcctatgtgctactcaagtcactgtaaccactaggccacatgccctttcactcgaggacattccatctatggtcacacaacactagctagaaattcatgatttttcaagtgacatttacatgcacgccacagttggattcgaacctaggacctctcagcacatgcaaactaattgtaccatctcatttatagaccacatcttgatgagtcttcagatattaattattcttttgattattttgtccaaatatgaaacaaaaatttgaaactctagatgacttcaaatgagaacgctttcaactacaaagttgcaaatctcatcgagttctacaacttcagcgtagggcatgtctccatccaaggtgatttgaaaaatcaaaaaatattttagaaatagatcacatcacttatagagcatattcaaggatgtaaacaatctcaaaagaaaatattatcaatcacaaagttgtagatctcatcgaatccttgcactttgatatagggcatgtctccatccgagatcatttgaaaaattcaaaagtacgttttccaaaatttatctcaccacttataatccttattcggtcaaatgcaaatgtcgtcaattttaaagttataaatctcatcaagatctacaactttcatataaggtatgtctctatccgaggttctttaaaaaattcaaaatttttgaatttccctcatccgtgacgggtcgtaaatacccttcacggataacgttatccgtgaaaggtggtagttacaacctgtcctggatgactgttctcatcttaaacaggttatcccattaaacccatcacggatgacatgttatccgtgacgacggggcatttttgtgacccgttatagccttacaggtcatccgtgacttgttacaactacgtcccaaaaaagatgacctcatattggtgatggttcatccctgatagtcatatcttaaacgggatacttttcaacttgttagggatgagtcatcccaaatgagtcacattagcccgacacgaatggctcgtcacagatgctcggatctgtagtagtggaagtaaatactcactctgttaaaaaatataaggtgcattttattttgttaggataaggctttgaccatcaattgcttaactaatgtacgatttatgtgatagaaagcataggtataagtaagtagtccattgtgcaatattataaaggaaaaaggatgtagggctactatcctcaagaaggccagctaaatgtgcactaaattatggattaacctcttgaatgtcccatatagatccaatgattgtacccaaattatgttgttattgagcccgcagctacccacggttgggcgtctaattactacagccggggggtgaaattccgtatcctgggttagttcgtttcgaattccccccccccccctccatttggtttctaaacactgtgaacgaaattactggcagaatcgaacggaacaaagagacatcagtttgtttattttttacgaattttcccgggatagaagtttaccggaggagtagacgagacgacgaagctgagcgagctttgccagtcttccgccgccgcgtcgcccgtacggcttgccgctgtgctgcgccgccctacgcctcctttccgccgctcccgtgcgcgatccggcgggacacagacacggccccctccgcctctcgcctgcgccgccaatttgctccgctctctctccggtggacacgaggataatcgacggagaggaggacagcgaggaggcttgtgggtttgagtgggctcgatgggagcacgagatgggccggcctggtcggcccataaagtttttcacaagagtaacaaataataaaacaacaaaattaaattaaaagaaccggacaatctacctaccagtaaaaatgtaaaaaccgaagaaagggattaaaagtaatttattccacacctattatgacgtggaatttattctaactcaattctctctaatccccatcaattctctccaaaccaaactaaggccctgttatttgtttcagtttaagattattgtaatccagattattaaatcatattactctaagctggattataatagaaagaatcccttatatgccactagaatttgaccagttcccttatatgccactcaaaattagcttctcccttatatgccactagttcaagtttttccaccattttatgccactcccaccactatagtgttagttgactgttagtcaaaggttagttttttttcgtaaatgaccaatataccctctcaactaaaaaatgtgtaaacttcaaaaaattataactaatttattttaaatcctttttgagtcaacaaaatttggttagaaccagtgaaaaatgctctttatattaaaaatattgttagaaaactgcatgtttcatgcttatattgaaaatttatttctgatggtaatggctaaaattgcatgtgatgcagagaacatcaattttcatatgttgtatccaatagctatattagtactaaaatacttattattgattgtatactaattcttaagggcaaatgcgtctttttacaatgaagttaacggtcaactgacggtggactgacggcaatggcataaaagggaggagaaacttgaaccggtggcataaaagggagaagccaatttgaagtggcatataaagtagccagttaatttagagttgcatataagagattctctcattataataagctgacatagaataagctgcgagctgtttgtttttctagattattggagacatataagggtagtgggtctttagccacccaataatctaaaaaagctcctccagagaagattattagattatagtaatttggattaatctacttgtttgtttcagtttacttctaataatttagattataataattctaaactgaatcaaacagggtctaaggcctaaagtggatttggggaaaatttatccccccgtgtccgccgcgctcgagtccggccggcgcagcagttcgttcaccggcggcgcagccgccgcagtgttattggccgtctccggctctccgcgcggtcgtcatccgctgtgctgagttccgagggcttcgtctgtgatatgctctaataggcatctatctaagccattggccatcaggtcgcctggtcctccctgctgcttcgttcagtattggattatttcgctttggttttggttaatgctcgtgattcttgtggatgaggtagtgattcatgagaaaatggacgatttgtcactttgttagttgggtttcgacaacatgaaccctaaatcgtatagggtggcattttgtcaaaaacccaacgaacaaagttgtatttagtccattttctcggtgatttattggggtctcttggtaaacaaattagggttcagatggttcagatgaactgggtgttgttactgttattcaagctgtatttccttatcattaactacctggggatttatccatgatatcttctagcataagcattagagcaaatatcaatttaaaatataaatgtgcgactgctgagaaaaatccaattgctgagaaaagaacgtctgctgaatgaaattcttcaccatgtatgcaactttcccctgtcacaatttggaggaaatttggagaatgaacctttgcattgagttagccctgaagagcaatatattgtgtacaagaagaaagcgaaatgactaaaatacccttcaacgtagtctaaaacacttactctaacacccctaatcaaatgcaatgtgtatgtaataatattgcatttgaaaggtataactaaatactaaactaaatccaaagtctatgcgtgatgatgttgtcaaagcataaaaatcataaataatgatgaggaagaaaaaatccatcccctcatcaatgaagtggacttcagtgccttcacaacctgttcttcagcccttagtgcgaaaagccttcacaaactattcttcaactcttcactaattcagagacgatgatgatgacgagatgaatgaccttcacaaactattcttcggcccttcaatgattgacgatgatgtcaactccgattaggagctggtgatatgacaaagatcagctccgacgtggagctactgatgatgacagaaggctaactccgacatggagcgagtgagatagtgataatgattgacaagcatgacttcggctgcgttcgaatgtccaacgattcttggatgaaattttagattctcgtggcacgcttttcaaactactaaacggtgcatttcgtgcgaagactttctatatgaaaattgctctaaaatatcagattaatccatttttcaagtttgtaataattaaaactcaattaatcacacgttactaccatctcgttttgcgtgaaacacttaatctttatcttcatcttcagaagagatggactttgatggacttgatgatatagcaaaaataaatactgacatgtacagcaaccaggccaagaagaagaattaaactaggctaagaagaagattaattctgctaataacatgctccgggacgaattcaacgagatgtaatggattttggtagactagataggaaacatagcgttggtgatatggacccgggggtatcacgtctagagggaggaggctgccctcaaacccacgtggctctccccgagggggatcgagcccgagatggagcggcggttgcctcctccctctagcctcaaacccacgtggctccccctaagggggatcaagcccggagtggagcggcggctgccccctcccagctagagggaggaggccgccctcaaacccacgtggctccccccgagggggggtcgagtccggggtggagcggcggctgccccctcccagctagagggaggagaccgcccacaaacccacgtggctccccccgaggggggtcgagcccggggtgcagcagtagctgcccactcccagctagagggaggaggccgccctcaaacccacgtggctccccacgaggagggggggtcgagcccggggtggagcggcggctgctgtcacgcccagaaattcccgaatagaatttcaagcagaatgtgcattaaaatccccgtccaggaccggccggggtacacaaacgacaatgttgacattcagatccacgtcttacaaacatcataaaagtcttacataaatgcagcggaagaaaagaaagacaacaggagctaagccttgactaaaactacagcggaaacaccactccacaggcatcctcgacggcacagacaaagcctactcctcggagaaaccttcatctgacccgaactcaaactctggggttgggaaaagtagagcaagactgagtactacccactgtactcaacaagtcataccggaataggggtatggtgcagggaatcatcaaagaagagctaaagtggttcatttgcataaagcgagcatttataaacagaaattgaaagatttaaacagttgtaataattaattaatattaatcatccgctgtccaacgctatcccacgttgcgacaggcccagccatccacctaaactatccaaattcaaaagattacactaaggtgagactaatcacggtgaatctggttgaccgcccataaccgcgggcacggctattcgaatagttttactctgatcagaggtgtacaactgtacccacaagacacagccccacaacacgtttccgtgcgccgacatgccaccacgacatatcggaaagaggctgtgacaggacccttcgcctaaccccttctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcggctagaggagagctacactacaagcccagccgttgcccacactggcttgtggtaagtacgataagttcttccagggcatcccgcgaaccggtccttaactgccataggtgcgaccagcaaaaccatgcacccacagcccaccatgtgatttattttaattaaccaacaccaaagcggtgttactaatccaacaaaaccattagaaccaacagtctaaacattaataggatttttccccattgtgaactagttgaactaagcatggctaagcaatccctagtccaaactctaatcatgtta

SEQ ID NO: 2955 - DNA, 2149 bp, Oryza sativa
ccctacaggcaaacattgcaaacaggctataagactactgaaacaggggacaaaaccatttttaatggattctacacatttttcttgatttactgagacttgaatgggcttaaacggagctcggatgaattagttatgaattttagaagattcactgtgtttattactatacaagaaaaaccttaaatcatttattgcgcaatatattccagggctgacgtcatcaaggcggggcgcagcgccgacatgcgggccccaccggtcagcggctcgggagagggaggaaggggcgccggcaagcgggccccaccggtcagcggctcggggagggcggtccacggcggatcgggtccacggaccggggaggagcggcgcaccacgcggcgggggctcgcggccggtgcgcgcgggcacggcgcaaaccggcccggcgaccatggcgcgcgacggcgcggcgcacatgcggcagcggcgcacatgcggcagcggcgcaagacggcggccgacggcgaccgaccggcggcggagagcggcggctagaggtgaagcggcagctacgcggctaagcggcggcgcgacggctaaacggtgcgggagagagagaaagaggaggagaggcctcaccgataacggtcgacgacggcaggcgacggaggacgatggtgacggcgggacgagctccggaacctcctaacgaacaaaaggagaggggttagatggagagaggagagtgcgagagagcgagggcgccggccgaaggcggcggccatggcgtcactcaccagcgcacgacggggatggggctccggcggcgaatctctacggaggaggggtggacgaggtggacctcggccgcgcgaacccaacggcggagacggcgcggtgcggcggcgggtgtagcggcggctagaggcgaccggagtagcggaaacggcggcggcggatgggcgcacggcgcgggagcgatggggaggtcgggagagggaggcgaaatggggaaaaagcgagagggagcgacgggggagcttaaatagggagagagagggccggacgtggccgggagaggtgggaatcgccggccaacgtggaggagtgggggaggtgagagaggcgggattcgaaaatcgaatcccggccatctcgggcgcgggcgcgagcgggagagagaggggagtgggcgcggggaacgcggcgcacgcacgggcgtggtcgacgtggcccggaggaggcggaggcgtggacgcggcggcggtttcgggcgcggcggttgctggcgcggcgtcggctggaggagggagacgggcccgacaggtgggccccacctgtcggcgaccccgagagaggagggaggcgggacggcctggatgggcctcggcctgcggccggcccagcagggaggggggaaggaagggaaaaaaaaaagggccgacagcccattgaaaaaaaagaggaaaaagagaggaaaaagaaaaagaaaaaggaaaaaggattttccctggaattaaaatattgcttgctcaattttaattggttaaaattatttctagagctctgaaaattccactaaaaatcctgttaatgaattttgacatgtagaactcaagaaaaattccacatgcccaatccgattattatttgcattactttcttagggttttctcttgatttgcacctgcattttcttggggttgtttacaaattaaatttggcttgggaggagaacttcggggtgtgacaaacctaccccccttaaacggaatctcggccccgagattcggaggagctggtgaagaggtgcggatgggcggctttcaactcatcttccctttcccaggttgcttcctcttctgaatgatgactccactgaactcggcaaaacctggtgaccttgtttctggttctcctttcgctggtatcaagtatacgaaccggcttctccacatatgttaggtcctcctggatatcaatgtgttccgaatcagcctgttcttcaggtacccttaagcacttctttagttgggacacgtggaacacgtcatggatgccgatcatattggatggaagttctaactgataagcaacttctccccttcgttccaaaattttgtatggtcccacgaagcgtggtgccaacttgcctttcgtctga

SEQ ID NO: 2956 - DNA, 3327 bp, Oryza sativa
ttgtcccaagctccaccaaaatcaagagcgcaagctctcaacatatcttccaagatttgattgacccgctcggtctgaccatcagtttgtgggtgataggccgtgctgaaatttaaatgggtccccaattcttcctgcagcttctgctagaattttgaggtgaactgactccctcggtcagatacaatctttttgggtactccatgtaggcacatgattctcgaaaggtaaagctccgccaaccttttgcccgtatatgtggtatgtactggtatgaagtgagcaaccttagtgagtcgatccacgactatccagatcgaatcgtgacccgatgatgtccggggcagtcccgttataaagtccattccaatctcctcccatttccattccgggatttgaagaggttggagtaaacctgctggtctttggtgctctgccttcactcgttggcaaacatcgcagagtgcgacgaattcagctatttctctcctcatgctgacccaccaaaacttttctttgaggtcttgatacattttagtgctgcctggatgaatggagtactgggtctgatgagcctcggtgagtatcagatccttcagttccttgtcgtcaggtacacacaatctttctcccaaccagattgtgccatgctcatcttcgtggaaatcccgggcttttccgactctcatgttctttttcagctctgctatttcagaatcatttacttgagctgctctgacttgatccacgagcgtaggccatgcctccagagcggctacaaaaccgtgttcaacaattcccacgttgagatgctcaaactcctgccgcaattcttcacacatgccctcgatgcatagggcagtgcagtaacttttcctgcttaacgcgtctgccaccacattggctttacccgggtggtagtgaatgctcatgtcatagtctttgattagttccaaccatcttcgttgtcggagatttaggtccggttgggtgaagatgtatttcagactcttatggtccgtatatactttgcagcggttgccaatcagatagtgcctccagatcttcaaagcatgaaccactgctgccaattccaggtcatgagttggataattcccttcgtgtggacgcaacagccgcgaggcatacgcaaccactctgccctcttgcattaggacacatccaagtccgtgacgggatgcatcgcaatagacttggaagtctttcatctggtcgggcagaattaaaactggtgcggatactaatttcttcttgagctcctcaaaactcttatcgcactcaactgtccatttaaacttctcatctttcttaagcaactgagtcatgggtcgggcgattctggagaagttttcgatgaatcggcggtaataacctgccagtcctagaaaacttcgaatctgcgacacggtcttcggtggggtccatttggtaactgactctacgtttgatgggtcaactgccacaccctgagctgtaatgacatggcccaaaaatttgacttccgtcaaccagaagtcacacttgctgaacttggcgtatagctggtgctccttcaacttctcgagtaccaggcggagatgttgctcatgttcttctttggactttgaatagataagtatgtcgtcgatgaataccacaacaaacttgtccagaaattccatgaacactttgttcatcagattcatgaagaatgcgggtgcgttggtaagtccgaacgacataaccgtgcactcatataatccgtaccgagtggtgaaggccgtctttggaatatcctcctcccgaattctcaactggtggtagcctgatcgcaggtctatcttagaaaacactttagctcctttcagttgatcaaacaaatcatcgattcgcggcaaaggatatttgttcttgattgtgacctcgttgagtgcgcgataatcaacgcacatcctcttcgtcttatcctttttctccacaaaaatgaccggagcaccccaaggtgaagtacttggtcgaatgtaccctttctgcagctgctcatcaacctgcttcttgacctcggctaattcattagccgccattctatatggtctcttgtaaattggagcggttcccggtgccaagtcaatccggaattcaatctctctcttgggtggcatggtagtgaggtcttcggggaacacttctggatactcgcagactatgggtatatcttccaattccctcaagttcttctccacggtgtccactgggatttccgcttcaatttgattcaaagagacccctcgctttggtgcgtctggtgattcgtacactaccgtttctcccttctcgttggtcaaggtgacggtacgattcgcacaatcgatgactcccttaaacttggtcagccaatccatcccaagaatgacatttaggtctttggattcgagaagaatgaggttggctagaaatggtgatccttgaatttctattgttatagaagggctgaattgaaccgaagtggagctattccctggggtatgaacccgcatcggtgtgctaagttcctctcttattaacccatgcatcccgacaaacttctttgaaatgaacgaatgcgttgcaccagaatcaaaaagtactgttgcagggattgagttaacaggaaacgtacccagtacaacctctggtgctgcttgagcctcctccgcggacgcgtggttgacacgagcctggataaaccttggcccggcacgcctaggcttcgggcatttgtcagcgaagtggccaagctcgccacagttgaagcaagaccctggttttgttccagtctccttcttggcttgcgcggacgggcctgactgtgccgatgccgttggtgggcgtggagctgcaccgctgctgggctgacctccatggtggttctgactgcctctggcgccctggggaaagttgctagggttgaacgggcggtactggcggacgatcatggtggtaggtccaccctgctgcccggaagcgaagcgcggcctctggtgacttccctgaggtgccctgaactgagcggccttcctcttcctatccatcttgttgcgttgatcctcctgacggattgccttgtcaactagcctctcaaagtcagcgtagtccccagatatcagttggttggtcagctcgtcatccagacccgccatgaacttttcctgcttctcggcgtcggtgcggacatcctctggtgcatatcgcgcgaggcgattgaactcatggaggtactccgtcatagtcctgttgccctgatggagtgcccgaaattccctcttctcttgtgccacgaccccgtct

SEQ ID NO: 2957 - DNA, 1874 bp, Oryza sativa
ctggagcgaaggagagagcggacgcgggagctggagctggagctgcaggaactgcgggcggaacttgaggtgctgcgggagctactgatggaggtgggttcctgggcgcaagctggatgcgcacgggtgcagtcgtcgtcttgcggggcgtggtgcggatccggactcctcctggcgcgggaagcccctttaactgagcgttctccctcttcaggcgcgctatctcgtccttcagagcgacgatcctcatgagcttcccatcattcaaggccttggtcgccttgtgcaggtccgagtgcatcctatccaatcccctcatcacagcacacatgtgaccaaaggtggtgtcgttctcgccggctgtcggacggaaagtactgacatcatcactgctggctcgacgagggtgaaaccggtacgccgtgtcgtggaagatgtagttgtggcgctcccgtagtctggccatcatcaggtatgctgcctcctgacaggcgtgatctgctgtgcctccagatgcctcaaccaccatgttagctaggcaggtacccacgtagccgtggacctccaggcgaacacggtgaggaagctcgccactgagcggtggaatcgtcgtgtactctggcgcgttggggtagcccaccaccagcgtcatgcgtgccaactctgccacaaagtcgatcatgccttctccacggtggttgggtgggtgaccggccatctagagaagacaaaggggtaggatcaatgcatgctcaaatccaaacttaaataaagcaataaaagactcaaataaaggaatcgaataagagcgaaatttttatgcatagatcgttttgcatgagagcgaataaataagacagactcacataacgataaaataatggggaaattagctacatactaataataacaataagagcataaataccttgcaacccatgttcctgagctaggacctaatgcatttcacccatcaaatcccaactgactgacgaataaatctcaatagttttactaaaaccctagactgactcgttttgacaaatctcacttaaacgagcgaccaagatttttcccttgaaccacaagaacagatcccaattttcccggaacaaatccaattgcaaagaacatatgcaatgaaaaggattcagaaggctcttaggtttttccatttggcttgtcctacggtcaaggtcggctctgatactaacttgtcacgcccagaaattcccgaatagaatttcaagcagaatgtgcattaaaatccccgtccaggaccggccggggtacacaaacgacaatgttgacattcagatccacgtcttacaaacatcataaaagtcttacataaatgcagcggaagaaaagaaagacaacaggagctaagccttgactaaaactgcagcgggaacaccactccacaggcatcctcgacggcacggacaaagcctactcctcggagaaaccttcatctgacccgaactcgaactctggggttgggaaaagtagagcaagactgagtactacccactgtactcaacaagtcataccggaataggggtatggtgcagggaatcatcaaagaagagctaaagtggttcatttgcataaagcgagcatttataaacagaaattgaaagatttaaacagttgtaataattaattaatattaatcatccgctgtccaacgctatcccacgttgcgacaggcccagccatccacctaaactatccaaattcaaaagattacactaaggtgagactaatcacggtgaatctggttgaccgcccataaccgcgggcacggctattcgaatagttttactctgatcagaggtgtacaactgtacccacaagacacagccccacaa

SEQ ID NO: 2958 - DNA, 1731 bp, Oryza sativa
attacaaatctaataatcttatactaaaactcaaatagtgatgatatatgctaagtctaggtgatgtatattgtaggaccctagctagtcaattattatatactaagtctaattagaaatataataatcttatattaaaactcaaataatcttatatgctaagacaaaaatagccatgtatgctaagtgtaactgtcgtatattagaaccctacacaatcttacatgctaagtctaattacaaatctaataatcttatactaaaactcaaatagtgatatatatgctaagtctaggtgacgtatattatcgaaccctagctagtcaataattatatactaagtctgattacaaatataataatcttatattaaaactccaataatcttatatgctaagacaaaaatagccatgtttgctaaatgtaactgtcgtatattagaaccctacacaatcttacatgctaagtctaattacaaatctaataatcttatactaaaactcaaatagtaatatatatgctaagtcttggtgacgtatattataggaccctagctagtcaataattatatactaagtctaattacaaatataataatcttatattaaaactccaataatcttatactaaaactcaaatagtcatgtattctaagtgtagctgtcgtatattagaacactacacaatcttatatgctaattaagtctaattaaaaatctaataatcttaattgcattacaaatataacaatcatatatatataattacgtcacttgcctgggcgaattccttcgagggctagctctaccagtccggcttgagggacgactccgacaacgtcttttctgcaagatacaaaaagatgtattaggataaacgcgaagtaacatatattgcatttgacgttcacgtttcgttcacgatatcgttcatgttcgcattctcgttaaggtcacgtttcattcacctacgtttgttcgttcacgttcattaacttacctataattgcatttcacgttcatgttcgttggctcgttcacgttcgtccgacaacgttctagttcacgttcattcaccttgttgtcgttcacgttcgttctctcgttctcattcacgttcgttggctcgttcacgttcgttcgctcgttctcgttcacgttcattcaccttgttatcgttcatgttcgttcgctcgttctcattcacgttcgttcgctcgttcacgttctcggtgtggcggtagcgggacggcggtgtggcggcagcggagcggcggcgggatggcgcggcagcagcgtggcgccgcgcgcggcattggcgtggcacggcggcagtgtgcggcgtcgtggcgtttcgtggcgcggcgtcgtcgtggtgcggcgtcgtgtcgtgacgaggtcggcgtcagcgtctgaaactcggtggccggcggcaaccgagagggagagagagagagatcgagatcggagagagagatcaagagggaggcggcgcgcggcggctctcaccccagagatgcggcggcggcggaggaggcggaggcggcggcgacgacaacgagcgcgagacgacggcgagatacggcggcggcgtcggcgcgaggatgccctaggcagtggcggcgaaggagaagccgagagagatcgatcgggcaaaaacttctaagtgttggtggagaagacgagggcgcgcatcgggaatatatatagccctagatctttagtcccggtt

SEQ ID NO: 2959 - DNA, 5435 bp, Oryza sativa
caaccgggacttcccgctatttccaaattctttttaaacctggttagggttaagaaccgggactactgataagcgcactgaatattattttccattatatatgtgtttctaaaatagaagataatgcattacaattgtttaaagtaaaaagattaatgacaattacttcgaaaaattattgttgtctgtaataacttaagtggataaaacgtaataagcaaatatatgatttaaaattaataaaaattctaataatcatatattcttagcatatgaatgatattattaaattggtaaaaactctaattaacatatgtatatacatacgacatgatttaaaattaataaaaattgtaatcatcatatatacttagcataggaattatatgaaattaaattgtgaaaaactctaattaacatatgtaaatgccacatgcatgatttaaaaattttaaaaattcgaatagtcatatataattagcatatgaatgatagtaaattaaattgtgaaaaactctaattaacatatgtaaatgccacatgcatgatttgaaacttttaaaaattctctagtcaattataattagcatatgaatgatagtaaattaaatgttaaaaactctaattaacatatgaaattgccacctgcgtgatttaaaacttttaaaaattgtaagtatcgcatataactagcatatacatgatttaaacttgttaaaacctctaataatcgtgcgtaattaacatatgccatacatcaattgatttatatggataatcaatacatccaaaatagtttacatcgtgtacacaataataattacggtaatacatcggcggtgacagttgaccgcacgtactttctcctcactattgttccctccttgtgatcgctacgtgagtaaggggtgtcttcatttgataggaggatgctagggtcaatcgtcaccgtgaaagggggttgcccatccaactgatcgtaatcctcgtcagtcttgtcctcaacttcgatgatttttcttttgcctaggagaaccacgtgacgcttaggctcgtcaggccctctgcccttctttcctttgctagacatgtccttcacgaaaaagacttgcgttatatcattggcaaggacaaaaggttcgtccgagtatccaaccttgttaaggtcaaccgttgtcatcccactgtcatcaatcattacgcctccaccagtcaacctaacccattggcaccggaacagagggaccttgagaggaccatagtcaagttcccatatgtcctcgatggcaccgtaatacgtgctagttgttccatcgtgtcccatggcatcgacacgaatagcgcggttttggttcgtgctcttcatgtcttgggctctcgtgtagaatgtgtacccattgatctcatatccttggaatgtcgcgatcgacccagacggtcccctcgccaggaaggcaagttgttggttgatcgactcgttacccatgagatgttgtcgtatccacgcggggaaagtatcaatgtgatgccgtgtaatccatgcatcagacttaccgatgttcctggcgcgaactagagccaagtgctcctcgatgtaaggagctaccaatgaagattgttgcagaaccgtggaatgggctttacggaataaattgttgtctaccgtcattattgctttccttccgagagttccctttccccgtagttgggtacattgctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaacactaacttgggtacattgctcggcttgcccataaccgagggcgcggctattcgaatagattaaactctgatcaaaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacctccgggacaggtaggcaggactgagcccctagcagcaggacaccggccctgtgccatgacatctcgactaccgggccgcagcttgtgtagccttcatttgtcctagagatgtccatcgacccccgacttcatccatctccatccgtgtacttttgtttataaccagactgagccacaaactaagccttacccactagacatgtggaggtacggtagtgctttgcaacagaggcccgaagaccggtccttatatggccgaggtgctactatcaaaaccatgcaccccgagcccaacctaaaaccattttggggattttgaatagagggggaggtgtgaatccaattccacaataatccaaccattccatagtgtccaggtgataagagtgttcccaaagtctagagttgtaaaaccacctaatgttgcctaattaatcagcgaagcatctacctaaaatcatactagtggtaccatgagtagagtttccactagttggggttttgtttattctagggtgaaaaaggaaataataacaataacaacaataaggtcataacaaaggtacataggcatggctagataaaacagtgataacgcgggaatttaaataaagcgataatgcaataatttaaatcaaaataattttataaactgggattcgatatgttcaaggatgatgtgacttgccttgctcgctttcccaaacgtcggcttcaacctccacgaagagcggatcttccgaagctgcagcgtctacacgaccaacggaaaagaaaaggcttttactctaataaactccatataacaagcaggaacaaagcacaaaaatgggttcttgacttcttaaggaaaaattagagacttgaacggtctaattctgagttcaaatggccaagttatggtcatttgaagtttatatgctctttaaatgaatatttgtgaatttcttcatttaaattttaatattaaaagggtttattgcgtcagccgaggggagggggcgcgcggaccatgtccacgggagtggggcccacgcggcagcctaacggtccacggtggaccgggcgcacccgggctcgcaccggccggcgccgtgggtcccacgcgtcagccgcacctaagggcgcgggcggctgacggccgggccccacaaggcagccactcggcgcgcccgagggcggccaagccggcgcagccggcgggaggcggcgcccgcacccctatggtcgtcggcggcggccataggcacggcggagcggcggccgaaagtggggaagggaagggggaaaagaggcggcggtccacggctcaccctaggtcgacggcgacgacgaaaaaggcggccggagcggaggaaggcggcggcgtggctcgggtcgaaggggtcgaaggcgttccggcggtcggcaagcgaaacggagggatggacgaggtcggcgaggatacggcgaagccgaaggaggcggcgccaaggtgggaggtggtccggggcgacgacggcggcggaccggagctcggcggcgacggcggagagagagagcgacggcgcgagctcgattccggcgaggaggaagggcggcgagaggcggaaacggacggaggaggtgcggggagggtttaaatagagccggggcgagagagggcggccggggaagggaggaaactggcgcgggaggtcgtccgtcatcaatggcgccggcgagatttgcgggggcaaatccgcccgtttgaacgcgagagagagagggaaaaaatggggggaaagggagaggggatcacggggagtgatttccccctctttattgcacgcggggacggcgggaggcggcgggattcgcggcggcggcggcgctagggcgcgggcgaggcggcgggagcggcgggaggaaggggatgacgggtgggccccacccgtcagcgagggtggcgggcgggcccgcccttcagcggcacgcgcgcggggagaggccggatgggccgcggggagaggagagagagggggagggagatgggccgagccggcccaagagggagagggagggaaaggggactttttagagtttttctttttataaaatcattttaactttgtttatttcttaataattattatttgtgctctgaaaattccactaaaatttatttacgcattttaggctttttaggaaatatacaaaaatcctccaagccttatttgacttttaactttgcatattttaaattgttggaggctttcacacggattttaattattctaggcataatttagaggatgtattttagagtcgttttgggacgtgacaactttcactatagttttccttctcaactattttataaaaccttctttagcaaatcaactaaatttctatatattctttcttccccacacaaattttctccctcatcaacttacaactaaattttggagacaaaaaagtgtgcaaaacatagttgcaaatgtaacatgacaaaaaaaatattggaggatgaagttacaaaccttttaggcacctccgatttgtacgtaatcaccaaaataaattcactagaaattttggcatgacctcccctcttttttaaagaaattttgaagcttgctcgggcagctggaggagaaagaagacatatatataggggtcggactttagtcccggttggtgttaccaaccggggctaaagatccccgagatctttagtcccggttggtaccaaccgggactaaagttacgaaggttagtaacaccaaccgggactaaagatcccggggggcctgacaggcgctggcagcatttgaaccgggactaaagatgatctttagttaccaaccggggctaaagatcaaatatgcccgttaccctttttaactaggactaaagatcatctttagccccggttttgtttgtatcggggactattgtggaattcggccgaccgacgaaagatggtttctccaccagtgttataaaatgttttggctttggttaaaattaaactaaccaagtttataaaaaaaataataattttttcgacccaagataaagttattataaaatatatttaattattaatttaataaaaattaattggtaatgtaatacaacttgaagcagtttaactttgactaaagtcaaaatatcttataacctgaaactgtcaattaactatattacaaagttgaaaagttgttttttaaaaacatattctactaaccgtgtatatatagaatttgttttataaaatcataacgtttagcttgcgaagtgtgctgcccaaaatatttattcattcatgacattcgaacagggcaaaaggtact

SEQ ID NO: 2960 - DNA, 414 bp, Oryza sativa
cccagcattaggctcgtttcctattagtttatcgactgtctagcttctgcttgttagtttgtgtgtttaggttgcttgtttggggtcagtcgacggtcgatatcatgtgcctatgatatggctgtcttaataaggatttttgcttgctctttaagtgttctaattcagatcagaacaattgcagtttaaattcctatgtaataaagcttagttcctgagcatctgtttttcttctttcccccgtctgcttttccctccagatggtctacaccaggaatggtagccgcgcaacaggcgagggcagcaacggcgaagagcgcactgatggggcgcatccccacagcgattccggcaatggtccgccaccacttcccgagaatccgacgctagcccaagtaatggcacatcagaccc

SEQ ID NO: 2961 - DNA, 2181 bp, Oryza sativa
  unsure (1)..(2181): unsure at all n locations
nnnnnnnnnnnnnnnnnnnnnnnnnnnnnnnnnnnnnnnnnnnncctaattcccatcctgatgctcgttggtcgacatgactttttcaccactatgcttctcttccattggagctagcttctactgattgttaattaattactgtcaaattagctatagtttactttgcaaatcctacgctgacttcgagagatgctgcctttattagtggcagatggcagtagttcaactgctatgcaattgccactgtccttgtgagaggacatgaaagcatatatgcaatcagaaagtaataaggttgtggaagtctctgcagtctgtacctaagctactgtataaaatttcttaatgaggctgaagagtagaagctacattctcctaggttctttctgtattgtcattctgcactaaccagctttgatgcatggcatctttcagaatattagttaacatgtctcttaagcatgccgtgaaatattttcaattccattttaattgaggcagtgacagattgaaagttccatgatcattcatcactcttctgcttgacaactgaataattaagattctgtcaatcttactacttaacctcattgcatcgtttgatccctgcctttgcatggattcttcactaaagcttggaatcagtcgagttctgcataacttcgtcgtgagattgtcaagtggatggcattcattgaaccaacacgacagaatcacagaaccttatctttgcctatgtaatagctagctcgccttattttctggtctcctgatggatacacagcatgtcaggatgtcaccccaagactttgctggaattttggatagatgtgtatctgcttgtctgattcctgtgtcaccttggaaacaaacagggcatgtcctaccatgtaggacaagcttcatttcattgagtgcattgcatatttgcatatcagatgatgaacaaactacagagcgtggtgattctttgtccctcccttgcttgtttgtgtgagtgagcgatttgctatgcaactggagacctggttgcatgagcacacatttttctcatccttaaaacgtgtgcttgtgttgtggacttgtggtaccatgagcttcagtttctcattcacagtcctctcctatgagcaatgcaaggcagagacatgaacatccctgctgcacctgcaacagttaacatattgcagatgcaggcacttgctctcagtgtatgtattcgtgcaaatgttgaccatattaacatgatacatgtccaaaacttaattaatccatgctaatgttccaaatctgttcagagtaaagccagccgggcggtaaaaaaggatgaaaactgaaatgcagataggagaaaaggacacctctgctctgccattgctatcatcttttttaccatggcgcgcacacacacatacagagagagcatcgcaatgatggaagggaggacgcccagatagcaaatgtgcacacccaccaatccatgcaccccatcacagccagattcacaggtgatatgcagcaagaagagatgagatgagagccatctctcccattcttttgaggcgaaatcaagcgtgcctcttcatcacaacaatgacacaatctacgaaggaagaggcaagcagggccccatctttttcatgctctgttcatcactgtgcagcatctcagcatcactagctaaactctcttcctcctcctctgctgccgctgctgctgcctttttttggtgaacacttgagcctttccaagaccacagaagcaaaatggatccatccatccatccatcaccttgagcaatgcaagttgggatccatgcattggccccagcaacacaatgaactaataattggattagggcagtagtacagtggtacacactgccttgcctttgcaatgaggagaccccacaaatggggtttgaatcaggggaggattttgaccaccctacagtgccacacaaccacaacactaacatttgacacaaaccaccccagaatgcagctgttgtcaccaatggcactctcctattctacctaattcagatgtagcttatcagtttataagctcaaaagatcatatgtgtacttagaagatagtgatactagttcagtagtggcatgtaggagggctcagtaaaagtgggcaaaaagattctgagtctgtacaccagatgaa

SEQ ID NO: 2962 - DNA, 3672 bp, Oryza sativa
ggggggggggggcaagaattgattcaatcttgtcctgttgtgctactatcttaactagactccttgttttcttctcctcatcaccttttgtgtgtttgtgtagtggctgtcacctgtgtgtgcatgcatgcatagcaatagcattacattgcaatattgcatttgcacaagatgggagcatgcagtgcagtgcagccccctcctgctgtagatctgtgcaaaacattgatgcctttattactacatatctttctgagctaggaggagccccaatcatgtgcttgtcctagcatgacagcaacttggccggccttctgcacaatcacattgtgtagttgtagttctgcaggtttgcaacgcattaataaacggcgtttggcccattgtttaactcaaacctaacctgccactttgctgataaattgttgttcatccatcatcctagtgcctcgtgagcactggattggttcagagcagcagctccagatccagagatgccgcccatttgagttgtccttctcctttgtttggtcacttgggcagcatcaacttgtggattgtcttgtccccgcaagaacagtgctaatgcacagatcacacacttaacccactgcaaacaccacatgagaaagagagtgaggaaaaaaagaggacagatgaacaggagtccattggtgttgagattatggcccataatttttttgtgcaatgctgaatactcctttatttgttctatatataatttgatgatcattgcctgaggagtgcttggtgtatgcaactctctgcatccagcagttcactgcacattttctttgggtcatgcgtttggcatctgttggctaatgagaatatttagggcccctttgaatcgcagggtagaaaaaacggaggaataggaaaaacataggattctgacaggaattaaagtgtaaaacagaggattgcaaaacacaggaaaaacacaggaatggtcgtttgattcgagcgcaggaaaaacgcaggaatcggatgagagagatagactcaaaggaaattttccaagaggttggagctcttgctaaatttcctccaaaatctacatgcaatgtgtcattccataggaatttcataggatttggaaagcttcaatcctttgaatcaaagggccaaataggaaaatttcctataggatttgaatcctatgaaattcctacataaatcctttgattcaaaggggcccttagagtagaaaagcttcagtcaggtatgagtttccatcaaacagacagaaatgtcaagctaatgagattagatcttgccaacttaaatgctagtcatgccagggaaatgtagttggctagaagatgaataatggtcttttgcaagaactgaaaatccctttcttgtcccaacaagacatttgatgtttattacgatcactcataaactgtttcaagaattgtcggtgatttttttaatttaattcatctcaagttttggaaatgaacgagcaaaatcagtcaccagtcacaactgacaactaggttcgatctaatcagcaaagcctaaggacaaatcaagagtataacttcttccagaactatttcatgatgtgtacgagataacgagatatttattctattatcaagaaaatctagtgatgtacgagaaatcactgactaatttactgcgagagtaaatccggtattttccaaaagtataagtcatggttcagattacagaatatgttcttgcaaaccatctttcacaaatacaaagccactttgcttttcctttttcctataaagcaatatactttgctgatgttttgacaaaagatgcgcttacagcgttccatcaagagctttgacatttgcagtagatgattcccagtacaaaacatcagatagagagaaggcaatgagggtgaatagcttttctgggatttagtggagcacttcacttctatgaggccttcatatttcatacaacatgtggacactctgttcatgtaatcttggatatttaggaacatgacactactactacttcaatcagaaaagttgatgtgacagaaaaaataaataaaaccaaggtgttgacacaccataaagtaagcctataaatccaatcttatcactgttcacaagcttggatgattgcaaagccctactactgccataggcccacattggaggaagtagttagcagttaaacttgtgcttgatcgttctataatcatcagaggaaaaaggtttcctgaccaaactagtagtgattaaaaagcttcccaagtccagcagccatatgcagttgtattgtaccttataactgacaagatctgattaaaaactgctctaatgtttctgcacatatggaaacgcacgcctaactttcagaagagattttgcctgatgcacacagaaaaatgatctgttcccatgcatgcagtcttgatggctatagaaaaggagtatcttcttcacctattgctaagattggagccactgaactggtagaaatagggaaaagtcagcagttaaaaaaaagaatcaactttgtgccatcatttctctcctttgccaagcataatgcgtctgaaaaaagctataatttacgtcgtgtttgacaagagctaagacaggatcatcattgacaaccctgaaagaacactgcaagagaagatgtgtggaccatggatgcagttcccaaatatggctctcaacatagaaccacaaatgcaggtttaggtaaacacaatgcaaaagcaaacgcaatggaaatggattcagaggagggtgtaaccagaagaagaaccccccaggttttcagtattaaagccacaagtaatcttgagttcttgacatgaactgtctcctgattacaagtctcttgtctgaacctgaattattaccccagtggtaaactggtaatagctctgttcatgtaaatagtagtagaggcagtaataaagtttacacatatgaaaacgctgtaccaaatggcgtatagcccttgcagctttctgcttgggtgaatcaatcacagtccccctcattactactcctgcgtttgaaacagcccaagctttgcgctttcttccacatcagtctcattcaatcccgtggccggatcgcagcttgttgcgagcatatgagatattgagatccgcattcctcccagatctgaagaaactaaaatgttctttcgttttcttaagccggagtggcaatagtagccaattatttgacaagatgtttcagagatggcaaagggcaagaggagatccatctatagcctcaaatgtaccatcaccaaaaaaagctcagttcagcctcggatgatcagaaagaaaaaaaaatatcagtcgagatctcctgattttaagcacaaaaatttcggacatcttgctttgacaatgagtggctgcatctctcactttcagagaaacctatcaccctttttttttctttggccaaagaatggacagacaccccaagaaaccgaaagagaaagaaccaaaaaaaaaatcatcagaataacattgcacagcatcacatcttcatcttgagatacacacagggagaaatggtcaagggagccaatgagtttggtgaggaaggcttttcaccagctgcagagttttttactgtggatggatccccacttgggttggcatctactactcct

SEQ ID NO: 2963 - DNA, 15764 bp, Oryza sativa
  unsure (1)..(15764): unsure at all n locations
ccatcagggatggatcgaccggtcatcactccctcatcatttgccaccccttcactatcaatctttttgagctcagcttggatgcacccaggcttccttgtaggattggtcaccatcctacaaagcttttctttctttctcagaagaagctgtgagtgaccagctgcagcagcagaagcagatgcagccacaagagaacaaaggaaaaaaagaaaaaagaaaagaaaaaggctgtggcgactattttctccaacagtatcagcatgagatatgtttctgatgggcaaaaaaaatggtggtggatcaccggagacggaggcagctgccggccgtcgttttcactggcgtggaaggagaacacgtaggccggaaactgggggctgtcaagcaataatcacttgatggactagggcctaacttttgctgacctcccaataaggaacccatggatagagctttcaggttgtgaggagtaggacctccaggtaatgatatcaacagacaaagtgcaggattcagaggagataacgaaaagacaagttcaaagacttttttttcaagcctgaaccagagatcacccaaaatttgagcacatagtagtaggaatttaaacataagctcaattcagcagggtttctgtttttctgagttccaacatacgaatgcgaaaacagaaggaattataaaggcaagaaacaggaaatgtgttaatgaatttaatctgatgacaagcttcagttgggaaaaaaattagaggaaccatggtggttgtgccggcatagatagattgcccccctcaaacagaaggccatcagagcagcaaacaaaactgaggggatgaagccccctcgaagaagcctgctctgatgcacttatgatcttgcggtagaaaattttgcatataccgatgccccccctactagtagtacaacaatttaaccatttgcagctctgatagatggctttagaactccttccaacttcaagcatacaaaaaatgatcatacgcctgactccagctatcttaccttcccttgttgcttaggccgcattcagcgtatcaagtgccactctgcagaagcagcttataggatcttcacgaatggtggtacatcctctcttggcccttcaagcgaccgatacatgtataagatgtccacgctgtcggtcctttcgttctcaggctggctatttatcagctccaccaccaatcttggtagcctccgtgcgacctccttgcaaccttgcagcgtaaggttgcaacctgacatccagaggaaccgcatgttatagaaatggtgcattccggagaggaggccagcatccccaaatgggcaatcccttatctccagcttctccagcttcgagcacccctggaggatgtgttgcaacgccagattgctgtctccagcgaacgcaacagagagcgtccggagcgacttggcatacttgccaatgtactcgaaagctcgatcagtcaggtgtccagatgtggagagcctagtaagcttgctgcagttcctaacaatggcaccaaacccttcatccatgggctccccagtcacatggtcaggctggtgacgtcccattatgcataaccggaataccttaaggtccacgcaattttgagaaatggcgatcaccgcagcgttggtcatactctggcagaagtaaagcgtcgaacggagccctcggcagccctcagcaatggcagtaagcccgacctccgacaccagctcatcggcatcctcaagtgcgttcaatggaagcacatggagaacctggagcttcttgcaagtcctcgccgtggcctggagcccctcgtcacgcaccgaatcaagcacctggcaaacaaatcatcgtcagaaaagcagaatcgcgcagttcagtcgaaaccaagctgatgaagcaatccaggcattacatatagtctctcaaggttgtggcattgcccgatgaagggcaggaattgatcgggagtgaccgggcaatagctgaagtcgaggttcgttaggttgccggacacggcggcaatggtgggcaggtactccggctcgaactcgcggaagccagacagcgaaaccagcgtgttcgtccggccagcggacgcgaacgcggacgccatctgctcgatgtcgagccccacatcctcggggccgtcccccggccggaacgctccggtgccgaggtgcgtcaggcgaggcgtgttcgccatgagccggcgcagctgccccagcgacacgtgctcgttgacgcccaggcgggtgaggcgcggcgagcgcgccacgagcgcctcgagcgcggcgaaggacaccggccggacgtagcactcgaaggagagcgattcgaggtcggtcgtccccggcgggaacgccgccacccagtccaccacctcgtcgtcgtcgtcgttcatctcgcagtcaaccacatcgagcactcgcagccccctgcaagaaacagagcgagagcaaaccgcatcgaatccgccattaccacggacgactagacaacaacaagaacaacaactactactagtaagttggaagttggaaagttccatggagagatgcattacctgcaatgggaagcgatggatgcgaggccagcggaggagaagccgtcgcagaggaggagcgagaggtcgcggaaggaggcggggagggagcgggagacgaggtccaggtcgtcgtcggtgacggtgatgcgcttgaggaagagggaggcgagcgcggggaacgcggcggcggcgacggcggctgcccaggggcggaagtcggcgccggcccagcctggcgggaggaggttgaagtcggcgaagcgcgggcggcccttgaggaggacgcgccgcgcggccgggaagcgtcgcgcgacgcgcgccggggacgcggcgaggaggttgcggacggcgacggaggcgcgggtggcggactcggcccggctccacgagcggcacaccagcgacgccgcgcaccggtcccgcgccgagtcgaggaactggagcaccgtctcgaggacgttgtcgagcacctggtccggcggcggcgacgcgcgcggccgcttctgcgccggcagcggcggcggctggtcgtcgtcctcctcggacatgtgggccccacccacccccccaccactcgcgtggttggttggtggccggcgaggagtggagtggagtggagacgcgccgcggcggaggaggggggggaggggggaggtgggtgtgcgtgagtgacatccagcgcgtagccaccgtggtgtgtgggagggaggcgtgtacttgttgttgtgttgtatgtttgctgctgctgctgcggttgggccgggagccgcagtgctctacagaacggcacacaccacggcggcaccaccacagtgcccgccccccccgtgggactggcaaaggcaaagagagggaagctgggatagatgtaaacatctctcattatttgcttaggtgtggttagttcatgtcaaaataaaattggaacgatgtgatgaaaaagttgaaagtttatgtgtgtaggaaagttttgatgtgatgtaaaagtttgaagtttgaagaaaaaatttggaactaaactcggcctttgtgcttttttcagatggtgtgatgaaagcgtgaaagagattgtatgcacggggggagttttggacacctgaatttctctcttccagctaggcatgttttgattcgttgaaagctatttgaatgctttgttctggtagtgaagatggttatttcaattacagtttattatcaaaatcaaattttagtgtcttcggttgtcacatatgtcctatcatctatatagatttgagtaatatgtactaaaaagtgtcactgatagctactagctgaggaggaagatacgtgtaaatacaagtagcaacgtagagacggaagaacgtggagttatgcattttgaaagaatggaccaaccgcgatggtgaaacaattgttcgatcacactagcctttgagatctatacctgagatataggatgaggcacgcaaacaggatagtatggcttgcgactatggcgagagagaatggatatgagatgagtggtagtgtggaagtgacattagccatgaaaagacgaaaagtggaggacatatatatgtgtagacattaaagcgattcataagatcaaaatgtgtgatctaacttatgtaaagaaagaaattgttcagtttcttgttagcacaagattttactcttatagtattaacaactcggatatctagttgtcttctctattgaagcgatgatggtatttcaagttaaaacccccctaaggatggtctggagctgaataatgattggaaatagcttctgaggaattggttaaattattccagatatgaaagtgttttcacactcgcatacatgacaaacaaaagactttctagctacagaataacttctgtctagtctcaactctcaactactacttccttatatattggatacaaagaatagcgaccaaaaccgttcatctgaatgggagaaagtccttgaaaggtccttaatttcaatcaatctaatttaaacaaatatcgtgtttgttcttttagttggtgatgtggtgtaggagcatggtggtcattactaacctttgaacttgtcatatgctcacagatgatgagcccccttgcccatccggaaaggcatttgaaaatgatccgaaaaaacaaatccttcacccttgccccagtccacatgcacaagggactttgtttagaaacgcaacagtaaagaggcgagagataggccaaggaaaggttctttgtttttgtttccttccacatcttttattgtgcttggtcggcctttcaggcagggattgctgtcagtcaaggcattgggattcttagtgcagacagtagtttacgcacacccttgtttacccccctcccagttctttaattccaatgtattttttttcgaaagaattatttctttagttttagaaaacaagaaacacagctcatactgtcccaatttttatattctccgaatttgatcgatctatgcaggcgccttgtattcaaaatttggccagttggtttatatgataagaccttggaggaggagagaaccctaagcccaagtacatgacatggattaaccatgcatgataccattgtgagtgtgattgaagctggttggttctgttactgtgtctgatcagttaatacctttctaagatccaaatcgagctcctcttttttcctttttgaacggaatgcagagaacacactttgatgctccagaaacttgagaagtgtacagaatgagcattcggtgcttgcagtcatctcagattctctcatcaaggcctcttcttcctttctgtcagtctagcgatttgctgctactctttgaggacttcagatgccatgcaaattcaggcacaagctgttcacaacaccacataataattggacattctttcagagaacaggcaacagccacgcatgcaaaacacaatcttttacaatgttaacaaaactgattggtatttgatgaccctttttccaattagtgtgacgtggtactacgacttattcagataacagtttttcacaacatgcttttaatttgtcacatcacgcttggccggtggggtgttgggttagtttacttgtaataacatttttttaacgattagtgcagttttactttacgtgctgctagctctcacatccttgcttaattaattagcacgagatttcaaaaaggccaggtcgttgattgtgctgttacgacttcagagtaactgcgttttgttttttggtgatttgcagatgagctgtacatctcctaacaccaaaagccatgcactattatttgacctgcaataacataatccatttacctgcacggagaaataaaaactagaggcaaaagtggccaactttctcagtggacttcctgcacatctcgattctcctttttctttggttgaactgatcatttacgactcaaaaactctcagaggaaaggacttgtggaccttcacatacaactgtgcatctacacaactacattgttcatcaatcctcattcattgtatttttatctaatagtggcttcttgctaaatcttgagcactagttcttaccttgtttcaagggctgtatgcatgcaatgaaaacgtaagtattctgcttcctctcgatcttttgacaggtacatgatgcaatattcgtttctgatattgatccatctgtacaagcaggaaagtcaatttctttcaagaaagatggtactaaagtttgtttcaaaaaaaagaaagaaagaaagaaagagatgatgatgataaagacaactcagattgtccactcaagcacttactgcaccctggcctcacgatattgccagtgatttatcttcttttacaaaagaaaaaaaatacagttgtccattcctaattttgtccaataaattctcttcttcgtgtgatagttgctgcaaataattgttttcagggaaaaagaactggcttgcactgtgccatgtgactccatatcaacttctgttcagcaaggcatattattttctgagtacttccttatgataaattattttatttcatggtggaatacattttgatctgtcccatgttaattgttatttatgtagtgctgaccaaacactgtacttttctatcatttgtttacaagagctggaatcaaaccatctaccagtttgtccagagatccttcatgctaactaactaggcataatgataccatctttacctgtgctcttgtgatccccaaatttacatgcttcatcatgtgatttaccgttgtatgcatgtcagccacgtgtgttttaagctatatttctcccacatatttacagtcattatatccccataataagtacttcctccgtctccgtcccataatataaggaattttaagtttttgcttgtaacgtttgaccactcgtattattcaaatttttttaaaattattatttattttatttgtgacttaatttattatctatattattttaagtacaatttttcttttttttaaataatttgaataagacgagtggtcaaacgttccaaacaaaaacttaaaatctcttatattgtaggacggaggtagtatataaaaactaaggagatggagataagggagaagcaaaaaaggtaaagtcttatctataaggttcagcttcctcccattcaggcctctgtctattattattcgacacaacaggggagaggatcagaggagaggagctacaatgacgtttgatttgatatccggggccaagcacaaaacctaagaatagtcttctttaaggtatccgcttctttttaagattgtaaagagataactccatatcctggtccatgactggttgttgttttgttcagaccaaactcagaagtgaatttcccagttttgtgttgagctagaatcaatcttatacagtaaatactatattcgtgggatcattgatcaggtctaagctaacaagagtaacaacattagctgaaaatcaatgataaggaaaattcccatttgttaaggacaaaagggaaatcatttcaattcgtatgagcaaaaattaatgaagagaaaggaggttcctttccctctatttctcacacaaagagaaagcacggtgccttttgaaaaccgaacaagagaccatgaagcaaatagatatatagtaatggtcataaaaagatccacggttagtctaataaagcagtgctaagctagtcgtttatgagaggaaaaaaaaagaacccaattagtggccaacttttgggcaatgcccctcgtgcatctccaaaggtggcccccctgctggtctttcccgctagtggcaggttgcgagttcagcctggggctctcagctttcaggtgcaaaaaacggtactactccactaggcactagtagtaggtaggtatccgtagccccgtatctccatttcttttccaatttccagtattccccaagatcccccccaagtgcttgggccgccgtatacgtacgcgtctacgcgaggcgggcgagaggatcggcggcccatcgtgccgcgcgcgcgcggtggtgtacgcgttcggatggacggcccagcacacgggggcgttttttccacccgggccccgtggccgtgggcgcacgcacggtgcgctcctcgtgcgcgcgtgcgattccccggattctcccnnnnnnnnnnnnnnnnnnnnnngctcgccgctcgctgcggagtgcaacgcgccgagcggagagacgcggctgcagtgctgcacccgcgcgagtcgaaacgcaggctgggccgttcgttgggcggtggagcgacagggctcacgtgaggtgggccttgggagagtttggggtccgaaaggcagaaatgaaccgttgctgctgtagtactacgcgaagcagcggaattaacgggttggaaggaggaggagcaacacttggttggatccgatctcattctcacctatacaggactgacatgtgggccgctaaatattaacgcgtcgctgaccgagagacctcgggcgttacacgacagatcagagcgggctatgaaagcaccttcgtggctaagcatttgttggtacaagttcgccgaagactgaaatccttagcgatgacctcatcgtgttatttaagtgtggcattttttttgaagcaatggaaaattcaatatttcgattatgtatatataccgcatcagcttcggagacaggcagtcacgatatcctcgaaaagaaaaaaaggggagaaaagaaaaaaaaggcaaccacctgaagcgtccgttgggtccaggaattacgtcgagcacgacgcggcgcccagctgtaccgtctgaccagtaggccccacctccccgccgtcgacatgcacccgccggccgccgccggaggagaccacgccacggcggcgccggcccccgcgaccggcgcagccgcagcaacagcgtcggactacgcgcactacccgaggctctcgccggaggacgtggccccgcccccccctccgtcctaccacgctgccgcctcctccgcgccgccctactcgggcaacccctacgtctcctcacccgccggcggcgtcgcgcccgcctccaagagtgcgttcctgcagccgaatctgccctccgttgttggcaggataacttgcggggttttttttttttaactgtttcggatttccccttttgcagatacaatggatacggtgaaggatgttctcggcaagatggggaagaggtttggagaggcggctcgcaagacggagaccctcaccggcaacttctggcaacactgtaagcttcaattctgaagttattggtttttgttctgtatcagtttaccaatgcttggtttttctgcatattatcttcgttttggagttatgagtagcatgtaattaaattaagtgggggaactgggtattatatcggtagttagcgctaatggaatttgacgataattcgtgttgatgagttcgaaaaaaaaaaggcggcctggtgagaattgtgaattacagtagtgcttgattgggtatttgtgctgtctggtgagatctgtgggttatagtaatgctgaatgaagaaggttcactatctattggcttctttggtctgtttgaaactttgaattggtccagcgcatatggattatgggtggtgctgttgctattaggctatgtaattggatttatgtggagttggcgttgttgatgacaacggagaaatgctgggtatattctatcagtcataacacaatttatttgcagtgaatagctcatgcatattaatttgttaggtaaaccatatgtcttaacaatgtagagagtaaaaagatgttttaaattcttgcagtgttttataatgctgatcattccagatagatgtctcattgtgctacctctcccttattttctagttgcactgatttggtgttgtattcatgcattgagccttctttgttcacatgctcattgtactgttgatcccttgaaatgatatggtataagtttcttaaattgaattcgagcagcgtgagataatatagtcataacacgaatcttaatttgccttgaaacagtgaaaactggaccaagcattacagatgcagcaatgggcagggtttcccagatcaccaaagtcatagcagaaggtggatatgataaaatcttccatcaaacatttgatgtcctccctgacgagaaactgaagaaaccatatgcatgttatctgtcaacctctgctggtcctgtcatgggtgtgctatacctgtccaataaaaagctggcattctgtagcgataatccacttgcttacaaggttggagacaaagatgagtggagctactataaggtattctgattacctgtatgtgtttttcatcatatattgagatcataccgagtctgcttcacaatacaaccgctggtgataatcagtgtgacaaatttctcctgaagcaagatatcttaccataatgtactgtgtagaaagcaaagtagtgaattggtttatgtgctttccttttacttttcttcatgaaactagtcgcagatttctttctcttccattagcctgctgttatttctccatttgcgtgaatcattttatagaagtgcataacttatcattgttctgtctgaaacaacaggttgtcattccccacacccaactgagatcagtgaatccttcaacgagcagaacaaatgcatctgagaaatacatccaggtggtttccgttgataatcatgagttctggttcatgggcttcgtgtactatgacagcgccgtaaagaatctgcaggaagcacttcaggaggctcagaatctacgagcttagtgatgtccatagattggggatagcaagcccaacatattacagtttgtgatatactctgtgtttcatcaaattggcagtcgtctgtattttgttggataggtgttggcatttcttgcaatgtgtaccgacttgaaacggtttttgatatgtgacatcatgatctctcgatagttactctctgttgttgtccgactggatttcatttggcttcctgcaatatcaaacgagtgtctgttctgacgttcgataatagtgccaggctgatagaaagaaattcgcattaaaaaccaattttgaagtgtttacaaagtgacgcctatgatgaaataactttcttctacatgattgagttggttgaaccatgagttttgctcatttatattctccctttactgctgcattgtctgaccatccagtagcggcacctgaatagatgaagattaagattaagtaattaagtaaggaagtaagggtcagtttgaggtagataaatattagggcatgtacaatgattgtcaacagtggtcccttagcgttgttaattaggaatatttatccacagtggtctcttagcgttgttaattaggaatatttgttgatatggaagaaagagaaagaggagagacaaaacatccttgttatggataacaacgactcttaatcactataatatggaaatatggttgtatgagggtagaaaaatggaacgaatgttaacaaaatgaatatttttttgagttaatgattagagcctttgtcgtctcaactattgtaaagacgcggtctctaaataatcttttattatttaagagactataatcgtctctaccattgaacatactcttaagattaaataaggtacgtagagtgagaaagctattgacacataattaattaagttctaattattataaacttaaaaataaatttatttaatattttaaagtaacttataaaagtttttatacgaaacacactatttaacaatttataaaaaaaagcgttaataggaaaatcctgatggaatggaaaacctatcctctttgtgctatacaagtttataaaaaagcatcatcatatgcacgaagcagcaggtaaaaccatgtgggcatgtttggggagcttatgacatcctataagctgtagctgtcagaaactttcaaaacacttagattttcacctgattttaagaatctagaaaataaattagaagtctgaagctaaaaaaacatagtttcttcgaattcttatcggctaacttctcacccgctgtttttcagaattttaaactcccaaaacagtcactaaagcaggattaacctgatttcctgacagagaagcaaccgctgttcgctgcacgctggcaccgctgcttcgacaacgcgtcatccgtgaaccgtgggccgtccgatctgccacgtcctcggactttcccccctctactccgcttcccttcctctctccttcgtcctctcctctccgttccaatccaagccgcgtcgctgggaaatttgcagcctcgatctccgcccgggaagacgcggatccggaggaggaaagcagcatcggtctccatctcctcgggctcaatctttcgtggtctccctcttctgatctcgcaatggcgagcggcgcctacggttcaaggttcgcctcttcttccccccccccccccctagttttccgtcctaatcgtcgattccttcgattttttttattgcgggattagattcgccaggacgcgtcgttcttttgatttcgatttctcgtggttgacgaacacctggggtcgtttcccccgatttgtgttcttgcgctgcttcccctgttggtaccctatgaaatttcgttgttgattgagccatcgacaagtccctaatttcgtggcttgattctgaatttctgattaaccgtcgattcgtgtgtgcaaattatcgttttccctcttggactttccaattttgtctcggttatcctgatcctaatgttcggttctgcagggaagggctgacggccaggccggctgcatcatcaagctccagcgagatttcgctccagatcgacccaattaccgctgatttggatgaccatattgtcggacttcgtgggcaagtccgtaagctaagaggggtaagtattgttatgaatctgtatgagcaaactctgttgtggaaggtagtcaaaatttggtgtctaaatgaaaccggtgtggcgagctagagttgttgtgaaattgcgtgatgctatgtgggagtaattgaaccatgatctacttatgttcataagcttttttcatattctttcaatcgattctaaacaagccattaatttggtgctgcaggttgcccaagagatccaaacagaggccaagtaccaaaatgatttcatctctcagctggtaagtaacttgtctgcgagacagtttgggccaaatcctgaatagcatttagattgagttatcggaatgttgatatggcacgcctattgtacctcacatggacattttttagcagatagattatcactgatcgcaaggttcctagtgtaatgtttcttcaaacacaatctgctgatcctcaatctcttgtcacttaaccagtcatgttcagtcatcccatcccatgcactgtagttgattcattatgcactaacgcatgtctaaaagttaccatgaattcggccttgtatgttggtatcctgggtattacttacattgtgagctttgtctagtctatctgtagcggcatcatgttaaaatttcataaaatagtagtttctggaagtgaagtgcttgtagaatcgtacatttaatcataattgattatttggaatttgatgtctgctcgttttaaaatctgaaacctttgtacgagaactctaaaagtacactataaccatcattcaggcttagcaggatgttcgtgcctaaatggaatcacattctgatcttctctccattgtcatcttgttggtcgatagtttttggaaaaagaaaaggggactaggccacatatacatgagaagtttccatgttagcacacctataggccaggaatttgatggacccagattaaggtccatcgaaatgaggctttactctataaaatgccctagatcatccaaaattacttgtctggcatattcctttctctgtttgtcgagaacatgtgtagactagaatctgcaataagatgtacactagtttgtgttgaaaacttgaaatacgctttgtgctcggtctctaatgtgcatattgcacttgtttgcagcaaatgactctgacaaaggcccaggcaggcgtcaagaataacatgaggagaataaacaagaaaatcatacagaatggttcgaaccatctttttcatgtaatcctcttcgctctcgtctgcttctttctagtgtacctcgtgtccaagttctctaggagatgatgaagcaccaagacctgacaaaagggagagatcgagtaaaatgttagttggtacctccgtcaatggcagttggcagacactgtgttttgaggttcatgttacagtactacggcagaataagttgatagttggtgaaaaaaagtgtcattcccctgtatcttgtacaagaattccatattccatgacaatgtgaatatattccatgatgtttgggcccatatttgtttttcttttggtgtgttcgtttttgtcatctatgctcagggtgactggatgagcgcacagcctccaaaaattgcagtggattcggattcaacttggtgttggtgcaggcgacgacagcgatcaccttgttggtccatcatccagtgccgtagcatgcgtgcgtgacggtcttgtgggcccatgccctctttggtcttgtaagtcattgctgggccgttggaccggatggcggcctgtcggccaccacgacgccggcgaccgtcgccacatgccaagatgcactgcccagcatgcatggagacatggagttggagggattagtttgttttgttttttactagttttatactatgaaactattttatccctgtcgtttcttgcatgcatgcttgtgcttccgtagtcccatccctcttttctgctccaggtgtgcatatcagcacatgctccttctgcacaggcatgcatgttgccaagcaactgtgtgctctatatgaagtgaaatggcattttaatatgcaaccccttcatggcggcttacaatcttcccttctgtcttgttatcttgtagactagctagtagtataaaggttttaccagcactgggaagaagtcatgaagtgaagaacttgtgaatgtatatgctagtattctctttgttgatacaactatagcacttgctttttctgcgtgctagtaccatataatgaaacaatgtcatacagaatttgaaacaatctcgtacaaaatttatgcatgccactgtactgtaaaactacactgagaaacatgttcactacacccgtaaatatgtatacgacccacccaagtagacacgtacaatcccattgtaaactaaggcgccgctgactccacgtctgcggtcttctgtgccagcgccacctcctgctcgcgctcgcgcatcttctgcgcctccttcttcttctgcgccttctcgccgtagaggtaggaggcgaatccccagagcgagagcacgagcgcgatgcccttcgtcccgtcgaacttctcgtggaggaagatgacggcgaggacctgcgagagcggcaggagcacggcgatcatgatgccggcgagcagcgacgacgcgcaggtgatgagccccatgatgcccaggttgagcagctgccacgacacggcgtcccaggcgaggacgaggtagtagttggccgcgccgagcccgaacgccgccgcttcccgcgccaccgactggaagtcgcccttgat

SEQ ID NO: 2964 - DNA, 12341 bp, Oryza sativa
aattcctgcagccagcacgacggcgttggccgagaacggcgtgaaccggaggcccacgaagaggaacgcgaacacggcggtgaaggccagctgcgtcgccagcagcagcgacgacgtggacagcggcagcgcctgcgaccccagcgcgtacacgaagcacgacacggcgtacagcccgccgagcacggcggcggcgccgacgaggcgccgcgggaggaggaggttgccgatcccgtgcctgcggccgcggtagagcgacacgcacagcggcggcagcagcagcggccagccggagatctggagcgtggcggacagccacagccgggtcccgccgtgcacgaagtagacgcggaggaggagcggcccgccggcgccgaggaggacgaggcacgcgctgaatatgaccagcagcgacggccgggacctcgccggcggcgacgcattgccgccgctggcggcaggccactcgctagtaggcatcgccttgctggtctcttccatggctgcaggagcagcactgggtctgggactagcagcagtaatggtggccatgatcaaatgaagcagtgctagactgctagctagcttactgtttcctgcaagcttggcacctttggattagggtgtgttgatggtagttaattagcttaatctgcttgggtgttggatgacatggtgtgttctagggtttatatagatgtgtgaaggatgtgaaggtctaggagaagatgttggagatttggagtaacgtagagattaacagagtaggtgagtcaacaaaaaggaaggagacaagaagtacacagggattacagtaaaataatcaacagacatgtttgttctgaagatacttgagaaatcgtcccttagctacctctacagtgtaaatggactattattccacttgttacacgctacggctagggagtagctagggactccacttgttgcatgcgtacaatgaattaatactgatttttctacaaaataaaagggtaccccttcgtatatagtagtagaaattaatacaaaaccaacgttggtttttttatttgaagctaatcgtattaggatatgtcatgttcaatcatatgttgttatatttttgaactgatggagtagctagcgtagagaaaggctagctagttctgatagtgtgatattttctaaagaaaaaggaaatggtgtgataattccatacatgatgacatgatgtactcatgaaattagttcagactaattcaacttgaaatgaatttatttttcttttggaacttgatatatatatatctcaaaatcactttcgtatgaatacgcgcgtgaccataaggtgcatcaaaatgtcacaaatctaaaacttatccgttatcatttcagcaaatcatacgcttaatgtatatataagtttatgaccgagtaaagcctatcgtacgttgaccacaagtactcgtaatagcaacctgttgtgagcaaacatgttcaacgttccatgtgcttggacttgctgcgtttgacgacccaccgtgtgtgcatgtactaatcattcgcatccataaccaaccaccatgcatctccgtaggattagctaagctgatgacctgacgtgtcatgggtctagtccaagtagatagtactatagtgaaatatagtactgagctgaaacaaattaacgtccttttttcttcccaataatccacacacatccgtgatgcgtctacacggagactagctaattgatcattgtttagtgagacaaaacaagcagaagcgcctccgtggaaagtgcctgcttgttccgtttggttcaagcggctgttaagaccgggtaattaacacatgtgctatcttgctctccaactatatatagcgatcctaaatatatcgatgatttggattattttacctaatagaattttgcttcgatctttttccctgttcaaaccgaagaaactactagtcgtttgattagttcccctccgctgtttggtgtagcttaatttgttggtgcctggagttaattaaagactggttggactctgcatgtgtttaaactgtatacattgtggtaatttgtggtgtacataccgccagtccgttgttccagtattaatttaaattttatctgccgcatatacagccaacagcatatgcaattaattaatactcttgtggattggcaatttggcatatgcaatatccagtacatggaattccccagtactttacctagctagtgtccttactgatcatggatggtgatgatatggctgcatgacacagtaaaaagttggtggcagtaagttcagaaaagtgacagtcacagacaggaacgactccgatatggtgtggaaaagtataatagagactaaaaatacatgaaaactcctcggtagataagatggagaagagaagagagcatgagtcacctatcggtaagagatcatctctactcattccgtaccaaaaaaacccaattctaaatttaaatctagacaaatgattagattttttttcagagtgagtgcacaaattctaattttattttaaaaaaatagatcaataaattaagagcaaacaaataaaataaaataaaaattatatatgatggtgtattaggatataaaagtgctagaagcctagaagtaatgtataaatgtgttgtatatattgacttttaattaatgagatgatgtgttaaaacttgaagctatcacactatctcattctcttgtctgagaaaagaggttcagctatgtttccattcgttttaactttacggcaccatgcataatgcgttagttggtttctcaatgatatcccagcaggtgctgaaaacgtattccatttccaccaactgcgagacatcgactagcagctagctgatccatcattcagttattccatcaaagtgttccgcttttgtgtgaacgttatctctcgaggtcgccgatggttcaggtaattaggatttgagatttgcaggggaaggcacaggcacgcgtgctaagtcttgaaggggattattagtaggtggtaagtgtgtagtaattaacagcgactatctcgtatgaatgttattagctcataagaaagtcgatagtcaatagtcaccgtatgaatcatgcatgagatctgcgcgcggagacatataagctctctgtcagtttcatggatcttgtttgtcagagttgaagtgcattcacctaccacgggaaaagaccaagggattgtgcatgttgagagctcggataactgttttttctttttctttgtttcaagaaaaaaaatccacaggttccttgggtgcgtactgcacgcagtcgagtagacaacatgcttactatatatgttcaatctagttagcatctactccgtagtaggtataacttatttaggacagcaagctggaaattgtcatactaatataatcagatgtatttccctcaaaacatataaataatcagcgaaagtttatataacctagtggttacaatagcctcagtagcatcttagatcctgggtttgactccaagatagatttgctagcccagtcttcgaagatgctcaaatgggttgggtttacgtgcgtgtgttcataggggtgattatgcgtatgttgtgagtgtctgcgttgtactgtgtaatttaaataaaataaataaataaataatcagatgtgagtacggagacgtacgtgccaccttggtcgatcaatcaaataaaggtcaaactgaaacccaactaatccgtgagaccgtgaccattattcttctgatcgcagccgcgctttgcaggtcgcttggaacctgcatgtctaacaatctgcatgcgtgttccgattaactaactaacccaacattaatccatcaggcgaatcgaacgggcgcacctactcccagcttcctagttgacaccgtggaaagggtcaagttgacacacgacggtgcagagaatgcagctgaattctctgtcttaaaagtcttggggttaggggactgctatttagcgtagctacgttttcatcaacgcatatttttcttgaaacaattatctgaaagcttttatttgtaaaactttcatctgcaaaaaaaaaatcatctgaaaaaaattacctgaaaattttcattcgaaaacttctcatatgaaactttgacgtgaaatttgtggaccaaaagtgtgagacgcagctgcgctaattggccatcctgttcggccttgtgatcggcctcgctcaggccggcagcccactcctccttcggccgtgtggcctggtaactgagagattgaacccaccaaggcccatctcgctcaacttggacgagtcctatttccatctggcccagtacaaaaaacagggccggcctcttgtgtttgcacgtctactctgggctggcgttttcgtgcgaggagcagatcacttcagttcggttttgtgtcggcgagagaatcacatattcacaggccatacagtgataataatcagttaatcactcaaacctgtacgaaaattccaaaaccattgcatacagctaccggtttgtctgccatccatggagacaacaggcaccgatccaaaattcccctctcgatcgccgcaccacgacgagggcatcacgtcctgcctgggcttcatgtgcgtaacataaacagatccatgcattattaacatgattatatgatttacatccacatataatgtatgtatcctgcgacactacgagagggaacacatgtcgctacacatcgaggcgtgaaccacgactcgttaagttttgccgtgaccatcgcgtcgcaactcacaaccacatgcatcatggtgccaagagctacgtcgctattaatcgtagccaagagctgtatcctttactatgccagtattgattaacaacagtttgatcgatcagctgcatcctttgctacttcgtcggccatgaacatgatcggcagacgaacgcagccacgggcccatggataagatcgaacttaatagtactccctctatcccacaatataagggattttaagtttttgtttacaacgtttgaccacacgtcttatttaatttttttttttgcaaatataaaaaacgaaaaattgtgcttaaagtgtagataataaagtaagtcacaaataaaataaataataatttcaaaaatttttgaataagacgagtggtcaaacattgcaagtaaaatctcaaaatcccttatattatggacggagggagtactatacaatcatatgcatgcatcatctcatcagaaagaaaatgaaaataaaaataaaatggcatgcatctatccatgtcgaacaggcgaagagctatagctttgcttgttccaaagacggggtccggaagacgtgggcaatgacgaacgcaacgagtggtgtgatgctacaatgttatgggtgggcgatggagaagcagcaatgccaacgacccgtttgctgtgcaaaatggaaaactgaactttgtttgtggctgtccatcgcgtccatacctcagaacgatagtgacccgttggaaattaatttggacattctatctactggagtactccgtagtaaacaatccggagttgcaatcagtttgacagtttgctctcgctttcttaaccctgattacctacccattcaagggcgtttacttgtgttcttttttcggtttgcctccctcattggcaagcccagttttgagcttatacggaggtggccgcccccaacaaattgggtgcttatatatgcgtgtgaatctcttgaagatgtgagcaaaagtaggcacccatatgtcaccagcggttgtgtgccatcatgataccagtaactcgtctgatttttattttcttatttttttatttttttttgacgcaaaaggtagagagactctaccttgttaccattgtattaatggtggtcatttttattttttattttgtggttagttggcaatgtacaccaatcgatttctagatacacattattgtcgatggcttgggagtatctgtgtcctctacggcagtacgcatgacccacagcgtagctagcgcgcgtcaatattcactataactgatcgatgcctcctggtattatatactccgtatgtccattttgtttcggttcgggtcaggttttattgtatacagacttggcagaaaacaaagggctcgtgcgcatttttttttagttagtagtcttattcatgggccccatccgacgtcatcatcacccgaacttccaaagcaagtgatccccccaaccccagttttttgacgagattcatgagaagatagcaagcaacaaacgcgattttaaagtgcaagtttagagagccaacgcatacgttgatgcatatgcatgtatagccacaaatctgccgacgtgtacggatacggactagtaatctctccgtgtgccgcaacagctgcctgcggtatatcaaaccactgcacaagtgcagagacgaccggttttgggagcccgggcaggtaacgatcgatcgatctgcgacatgcattgcatgagccatgatggactcaaagagtgagttggtaattggtttggtcaacagcacagctagcttctccgtacgtagtcctccccaatattcacaatcacgatcaacgtataagaatcttgtgttgacacggccgcagatctcacacgcggtacaggcgcctaaaatatatacaccaacatctcacttaacaatctcatttaatattcccatcagtcgtacgtgcacaccagttccaacacacagtggattcgcgcgtgttcggactaggaggactcgatcgcgaactcgagggttgttcgcgcgcgatctgtgcacgcgtcacgtacgcgccagatttgatcgagccgatcgtttccggaaaggcaggagagaacacgggaaagccgtgcgccgcagcatgatccgatccgtctccacggacacgggagctaacgcgaggttagttggcaccaaacaccacagcgcgcgcgcgcgcgcggcagatttgcccaacagcgacgtcgtcccgtgcgccgccctatacgtgcgccacgaaacgcaaggcagacgtccgcgctttcgtcgccctctcgtgcgtgcctagctgtagcttggactcgccaacaccaccacggaactcctctcctattaaaaggcgttccacctgcctctgctcgctcggtcgctcgttccatttgggtttgacacctcattgacatcgggggaaaacacaagaggaggaatcgaagaattaatcgaagcagaggaggttggattgttcgttcgttcggacgacacggtcggcggcgatgggtgacgggcgaggggatgaggaggagtgcagggtggcgctgctgaatggcggcggcgcggcgaaggagggctggcaggtggtgtccggcggcgacggcaagctgaggaggagggtgtgggaggagtcgaggaagctgtgggtcatcgtggcgccggccatcttcagccgcgtcgtcacctacagcatgaacgtcatcacgcaggcgttcgccggccacctcggcgacctcgagctcgccgccatctccatcgccaacaccgtcgtcgtcggcttcaacttcggcctcatggtaggccgattgaacacgtccttttttgctggttaattaattcgtcgtgctagctcgtacgtgctatctttgggtgctatctcctcaatatggttggcaacttaggattggttttaattatcccagcaaggaaaaaaaacataaacattaagcagtaaatatttcgaacaaaatgtgctgtgaattactgcatttcagattataagatgttctgactttagtcaaaatcaaaccgcttcaaatttaactagatttatagataaatataataatatttatattaccaaattagttttattaaattcataattaaatatatttttataataaacttatcttggattgaaaatatcactattttttctataaacttgataaaatttaaagtagtttgattttataacctttaacggatggagtagactgcaagagcagctagctagcgccaagcatgcaagaacgctacgcttctggagttcgatcactgcaaagctgccatgacccatgatcgtaaagtccatttatgcatggtgctagtgtggacaggtgtgacgtgttaattggcatgcatatcgcagcatttgtggggtatccttttgttacacttgctcctatccatgcatgcgtgcccaatgttttttttccttttttgaaaaaaattgaaacgtaaatgtggatggatttgttcaattcagcggccaaaatcctcgtgcaaccctgtacatatcgcagacagcccacctgaagagttcaactaggaatttgtgaagacaaaccgaatcgtgagtagtcaagtggatgtgtatttctttgactgcgatatgactgtttttcctcgcgtcagagttacgacttacgacatgagagcggaatctctcttgccttttcgtgaattcatgcgaagttgaaaggctgatcgtgaaatttaaggccgcattacttcgtctatgtttataagctaaaattatttaaatttaacttcaaagctaattttactattcttaaaaaatactagaatcgtcgtactttctagtgtaaaacttgataacttaagtactagatttctcgagtcattaaaattttcagtgtaaaatttaggtaacttaaaattctttctcaatgacaataaaacttctctaattttgaagtttgattttatgtttttcattatattttattttatatatttttaaattaataaaaacacatatatataaacattttattggtaaattattttatttactattcgagggatcattttacggtacatgagaagcaaccatatatttttattgtataatttattgactttcaatactttcgatgtcagaggtaccaaaattttattttaaaaaacatttcggtacttcttgaggccagtataatttctgtttgtttttatataaaaagatgcacgtgtccggaatattttttttaatttcgtttgtgaaaaatggaaaatcataaatgcaataatccagaatgcaacggctggcgcttctgtgcccgcaaacacttgggttttatctggtgtccacgttttcttatcatcagtatacagagaaggcggtgtcaaaaaaaaaagtatacagagaaggcaccggaaggagctgggcctcttgagtgaattcttcatttcttctagtacttctgagaagcttcatctcttttgttcctgaagcttcgaataaattcctcgcttccgctgttccacctgtcgattttatcaaccaaagcacacatacatgtggcatctattcatctccagcatatattccgacttatttgccgtgcttgcaatttcttttcagcaaaattgatgtcacttgtcacctgcaacgttaaccttctcctgttatcccccgaaaaaaaaaaacttctcctgttatcaaataaactagcatggtggcccgcacaattttcggctagcatcattatattttctcatataatagcatatatgttttctcattatattcaaatatattaaaatgacaacataatttaaaattttgcaataactttacaaaactactaatgtgtaatattcatattatattttatatacgtgctatttattaattatttttaatattaaattttagttatttgtaaattatatatatttctatagggactctagactcgtcttttaatattttttttaattctgaattttctgtaaattgtatttctatatagactctatgctcttcttccgatatatatatttttatttctgagttttcatattatattttatatatgtgttagttattaattatttttaatatcaaattttagttatttgtaaattatatatattcctatatagattctagactcgtcttttaatatttttttaaattccgaattttctgtaaattgtatttctatatagactctatgctcttcttccaatattatttatttttatttctgaatttttattatttctaattgtatttctatgtggactctaaactcatgtttcaatattctttaattttttcattttgaatttaagttacttctacattgtattcctatattgaccttaaactcttcttcctatgtttttcttaatttcgaattttagttatttgtaaattgaatttttatacagattttaaactctacttttaattttattgtgtttattctaaattttagttagttttaaattcctatatggactctataccctacttctagtattccttatttttaaattccgaatttctattttttttcttaattatatttctatatggactctatactctacttctaatattccttatttttaatttcaaatttctattatttcctaattatatttctatatggtctctatactctacttctaatattccttctttttaattccgaatttcagttatttccttattgtacttctatatggactctatactatacttctaatattccttatttttaattccgaattttagttatttcctaattgtatttctatatggactctagtcttctcttgtaatattccttattttttttaattccgaatttcagttatttcctaattgtatttctgtatggactctagtatcctcttctaatattccttattttttaattccgaatttgaaagggtcaattaggcctagaggggggtgaataggctaatttaaaacttaagaaatgcgaaagcagtaattttcggagctaggctaggaattttcggaacttctgaaaatgcacagagcagcgcacacaaaatgaaaactctagatctataagactataacagggaatacaaggcacaatcagcaactagaccaatagcagtacaagcaagcaaagctagaggagagggaagaaatatcaccaagatgtagctcccaaagttgttccccagagttcaaatccttgaggggattctactctccgttgaggagctcactaagagccgggtcttagctaacactttcctcaagaggttgcactaagcactcctcctttcactaagaggtatctcttcccttgcggaggcgagatccggccttcacaaacttttcccggccaaccacaaggagatcggtggctcgggagtgacacctagccgtctaggagtcctcaacctccaagagtaaaagatgatgcaaagaactcccggagatgatgcaagtgctcacaaatctttacaaagaccacaagaagcacccacacaagctcgaatccacactctcacacacacaccaaatcaaaatcaaacacgggtggagagatgaatcgaggaagcaagtctcaaatgaactagagagagagagcaagccaagggcacaaataattggaatggaaccagcaaccctcacaagtgaggggaggtgggtatttatacccacagcacaaatctgcccgttggagtgcaataaaagggattttcggaacttccgaaaattccagatctgaggaaaatcgaagtcaacgcaattttcggaacttccgaaaaatattttcggaactttcgaaaatttccagaacgcttctgtgtattttcggaacttccgaaaattattttcggaacttccgaaaatttccagaacgcccaaacacggttcggtgtattttcggaacttccgaaaatttccagaacgctccaaaagagaaatgcttcgaagtaaaattgattttgagcacacgcatcactccttatatgtctatgcatcatcccccttaatagtatggctttcctacgacacaatgcgaggaaaaagatacaatataccatttgatcattgccgcattgcatcacgatgtcgcattcacgggatatgcattgtattacaacacgttgaggacttaacaaccttcacatttgcttgaataaaaatgttagtcctctctaatcgcattgtaatcaatcatcaaaatcattaggggtctagatgcactttcagaatttcaactattttttttcttaattgtatttctatttagactctatactctacttctaatatttcttatttttaattccgaatttatgttatttcctaattgtaattctatatggactctaatcttctcttctaatattccttattttttaattccgaattttagttattttctaattgtatttctatatggactctagtctcctcttctaatattccttattttttaattccaaatttcagttatttcctaattgtatttctatatggactctagtctcctattctaatattcct

SEQ ID NO: 2965 - DNA, 24193 bp, Oryza sativa
ggactctagtctcctcttctaatattccttattttttaattccaaatttcagttatttcctaattgtatttctatatggactctagtctcctattctaatattccttattttttaattccgaatttcaactatttttttcttaattgtatttctatttggactctatactctacctctaatatttcttatttttaattccaaatttatgttatttcctaattgtatttctatatggactctatactctacttctaatattccttatttttaattccgaattttagttatttcctaattgtatttctatatggactctagtatcctcttctaatattccttattttttaattccgaattttagttattttctaattgtatttctatatggactctagtcccctcttctaatattccttattttttaattccgaatttcaactatttctaaattgtatttctatatggactctagtctcctattctaatattccttattttttaatccgaatttcagctatttctaaattgtatttctatatggaatctgatttttctttttctctgattaatatgagaatttctagatcatgagagtgaacgtggtggctcctttttctatccctttaataatataatagattccggtcggcttctctttgccggtcaaaaaaatgtcaccgatccctttccaaatacgagtacttatcactatttattatatttgtttttttaattttgattactcgtagcaatgtaacgttctttaattatgaatcatcatttaaaaattattaatgattaaagttgaaataccgataattaatagtgacaagtaaatgagtacgacgacaacaatagacagatgatggggcattcttgaaagtccctcctccttattctagttgagaacatccttataaggcaacattatacacatgttcatgttatctagcaaccccatcgttggcttattcgagaaataagtcaaacaatatatttgcaaatgaaaataatttataaataaattttttatatatgttcttaacgatctaaaagtaaagactgaaaaataaactacgataaaaatgccccaaaatcaattctaaatttaaggctaaaaatttaaattttggctgataaacataagtataagcgaaaagatgtggcagtttggtcgtgtgcattttttattagtgtagagattggacagtttttgttgtttaatgaaatctttcactatactttaaacaagtaaatgggcgcagagggatcatagcataaaaccgatttgcctttagtgatttttctcactgtatgatagtcccgactacctgagcagtgacttcttgctgtagtatggtttgtacgataggggctgttaagattatagataaaataagggagtagctatacaacattcgacagttttttaaatagaaaactttcaattgtaactactatgtaattataatgtaattacattgtaactactgtgtaactacaatataagtcatctgtaactaaagaaataactctgaaaaaattgatggagcaattggttagttgaacgagcattcaagctgcaagtctcaggttcgatcgatagcaaatccgtaaaataaaccttatcaaaatttgatatttgctaaaattttagtaagtttgtaatattgtcaagttttgataggatttcttatgtatttatgaaagtttggtaataaaactaaatgtatgcatcgttggcaactttaaaaaattgacaagatttgaaatggcatcagtttgaaaaaccactgaattattatgctgtactgaatcctgttcaaaaaaaattatgctgtactgaatcaattggtactactgattctcttactgtataattgtacctggctacctgagcagtgatgacttctttatactactgttgtatactagtttgtacgattgctgcttctgaattaaggccgagtttaattccaaacactgaaccaaaaaacgtcacatcgaacttttctacacatataaatttttagcttttccgttaaatcgttctaattccaatcaaaattccaatttagcgtggaactaaacacaccctaactgtacggaaatactgaatcacaattactgattcactgaattaattggccgtgtggaacgcagcttggcatggcgagcgcgctggagacgctgtgcgggcaggcgttcggcgcgaagaagtaccacatgatgggggtgtacatgcagcgttcgtggatcgtgctgctggcgtgcgcggtgctgctgctgcccatgtacatctacgccgaggacgtgctgctcctgacgggtcagccgccggagctgtcggcgatggccggccgcgtctccgtctggttcatcccgctgcacctctccttcgccttcctcttcccgctgcagcgattcctgcagtgccagatgaagaacttcgccagcgccgcggcgtccggcgtcgcgctgtgcgtccacgtcgccatcagctggctcctcgtctcccgcttccggttcggcctcgtcggcatcgcgctcaccctcaacttctcgtggtgggccaccgccgccatgctcttcgcctacgtcgcctgcggcggatgcccggagacgtggaacggcctctccctcgaggcgttcgcggggtgtcatgctatggtacgtacgcgacgtgaaaccgagaacgttcaattctcgtgtgatttggtttctgtttgatttcacgtttcgtacgttttttgcagttgctgacagaatttgtgtgcttaatttgcagcttggagaactggtactacagaatcctcatcttgctgaccggtaacctcaagaacgcggctattgcggtcgacgcgctctccatctggtaagtcagtaccaagttcctgaatcaatctgacatgcgtctgattgtagctaacctttatgtcttctcgtggacagcatgacgatcaatgcatgggagctgatgattcccctggcattcttcgctggaaccgggtacgtacgcacgcactgccttcttctcagttctcactcgatttgcttacgaaactcgaatataccgaactaaagcagagcacgtgtggcggcgtacgtgtttttgttgtggtttgcagggtgcgggtggcgaacgagctgggcgccggcaacgggaagggcgcgaggttcgcgacgatcgtgtcgtcggtgacgtcgctggtgatcgggctcttcttctgggtgctcatcgtgggcctccacgacaagttcgcgctcatcttcacctccagcgacgtcgtgctcgacgccgtcgacaacctctccgtcctcctcgccttcaccatcctcctcaacagcatccagcccgttctctcaggtaaagtacacacacacctgggccgttgggccttccttttctacatgggccttcagttcccagctgaactggtcataaatgggccggtcatatacgtgcaggtgtggctgttgggtctgggtggcaatccatggtggcctacgtcaacattggcacctactacctcatcggcatccccatgggcattctcctcggatggctcttcaaacttggcgtcctggtacctatgccactatgctacttgatttctgaccagttcaagttaaaccgtgaaaatgttagccatctccggcctgaccatttctttcgtgaaacctttaatttgcagggaatttgggcgggtatgatcggcggaaccgcagtgcagacgctaattctggccatcataaccatccgctgtgactgggacaaggaggtgaacaaaacgatcaatccctccacacagcccaagaaaacgatcaaatgccgtagcgacttgaaattttgacattttttggctgtgttattttgcaggccatgatcgcaagcacacgcatggacaagtggtcgcaagtccggtgatgggagaggacgcacacgttcctgagctaatatgctcgtcaccagattctgccatacgagaggacaagatggtcgcgacgagtgagctgattaactgcataggtgaacagtggacaagacgattcttcatcacctgctcttgttggtctctagtattggcttcgttgcgtccaaatttatggtattggtcttctggctaccgaagagaatttaccatttcggctggccgagtgaagtaacgtatgtatggcaaatggtgacatgtgaagattgaatcgatcttatctaaagtgatttcaccaaccgtattccttctacaatcttcatcttggatttttaccctgcatgctcgccgtattggtggacgtagctgccctgaaaaagaaaattttcaactaccgttggtattcaagacgaattgccatgtaggacgccatcatcctactggtatctctaaggataatgtcagcatgagagttgacattgaagaacgggatagaaaggtgcatacgaacaatcgcgtgcgtacgtattctttgactggatacattctctgtcactgacattcacggagtgcatcggccggtgtatcatatcacttcttcgtttattccatttttgcaactggcaagcctagcacacagtggagcagcatttctggcaagtgaccagcataattaatcactaatcagtactaattatccccattaatctgagaggtactgttaaggatatcctaaaatgttcatgatctaccggaatattaaacctttgtacccgataaactcaaacaagaatcgacgatctagagtagtagagtacttgtttgctaatagaaaattgtgcaaggtagtttatcgttaatttgtattactacaccgctgcacaattagaacgaagcacaagaaaaaaaaagaagaggagaaaacaaaattcaaactcggtttaacgcgtcagaatcggagttctccttgctcccatcggagccggacccgctgggtgtctcgtcctgagctccggcgaccgggtgaacccttttgctgccgccgtgctcctctccggcgtcccagtccgcccggctctgcctctgccacgacaccgatcgccagagcgacgtcagccacctcggcgtcctctccacgctgtccgggtacccggcgaggctcgcggcgcgccggtgcctgcggtcggcggcgagctccttcatgacgtgctccggtagcctcagcgtgtgccggtccggcgcggcgtccatggccgactgcgtcctccggtagtgagggtaccctgctctgtcgaattcatggtcgtgcgtcgcgccgaagtcgatgacggattccggcgtgaaggtggccatcagggacgcctcgtcgagctcctccgactcttcctcctgcaccgcctcctccggcgccgtcaggtcggacggcaggcggagctctcggcggcggcgagcgacaccggtggcgccgtgaggttggcgcggcagagcgggcacgtgacggcggcggcgagccaggggtcgatgcagtccgggtggaacacgtgacagcacgccgggagcacccgtagctcgtcgctgtccgcgaactcggcgaggcacacggcgcactcgagcggccccgacttcgccgccatgcgcgccttcacgtcgccgtagaccgccgtggggaacgcctccacgacctccttgtcgaggccacgcgaggcgcgggacgcggcggcggcgccgccgacgggctgatgggacgccgtgctgcggaacgcccggcgcgggggagcgcgcgcctgggcgcagcggttgatgaggacggagaacacggtgaggaggacgaaggcggtgatgagagccacgagcacgacgacggtggtcggcgtgaacccgccggccgtggcgctccggtggtgtttgctcgtgtcgtcgttgctctgttgcgccaggcaagggcggaacgccgacaagagcagcgtcacgaggacggcgagcgcgatccggcggtgagccattgccgccgtctccggccaaggtggggtggatggatgagccgctcgccggcggccggagagggggaggtttcgagttttcttttggaaggaatggagtaacggaggtgttaactacgacgcggatggtgtaacgcgcggacgtcagggatggctgcgtggcgagtgggccccaccagtcagtgactgcggggacgagcgggcggtgccgctgactccctcactggctgttgccggtggaaatcagctggaagcatttttcgtgtcaccgtttcacgcgtgcctggattttggtcagagttccatctgaacaaacaaacaacaaacctcttggttacagaatcaacacgtcgttaatgtactaatccatatgcacaacttacatgtacggtgatcatgaatgatctgatggctccgaaaattcctagccaacaagaacttactgtgggttcagtacatcgagtagcaatgccgctgtcttttgcacgcaacgttttgtgcccccgacccatcacaaagacgacgggaaagtgcccaaaagtcgccaatatgcagcgattggacggcgcctggtgtggctgggtattcttcactttccgacctatcctgccgcccatgtcaagcatgtagcatgcactcgcgttacaatccctacatgtcagcttcgggattactgacgccatgctctgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagtcgtttttgctcacgaatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaatgcgtggcaagccaacgttaagctgttgagtcgttttaagtgtaattcggggcagaattggtaaagagagtcgtgtaaaatatcgagttcgcacatcttgttgtctgattattgatttttcgcgaaaccatttgatcatatgacaagatgtgtatccaccttaacttaatgatttttaccaaaatcattaggggattcatcagcgccatgcttggattagggatgcatttagttaaaaaaatagattagggatgcattattatgaccagttcattctacttgtcggttctaggaacaagctttgaaactgtgtattttgtgagttttgatgactcatgtggactaacgactttgtatgtgtacgaactcaaatcttcttttttttacaacttgtacaaactgaatctaattccgatatttgcaaccaccactgaggtcgtcgccgaaagttttctttttataattttataaagcttgacgtggtcatatgaaatttgtagcagtcaacttttaaccgaacaataatgcgcagttgtttactattatgaatcatcaatcacgtggacatgtggtggttgccttggatcaattctttgtctatatgtcacgtaagttacgtacgctagatcaattagaataacctcttcgcgttgtttcgtcactgctgctgcacaattagcaaaagtaacaaataggcatgcttgtaaaaagaatgctagtcattgacattgaatccttgagttaatgtgaatatggctggcatgaatctgaaaagaaagaaaagcagacatcagttggaacaatagcgcactgaatttgttacctgttttatgggcttcataatgggctgattctgtttcagttaggcttggaaatatggaataagtacagtttgactccctgaaatgaacacggaatctaaatcgtataccttatccgcaatactagaaatcttgacctccgaactgtctaaaccgatacaatttgactcccttgatgattttggagggcggtttcactgacgtggcgcacacgtgacaatgttgacctggtcttcgtaccacgcggcattgacgtggcgcttatgtagcattaaatttttaaaaatatgcgggagccattcacacaaaaaaaaattatgggacccactgacatgtgcgtcccacatgtcatcctctatttatcctttcttcttcctccctctcctcccttctctatctctccctctttctcttcgtgcgtgtggagcggcgtctggatcggcgtcggcaacggtggcaggcgatggacggagcggcatcggcgagcgggcggccgctggagttgcggacccagaggccagatccgcccctcgcttgcttcctcctcccaatagactgcgccatggccggcgccactgcgccgccgatcgtcaccgatgacctcttcgaccatgtgcggcaagcgggtgcgagagcggcggcgctggcggcggtggcttgtcgcggtggaccacgatggtggtggtgccgtcgacggcatcgtgcagccatgcatgaggagctcaggagggaaaggcgagagagagaaagagagatgggagagaggaggaagaaaaaagggtagtgagagagaagataacatgtgggacccataattttttttgtgtgaatgacaaatgggccccgcatgtattttttaattttaatgccacaaaagcgccacatcaatgccacgtgggacgaagaccaagacaacactgccacgtgtgcgtcacgttagtgaaaccgtcctacaaaaccactaagggagtcaaattataccggttttgacagtttgtgggtctggtactgcggatgagggatacaatttagttttccgtgttcatttcagggagttatagtgaacttattcctggaaatatcgagtgtccggcctgctttataccatcaggttacagaagtaggagaagtttagcagtaatgggcctctgtattgactggcgcaaatatttagatgaagtaaaggcccacgcattctgtgcacattatgacaactccttcggcctgagcataaaaactgttaacaaaagaacagggaataacctattttttgccaagtttttttttctaaaaaaactatttggcctccctcatattttgctcttgattgaatcgtcttcctcatcttagcaaaccgttgcaaatcgacttttttgatgtttaggaagtggtttttaacgatgtgacacgttgaccatcgttgacccgctaagtaagcatgtagacccgcacgtctaggactctcaagtctcatctctccttttttttcatctctccctgagggcggtagggaaagtattctatcccatccgctgccttgcttctccttcatagcagcttgggttgctccgtcaccgatctgctgccatcacagtagctcatagccagattgtcggtgacctcggcctgggccctcgggcgtagggacgatgcgggatagaggatttgtgccaccagccttaggggatagatggaaaagaaaaaagagaaaggaaggatagatagaagagtcgctaacatgtaggtcctacttgctggttcagtgaaaagccagttcctaaactactgaaggagttagtttacaccggtttttgaagatgacaaatgcgttatacccgattttgtagttaagatagatgattaaaatgggtgcaagagatagaagcaaaatagatttattccaaataacaattattccattatctaaaaaaattccaaataacagtagggatattgccgcgtgtgagttgtgacagccatatttaactgctaggtggaaaccaatcgctgctaataaatctgatcaagctgatgcttactatgcagagttcaccgggcaaatgggcctaaacttgtaacgccatcacgccgtgtacctccttgaatgcctagcatttctaaccggagaacaagccgctgcgttccaaattgtgtccaatgatcaagttcgtttctgactttatagtgatagagatcttgatgcatgtatatatgaaacatagtggaacacgccacgaaatgccgattggtttcgtgccataacagaataaccttactgcgagaaaccacgaatatgcagtgtaaatgcgtttcacgagtccactgcacataagcactttcgcagaacacaagaaaggatcaccacggtcgcgctgtgtatgagagcaatatccctgcacgaatcatgtatgtatgtgcgacctactagttgcattgcgtgcatagccatggaccatgatgggatcgatcacagttcacacagagctcagctagccatgccgggacgaacaatcatcgaacgacgcggctctgtcgtgtcctaggtagcacaagtggtgtgatataaggccaatgcctgatgtttgaagcgacgggcacgacgacctgcgtactcctacgtcgtacagattatgacacgaatcattccaaggtggaaactgacccgaaacgttggtgcgttccttgtgtcttttttactactccattgcacccatcgcatgattgacgacggcgaccacgacatacgatcgatcgatcgcttgcatgacgcgacgtaccggtcggcgcctcacacacacacacaccggctcgatcgcgttcattattcaattcagtaaccctcatgattcggctggctcgaataacctgacgctgccagtgccacgctgcataacctgcaactcgatctgcatctggctccatatcggtgtggaagttgtagcggacacttctccgtccagaccagagggtccttaattgacaccggccacgcatccactctcctgtagtagtctgtagaccgatccaaaaccaagtttccgatcgatgctctgcgcccggcacgctgggccgcgcgcgcaggagctgaggcgcagctgcaaaccgcggacacgaaacaggaggtcgggaaagtggtattcgcggcgtaatatagcccatggcatgtgcggaagccgcccgcagcagcaggacgatgcgatgagccaagccgccgtataaaaccgcgcgatcccgcgtgtcgtgtgatgaggcgcgcgcctaggcatagcgaccgaccacgcacacgcccacgcacacgcccgcgcggccgcagagaggccaggccccaaggccgcgtacgtaggggcccccgcgtgcgcgtggcagcgcgaggacgtgttgtgcggtaaccaaattacggtcgatgccggagagcgattcgtttctcgcgcgagtcgcgagtcgcgagcaggtttcacttatcgcacgataatcacgcgattatcgcggttatcgtgcttattgtggggtacggtaggagaaatcgacgatatggtttggatgaattttgactaaatttaaaatcccggaaaaaataaaaaaaattgaaaaaaattaaaaaaaaaatcatgtaagtagttcttgatttgtaattatcaatggtgaagaatttttttgaacagagtaagctatattcaaatttgagggcaaaccgagaatagtttacaaattggaaaaggaaagagaatattgggccttaagtatcctacatattcttccaattattctcaatttctagttttctacatatattcaaccgtattttttatttttttcccctatttattttgcatttatatgatttcagttacatagcccgcgataaccgtgcgaataccgcagttatcgcggtaaaccgtgcgattatcgtggtgaaaccgcgaaaccaccgagttttgagttcgaatttttggatgtgatttttgtgcgattttagacgattatcacgcgattatcgtggttatcgcactaccgcggggtggtggtaatctcggcccaaacgataaggtaaaccctggtcgccagtgctccactgctccttgtacggcggggtcagcggaactctgtgggcgtcactgttcgtcacgttggctagattccggcagagaggcagggtccttttgctctgccattttgtgaccggtgtgtgtccgaacgctgcacgaaattacacatcagaaagagtagtatatctgtgactctgttgtgacgacgcgagtatctgacgaccacgtacgtactccgtacacgaaccgagctttaaatcacagccgtcgagatttgcacaaggcataaaaaaaaacacgggctcgccagtagaaaaataccactgcccggtcaattggcgccatgctgacataacggagactgtaccatgcattgccagccacacattggaggtagcaggagacaaacatgcgcacacacatgcatgatcgaacactattggttctattttagtaccatactttacaaggttcgaagtgttaggagcttgactaggggtaagaataagatagattccctgatgtaccaactcaatcctccatggccaagacaaattctctagtagcatttggttttatgcatgcctgcaggccgagctatagattatggtatgattcccgtgccgacatcggttgcagttaacaaaccaatcttctgtagttagatggccttaataatctgctacttctgctatatctactggattatcatttagtgaactagcttagttagcttgtctgttgcatgacttctaattagatgattcagatttggttgcttagctgcagctggcctgtgatggcagcattcccagcctatagcactgcctgatccaagcgagaagagtcgtattaacatcttacagcctcttcattgtcaccgtaaacaacagaatgcatgcagacccaccagtagattaatttatgtccagttatattttttaaataaggtgagaggatgtgtaacatactacatgaatggttgaggattgttcacttgttctaccaaccactttgtgacactatcttggtcagtttgttgtatgtatatttgtactttgtaactgggcataccttttcaagaatccggtgtcgatcttggaatttggcacaacactatgcccggggtcctccgggcgaaagctataggaagaatctttgaaatgtgcaagtacatcgaaagcatttacctgaccaagtgaccaagttgcaaataaacttaagtctctgaacgaaaaaggttgcaattaacaaacttgctagggacttcccaaaggaagcgttgcaaaatccatttattttaagggcagagaggaccccgggagtacgtaggacgctgacccgagacggcagcggttagcaatgcttccaaacttcgcaattcacacttgcaaaaaagaccatcaccaaaccaaatcctcggttacctacttgtccgtccaaattaatcccccacaccggatctctccaagatttgcactgattaacaatattgttcgagcatgtcgtcgtgctgcgtctggtaatgcggcgcatactgcagcaggtatatggttttcttcctcacctttgaactggagaaatgatgctatatgtcaagagagctcagctaacacagctgttttgcctttgtttcgagagaacggtatggtttggtgcataatagggcatgggcagaatggaacaagattgccgaggattacgttaaggatatagtattaattagcgcctacctataacgtaggagctgcacgaccgaattgacattttgtacatgctaaacaacaaactaggtgtcgcacgatttctggaacattgcatgaacaattagatacacaaaaaagatttgggtatatcttcgtttcattagataattggcaatagttaagtatatctgagatcgtttgtgtaaagataagaattcgtaaaaccatgtgtgtgcatagaggttttacgtacaggttcgtgcctcccgcaagataatatccatatattttgtttgtatgcatatacctaaactatatccagattatatgaagtacaatgtgtatatagaaaactctaatctagatctagccgatcataacttttacggtataatatactagtaccggtatatactagcagtataaattaataaaggcaatgttgaaaatttgatagaaaattttatacgataatttttgtaatttgcggttcagatttaatctaattgtaaatgcccagtcctagttctctcgtgtattaatataaccatatgaaagtattttgtgacaactgtattaattaattctattttcacatattacatccttgagatgcacttgataatttactaatcattatattaataaattattattttaccactcataaaactggtgtataataccggataatcactcttccagattttgtctatggactactatacacatcagaaaattttgagaagatatagtatgtcaagtcgagtagtacgatggtggtttgtttaattttagcaccatttatttgatatgttatcgtatagtagtaacactcgatcggtcagaaatggcttcattctagatgactatgtgaaatataattttgtactacagccacttggacgctctgatttattgacacggattcgtatcttttcaccaatcataatttctagttttatactacgtaaaaggagaccattgatgttacgttcagaaccaaagacgaccaggtaaattacgcgtaggaatgttcttatcaccagctgtagtatgagattttatccgagaaatgttaagctgtcactgaataacattttgggtctttatcctactctgaaactctgatagacataggagagtgcttgccagttattgctagccagccagctttatcagcattggcagcaatcaaattcatgcaaaaagaacaaagcattggcgtcatatagtttcatcaaggaaaactgaagcaaaagaaaatgcctggttgccgtacggttgcgtcattgtaagcatttcagtctcgatctgagcagattctcccggggaaagcatccaggctaagctttcagcatctccagggcacaccacgtacccgagagataatggagttcttttagcatcgccacaactgcatccagaaactgatgtgaattgaacaaattgttttaggtacttataattaagaaaggtctcattacattccaagcgtgacacagcagaaataataatgcttcagtgcagtatacctgaagaacagaacaaaatgctttcttcaggccaatccggtgttctgcccctggtttgaactagcttccggcaatatatttggagagcggtttcagttctttcatgggcttgatctaacgtgtccatgaggtcaataatttacaaattgcaagggaacatttgttcttattctccagcatctgtgataaacagtctaaagtacttgtcgtcgtccatagactgatcaactatgtgattagtatatgcactgccaactgttctttttcaatcttgttggggattccaatggaacctgtgtgccgtacgtctttctactgtcttttggaaacaggttaacacgttcttcctggaaaaacaaaaatactacttacagagaagtacgtgttactgaatttttatatgcaaaacacccgtcccaaaaagatgccaacggttgttcagctttgtgcatgaaactgtggcataccacagaggttatggtcctcaagttctccctgcctagctgccgttagacaaaagttagaaacgaacagatcgaaaatgataccgaataagaaaaactttgtgcatgaatgcatctttcgctttcgtttttactgttgctgatgcggctatttttgttggggttagacatgatggggcgcaagttgagccatgctttggcgaacaccatcacgaactgtgcctagatcgatgaatgtgagctccctagcgtacgtggcatggaccccaacacttcaacgagagtatatctgtacatcacaagcgtacatagaagttgaaacttatcgtgccgaatcctcatcctcacggctaactatctagtcataatgtctcatctttcagtacaaccctgataataatatatgattattaggaaaatgtctatactatcggttagaatacgtaatacgtgttgaatatactaattatatttagttacagttggagtacttgaagttagaatatgtgataggggtaaatgtgaatagtacgatcctgagtcatatatttgttatttttgttccccttatataggttgaatttaaacctatatgtttaaggtgtgacatgtcgcatatgatctatcatactccctctgtttcaaattataagtcgttttgttaaagtcaaattgctttaagtttgactaagttttttaaaaaaagtaacaacattttctacccaacacaaatatattatgaaaatatattcaattatagatttaacaaaactaatttagtgttgtaaacattaatatatttatctaaaaatttggtttaatttgaagtaatttgactttgacttaaatcaaaacgatttataatctaaaatggagggagtattaaatttaatgtgccaagatttagcattagtgccttaatctttgttacgttgtgtaatttcctacgtcggactcaggatgatcccatctcacagattttatgcgccaatcagctgtaaaataatcacactacacaaatttgtactacttgtagtacacctaaacatattcctttagagaagtgacatatcatagccgattctttgcaaactcagtgaagcttctttccaaggaaagcgacgggtgatacagacaagtagacatacttgtacaagagggtaatcgtaaatttgatgccgattgaaacatacaagacagtagatcaagccagatcacctttgtaggcggatgaaagccacatgcatgcaaacactgtagtgaaagacgatcacaagcagaattctccaattacgagtccaacaatcaagcagaaatgtacgaaatatatgtgaacagtaaaaatcaacggacgcagtgagtaatcagaaaattcagatcgactcatggctgcacaagatgacctgtacgtgtcgcttgtttgccacgccccctccgatcaccgtgcagcgcagaatgccagaatctctcgatctgagcaaccggcccgccgttccaattcgcgcctgtgcgacgtacgcctctcccgaccgggtgcgcgcgccgcgccgcgcgttcttcgccaagttgccacccctcttgcaggccgcgttaccgcatcaaacaagccgcgccacccgatcgatcgcccgcgcgcccgcgtgccgagccccgtccccacggctccgcagcaagcaagcagatcgcgccccgcccgcgtgcgtgcccgtgcccccgcgcgcgcgcgtcatcttgctttgcttccgctctccgtgtaaatcattgcgttttcccttcccgtccccctcgcgcaaaaggccgcctcgcccctcgcgcgtagcgtacgtggcccccctccccccgcgcgcaatgcatgcgtgcaccactgcaacttgccccgcaccgcgcgcgcgcgcgcctctctcggccacacacctcgcgcgtccccttataaaaacggcggcgcccctcgcgtcgctgggcaactcactctttaattcgcctccccctgaatcgtgtgcgtatcgtatcgtggcgtcgtcagttcgcgaaaaaaaacgcccgttcgttttgccgggtgcgtgcaggatggcgttagaggccgtggtgtttccgcagggccatttcggctacgggtgcggaagggactcgccggcgtacgggatgccgtggtgcgacgtcctggctgctgccggcggcggcggcggcttcggtgagttttacggagtggacgagtgggatgaccagctgcaggtcgcctccgtggatgagtgggaggtggcatccaaggataactcggatgcttccacggagggcaaggcggcggcggcggagcgggcggagccggtggccgccgggaggaggaaacggaggcggacgaaggtcgtcaagaacaaggaggagatcgagtgccagcggatgacccacattgccgtcgagcgcaaccgccgccgccagatgaacgagtacctcgccgtgctccgctccctcatgccggcgtcctactcgcagagggtacaacactaactacgcatgcttcaattaatcgcttttacgcatactgttatgattcgttaatcatcattaaatcgaatccattttctgctcagggtgatcaagcatcgatcgtcggaggagcaatcaactacgtgaaggagctggagcagctactgcagtcgctggaagtccaaaagagcctcaagaaccgcagcggcgccatggacgccgccggcgattcccctttcgccggcttcttcagcttcccacagtactccacgtcgcctcgcactggctgcagcgccgccgccagcgccgggagctccggcagtgcgagcagcgtcgtcatggacgacacggcgggctccgcggagagcggccggcagtcggcggccatcgccgacatcgaggtgaccatggtggaagggcacgcgagcctcaaggtgctcgcgcggcggcgaccgaagcagctgctgaagctggtcgtcgggctgcagcagctgcgcatcccgccgctgcatctcaacgtgaccaccgtcgacgccatggtcctctactccttcagcctcaaggtaaaaaccaatcgacaatttgcacctattttactaccacgactgcatgcttagttagtttaggctagcagcacagacaaattaagcgattggaacgtcgcgggtgagcgaagattcgctcccatttttctacaacgccgatgataatgtcatcgctttcgtttggatgttaggtggaggatgattccaagctgggctctgtggaagacattgccaccgctgtgcatcagatcctgggcagcattcagcagcaggaggccgtcctctccatcagctgacgccgcgatcgatggagacgacaaccgagacggccgccatgtgaagcctctgcctcgtccgtcctggaaatggaaccatggcgcctcgatcgatagcttgttagcttgtaatgtgtgaatgtgattgtaccctagccaacagagtgctgcatgcatgcagtatctccggcgaccttaatgagaaatctataccaacattttgagctcttgtaaacgtacgtacgatgaccacttttgtcttgatggaggtgttgtgcactagtacctcttgcttaactgctaccttcttttttaaaatatattacgtcattgattttttaacaaatatttgattacttgtctttttttacaaatataaaaaatctaagttatggttaaagaatatttgatgattataaatcaagtcacaataaaataaatgataattatatatatatttttaaataagacgaatggttaaacgtattttaaaaaatcaatgacgttatatattaaaaaagggagtactacttgccatttgcataaaaggagggtgactctaaaaccttacgccttctttgaaatggagggacttcaagggtttttcataggctatacactaatgatatatcgaaatttttgtgttctgaaggagcccttgggcgatggtgttcttaactgatgagggtaaaaccattaacacataattaattgagttttaattattataaataaaaaaataggtttatttgatattttaaagtaactattatatagaaagttttaacacaaaacgtctcgtttaacggttttgaaaatcatgctaacaaaaactaaggtagaatctagatcttaattagaaacgaaaatatcatgaaaatagttatgagaaatccagaaggcaaaattgacagcattagtgcaatacctaaagtcatgaattttcaagtgtaaatctgaatctactcattcacaaaaggggaaaaaatcacatacgctaccaatagccgattgctttattcaacgtatagattgattttggatttaatttctttgagatatatcacgtacatttttttctaagtttcttgaaactaattggttacaaatcttgaactgtcctttatgatgtaccaagagatactatattttctagcgtagaggtactataaaataacatcgaaaattgtgataactcttgataaaaaaagaaccgtgcaatcactcatttgattagcatttgaggtatacggctttgtgtcctaaaaagacctgtggcccatttgcatgcatccatctctgtttcggttcacatgaactctgctttctctgctttagagtgcatctgtcaggagctatatatgactggtcgaacagcgtggcatccatgcagtgcagaggccgaatgattgcccgatgatgtgatgagctgcttcttttctcgtgataaacagtaaataatcctcatgtgtgtttggttctgcggtttggtcgcaggagtacataatgctcttcagacaatcttgctctcagggtgcactagcctacagagacaacatgagtgatctgcggcagagactagagattccattgacccgaaggacataagttctgttactaccgtataatctaggactccatgaattcttgatgtccaatgggcgtttgatcggacttgttactaactggctgttcccatgtacgtggatttcagaaaaagaatgaaccattttttcttcctctcgtaatacttgagtaagtttcagactgtcagtgagcctcctattatgcaccccacgtttctcctcacaatataagtactgctacgtactctctccgtcccacgtaatgtaaatgtaaaatgaaataagacacatcctaatactaattaactaatactatgaacctggataaatatctatccaaatttgtttttagatagagggagtacatcttatttctccggtacaccaatcggacaaaattctgagcaaaattcttcgactggtaattcatatcaaccttctattgacgatatagatctaccgaaatatactgtctattaacaatgcaatgactggttctgctcaagtacgttggaaaactcggatgcagtatattcagagtagcttcaataaggcactcgagaaggatgaggattaagtagtcgtatacaaacttgactgcgaggtgctagctgtacgtggccacgtcagtgtcgtgtgtaagctgttgagaaagatgaggattaagccgtgcgatgccccgttttagccagcaggtcgttgccggaacctggggcctaacagctgatgggagtactcagacaagtggcccggcagcttaccgatgattggctttgtagtttgtgtagatcagctcttgcgcacctgtacaactatgtcttgatctagccaagtagcagcaaaacggcatcaagctgttcaagcacaggtgcactgcatcacacggccaagttgtggttgtttccacatcagattagtaagcagctcactttcaccgcggagaagcgaggccaggaaacaatttgattcacctggaaattaaactttccagctattttcacatcacagtaatacagtgtaccggctagcttaattggcacccacaacttgtgagaactttcgtgctgagctgatgcatcgatgccttgaaagctaaccctgctttgtttctatcgatcagtctgaaggggaggaggttccttgcgaacattatatgtgctccccccgtcaagcaaattgctgggatggagtggaagaagtggctggcaaaattccaaattttacactgtgctataatgacggcatgtgaaccatctggagtagacaagttgattgattgattgtgtgcgtcagtgttcttaaaaaagaaaaaaaaaagaatgaatgatttcgcttgttaaggggagcaaatcttttgcgtatactaagagttggaagtttacgttttgactacatttattctacgatgatagttaccatatttgagaacgaagggtgtattgttcaggtaatattccatgcatcagcgctaatttgctgatattgacatgttgcaagttactcgtatgtcaaacctcaaaccaaaccaaaagaaaaaaataaataaaaagtgaaacaagcggtttacttctaggcctggattgaacttgaattggatcttccgtcctggcccatacaaactcctcgtgttctaccctcatcttttcccggcccagtactacttagttgggcctctttaaactcaaacgaactttagactgtccacactcaaccacccgtttcccccaactctctcttcttgacgcagtgacgttctcagactctctcagtgtctcacacggcaccatctcgtctggtgttcaacttgcagcgtttccgtatagcgagccatccaaatttggttaaggtaattagtgtaccgtattttctaggcaaaatttgctattggacactgaaagattgcggtttttactgtgagacacccgaagatcatgtatttgctcgtggacactgtaaaaaagtgataattagctgctgaacactcctcacattattttattatttccggttaaaatgaagagagagagttgtgtaagtaccaaaatacccacttacacttcctctcacttcttttcttttcccttcttcttcttcttctttggggcgacgacggctggcctgagccgggacggctgggccacggccgggcggcggcggcggtgcatcgccgggggcggcggcggcgcatcaccgggacggctgggccacggcggggcggtggtggcggcgcatcgctaggacggctgggcggcggcggcggcgggcttgacttcttcgcatcgcgctcccacgccgctcgcctcgtcgacctcgtcacctcgccgtggcccgcccgcgtcgtcgccgcctcgtcgtcctcgctggcacaccttcgccgtggagctctgcccggtgtgccgcgacagagaaagagaggaactgaggaagagatgaacagagagaaagagacgaagaagaacaacagagaaagagagattgacaagtgggcccacgggcaaatttgtctttaaacaaagtttaataggagtagtgtccagcagctaattaacacccttttaagtgttcataaacaaatacacgattttcgagtgtctcacagcaaaaaccgcaatctttcgatgttctgtagcaaattttgcctattttctaacggtgcctacggattttatccaactttacatgaaagaaaaagcgcgttcaagatttagactgagtttagttccaaaatttttctttaaacttccaacattttcatcacattaaacttacaattttagcgtgaagtaaacacacccttactacgcatatcattttaatttcaactaaacttataattttagcgtgaagtaaacacacccttactaggcatatgcaacaaagccgcttcacgtgcattctgaacaagcgaaagctgttgtctcactcacatgtcacggcatcggacatcggtaaagcaaagggaaaaaaagctagggctgcaggaatt

SEQ ID NO: 2966 - DNA, 7155 bp, Oryza sativa
catccatccatccatctagaacacgatggcggcggcgaccgcgccggcgacggcaacgaagctggcggtggcggtgtacgtggaggaggcagcgggggcgccggtcggggcggagacggaggagggggtgaccgcggacggggtgacggcggagggggcattggcggcgggggcgtcagtgggcggggccggtggagacgccatgggggacggcgacgcggcggtgggcggggtggcgaccggcgcgggggcggtggccggggacctcgccgggggagcgggcagcggggccatcttgggcgccgggacgggggccgctcccggggcctgcgcggcggccgtgaccgcgaggagggcgacgatggcggcgactacggcgaagcgagccatggttttccggcttggaaacgtgagttttcaagtgcgtggaaaccgcgaagctgtgagctagagtgtgagaagatgccgatgaactgtgtggcgaaaacaatgggagggtccaggtttttatagccgaaaggctagtataccaccatgtcggttaagcaacagctgtagcctattgaagtcgtgacgaagtcgcaacggcaacggtcgccgacacgtgggggccacgtcgagtgggaccaacacgtcagtgggttgggtccggctggcaccgaccaccttcgtcgcgagagcggcgccggctatgttgacccttcgtgcagcggcaccgcgtcgccgggagggagaagcggttgttttaccaggtaatcatccaacgactagttccaagatggacaggtggacgagtgcctcgccgtcggattgtccatggacgtgtgtgatggatcacgataaaatgcggccctcgggcgacgtgctgggccgtccggctactagccgttgcggaggtcggttttggagttgtttacaacgggcgagacgtggtgctaatatgctatttttaatcttaccaaaatagtaaagttataaaaaaaaagctacatttagtttactgtcaaattttactaactataaaaaaatcctaccaaaaattttaggaagttaccaaaattttgtcaatgccaaaaattaataatttttttttcatcaaattgaacagtcccgtgctgtgctgacagatggcccgcgttgcgagccgtgacggccgggccggcgaacaagtgttgtgccgtactcccgccatccgccatgtgatcgatccttcaaacccgcgtacgagtagaaaaatctgcaggctctctttcaatggagaaacataaatgcgttttgttggaagaattactcggtgcaggtattggaacagtgccattttgcttctatcgccgtactcttctcgcattggtgttgcgcagaagaaaccggaattacggatggcgaagaaaaagtatggtcggtgtggtcggagatttttctacttccttatctttaaaatatggttatgtttagatcaatttaccgtggcaattttttttgcaaaaaatttggtggcaaaagatttggcattaaagtttttctagttggtatttagatgtatattaaagttttgcgttttactagtaaagatagggcctgttcactttgatgtcattttcaatcttaataaattttggtaaagttgctaaaaaagtggctacatttagtttgctgctaaattttggtaactatataagaaatcctaccaaaattttggcaagttgccaaaaagccaaaatttggtgaggttttttttcatcaaagtaaacaggcctatagagagagcatggctcccaatatattttttgcaaaatttgctactctagacttcaaaatgacaaatgtcaaattaccaatttttgctactagtgtttagttccattttgacaaaaagtgctaaacaacaacaaaactttcgctattttagagcaactaaacagagcctaaatcacatttaatagatgaacttattattaaaaaatgaaccggggaaaacggtctggcttggttggctaccagcttgcctggaaagcaggacatgtgacgctgtgaggttggcatgagctgtgcctgcgcgaggatggagtgtggacacttggatccggctggttgacagtacacaaagaagaacggactggcgcgcatctcaattaaagagaaaagaaagcagctgtctcctggtaacgcgctattttgcgcgtctgtttgtttactctaatccgtctggatgcccaggaggagtatgcgcgtcgatggatgccattatcagcttcccggaaatgcaaaaactagctggctggcacggcacgacaatacaaatgaaatgaacagatagatcaacgaagtacaggcagatgcaaacgcacaagctaagcaggtgccaaaagctgaaaacggtaagctctctactattcggcgcacagcccagcgcaaattccgaaatcgagcacaggaaactcactattaaggtccagtgagtccatgttaaggcctactcatgacaaaaggcccattggtaaactcgctactgaggccgagccaatgtggtaaataaggcccaattacagactccttttcagtccatctcataatataggcccactgtggcgatggcctcttttttttttcctttctgtgtgtgcgtgcctaaatagcaccgaattttaccatgaggtcatctgagatcggcaagaggcaaccaaaactactgttgcgagttcacaatgccagaaaaaagtgaatactcctggccaagcgcagaaaatctacggctacaccgaagtcggcattgatctagttcatcaccctgtactcctacaataaaacagtttgttttctgaactcaagtagccctgtacctgtttagttcctaacaacttttcacaaaaacattacatcaaatctttcaacacacgtatgtaatattaaatataaataaaaaaaatcaattgcccagattacatataaatcacgagatggatcttttgagcctaattagtccatgattaactataagtgttacagtaactaacatgtgctaatgatggcttaattagactaagaatattcgtctcgcggtttccagacgagttatgaaattagttttttcattcgtgtccgaaaaccccttgcaatatccagtcaaacgtccaatgtaatactcaaaaatttttatttcaccaaataaacagaccctaaagggcatctgcaatctgtagataaaggaactcattgattgtcatcttaaaaaaagaaacattttgattgcactatcggggtactgtatcatgaggaccacacttgacgaacatgacacacccgtagcacctacggcctacactagcctccaaagtttccatcgatttgaaaagtctgaacccttctttaaactcgtctaatagggttgttagcctacgacgttattgccagctacagggattttgaactcgtcgtaccctcaattaaaagcagagaagagaagaaaaaaacatgggagtagcagttgttcagcggtgcaaccgaaacccaatccgacgttggggttgcggcgatagcgacgagatcacgagacattgcaacgagacctcgcttatcagcaaggaaaagacgtggccgtgggtgccgtgagcccgtgatcgacgaggttcattcgctctggtcgatcgatcggaaagtgtgagctgtactactacaagtatagtaactctatggttcgccaatgccggcagcacgagctgttcagccgttttcggcacgtgaaaaattacgccttagattcatcttactacacactggcacgatcgcacgagtgcatgcgttgcatgccagtgcatctggtcgtcggctcgtcctgaccagtgtggattttcatgtgtatgccatgctgctgcactgcccatctcgcatctctgaatgcgtcacactatcaaagaatagcgtcacgtgggctgatggtacgacgacgctggtgaatacaccatctcaaaatataataacttttagttaaatataaaatatcatagcactacgaatctgaatagaacgaaacgagagatcttctatctaaattcgaatctgaatagaatgggagatcttctatttaaatttatagtattagaatctgaatagaacatgagatcttctatttaaatttatagtattatgatatgttctatttatctaaaaattataatattttagaacggaagaagtagcggtttgaagagcatatcgatgtttggtcacactgacgagccagcacaccgccagtactactgtggcactagagctcggccaaacaaagctgaggttgtaccgctgtatctatcgactaggagtatcgctggtggactcgcacagtcgacgctttgttgagttgttgtgacttgagctgtccttgctctgtttgctcgataaaggtggagccgggaccagatttgacgcttaacattgtgcagaacagtgcaccgcggcccaaccatcgcagcacagtgcacagtgcatagtgcacctaccgctagactccaacatttataatcgtcgaccggatacaatagatgtgagaagacttgagttcgctcctactccctccattaataaaacaagagtaaatttcataaactacatgtattttgtacaatttatcataaaactatagatttaatattctgttttacaaaactacagatttagtatcttcgtttatcacaaaactacatgtactttgtacaatctatcacaaaactacagatttaagaacttgtttcacaaaaatatagatttagtgtattcgtttatcacagtgctacacatttagtattttcatttatcacaaaagtacagatttagtttctccattctcacaaaactacatgttttagcattgttaaaatgtgtagttttgtgagaatggagacactaaatctgtagttttgtgataaatgaagatattaaacatgtagttttgtgaaataagttattaaatatgtagttttgtgatatattgtttaaagtacatgtagttttgtgataaacaaagacattaaatctgtagttttgtgaaactagttctaaaatctatagttttgcgatagattgtgcaaagtatatgtagttttatgaaatttactcataaaacaaacttaagactaaatgtgatatactaaaacaaatctagaattagatgtgaaatatcctagctcccattttattcatattcattgtactaggattttatccgaattcgttgagattttgtctagatttattgtactagtctactagaatatgtctacatctaatcttagttttttttttcacgaaggaagtactttcttcgttgcgagttaaattaatctattgtaggatataatataccttactagtacacatatgtcttttagatttatagtaatacaatacgttacatcacttagtagattaacttaatgtggaacataatgtatatgttagtactataaatatgaatagatgtttgtttagatttataacactattatatggagtttgttttatctcgtattagattaatttaatataggacggaccatgtcctagtaggctcctgtcagtaccacagagtaccactcctgcacttcagaccgccttgatttcactgcacttccaatacactcgacaaaaacaaaacacgttgtagaggacaattcttgcgagtttttagcccagcagactgttgataaggagtactactatactcatgttgatacaacaaagaacaaaactgttcgttaagtcactggtcacccgtcaccccctgcctgttttctctgtgggaacagaagctgggatcaatttggccgtatttttcctggcgcgctgcctcgctttccgctatttctcctactcccgtcctgggtggacggaatcggatgatcaatggtgtgatggactgatgggtccggatggaaacagatcctgttagctactttctccgtcccaaaatgttactctcctatcctagatagcaatattttaaaacgaaaaaggtagatgacttcacatatcaaaatataagtatattacatatcttatatttataggtagatgacttcaaatattagaacatatcataacactataatttaaatgtgtgctcctatatgtttagatatataatattagaatatatcatatctgattatcggttaattttgtatgggaccaatgaagtactccctccgtctcacaatataagggattttgagtttttgcttgcaacgtttgaccacttgtcttatttaatttttttttgtaaatataaaaaacgaaaagttgtgcttaaaattatgtagataataaagtaagtcataaataaaataaataataattttaaaaatttttaaataagaagagtggtcaaacattgcaagtaaaaatgacggagggagtactaactcgtaagacgtggaagaaacgcgaggccgagccggaccggacgtcggcgtcgtcttccggcgacccgtactacagtagtatggtccatgcgctagtgcgtgcgtgtggcaggctaccgctttattggttgggttggattgttgatgcggccatcaatcaatcaatcgggctatgcggcccgcgactttctgggcaaaggaaggttgcttatccgggggctgcttttcaggccaccggagaacagattcccggctggaaaaaaaaatgtggttaggtcgcgcctgactttttttgcttgcgcgacttgtggtcttgtatacgtgtaaggtttggaagatgaattttaatattttggatggacgtctaatcgttttcttgcatgtcaagtaaataattataaaaaattttcaaaaaaaaaacaagaagatagattaatgtgtaatataccacctcacaaatatgcaagttcaaattcagcttctataaattataacaaaaataacaaattaaactctaatattcacagttaaatttgttatttttgttacaacttgtagaaatcgaatttgaacttgcatgtttttgaagtgatatattatatattaatctatcatgtcaatttttttataaccatttagatgacatacaagaaacaggtggacgtccacttgagtatttaaaacagtttcccgtaaggtttggctcaatttatactatccagtacgggctgcaggaatt

SEQ ID NO: 2967 - DNA, 21083 bp, Oryza sativa
aaccgaaaatggagcgaaaacgaaccggcgcgaatacggtaacgaaaatttatcggaataaaaaatccctcaaactgataaatccaattgaataaattatctatatttaaaagatttatgttgttgataaatcccaatgcatgacaaaaaaaatattcttatgtaattttagatttacataacaaatattatttttttaaaataacagacaaacaccatggtatttactattcagtgcttaaaaagagaatgcagggtatttccgtcacaaaatttctggtaattccgagaaaattttcggaaagtttccgaccgatttcgagctccgacggaaactgtccttatcatttatgattccgtttccgagaaaatattttcgaatttgattccgtttccgaaaaattccgaccgacatattccgttttcaaaaataggtccggaattcagaaagtttccgtaccgttttcaccccctagtgctcgccgtgttttggcgtttatacatccatagctgatagcatgattggatatttcggtaaatcgataggttctgcggaacttgagcaaactagcacaagtgttgaaaaaaaaaaaaggaaactagcagatgtacgacacccattatcgaccctcattaatctagaacgtattaacactctcatcaagcgatggggctctgcaattctgcattgtcgttatcttctaatagtactcttttttttatataggatacattgcctacgtggtataggctaatagcagcatacggcacgtttgtgattgtccaagtgaacaatatcctagacccttaacacgacacgtcggcattatataatagcttggcatatactccctcctccataaaataagtgcagttttgcgctattcacgttcaacgtttgaccattcattttatttgaaattttttatgattagtatttttattgctattagatgataaaacataaatagtattttatgtgtgactaaatatttttaaattttttacaaattttttaaataagacggacggtcaaacgttagacacggatatccacggctatacttattttgggatggaggtaataccatttgcgcgtgaggacgaaggctacaaaagatgcaaagcagagctccgttggtgcccgtaaagcagggtccttgtcgtgattcacgcgtgcagacacggtcgtctcgcccgagcccgatttaatttacacggacaatggacatatccctaaatccgtaagatgacatggtcgatccttcgcaagttcatatagaagtcacatacgtcctgtttagattttaacttttttttttaaacttttaacttttctatcccatcgaattttcctacacacgtaaattttttacttttccttacatcgttctaattgctttaaacttttaattttaacgtggaactaaaaacagcctacgtacatcaacgcgtcaacgccagcggcgttgcgtatgaagctgatttatctataatagctgctgctagtagtttcagcacgccgcacatgcgtcgtgatgttgatctcactggtggtggaacagagatcgtttttgtagttctgtgctgcatgcacaagcaaataatggccatgaccagagaagattttaggcgaaatggaatcagatcaaaagatgacctgtcaccgttcacctctttcatgatatatctttggcatggctctgttccagcaaacatcacagcacgtcgagagaaaggggataatatatcgtttttggaccgggtgacacatgctgctgttgcacgaatctggcctttcaaactgggtgctgctagccatttggcgagctacggcgtccgctagccacactttgcgacctcgcgtatggttttttttttcctgactttttgtcatgtgtttagatactgtatcagcttcgctgctgtttcctcaacacatttgctgccacgtttggccacccaaggaaatggtaaacaaatgcagcaaaacctcacgttctatagtttagtgctaattaaagaggttgcgtagatgtacttacagagaggtgaataaggcctctcacagtccggtgacgtggagcgttacttcgcatcgccggctcggctttgcgcttgcatggagcaaggtcgcgcgctccaattgagctcctcgccccttagcagagccgcgcgattcttactcgcagtgagtccacgcgcggcaaggttctgtgcgccgtggagcgcgtgacctagacgcgtcgtgccctcgccggcgaacgggacgaggaattccggattcgtcatccaaaattgccctcctgcggctccgtcgttcgcgccctcccgaccaccaccttggcagggtcgacgtcgagctccgccgccaacaccgccgcaaaccaacacatgtcttttctgcacactttgtcctcactcgtacgcacccggaaagaatttcccgatcggtcacccatctcgaaattgctccaggccaagcacgcttaacctcagagttctttcgagatcggcttccagaaaaaagttccaacttgttgatatgagtattctattaatcctattaagccctgggccgggatgccacatcctcacccccttaagaaagatcaacgtcctcgtcgatcaacctcaggccaggaacgtcccctcttggccacgtccgtgtgtctagtgccagcgcatgtgccatgctgtgtgaccactccaggtccacaccagccatgcgcaccatgcctgcgcaactgcgacacacgtgcccgtgaaaccgcgagagtcagctctgataccactttgtaacgtcccgcctctcctaggccgggcccgcttacatctgatagctttcataggtcatagactgccctcacagaccaacacatgtcttttctgcacactttgtcctcactcgtgcgcacccgggaaattcaccaaggacgcttaacctcagagttctttcgagactggcttccggaaaagaagttgcaacttgttgatatgagtattctattaattctattaagccctgggccgggatgccacagctgtggccgagcagcaatcttctcggcgagattcagggaaaaaggagggaggtcggagaggcggctatggccgagcagcgcttgcgcctgcttctgctccgattggggaggagggaggtcggagaaggtcaaggcggcgatcttctcggcgaaggcggcggcgctgctcggtgtgtgcgcgtgctcccgtggagacgacaaggataggggtgggctgcggtggtggagcgggatggcggcgggatggaggagcaagggagtagacaataaggacgacgacgacctcctcggtttttcacccgttcgcttgtggcgaggtgcggcggagtgggtgggaggagaaaaatcgaagggtaggtgaggaattgattttcctccgctcccccgtgcgttgtgggccttcaacagtatctccatccatttatctatttagatcacccaaattaggttccttgcactgtgggattgagtgtttgtgccaactttttaggctaacaagtaacacccctctaccggtgcatgctagaggtggccaaatgggccgggccaaacgggcggcccgaggcacggccgaacctgtagcaggcacggcccggcacggcctgctacagtaacgggccgtgccggcacggcacgagtagccgtgccgtgcttgggccgctggccgagcccgcgggccggcacggcacggcacggctactgtagcgggccggcacggcacggcccgcggcacggcacggcacggcacgccggcggcccgtcaggcgcggacagggcgggcggcggtcgaatgggaaggcgccacgtggcactaacggctatttgaccgttcaaatttgaaaataaccgttgggaggctaaaaaattcataaaaatttcgaaaaaattccaaaaaatctcaaatttcgccctataaatagggcatgaaccccagccatttctcctcatcccacactcctcatcttgtgctctcaagtgttttaagtgctctctttgttctcaagtgtgcattttttttgattttgacaaaatttgctcaaattttgtcaaaaatcaaaattagtttcgtagttcaacagtttgatcgcagaggtttgaagagctcgcagttggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgatggtacctccggatcggctccaactccaccatctgtggaggaggtaccggttcatacggctgtcgttgaggaggtaccggttcaggcggagacagcttcggaaggattttccggaaccgcgagcggaagtgtttcgacacacaccggctcgaagagatcgagaacctccggtgtgtggcaaagcttcgatgagataaaggaaacatgccccgacggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatggtaaacccagacggtacggtacacagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgttagtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagggctattgaaatattgcaacctttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgcatggaagaggttttgcaatgcggccggtgtgaaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaattttaccaatttctagaaactttttatgattgtactctaactttgtcacaagtttattatccaactgctaatataattttgcacaaccttcttgaaattgctactttatttaaagaatacgaaaatgatgacgttctaactgaacctgtctttcacatgaaacaaaaatatttgaaatattggaaaaatatacctatgttgtatgctcttgcttttgttttagatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcagagaccccctcctatccccactacaggtaagaagaagatacagtggggtaggatttggggtggatcgtcttcaagttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgctttcaaaactagcacgggatgtgttgacggtgcccgtgtcgacggtgtcctccgaatcggccttcagtctatgcggccgaatcatcgaagaccggaggacgactctgcgcagcgaccacgtcgaaatgctactaagcgttaaagactgggagcttgctcgacaacatgcccaatacactgcggacaaccaagaattggctgcccagttcgagcaactctacctggatccagaccaaccccagtagaattttgttagaagtagttctgacctttgagctgtactcttttctttgtcatggttttctcattttcccctatgagtttttacatgacaaagtttttaaagaggcagcatgtatcattgtatcctgtaatgatataaacatcaataaaggtcattactatttttaacaaattcttttgcaatattttcgcaagtgtggatttatctttaaattatttcaaaataatgaatcacaatctatatttttaaatttttcaacacaacaaaaaaataccattttttcttttttttaacattagcaaatcattactttttaaaaaaacttttatttccattttttaaataccattttttcattttttaacattagtaaatcattacttttttttaaacattttatttccatttttaattttttttttccttatacatttcctttgcttttttttaaaaaaaaaacactgtgcactacaggctggcgggctggcggcctgccttcacgggccgccgtgccccgaacggcccgtgggccgcgggcgtgccgtgccggcacgggcacggcccggccatccacgggccgtgcttgggccggcggctcggcacgtgggccggcacggcacggcccgtttcatcagccgtgcctaacgggccgtgccgaaacgggccgtgccggaaccgtgcccgtgccgggccgggccgtgccgcccgtttggacacctatagtgcatgcactgtgattgccctaacagtaccgcatcatgaaccatataaaattataagtacgtactcctactactcaacaccccacaagtattcctaacataacaccgtacgattacaacaatttcagagaggtttgggtgttccactataatgcttgttcaaaaacttgaatacatttgtttaatattataaatcgttttaacatttttcttagtcaaattctttttaaggttgagtttatagaaatatataacaatatttttaacacaaaacaaacacattattaaactatatcaaataggagtattagttttagtgaaactaattcgtatcgtagatgttactaaattttttctataaatgatatcagagaagtataactataaaatcaaaatgacttataatcaatttttaactatatcgagtaacatagaattcatgtggactatgggagttagaattcacactctcattattgtgaatggtaatctattatatcttgagtttacatttttttttatcttttttagatatctaactctacatatttcttacattatgtccctgttgatatgattgacatgcatttgtgccacacagcccacactgcttgcttgaaatggtaacgccacaaacgctattaaacgatacgaatattactattgtgtacgtacaagacagcaaggtcttcttttcacaactctgagttcgatcgatctcgaatttaaattgttagcggcaacgacagaatcacagaatactaaaacaattgcacatttgtcattactatatgctccaattgtctatgccatcgaaaattctgaaaattgctagaatgccatcaaaagggagattaccttgtaaaaattttgccactatcgttaggtttttttaactccgtagtagtttttatttcttaagaaaatggaagatgagaaaatactttgcaagaaaatggctcaaatgctaccagcagatgaatttgacgatgagcacaacattttatttaagtttttctttaaaagaaatctaatgtacagtccaaacatgttgacttggtagcgttagtcaaatttaacggcagggtggtatattcgcaactttcggatgaaaccactagcattttagaaattgataattgaaaaggtggtggcagatttacaattatagcaaatcgtagtggcgtatgtgcagttctcccattattgtttgtttttttcttctggtatttacttggtttaaaactaggccgtcaccgccatccgattctgtgtttagttctatgttaaaattagaagtttgactaaaattgaaagtttgaagaaaaaagttataagtttatgtgtgtagaaaaattttaatgcgatgaaaaagttagaaatttaaagaaaaagttggaactaaagaagcactaagctggattgatttaccatgcatccctgatactttgtggttgattgcagtgcatgcagctgtgtgcttaaacttaagacttacgaaatgaaatatttcgttggcacacaaacacgtcataatttctagaggaaggcaatcgaaatttacatattccattgatagtttttatggtgttttctattgattgtagttgtagagtcgatttaaaccgttcgtcttttctcatttaatggaacacatctatttataatgcatctcagttggctgatagcaaaattaaggagtgtatacgtaagtttgattacgattaatattcagattatgatattatatcatgctaaaaatatattgtttgttaaatagttgttgatgtttagtttcgaagattatacattgtcaaatgactacattgcccaaaaaattggatggattaaacttataatcactgggtgccttgaacataggagaaaaatgttcgaacaaggttacccatattgttttgagatgctaaagtgaaagagcgtcgtagactaataacaatggaaaataattcggtagcaatctgagtagcacttgaagatatgcaccatgcactaacattcaagaaccttaagaaaaagttaaacaacaccatgcatgcaaatataactaattaagggtatgtttggtttgttactaaaataaacttactaaattttggctagacagcaaaataaaatatatgaagcaatcacaaccataccttgatttggcaactttggaagtttctactcttaaaggtccatcaaaatctattcggggtttgtaaattcgactataactacccgacaattatcattatttcaattgatatggtctgaatccgtagaactttattcgatgaacgttgatagattctgatgaaattcaagtcataaccaggcaattgtcaaaaagatcggggatggatctcgcacctccttctagcatggcaaatggctgatggatgaacctttggctcacaaatttcaagctccgtttacacactcaagtaaacctgaaggatgaaacgaagtcatcttctaaacctgccaccctcagtttcccgcttactgcgcagctgctcggaaacggctggattatggtcacatcgcttcaaacagacccactggcacgttgcctccacttgaaaggcgctattcgcctcccctatacattttttctaatcttcatgtgtttctcctcgatgttttcttcctcttatttatggttcggctgatttagttttaaacttttgtggagttcttttaaattttaattaattcaggtgagaagactctgcctggaaatggctagattatagtcacatcgcttcaaacagatctactggcacgttgcctccacctgaaaggcgctattcgccttccctctacatttgttctaatcttcatgtatttctcctcgatgttttcttcctcttcttcctggttcggctgatctagttttaaacttttgtgcagttattttaaatttcaattaattcaggtgaggagactctgccccggtgtcccttaaaaaaagatttatgcagtcgaacttgattggagatattagcggtcattttattagtccagtgtttgttttaataatgaattaaaactcaacatctatatattcaaaggatgtacacaaccaaatgcatgagatttctcatgtgtttaacttataaaattttgttaatatcattttttttgcattacaaaaaattgatatgttcatcttcaacaaatcaaacatgccttgaagacacatgaatcatacaaagatttctgccacaggacatcttggaaaccgtccaaaaccagagttcccggcccacctcagctcctcctcctgcgtccttttattaatacgcgatccatggcttcttgcatcagctgtttgccccgtccactgacctctctctctgctctccgcctctcacctccgtcctccaaaggacgaatcggcactctgcccagttcatctccacgatcactgctcgattctcgaagcaggggaggccattgccaccgaccaacaaaagttgaaggggtacacacatctgcatgcaatttctgtcctctggttgctagctgccgcttctttcaagtttcaacactccttgcaaccctccactcgtaggatcatctccatttccaatcctccttcagttttgtaaataatgaagaggcccaccagcagcagccgaaaatccaaaaaacaaggtgtgtttgctgcgagatctttttcgtttgtgtagactacttgtggagtgcgtcatggctgcaaatctgtttgaagcttaaatacaagtgcaaactgtacaatccatctgcatttgcggtagtaatatgtttcgatccagtgtaattgaagcaagaataatacaaacacaaagttaaaagtgtacgcatatttttttgcaggagaggacctggcgttctctgaggagggcagcttgcccgcggtgaccatggagcagaaagatgaagccgagatggaggaggtggacgaggaggaggaggaggaggtcgacgaagacatggccggcgggcacgcggcgcagtcgccgtcgccgtcgtgcgggctgggcgagaagaagcggcggctggcgctggagcaggtgcgcgctctggagcggagcttcgacacggacaacaagctggacccggaccgcaaggcccgcatcgcgcgcgacctcggcctgcagccgcgccaggtcgccgtctggttccagaaccgccgcgcccggtggaagacgaagcagctcgagcgcgacttcgccgccctccgcgcccgccacgacgccctccgcgccgactgcgacgccctgcgccgcgacaaggacgccctcgccgccgaggtacgcgcccaccgctgtgttttgcccgacgcgcgcgagagcttgtcactcaccttcaattcgtgctcgatcgatcagattcgggagctgagggagaagctgcccaccaagccggcggacacggcggcatcggtgaaggtagaagccggcaatgacgcggcggccggcgccgcggccgccacggtgtgcaaggacggctcgtcggacgacagcgactccagcgtggtgttcaacgacgaggcgtcgccgtactccggcgcggccttcattggattcggcccgtcgttcttggtcgacgacgcgtcggcggcaaccgtgggctgctcgtcgtcgctccccgcgctcgagtccaaatggcacggtccgtactccgacgactcgtgcaaaggcggcgtctatggcttcacggaggaatggctcgctgcctgctccggcgagatggccggcaacgacgccgccggcttcttctccgacgagcacgcctccaacctcaacttcggttggtgcgcgagtggtaacgagggttgggaatgagattttgatctccacggttagtgtaaaaaatggcagggttagtagcactgtgcataaccgcattggcgcattgcatgcttggatggagcacgtacttttagtttttttactgtactcatttactaccgcctttggctacctggcgtgcttactgctagtactgtagcaaagtagcaagaagtggaacgagcctagaggacgaaattgatatagggtaattaacgaaggatcaaggatgtaaattttaagccgccaaggggtcgaagaaggatagcacaggacagcaaagcatagctgtctgcgttttactacctgtggtatatatatcatactagtatattataaagcattacataatagaaaaaaaaagacataatgccacatgatgtctatgcgaacgtaaccaaagtatcatgtggcatccctgaacgcagcctaagtatcgagatttgttgctccgtacctcgaatgatgatagcccaaaagtaaatagcgagtcaaaataactaaatcatttagttcagtaaccaaatcttcatagcagaattagtgaaaacagaggtgcacaggagccccaagcagtaagcagcaacagcactcacagcaatacaacatgtctgagtcaaggtctcaactccctactgaccctccaagctgctacatgcaatcgcacactggcaaggtccaatatcatcttcaaaagtctctccatcccatttttcaagttaaaatttaataattgtgaacaaaaatcacacccaacagtctctccgtctggttggtcaaactcattccctcacttgccaaacaggcaccaccacagcataggcatcgcacctgcccaccgcgcccatcgacggcctttctttagctggcgtcggccaccacgcctcatgcgctcacggatccaactgtcgctgtcgcacagacattatcaccgtagagagggagagtgctatggaggagcttgaggatggccccaacgggagaagaggaagagaggaaaaaagagaaagaagaaatggtagtagaggctgacatatgggtctcagtgttggctgtatagatgtttggagagtttgatttggtagaccgttagacatactctaaagaacatagtacaattcgggagcttctcacagctacgactaattgtaaaatctcctactcctcaaagtattcagatttttatctaaattttgagaatatgtgactacaggataaaaaataaactactaaccaaatattgtgtttcaccttacgaaaataccttagcgttttttttacctctgaacacaactagtatgctttcgatcatgtttggcacatacgtggcagcattttggcgatgtggcaatctatagtgggtaagattatcgatcaattttgcttatacctttcatccaaaatttatcgaattaaatttagaaatttggccgaacctataagtctcagcctcctctaaacatcttttgtgcactccggtttgtctggtacataagttgagggtaaatcggataggacattttacaggctaaatcaaacatttcccccaaaatactatctgtagcgtttttacagaaagctacggaggatccatcgcatgttttggcagctgataaattttgaaagataacgcaagccagctaaagcaccaaacactactgactggccagcatgatggcttgttcccctgccaccaaacaaatgaagggatgaagacatgaagcacatcgtcttaaaaaaagatagagaaaaggaaagatgttatgggtgtataaaagcaggtcctccaaagtgatgtaaaaaagtagccatcaaagataagtagatgactctccttcaaggacattttataaagccatgttaattggcttacacacaagggttaagcccatattctttttagcttattgattcatgaaacagatcgttttacttcacgctttggaaaaatatattttcctagatttttttactgttcaaataactcgttttaaactatatattaagtttttctaaaaaaattactctaaatcacacagagtttaaaccatgttgggtcaagtaggtacgtaatcaagtccacggaagtacccctgtatcatgcaaccatgttgggtcatcgtctaaactcttgtgtgtaagccaaggtacagagtgacagccgcagtcgagattgcagatgtgatcagataccatcaagaattgtttggcatcaagagggagcttggaaagtgttcagtgctcttccaaaaataactgacagtattgtgctagtagtagattgcaaagctgagcctgcaaaggatgcatgcttttaccattttgggaaaacatgagaagaaaatcctcttatctacagacaggttccgtccgcaagaaagaaaaacgctgcagtcccaattaacacaaagtggtatagtggttttcaatcgtgtcaacacgtctccaagatggccatcaattttattccaatgtttggtaagcgtccttttcgcttgtagggcacaggcatcgcaagtaagtaaagaatcatattaagtaccagtggtgatatgtcacacaaggtgagacgtcatgaaataaagaagaaagagacagatataatacaccccgagccatgtggctaattttatacggagtaatctttctttgtcttaataataaaacctggtgcagtatgatcggaaagaaaaaaaaagaagaggaagagcatctttggtcttggcagtgctctcaaaccacaggcctggacatcgcaagaaccttgcaaaggctgaaagttcgctgaaatttggagtagaagatcgattttgccatgaaaatcctgtgcaacgcgcagtatggtgcacaggatcttgccatgcatgcgcaaccacgacaaaattgtacgtgtagctatcgctgaggagtacgtacgtctcgattgaatggatgtgtcgtgttgaccgcactgaagatgcggacgcgtgacatcttcttgtcccccggggtacctatgtcctatctccggccgctaagctccaaacgtactccagcggacacgttcgtccggcctcggctgacgtctccggcgaccgcgaccgtgtcggccgctggatcgggccctttgttaccgctggtcgacgacgacgagaagcccattaattacaacacttaacggcggaccgtcaaatgacatatgcttcgacatttcggttgtgttgggctgtcggcccgtcagtgaaaattctttttcagcctttactgcttaacctaaccgaaataggtacattttaggtcccttaaaaacataagtgcaatctaattcgtattcctcaaccgcaatatcagatatattgactctccaactattgaaaccggtgtgatctccctaaatggtttcgagagtggtttgctagtgttagggatcgcctcatctccttcagctttggctcaacgatgcccaggatccacctcggcatggatggataccgctacgccaagtctgagctctcccatgatcatggtggcataagagaggagggggatgtagtggtggcggcagccggcagtgcttggtttggcactgcctagatgactacagcgtggatcttttagtgacctccgtgatgggactccacccagcgagcttcgtgagctcacgcagcaggcccatcccttggtgtgctttgtgagcgaggaaaagcggcggccttgatgtgctgcgatggcgagcctcgagacgaagtggcgatgaagcgtccttgaggcggatatatggctcatcgtcctcaaggtgaagagaggtcgcaacctcgaggtagaatggcgtggtctcgaggcggagtggtagaggaactcatcaaagccccaccaagtgtggactagatccactcacctaccggtaggacggcgaaaggccgagaaagggcagtactagtactaggacgatggcggcggcggtggctcggcgtagccagccatgcaaggggccgcttcccttctttctaccataccttctcctccacactagctgctgctccaccctcctcccgctctagctcgacagtgtcatcgttgtgtgccgtgtgggaaaagagaggggacaaaggaatagaaaagaagatgagaagaaagaggaggtaacactgatatatgggacccgcatgctgactcaattggttgaaccaggtcaacgagccatatcaacgaaaaccgctgtggaagttaaattacactagtttcaatagttagacgaccaaaatatttgatattgtggttgagagatatgaattagcttggagctatatttgagggagtaagggtatacttattcctaacctaatctcttgacagggctttcaaatctcggcccatgtatttctcagctcagaatctggaccgatccaatcctctagatggtgaatgttttgtctgacgtatcgatgcctgcctacgtttgagaagctaggagtaggaggcggatcagcggatggaggacagcctccacttctgcactgcatcatcggcaagcaggtttgctctgcgaggcaacgcggatcagcagagctcacagctcaccgtcaccgacggccgacgcgacgggagaagatcatcatcagctgcacatgcaagaaaacggcgagagctaacgagcgcgtcccacacggccacagcgacgcccccatcccgacgtcgcggccggagtctgaaagtctgaacccatgcgtggcacgaggacgatcgaccgggctcagctcacgtcctgaaaacgtacgaagcacgcgcgaaaacgaacgcccgcgtgcgagagccacacgcggtgcgacacgcgtgcgcgcggacgtggacgccccacgccccggcgtaatggaggcacacgtaggagtacgtagcacatcgttgactgctcctcccacccgcgacgcgcaccacccgttcactctcgccgtcgtcgtcgtcgtcgtcaatcgtctaccagcatctcctgtccactgcgcgtgggcccgcccgtcatcgctgtcgcgggccatcgccactagtgcctcccacaagaggccgacgcggcgtggcactaatccttttcaccttttctttctactgactttttttttttacttcttttcgatgtgggggaaataatataattacacttggggtgcacaaagtctgaaggcagtcacgaccaaatcccactctagcagatgtggagttaaagaaatcaggcttcttttgaccaccttggatcagtgaatgcgttggcagctctaatctaatctttcgttgtatcgaaacattcttttttttttgtttctgtcgccattgttgtaggttggaattattagaatctgtgtttcagaggctggtgtggtggtgaaaagaaataaataatgggcaccttgaaactagtctgatacgaaacagtagcgcccaggccgagagactcagagacagagtacctgatcctgatccatgacagtatgaccctgtaacagagttcactgttggtgtttactttcatcattttcgcatgaaatgcttttatactgtgtttagtttgtgtactaattttttttatgtatacggacacacatttgaagtatttaacatagactaatatcatgacaaattacagatttcgcctgtaaactgcgagacgaatctattaattctaattaatccataattagcaaatgtttactgtagcatcacattgttaaatcatagcgtaattaggctcaaaagattcgtcttataatttacatgcaaactgtgcaactgttttattttttgttcacatttaatgctatatgcatgtgtccaaatatttgatgtgatagaaaagtcaaaagtttgacgaaaattttttgaatctaaacaagtcctacgtacgtaatactagttgttaggcttttttaacgtatctactttccaagcgtcgaagtaagttgtttttttcggcagcacatattgatattgcactcatcattgttccatcaaaataataacaaaaacgattagtttgattttttcctaggcaaacttatttaagtttaagcaaatttaacataaaacaggtatattattaaaaatatattcaatattagatttaatgaaactaatttgatattttaaatgttgctaaattttttctataagtttaattaaatttaacaatatttagctaggaaaaaaagttaaacggcttataatatgaaacatagatattgctattttttaaaaaaggttgaacagatcaaaggttttaataaagaagaaaaaagccaaatctatgcttatcaaacattacaacaaaacagatggtactaaattaaattatactggcgcaatagaacacgggccccggactccttctgcagcaagttacaagccaaactttcctcttccttttcctttcctttgctctcctcgctcctcttatcatctcctcctacccgccctgctcccgtgctgccaccaacaacgcgatcaccagttcaccaccaccgccacgcgcgcgctgtctccaaacacagacgcataaaccctagcaagccaacacggaggaagagcgatcgatcgagcagcggagaaagcttcgcctcgccaccatgcggcgatcggagtgggaggaccggtggtgcaagcggcacccggagcaccggctgtccaagggcgtgtgcccctactgcctccgcgaccgcctcgcccacctctccgcctcctcctcggccaccaccacgacgcgcgcctcctcctccgccgaatccagcggctactcctccggctcgcctccctgctacggggccctctcggccgacgtcagctccgtacacgtggtcggcgccgccggctcgtccttcgccaacgtcgccgccttctcgcagccgctgatgccgagctcggttagtcggaaaccagccggaggggggcaagaagagccgggaagggaggcatctggtaaggggaagcagcaggaggtgaagaggaagaagagcgggaagaagaagaagattgggaggttcctgtcgaggctcgtcggagcggagaagcggcggcaatcaggggacgccgatggcggcgatctcttccattccaagaccatgaaggagaagacggcgcacaagtgggtatttttctgatcaaacgttgccgccaccgcatgcaaactatggatcgtaaattccatgcttggttgttattcttgcctacctttttttttaaaatttttagggggctttcactctaaactattctcaagtatttttgtgtttgattttgactttttttttaaaaaaaaacaagaagaattttgggatcctgtatgtatacgagcagaagtttataattattaacctgtcaatgatttgtacttgaccacaacgggggattgcaaatcgttactctgtaaagctagaaaaatataaggagacagtgtatacgggtgtaaaattaggcatctgtacagtatcttgtatagtttcaattataagtttcatttctcgaattcatgcatgatcttatagttttgactatttaatttgcttatttgtatgtagaaatcacaattttccagttgtactgctcgttaatttaagttaccagttaattgccactacaaatacttacacttttgattttggatttgtaaatctatttgggcaaattctgaagtgcttctctcaaaggggacaaattgtactttatggaataatgcacatagcagtacaatactacgtacatggcaacgtgaagacaacaccggaaataggaaaaccaaatgaaaaaaaagagtttttatatgcaaaatgctaattaagctcataataacagtatcaatttcttaaatgttcagtgattctagctattcaagttttcatgttttttgatcgattgttacgcctattaattttaggctgaaccagtgaattctcccactggttatctacaattatttttatctttgctcctgtcctctcgttttggcatgaagtttgttgtctggattcagatatttctgccattttcgccaactccatccgcctatcctacttggttgggcagggcagttcaacaaaatagctccatctgatttgatatcacctactgtcctactggtgcgccccactgatcaacaacagttctctgttccgtccaacagagacaaggttaattcagtgatcagacctaccaaactcttgatttgttgtttaggtgcgctgtgcaatatgccaataacaaaggaaggttgcaagcatgaaagatagtactgcatccgttcccaaataagtgcacttacacttgatggacacaattactatgcaaaatgttcctaattaagctcataataacagtactatggaaatgagatgctctgatcgggatctgactccattatataacccttttgaataaaatgatttagatgtccctgattaaatgaggtgtagttcgagattgagtgaacaatatgaagaaatttgaataagaggtaattggaggaagaaatagtgataaagaagtacattcattttggaagaaaattaaaagctagaagtatatttatttagaggaggtagtagcctctatcacgatcgataatgcgcattcacggatgaacaagaacagatgcctgcccagctataccctgattttaataaaacatgcatcatagctttattgtgattaaagtgtagtggatgtcaagtaaatgataggaattgagtctagctgacctgctgggaggtgtgagcagagataaatgatttatatatttatttttctattaatttgataccaagttgtttcttaattagtattcttttatctcttgtttacaagagaataaaatgatgtagtagttcttgaaatctgtagtctgtagatagccatggtcaatacatgcggaacgctgcgtccacggctatgcaggcgtgtgacctaaacaaaaccgccagtaggtcaaacaaacaggcaatacaataataccatatcgtacgttttggagagcgaaacgcaacccgtcgtggaaggctctaactagagagattagagaaggaaggaacagatcaaagaaaacaatcgttgaccgaaccagatatcaaa

SEQ ID NO: 2968 - DNA, 2281 bp, Oryza sativa
aggagagagcccagcagcgcacgggcgcccatcccctcgaaagcgcacggctttttgggcgcatgtgcgcaaccgtgcaagtcggcaccgcacgtacaggtgtaccgcacgggagcgcggtcgttttttccccggtgctaccatgcgactgcgaatctgcctccgcgcacagcgaaaagttggggttcagtcgtgcggagcggttgtgcctgtatcgatgggagccgggccaagctggtgggattccaattgggccgtactggacgaatcagcgtgcttccgttggggaaataagtccattctacacccccctctctctctctcttcccaccttatctctctcggtctctccccttccccttcacggtggcggtggcaacgggaggatgagaggagcagcggcggctggtgacgagctcccactgggacgcagcggagccatgggctgggatcgtagagccaaggaggacggcgacagctcgattttatggaggcttgtgacagtgagaggatgagggtagtgacagcggcagctgatggcgagctcccaccggggtgcatcggaatcgggggcggcagctcaaccttgtgaaggatcgcgacagtgggccccagctagagtgatggcctcatcggctatggtcaccggtgtggtctccgatggctctgaccaccgctacaaggccaacgaggcgcattcaacgtcccccgcgctattgctcttgtaggatatgtcgacttgtccttgtccatatttggggaaccccactgcctcgcatgcacccaagtggaattagtggcctcctcaaccatcgctgttgctcggtgcccagcttctagaccttcaaagccgttgaccgccctcccctgctcaagctcattggcgtaggtgttatcactgccatcctctcctgcctccttgcctggttgattttcagccgcgtgtggtcactgcctctaccaccgtgacaaggtagctgccgcatccggctcttctttcgtcgggcgcccataggtcttaccggttctcatcgtcgtcccggctacaaactgagagcggagaggtggagagagagagagagagggagagagagtaaagagaaaactgtcactgacccatgggtccctcgccttatttttatttttttttcttgtaatgccacgttagatcacgaatactaagtcaatgcgacatgtagacatcatttagtgaaaatcaccctcaatattaccgctagagttattttgcaccggttttaatagttggagaggtccagacaccctattttgcaatcaagggatataaagtagattcgacctataattaagggagtcaaagtgtacttttaccttccgttgagcagttggggattgctgggcggaagatggcgaaagtggcgacgtgggaagatgggccgaccataagaaggcctttttagggcgagcaaaattttacagccttttgagcctagcggcgtgcatcggcccaaggtttcggtcgcgttagaactgaatttcctacgcgcacagaacaagcgctagcagttcgagtatgaaatgatgtactcgtatacactttaccagctcatgatctgatgatatgatcaggcgaaaggaaggtaaacccagtagtagtacacagaaagcaccgatcaatcaaaactgacacgcccaaacaggtagtgagaagagaagacaggccccgaatctcggcagtagcagctactacttgatactgaagctcttaaaccggaacaagctgccaaccttgcgcatcatcacccgccgccgtgcgggcaacgacctcggcattgtcgagaacgcgcttagctcgctcttctgatcttccatcgacccgaatatgtcgtacaccgatccttcgaagttatccgacctccgccgcggtagggtgagccccgccggcggcttcaccctcgcctccgagtggcacttgatcagcccgtgcagttctctcgacccgtgcgacgacgaggaatcctccatgtccagctttatcccggaagctgtggggctcggcgacgcggatagcttcatgccggcggccgtggggctcgacgacgtggcgacgagcaggctctgcagctccttgacgctgtcgcgcgccgccgcctccgtcacccggaggcactcgagctcctgcttggtgcacttgatggcggtgtccttgtcgccgagcatctccttgagcgcggcgttctcgcccctcgcctcctccagcgcctccttcacgaccttggtgtccttgacggcctgcctcagg

SEQ ID NO: 2969 - DNA, 6511 bp, Oryza sativa
atcgccagggactcgagcatccgcttctcggactccctggacgcgtcgagctccgcctcgagcgtctctatggtggtgcggtcgttggccgacgccagcgccttccactcgctcacctccaggacgcggtacgcgcggtctcgctcctcgcgcgccttgcgcagctcgccgcggagctcggcgacatgctcgtccacgtcctgccggctctgctgcatcttgttcgtccggattgaacacctcttcagacgttgcacggcgatatgagcaagaattcttggaccatgatggtgcggcgatcggggatgggctaaacttcgaggcatgtggaggaagaagaggataaaaatggatgatccaggcgtgcatcctcatgttttgctaaatatgtggtggcagatgagaacctaaaattgtgggtaatgacaagtttaaggccagggttcatctgaaattctgaattagattgttacctatatttggagtgttgagtgttactatatgtaacttgtgatcttgccctgttcttttaaacgtgacatttccctgaattattgcataatcatgatatgtatcagaattctggttgctaaagaaagcaatcatttattcacctggagatccattttttgagaaagctgttacaggcagaattcagatgactgagaatacacagatgaatttcagagagtgattttgtatatcaataaagtctgaacgcacatgatttgacacacgatgttaaaattcactagtcattatacacacaaatcttcttggggcagcagtcaaaccagttatttgtataattgtattgtaacctactgaagtgggcagcaaacttaagtagacaactggtttgctcaattgcaatttcacttagccacatcacttgtccatccaaatggtgcatctgagactcttcccctgcaacagaaggtcaaatgccgtgttgatgtccttcaggggaacctcgtgagttatgaacttgtccaactccagctcctgcattgcgttcgtatcaacaatcttgatgttaaaatattgtgacactatgaacagttaatcagttttgagggtgtctgtaagtgaaaggtttaccttgttcagatacttgtcggccaggatgggaatgtcctgcttgggtttcacccctccgaagagtgatcccattacgcatttgccgttgaggatctccaacgaaggaatggacaaaggggcaccgtgcatttcgacgccaagaatgatcgtcttgccccatccctgcagcagtaaacagttagtatcttcagacacaggtggatcagctcatccaacgtacactaggatgttcgagtacaactgtaatgtgcatacctctcgggagctccgaaatgcatcgctcatcaccgacgccagcccgatgcactcgaagcagtagtccgcgccaccgtcagtcatctcgatgatcgcttggctgacaggtttgtccccaagttcttgtggattgatgaagtgcgtcacaccgaacttctttcctgaaaatcaacaaaaggtgttactaactactagtataaactaggacatcgaccaaaggtctgaattgtaatcaacattcagaacagtttcatgagcagaagggcttgccaagttcatgtttctcagggttcaaatccacgccgatgatcgttgacgcaccgcaaatcctggccccttcagctacctgacaacaaaaatacttcactataacatacgtacacttcaatattgtacaccagataatcgaaaattaattaccgctaatcctacggcgccgaggccaaagatagcaaccgaagaccccggctcgactttagccagcttccacgctgctccgacccctgcaacgcatgcacgcgagcgatcgtgagagaacggcaggtatgcctgcatctctgccagtgtacgtgccagcagtagactagtaggacgaaccggtggtggcgccgcagctgaggagggaggccgtggcgggcggcacggcggggtcgacgcggacgacctggttggcgtccacgacggtgtactcgctgaagctggagacgccgaggaagtggtggatcggggcgccgtggcggtcgcggaagcgggcggtgccgtcgcgcggcatcccggggcgcaccgcgaaccggtacgtggagcacacgttgctccgctccgaggcgcagtccacgcactcggtgcactggcccaggaacgtgggcaccaccgggtcgccggcggcgaacccttccacatgctcccctacgctctccaccaccctgcagtttgtcactccgagatcgatcaccttgcaattttcatacatcttcgtatattttggcaaaacgaaataaggggaaaaaataaaaatataccattttttcaccgattttacataaatatacacgtgtataaaggaatagcagaaatataacattatcgtagaatggaagtgcgaggtcacacggtctcgggcggcatcattaaccgttaattaattattaattatttaactagcatcattagtaattaattaatcactcaataagactattaattgtgccattagtgtcattctggccggtgtcgctcaaggaacaagcgaaaccgaggccttcttgcaacggctaccagcgaagaccgagcggtctcgtattctcacttgcgagagcgcttgcgtcatcatgccatcatcgctatcgcactttggggttttacaatttcgctgcgatttcgcactattgaaccgtaacgacggtctattcatgcaaatccgtaatctcgtatatttctaagaaatacgatctattcgtacaaatccgtaatcttgtatatttcttaaaaaaaaaccttcaacattataatttcaaaaaaatattcaacgaaataatatggttgaaatgttaaccaattggttttgaaattttagatggttacataatatgtaaaatcgaggatttacgtagacaagtgtcatactcgtgctttgtaaggggatctaaaagaatatgaaaaaatggttttatgttgatatggatgattatgaggttcagtttttgaaggaatataatttacaactttagttttttctaccttttttttctaatgaaattatgaaaactggtggtttttgaaagcgggtggctggtggctggacttacgtgtgcctaccttctcaagcacctgatgccatcgatcttgtatgttggttgttggattcttggatgcacgcgcagggcttgacaagcttggcaagaaggcgtttgatgcggctttttccctgttatgctggattatctggaaggagctcaatgcgcgagttttcgaggtcactagtaagacaaacaacgaggtagccgacaccattatgtaggaatggtggattgttgggcttggcgcaccgatcatatagacatctgtgttcgtttctccaacaagagttggaagaaatttaggatgctcgtgatgcgctttttaaactgctaaacgtacgcttcctttgattttctaagaaaaaaacaaaacatatatcctttgattttcacttaaattggtgggtccaatattatacaccgttagatgaaactgatcttaaaacaaactaaaaaccatgggtcccacctattctctcctcccgtgccaaatacgtacgcttcctccccctttttccttttttcttcttttttccatatatatatataatggatatattttttaaataatcataattttacaaacaaagaatctaccatcatataacttaagccggtgtactctttactttgtactattattttcaaataatacactattttaaaataaattttacacaattatatcgtgtacctatcaaataaacaatatttatatattaactaatttatatgtgcacttaaatttatgggtccattatataaattatcggatctacattttattacactggtctattattctcaagtaatgcactattctaaaataaggtatacaccattatattatgtacccattaaattaacaatttaaaatctatattaactaatttacacttacactagaactggtggacctattattataatcatcaaatctattgtttgctaataaataaagcgtccaaaattctctttttgcccgctgcacattgcacgtctgcacctttgcctttcgcacgtattacaaagcataatgtctgagacatctaaggtgaacacaaccgttatagcgctaccgctttgccacgtatcaaatcatatatggagatgattaattttgtaaatgacataaaaagaaaattaaaggtgtgatgcgacaagagaataattaagcaccatgggttgtgtttttctctacactaattagctttgtttaagttgaaaccgagagttgattacataacaactataacgtatttgtgttatgtcgtatttggattttgtactatttgttcgtacaggtgaaaggaatcattatgttataaatgtgagcacaatattgacgaatatcaatacaaatcttactacgacaagggtgataaagggagtttaaggccctctcttttttaccgattccatattttggattttagtttgcatgctttacaagtttctaagtgtcatctttaaacaacattctaactttttagaagtcaatccattcgtttataccctcgaatagctatcacataaattatataattcatcaatttcagctatcctaaaccttaagtactactccctctgtttcacaatgtaagtcattctagcattttccacattaacatcaatatgaatgtgggaaatgctagaatgacttacattgtgaaacggaggaagtacatatttttttcatgcgagccatggtgatcaacggatcatcaaagtcgtaagatgaatatataagagttgctcttaacaattgtaaataggtgtcaaaattaattgctattaattagacatctaatggcttgctagccacaaaattaatttttctctacatgtatataaacatgaatgaagctggaacaaatattaccatatgtcgcatacatatatattgcgcagttaatattctagttagtcatttcaaattccttaaaatgctcacaagctgccacgtggtgctataataaattagggcaaatattagaaattctaagaaaaaaacaaagtatatattatttgattttcactcaaattggtaggtccaatattataaaccgttatatattaaattgatcttaaaacaaactaaatactacgaggtcccacctcgacataggtacgcacctacgtgcacgggtacatacgcctcccctcccttttttcattttctctttcttattttttcccatgcatatgcttcccttcctttattactatatcatgcgtcttcatgagacgatttaatcaaaagaatttttagtatcttacactcgcattcttaatttgcggccatactacacggtatgtatatacatggactgtatgataattaactagcaatagtttcttatttactcgagaaaaaaaatgattcaaaagtcgtaagtacttaatccatctcttactcaaaagtttgtgaatggttttctaagataccttaagaaatatacaacccttaaattattataaaataacattatccaaactttaatttgccctgaatctatgagataaaatttctgaacaaacaataatcttacttttcaataatatataagtgcccgcgcatacgcgcgggccaccttcctagttattatatactaaaagtccatgaaacttcctacaaacactcctaagtcaccatgtggaagtcctacaaacactcctaaaccgatacgtggcactgtaataaacagctagacccactatttttaattattattagaattattttttttgacctgcctctcctatcccccattagcccacatccacgcatcccccactggcccatatccatgcacgttcatatgtacttaaggagaaatacctaatcactatttgccaaataaagcaaaaataacataatacgtatagactattcatcggggaaaaaaagaacatatatgtatgcacgtttgcacctactggaaaagaagctatcaatccttacccctttattttcttcaattgttcactttttaaaactttataaaacataggatatttctccttccctcccctcacctcctctattttttttaagtaacaacatcatataaaaaatcaatagttagatagcttgatgatcataattggtagtctattaaacttcctattaacgcttctaaaccatcatgtggtaccctatgaatactgtcgagtaatcacatagcactctaataaaacggagaaattcgaccgcattgaaatcggtgaacctattatttaatcgctatatctatcttgaaaaaatcaccctccgttcatgactccgtgtggcttctcacatatgtacctaacctaccctccctccgttcttttctccttttcttttatttccatga

SEQ ID NO: 2970 - DNA, 2961 bp, Oryza sativa
cagcaagacaagctcagactaacagctgcttagcttttgattgctctaatatttctcacatttgttccagagatgtttgtcctactaaaagagctctttccttcactcctaatggagcagttaatgtaactcatgctttgtgtttctaaaacgctttcttttaataaagtgcatgagttctcaaaaaaaaaaaactatcaacttctatcggttgttggcaaacaataatataggcacaagtaccattattttcacatagggatttccaaccttttaattgtataaataattattttcatcacactactacacaaatggttcttgcgagcattcttttcacatgtgactcaaatgtgcagcctcctatatgccaagcatcttgcctcaaactcaaggttcatctttgaaaataacttttgcaatccttttacacataactattttatggggtgcttaaccagcaattagcattgaagcttttacacataaaactattttaatggagcacttaacccataagatagtattgaatcaatatactcctttcgttatagtaaaacatagctcattttacaacataatgatattttattctttcaatttttttatatttgtcttcatacaagtcatattaagcaatccaagagacaaaggtcaataataaatcaacaaaattcagtaaattcctatccttcaaagtagctccatgggtttctccacaaccttcatgtataagcctctaatgcggtttcaaaatcagtagtttttcttataataatatgattaaaatctatactttttcctaataaattattattttaagattcatattgactaggtcttttctttaaaataccatagagtctcacatattacagagaagccttaaataagatatgcatatttgatcaattaaaaagagggctaagcacgttggtaaaaaaaaattactagcaataaaagtttcttgagactttttgtggaaaaaataaacaatgagaattgaattaaaaaggaaaaattccttactttaatttcaacttattttgttaaaactatttccgaaacaaaataatatgcaagcctacgtgactgcgcgggttatgttcctagttattctagaaatattcaaacatttgggcaactcgtattctatcttggtgcaatgtactggcagtaggtcataggtcttgatcagtggtctaatctcatctcaataagtacattggtggcctaatcacaagaatgttattgtactcagacgggaaatcggcggcgcgaagaatagttataagtaacttacttgaatgtcagactctttaagttttaagttagcagtaggtgctaattagtactaactgctaaataatcgatgcttgtgccatagaacatcaaacctatttaattattaactgaaaggacaggtttgaactgattatatcgataggttggagtattaaactagtcgtaactcgtaatatagtccattgggagcattgacgttgaatttatttagccaacgtgttaaggcaggttagtagatggtatgtggtccgcacattttgttcagtttgattcgacgaatacaaaatgttgaatgaacatctcaacaaaatcatcagttcctatatataattgattttcttaagatggtgaatctttatttcgagatttaatactgttctgatgtagagctagccatttctattatttccaataaaatatcacggatcaatagccggtaacgttgaagaatatttgtggtgccttttctactcttctatctccattcattcccttttcacaatatattttttattgaacgcgtaaaaggattgcacgtcaatatattagaagaatagagtttttgttacacgacgcaatcggttagaccgacttatgccaagaaagggagaaaacaaaaagaccaaataaaaaggagaagagaagactactgcgacggctaaacacaactttaaatagcgggaaggggttagagccactaccctcccaagagaaccccaaaattagcaatgtcagctaaagatcatagatgacccttagagaggatggactcaaggacctctgagaccgaggacaacgcagagtcaaaaactttggagttccgctccttccacggttgccaagagaccaggaggaccataaaatcaaaaccggcacgaatatacctttttaaagagaaatttactattttaccacgtgcatatacattatcatacacatacgtacacatccatgaccatgagtaggtcatttttaacacacgctcaagagacatcagacacaggccggataagtcatattgctgaaaggttgcgacccgtttatatcaacaattttctacaccaacacgatccgaatgtcattttccgatttcttagtttattatggcctttttgacattcaggaaagcatcgtccctttcctactcctagctcattcgtagaagcatagaacccatccagaaaatgcagctatcttacgtcgttcttatcagaacacgggaacaagccaaacatactgcatccatatacgctcatgacattcaacatcatacatatgtttccatctttagtgtattgtttgactcgttaaaaatcgacggcctatagggacagcagagcagctttctagccgtgtaattccaattatttccacgccactcgcttgggccgatttttcaatgtgggccatctaaaaaaacataaaaacagtaaacaggagttgaaatgaactgacccgaaggcttcgtgcccaaaaatcctcgggaaaacgccggggaaatcctgcaatgtggcagcaaaggttctcgtgtcacaagttttcagagcaaaaggctcacacgttttcagagcaaaaggctgtggcctgctttagttccctaaatttattttacaaaaacatcacatcgaatctttaacacatgcatagagaattaaa

SEQ ID NO: 2971 - DNA, 4145 bp, Oryza sativa
aattcctgcagcccggtagggcttaggcttcaacttttcggcctatggccctggagatcaactcgatcttatcaatggtccacacgctttcacgccgaaaggcacaggactaagagtaattttacagttattgagaagttaccatgagataccattttttctattataaatttggtacatattgatatttagatactatgatgtaacatgaggtactaaattttacactaaatttttaataccttatggtacctccttaagactgtagaattgctccaggactaaagacagctgaagaagaggagtttgaaggtccttaaaaaagtaccttaaggtacctaaattttacactaaaatttttagtaccttaagataattagtagttagtatctggaggtatcaaattttacactagaaaaatatagtacctcacttccttaaaaatggtaaaattacccgcttaagaaacaggagacccggagagtgcgacctcaccgttcagtttcagaaacaagattggactgagatcaaaaaaaaaagaagaaacaagattggactaatccagttctttacacgcaaatctgaacatactccataagaaagataatccttttcttttggaatgaaaatattctgcattgattcagaaaggaggatgctgctaaccgcccatgaaattaagtgtacatcagttattcgtgatggctgatggacgtattagtgtattactccttgtttcagcaacaccagcgaaataaacagcatacttattgaacacatcaatcaaccaaattcagaacctgaacaggaaaagcatccccaccccaagttgtggccatcacttgtccatccatatgatgcatctcaggctctttccctgcagaagcaaatcgaaggctgtgtttatctccgtcaggcctacctcatgagtgaccagcttctccagttccagctcctgcatttgcatttgcacaacacacacaaagcacatgcattacaattaggaagagtctagtttcgtctgaaactgaaaccgcgaactgaatttataaaaacgcaaccttgttcatgcatttctcggcgaggattgggatgtcagttttgggtttggccccaccgaagagcgatcccatgacgcacttgccgaacagaaactcgaaggacggcaggcacaacggctggctgtccttctcgacccccagaatgatcgtcttgccccgtccctgcattaacacacgattattaattcccgctgcaaatattctcctctgaattattaacacgcgattattagatcactgaatgtctgaatcagtgtggtgagatcagaactgatttggtgcttctgactgcctcagtcatcaccgacgagataccgatgcactcgaagctgtagtcagcgccaccgtctgtcatcgcattgatcacctaggatagaacagaattaacaacgtgcactgacgagtttggatccattagcagatgatttctgtagggtggtgccaaatggcgtgtttcctcacctcactgacggatttgtcgccgagttgggatggattgacgaaatcagtcacaccgaactcttttcctgcaaaaagtagaggtttcttcagttgtgagaaaatgcaaagattcttcttcactgcgtgttatacacaggaaaaataatttggacttgccaacttcctctttgttaggattcaaatcaacaccgataatcttcgttgctccacacatttttgccccttgcactacctggaaaaaaaagtcaaaatatttgcagcggtcgtcaactcatcatgtatccgagtaagaaattacactgcttcacctctagcttaccgccaatccgacggatcccagcccgaagacaaccaccgacgaaccgggttgcactttggccaacctccatgctgctcctacccctgatcgacattcaatgatgcaatgaatgtcagtgcacagttcagaggtaaggcaatcaggcaaatggcatttcaggctcaggctcccccaattcgtttgtagcgtgctaaaatatggaactgtttggtaaaactcaaatcctaaatttagcttcaggagttgagtctgaactatgaagtggagttgtagaatagtttaagagatttgcttcagtccaaaaaaaaaatatctcgaagtactggtacctcacggtatcaaatcgttttcaatcgttggatctagcaatggccatcatgtccaactagatcaaatgatcggaaacgatttagtaccgtgagatactagtacctcgagatactttttactgaccggagcaaatctcatagtttaaaccaagcttcgtatatctagttcattttgtgaaagacgttccatccaactccgtacccattttaggtgaagttgaaactgttttgattgatttggctctaccaagcaggttcaatatatctgcgaatctcaggctcaccggtgccgccgcagcagccgaggaggcaggcgattttgggcggcacggcggggtcgaccttgacgacctggttgacgtcgacgacggtgtactggctgaagctggtgacggccaccgtgtcgctgagcggcttcccttcgccgtcccagaacctggttgtgccgtcgcgccgcatcccggggcccatggtgaacggcacggcggtgcactggttcgtccactccgccgcgcagctggcgcacgagtcgcactgccccatgaacgtcggcaccaccgtgtcccccgccgcgagcccctccacgttctcccccacgctctccaccacccttaaaaaaaacaaacagatatagttagagattctcgaattcgaattttcggattggcgaagaggaaaattaaagcatcagggaagaacgaacatacccgtaggcctcgtggcccaagattcttggaaaggcagggtctacctattatgaaattataaaagcaaattatacgtgattctttcacatggtttgatcagatgggggaacgtacgtataccttgtgccagagggtgacatcggtgtggcacagggaggtgcagatgatcttgatgcggatctcgtaggctttcggaggatcgacgacgatctcctcgacgatcagtggctcactggccgctctacagaccgccgctgcatcgtcgtcgtcgatatgtatcaatcatatatcatgcgtgaggaattgagtagtagtagtagtagtaccaaggagctatgcagatctgatctctgtaagtgaattgtgtacctttgcaacggatgggcttcaggctctgatcttccattgcggctggatggcgagcttaagcagcactgcagcagtgtattctccagggcaatgttctgtggctataaatagatccctaactaacctaccccaatcatgatggaacgaataatcgatttcacccatatgtggtaggtttgatttcctatccttagtcaatacatgcgatagaaaacaaaacatgaataaaactctgtagtggagtccgctagcttttgctttgcctggcctccacatggtgaactggtcctgattaggaccttgttgttttcaaaaaaaaaactctctattccgcttaatgaaacagtactccctccgttttctaatatataacgctgttaatttttttatacgtttaattatttgttttattaaaaatacataaatattatttattttattgtaacttgatttattatcaaatgtttttcaagtatgacttaatttattttatatttccacaataattttaaataagataaatgtttaaatattgattaaaaagttaatgatgtcatatagtaaaaaatggaggtagtagtagaactcatgcatcttccaaataaaagtagaaatcaaaacactccatacaaaccactactgtttagcaacctgttcactcacgtcgttttctcggacttttatgctaacctttcttctttttaggttgtatttagttcacgttaaaattaaaagtttggttgaaattaaaacaatgtgatgaaaaagttagaagtttatgtgtgtagaaaagttttgatgtgatggaaaagttgaaagtttgaagaaaaaatttgtaactaaactcaggccttatttttgggagatatagtgtaggtcagctagccaggatctttgc

SEQ ID NO: 2972 - DNA, 2256 bp, Oryza sativa
taccctagtaaatcatggtagtaaggtaaatgcccaggtacccccttaattttgacatcgggtaatgtgatctgatcctaaatgctagttactcgtattatgtaagcaacggattgctaccaccgaataaagctccaatggaagtttagacaaaattgttgtcaccctgatgaataaaacaactcattttccctaacaaagtagtgtaaaataagagtaagtcaattatttgatccacttcatgaacctgcaactctgaaacacgactatacctaagcagagcaagagtgaagcagcttcaaccgaccccgagcagatgatatcttttttttttcagaaaattgcttatttgattctattttaaagcgtaactataaattagatcctatttttttaggttttctcatttgatcatgtttttcaaaatcgaaaatggaggctgaccttactcgcaaagataagataacggtgttaactaagggactaattatcttttttacccttactcatttcacccggttgtatcaaattttatttttgtttggacattttaaacatatttgtaacgaatatggcatagcttgatatattttagacaatttcaacaatttgggcttaaaatttgataaatttggcttaaatttgacaattcttacttctatttctaaaaaatggcataattatggcagacatacaaaattttaacatcattttctatgtcttgttcatctcaaattacattaaatgaagcaaaagcacattctccaggcattctccaaatccaattaacattcacatccaacatcaatcacaccaacagcagcagccgccaccataatcactacatcctccaggcgcagcaggcattagatggtgtcgatttgaataagttgggtcaaataaacaaactagaaaatatgagataaaattagtagttaggtctataaatatggtcaaatgagcaatttctctcttttggaccgacgttaggtatatcatgcattcacgctactatctcatttggagagtgagaaaagaaaacaacctcactggccgatatagcccctcgggctgaagtagtttttcttataccaggagtgaattatatttgtcaaattatagggatataattgtatttgtcaaattagtgggatataattgcctctgttacatacttacatcagagaattaagacatattgtttgattttataaaatgtgggccggccggccgaccgggcagaaggtttattgatcagttttcagttttcagatctttattatatttaacttatctactactacgtactactagcatttgtgtctgctagtatcatatcaacatctgcattatttgtcatatctgcagtgcattcatggtcacatctgcagcgataaagatggagtctgtttgtacgtatgaataagcgaggtatatccgtcgataatgaggtattcgtgatggctacattaattacaaaatatgttggtctaacttttcagaaatactcgtaaagataagagcatgtaatcattcatatgactgagaatatgtatgatatatatatatatatatatatatatatatatatatatatatatatatatatatatatatatatatatgtatgtatgtatgtatgtatgtatgtatgtatgtatgtatgtatgtatgtatgtatgtatgtatgtatgtatgttttcttatataaattaggccttgtttagtttaaaaaaattgtccaaaaacgtcacatcgaatctttgaacatatgcatagagcattaaatatatagataaaaaaccaattacacagtttgtatggaaattgcgagacggatcttttgaatctaattagtccatgatttgccataaagtgctacaataatccacatatgctaatgacggattcattaggcttaataaattcgtctcgttgtttccaagcgagttatgaaattagttttttcattcgtgtctaaaaattcctttcgatatccgattaaacgtttgatgtgatacctaacgatttccttttcgcgaattaaacacacccttaaaagaggggaaatgtcatgcgtgatttggtcccactctcgtgtaggcgtgtaacgcatgtggcgtggtgatatgatatgccccaatcagattctggcagtgtggcaactagcgatgaccctgttctaaaaaatataaaaaaataaatagcaatgactctgtccctagcgagattttttttaattttttattaaaatat

SEQ ID NO: 2973 - DNA, 2640 bp, Oryza sativa
acatgtacactctgcctattagtgtttactggagtagcagcgttgttactctgcaatgtcggctctttatcttgccatccttttcttagaaagagtatatacctcttgatgcagttgagtatactggaggagaccggcgacggcgaggtcaatggaggaggcggtggcatgggcaccgacgcctagctcatctccgccgagcgccgcagccagggccacagccgccggagccgtgccaccgtcgctagagaggagaggggagagagagtcgaagagagggagatggggagagagagaggaggaagaagagatggctgagaatgacatgtggggcccatgtgggtcttaccattttttttattaatttctatgtaaacctgacatgtgggtcctaggaggtttattattttttggaattgaattgccacgtaagcgccacgtcaatgccacatcagatgaagaccaagtcaaattagccacgtaggcgtcatgtcagtcaaaaccgccgttaaaaccgccgagggatctcatctgcactggttttgacagttgagggacgtgttgtatctggttttccggttgaaggacgaaaatcggattcgttgacaagttaaggaatatatgatgaacttatttcttttgccgttcggttcgattgattgggtcaggcccatcatctgggcttatggataggccgcgttggcgttggcgtacgtacttccggcccatcaccgaatcgatctcatgcacggctgggccatatccatccattaagtagccccgacactgatatatcgatcaatcttgaggcatttgtaaatttaccactatttttttaattttgtaaagagattattcgaattacagttccagtgtcatttcataattttctctagtggtagtcttataataataatttaaagcagtggcaaatttataattgttctcatcgatctcttgatctctcgagtttatcctgagaacatgtcctacttgtgagttgtgactgagtcaaatactcaaatcccattttagacggataaacaacacgaaatatcacatcttatagcaggtacagtaacaggctataaatcagctgtaaacatattttaaacagataaatgaggagagagaagagtagcgggctatagatttatagccagttgtagcacggactctaagacaccggatgtgtataacaggtgggaccagatattaatagtgtagtatataactattatataaataagctattagattgactataaataaattaaagttagtagttgactgtactattaaacttgctcttatgcacgtaacactcggtaactgatgacgaagagtcttgtctgacgcgagttttcgtcattgaaaaataatatcttcgacgctactaaacgtctaccactacaccaattagaccagaaacacacgctaattaatccaatcttatctcaatgatgatcaaactacacactttgtccccgagcagaatcgggatccagtagatcacgcacgaacgcaggcagcatactcagtgtgcattgacagtcctgcccttgcccggtcaaagacgagcttttcggtcaaagcaactccccgtgcgtgctctccatatttaaaaagctagaaagcgaccggagtttaaacaaagcgcgcaagattacggcttcacatagccactaagagcaagtttaatagtatagaccactattagcttcaaattatttatagtcaatttatacaatagttgtatactatactattaatatctggtcacatatattatacatacattatgtcttcgatttcgtactgtgcttttctatctctttgtttatctctttaaaatatatttatagctggcttatagcctactgctctaaacccccacccacctcgtaatctcttgggacttgtctttacgtacgccaacctcctcctctcgtcgcgtcgtcccctttgggaacacatatttttattcccatggagctagctatggttgcagttgccgattattccatagattaagattgctttgctttgcttgcttctgtgctcttctgccgcttttcacttcactctttgcttcggcccgtggtccagccagtgcggtgatggattctgtggtcgtacggtcccgtgttgctgctgtgattgccctcctgtgtgtgtgagatactgtgatctggggccatgaaccttctgatgtttgcttttgtacttaaaaaagttcattaaggagtgattgccatgtgtgtgtgacggaattggaaagctatataccaacgctagggcgatacgtggctggatctgaaaatgatcacgacccatgcagaactgaacatgtgaatttaaacactactactatcgatcaatcacaaagataaatccaggtgggcagtacaaatccatgacaattcctagtcacaaacagaccgacatatggcacgcaagtgcaaaaggttcagctgaaatatccacggcatgagtcagctgatggctccctcaaaatccataatggaaaaccaattgatagtgcggtaagaggaaacataaaatatgatatactatttgtgaggtttcaatgaaatatcattcagtgcaccgataaaatatcacttggcacattatctt

SEQ ID NO: 2974 - DNA, 2433 bp, Oryza sativa
tagcgccgctagaatgcacgctccctgttcgttgtcagtcttccctgacgctcccgtctccctcctctatctctagagttaagggtattttgatcttaaaactctttaaagtggtattttattcggaagacattgtaccgaatggtattttatcctgtgtattatagtaagtggcatttcattaaaatcctacaaatgaagtggcacatgatctatttgctaatggagttgacaccttgccaagtgaggattcgcccatgattatttgtattgaaattatctggatatatacctgaaagcaacagtagttaagaaaaaaaaagaagtggtaaactcatttgaaaaaggtgataataagataactatcgaacaattggtaactcgtacattaattgttgaaactgatttttttaaaaaaatcattggattttctaaaaagatattaaactttttttaaaacacattgatctgttggctgtcaggttcgcaatgtcaagattcatggatatattgaaaaagataaaatcgttaaggccggtagatatattattggattaatttgtaactacaggtaaattaattgataaaacttagtatattttctgtaatttcatcagatttgctaaaaactgttaatttttttaaaacaatcgatttgtggaccaccataaagatttgtggtgcaaaatatggaaacaaaccttgttggttattgtgcggtgtgcctccactggtagccaacttagtaacactgtgtgtattcttttatacattagttgtatgctgatgacattacgatttcttttttaaaaaataacatcagaagttatatagttagtctcattttcattaagctaagttagacggataaatcaaaccaaagtttcatattaagaaaagaataaaaatatgatgaaacagggttctgtgtaagaattccttagagttcatgcatacgcatcctgcattagccactactaaaaatccgagaatgagtcatgattgatagcaccatcatcatcggacataacaaatacactttcttctcccatcctttccgctctactttgctatgccaactactcttctctcctccttgtgattgctttgctcatccctcttcgctgccccactataaggtatagggtgtcgttttgaatcaagtcttaaatacttctatatcgaagcagggatttaggtcgtactacttcatttttattgccctaaaaacataaatataaattcatattagtcagttatactagggtttggtgtttccaatcagcattgtcgtttttctattaacatcagtatgcttctgctccgataggtttgctttagacactagcataatttaatagggcaagaattgccgttttccgattgatatcgacatgtctctgttttcatagttctatttatgatattataacagagagctactattgtatttcttttatgtctgtctgatttcattctatttcatggtaggttaggtcccgtttagttacctaaaagtatttctcaaaaacatcacatcgaatttttaccatatgtatggagcattaaatatagattaaaagaaaaactaattgcacagttatggaggaagatgaatcttttgagtctaattagtccatgattagccataagtgctacagtaatccacatgtgctaataacggattaattaggctcaaaaaatcgtctcgcgatttctaggcgagttataagattagttttttcattcgtgtccaaaaacttctttcaacattcggtcaaacatccgatacgatataaaaaaatttttcattttgcgaacttaacatctcaatcgatttcgaccaatctagccgctatgtgcactccttttcctctgctggttgcccacgagagcctatcgcctattcgcctcctccgctcctcaaatcccaatccccactcccacctcactccccccctctcttcgcctccctctctctctcctccgccatggtcatggacaagtccagcctcccgccgccgccgccgcctcccgcctcttccgcttccgccgccgccgcctcttccgccctcaaagccctgaacaagtcatcctacaagatctccaagcagacctcctcgtcatctctggcttcgatgaaggcatcccaatcgccaccgccgccgccgccgcatcctcgccgcccttctcctcctccgctcccgccgccgccggctcctccttcgtccgcccccgccgcggttgaccacccgccgccgcaaccgcctgtgtacaacatcgacaagtccgacttccgggacgtcgtccagaagctcaccggctccccctgccacctcctcccgcctcaggctcagccgccggcccccgccgccgccgtctccatgctccctccccagcccccgcctcctaccatcatggcgcctccgcccc

SEQ ID NO: 2975 - DNA, 662 bp, Oryza sativa
gcccacccccgcggcggaggagaccaccacgccgccggtctcatccaagaagacgctcgccgccgcgcagaccaccccctccaccccggcccccgccgcggcgcccaccaccccaggtccggccaccgcgccacccgccaagtccaccaaggcacccggccaaggccaccccgccgccggcctcctcatccccgccgcggcgcacgccgagccgccgccgccggagctcgcccacctgcctcgctcgcctgctccaccgcccacctgcgccgtccgctgcccgcgaagaagagagagagaggggaagaagagagaagtgaggatgaagagagaagggagagggaagaagagtggagtgagactgacatgtggggctcacgtgggccccactattttaaaattatttttgtgtgcagctgacatgtgggcccatggtttttattattttttaggtagaattgccacgtaagcgccacgtcaatgccacgtgtaacgaagacctagtcaaataagccacgtaggcgccacgtcagccaaaccgccgagggaaaatcgtttgcccggttttcataagtgggggacggatcgtatccggttttgcggtcaagcaacgaaaatcggaatgggtgacaaataaagggacccaaagtgaacttattcca

SEQ ID NO: 2976 - DNA, 226 bp, Oryza sativa
tcgagcacctggtccggcggcggcgacgcgaccggccgcttctgcgccggcagcggcggcggctggtcgtcgtcctcctcggacatgtgggccccacccacccccccacactcgcgtggttggttggtggccggcgaggagtggagtggagtggagacgcgccgcggcggaggaggggggggaggggggaggtgggtgtgcgtagtgagatcgagggtggaggggg

SEQ ID NO: 2977 - DNA, 661 bp, Oryza sativa
tgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggccccagtaccgaagatcccggctgcaaatcctgctggacaaggaccatcagtttcatacaggtatgtaatagtattaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggaaacgtgcagttaaaacatggtgacatattcgtgcaaaagctgaaacaaaaatgaactaatctctgggctaaactgtaccgtgcgaaaccggtgctgtaggtcgcactgctccgaagctaggggcgctcgaaggcaaacgaggtcctgcgaggatggaacatcaagttacgacggggtgatgttttcgcacaaaaacagaaacaaaacttaagaaacctctgggctgagcagtaccgtgcgaaacaggtgccgtaggtcgaggtcctgctccgacggtagg

SEQ ID NO: 2978 - DNA, 693 bp, Oryza sativa
ctgttgatcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaaaaacaccgtccacgggaccaactggtgctcccgccagcggtagcccgagcaggtacgacacgtcctgcagtgtcggagccatctccccacagggaaggtggaacgtgtgcgtctcaggtctccagcggtctaccagagcggcaaggagtgaccggtctgcatcccaccgcttcgctgggtcacggtcgtccgccgccccctcaacaagcctacaaagtggtagaaggcctgccgcacgcaaccagtatagagcaaacttcaaacataagtacaacacaaagcaaagttgagttgaaatgtgaacatacgcgtaccaaggaacgtgacgggggtcgacacgcaaccactcgcgcgacgtgcgtggatggaaggtgccgagctgtgcaccctcgactgctgacaggaacgagcggtggttcctgtcaatcccacggttcaacagcgccggtgtgtcgtacgccatacctgcatcaaatagattgatcagaaacatataaataattgggctgcaggaat

SEQ ID NO: 2979 - DNA, 1786 bp, Oryza sativa
agaacgataggaatgggaggcatcggaaaatagtgagacaaatatatccacctccaattctagaagtgaaaactgatatctcatttttccaccatgttcccactcccactgctcttagattacctctttcttcctcttcctggctcatcccaaacacctaaggctccaaatatttcaggcttagaacatgaactgttgatgatgcctgtggtgttgaagtatatatatagacataggtgaagcacctaaactgtatactgtacaggaggcaatgagtatgcacacatcataatgaaccataacacacaacagtcagtgacagtgggccatagatcatctacttttaatgtagacctcatgcaatggagacaccagtacatcttctgcctactctcatataaaacagctgacacaatagtccttggttttgagccttgcaaggttagtcattaaatctgagccatgcatttacataaggaagaaaggaacctatgccatgaattcattctgattactttgagaatgatagttgggtggaggaagaaataatagtgctcgcagtggaggatcactggaaccaagcataattttctcacaattaaagatgatctgccccaacatataatgctagccatttttttagaccatagatcgaaccagctcttttagaaagccaagataacaaggtctttacaggaaagtaaaaacagaaaattaaaaagaagcaacagatttcaacgttggggatgaaccagtttacactttcagcataccatctacctctaaacaggaaacttagcccctacctacactccagggaacaaagactagaaacaaaatgcagcaaagcaaagaaaactagttcaaatcgccagaggtagaacatctgtgggtctcagttcctgcatcctgtccatcactttttcaatccatttccccgtcttctgtgtcttcttccttcagaaatatcttccatttctgcagcagaacaatcattctaaccgagatttcacaagaatgttttcatgcactgtcatttctcccactcaactgagcccaagaaatagctgccaacatcaccagatacaaattcaaattctttgcattcaacttctcaacattggccaaatgccataaattttcaaactcccagggcacctctgcaaaccccacaagtttctgatcatactccaagcaaagactgcattctaggggacagtcaaacaaaatatacaatgctagccatttggccaacgaatattacaattttcgcataagcagagacgcatcatgtaagtgtaagcttcattggctgatgggtctaaactctgaatacagagcatggaacaaaactaaaaaagatcatacatttggttttactgaaggagaaactgccatgaacttttggttgcaatcccttgaagaccggaaatctgcaacattagttttatgtaatatatccactgagaatctaacattttcaggacaggcttgattcctgtcgacctggaagactgagaaattttgagaaacagtgtggttatttagctcagtttctgcttaaccctgtataaaacagatgataaaagtattttgagtctaaggaaaaagtaatagaagcaactggttccattaccatctggatcatttgaggcgattatattttagagagctgtggataggtattgtcactattcttgtgctgcttttttgctacatttgcatttctcttcttttctgtccactctagtggccacgcatcagtgccaactgggctgcaggaatt

SEQ ID NO: 2980 - DNA, 5857 bp, Oryza sativa
  unsure (1)..(5857): unsure at all n locations
nnnnnnnnnnnnnnnnnnnnnnnnnnnnnnnnnnnnnactctagatggatgggaaatgaaaaacaataaacattacaaacatcataaaaatatttgaggggacaccaaaactattgctttattatttttatctaattcgagagagaaaccgtaatgaaatgatgaatttgtccctcgagctagcacatgtatgttactcggctttggtttgatcgaaccgaacaatgccatcttttccgcccgacccccttcaaaaatctagaatggcgaccacgactccacgagtacattttacaactttccaatttgtttactttttcaaatgtttagaaaaaatcaattgtttattcttttcttatttttccaaattttcaaactacacattatgcaatttgcaatctactatcgccccaagtatattgctgccatatatcaaatttcttctttgcatcaggttagaaacttgtggctcaaaagtcattcttgtatttttgaaaaaaaaactctctctccaattgaacctaaataaaataatagctacggtgcctgtactatccaataaattacatatttgaatgtgtcctttcttcatcgtacacttttattgtccaacatcaaattacttaaagtgttatgtagtaaaatttgccaatgaaaagtgtttataaaatttgcccgttgttttagaagaacacttctatatatatatgacatatcatatataattggaattttggtggtaaggtttcacaaaactacccacatctgaatccctcttaatcacaaaagctttctgattcccaatcattcaaataccatttaagaaaatcctatattatagtttattctttttccatagacggttcacgaaacttctctaattggtgaccttctaatagtagcgtgatgtaaacaaatgagtcttgtttcaaccataagtagcatatattttatcagataattcaaaaccatctaggtaaaccccgttaaggcattactatataggaaccatcggtgatgaccttctcagtaataggctaaatctgttaggatacacgtaggctacgatagtataaattaaaattttctatcgcgtaaaccaggaaccatacaagtattagatcatagatcgttaccactcgacgcgctgcgcagcgaaagaaggcgctaagaagtcgaaggaattctcgcgaagtagcgggtcgatgtagaggaagtagtcgatcgcaccagctcgatcttcttctcctcgtgcgttctcctcgccgtattcacatgctgatcagtaccgcaaaccagcggcgcctctaccggtatccacacgtatagggacggaacgccacgcgtaaatgtgctagcactcgcgcgcggctagggttttgcttagggaggatagtgacggctagggtttctcacatgatgcaatacctccgccggtcacacctctcacgaatatataggatccatcacttgggcctccaaggcccgtaggactcctattcggatccttatccgaatcaagctcatattggatctccatccaatccccttattctagcccattaagcgtgcgactctgtaggttcatgtacactcggctgtaacccaaaaactccttttcggttcacgcgtcaacagcggcccctagcagagtgtattgacccacggggcatacataaagatcatatcggctgaacctttagtgtatacttgtatgaacccctttgcctcacgatatcgattaagctcaaggctagatatgtgccatcctctaacagctcaaccgttcactcgaacctgttaatagattatataacttgtgattgactcctcaatcacctttggcatggctatgcacttccataatctacaacatcgaggggcccagagatatatctccataggaggggcaaatcccatcttgattattcatatcccactacatgtttcatagcatacccgaaaactacttttataactactcaactacggagtagcgtttagcagtccctaagtaagctactacacatgttaggaaccatgataatctcaggtctaaggattcaacaccaatactaaatgagatcactgatgacacaacacatatggctcttgcagtgtctcattatgttgggtctatccaataacatgttcactaacatgtgtccacattattaatttggtatctctataccatgatccatgagacatgatcatcaattaatacatgtgctgatcatctaaatatatttgttctacatatgatatttgatcagggatcctttagaaatagcaacacacaacataaagagtctcatgaaagaatcacatattcattaattatctatttcaaggaacaaagtcggataaatatgtaaacatagtatgtgatacaatcatctctatgattgcctctagggtatatcactaacaaaatcttaatttgaaaattaatctatatgtttgtaattgttttttttccaacataactttggattttaaaccgttaaattgtagatgagtaaagtattgtcctaaaattattttctgttacttcaaacacttataaaccgcagaaaaaaaaatgtcagccaatcagattctaaaaatagcattgtggtactgttatattgttaccagtagcatctttgtttggtggagtttctatcagctaagtttttgtcgaatgctctaactttcataaacaattcagattctcaactaaattatgagaatttaaataaaaaactaaaatataagaattcgtgtagttatagaataaaaaattaattagaagatataggtcagatatagttcatgaagaccagcttttccagtttctctatttttcggaatctcgagcccccaaacaaagcttagatatacctcaatgtttctcattagtttgggcctaaaatgcccaaaaacttctgtaccgttctttcctcatctggaaatgctatgcagtttaaaaaacaaggtcgacaactggtaaaagaaaactaaagataatagaatgagataaatgagaaaagaacaaaaagaagggaagagagcgagatgggggctagctagctgtgcaggttgcgtacaggttgtgtgatgtgagatatagattcaattcttctagagaaagtgtctggtcctatgatcttcatgtacacatattcatgtatgatgttggagcttaatgtatagccacatcttttcaaaactgatgttctaagtgcactcctttaattacgctttgcaacataatacttcgttgcggagaaatagcatttgtggatttgtcataaaaggcattggtgtaagctgagtaacagatgaacaaaaataaacataactatatatgttgcacatcttattcatactaaatgacaacaaataaaaagagaaattgcttaataaaatgatgcacggatctcctgcgtgttcccaaataaaagtaaaaaaagaaaaaaatgatgtaacattaataatccatggtacaagcttcgcaggctctcttgtttcaatcatgcagctcgaaccacacattagtgggagttaggaactctccgccaaacatgcaaaacagaacgatccattagggtatgattaattaagtattagcatttttttttgaaaaatagatcgatatgattttttttaaatcaactttcatatagaattttatgtgaaaaaacacacaatctagtagtttaagaagtgtgcgtgcaaaaattgagggagataagttgggaaagctaacaaaacaattcagcctaactcgctagtgcgccgacgagatatttcaatgtttttttttgttggcacccatgactccgcgcaaagactcctctaccgttctttcctcaactgaaaaacattacgcaattcacatatagaataaggttgacaactacaaggaaagaaaagagaaaggttgagaggagagaaaagaacaaaaaggaaaacaaaagaaaagaaaagaaaagaaagagagaggggaggttgctgcaggtggtgcgtgtgatgtgagattagattctgctcctgcaaaattttattttctctgctcttctcctcttctcttctctgtgggttgctgcaacgcagtttcagcacgcgtcggcgtcactgatgtcaccccctcccgtttcttcttcttttttctcctccttttcgttgttgctgtttgttccttccgatcccattctatgccttttgtgctgcgtctgcgttggtttgtcatgaaaccgtgcacttggctgcctctccaacggcaaaacgattgccggccttttgttcttgtgtggcgcacgcgtgtgccaaatgtttattctcttgttcttgatctttgtttctcttaatctgctcagctgatcaatttctcgaatgtaaaataccggcccaggtaacaggattgcttaaaaaatatattagtatatgattcaaagttttggagaacaccatggtttaatagactgtaacataggctaaattcgatgctgttgattggctgattagcacatggttaattaagtattaactattataaacttgaaatatatatatttttatttttgcaaaacagttttttgaaaaaaaatcgtttagtagcttgaaaagcatgatcacgataaacagtggcggacgcaggattaaaataaagatgaggcgaagatgctcgtctcaataagaacaactaaacgcaaaaaataccatatttatgttgtaatcatattaacatatagtataatcaataaattaaggcaaacaaaaaacaaaaatgatattaaaataaagtaataatttttgcgccgtacataattcgtcatacataaaaagataccagtaaacatatcaatttacaaatatgagtccattcataaagcatggttgatagatatcttttaaaaaataaatatataagaagatatcgcataccagaataaaatgattattattttgcttagaagggagagaaagaaaaacagtaggcacttactatagtaagggacgggggtgaacgatgttgaggaattgaccgaggaaaccatcacatacgcaggattaaaattggacacttgggctgcttatttatgggccaattgtgaattggatgtggtggtagacggtccaagaaggatatggagggtcggggcggcacgggccgtagctgggccggccgcctaaccccgcctaatgggtggtaccgcccctgacgataaacgagagaataactctttccaatcgcacagacaaacacagcgttacttacaggatgtaagataagtaagacaacgagcggtgtgtgtgtatatatatatagtgtgtgtctatatatatatatatatatatatatatatatatatatatatatatatatatatatatatatatggggtatgagaaatatatatcacggtactagatatatgtgtaaaaggtggtttaatttctgatatgcatagctttgttttaagctgaaggtaggcttggttagatccagtgatcattcaagtaacaacattccacactcatgattacttatgaaatttggttactcaagtcattggactccaaacttctcatttacgccctattaaattcattcatgccttgtgagacctatgatgagcgattgttgtcactagaaaaaaaaatgattttctacaattttattttagacttcgtcaagagagaatggtgcaacaacatgtcacttggtgagccttgacaacaatctcgcagcaggtagctaggctggatttttcacattttggtccttttgaaaaacttatttcgcaaatagacccctgaaaaaacttatcccagaaatggtcctttttggggcgccagagtggttggc

SEQ ID NO: 2981 - DNA, 978 bp, Oryza sativa
gccagcatggctggcgccgccgcctctattcctgtttctctgtgtggagttgcaacggtgtcatttttattttatttttttgatgtttttacacactcaggatcacgatacaaccaaccataaaaaaaatttaaactcgaactaccacttagctaagtctgaaaatatctagtataccacttagtctactttgcaccttcactaaaattagaccataactcctttagtaaaactctttgatcagcatgttaaacataatgcactctaccactatatgaaattacttaatctaattcaaaatataaccacatgaaatgacatatataagttaaacagtacatagagatgcaatttttttatttttatttcatttttttgatatttttttcacacttaggagaacataggaaccaaccgtataaaaaataaactcaaacggacaaaatatgtgacatgtagaattttccaaaactctaccgaaatggacaaaatatgtcatctattaaaataggcgtaactttctcatacggactcggaattaggcaaataatatatgcatggacatctacagaaaaagttacatccgattctccccagctttgctgggttcggcgatattaaaacctccaaattccgcttgcaagaatggggttttcgaggagagaagtttttcggtggagctttggaaaattccatatgccacatatttcgtccgtttgagtttattttttacatggtgggttcctatgagttcctaagtgtgaaaaagtatcaaaaaaataaaataaaaataaaaaagttgcacatctctctcctctgcactagttcggagagaggagaggagaggaaaaattctacatgtcacatgttacgtctatttgagttcaatttttctatggttggttcttgtgtgtccctaagcgtgaaaaaaatatcaaacaaataaaacaaaaataaaaaattttggggggggggggg

SEQ ID NO: 2982 - DNA, 8675 bp, Oryza sativa
ttgctagccctagaaattcctcccagaaacatataattaattataacaaatcgctcactaattcgtttcagtgatagacaggcttgagtatttcgccaaatgatatgattgccctatcaatcacaaccccacaagtagtcgtaaagttcaacagaaagttgtttttgatttcttgatttcgacgccttagggtgacaacatagaaaacacaatatatatatttttgtttccataataaaaaaaagtcttacagttacatgtacagcatagtttatatagacagggtcacataacataacataataggcaataatctaccaatacaatttacatcatgaacgtagcaaagacggaattaattagtatttaagcacaaatgattccgagcaagatgcaacgagttaagctaggctattggtacaccatacacaggtagaaaaaagtgtacaacgatcaacaacataaaaaaaaaagaaagaaattatatcgcccaatgatgaagtacgagagggacatttcaaccaaaagtatgatgttgcatgtaacaaccaatagaaatggacctaggtttttcggtattgcacaaggcaggcaggcagcagggggcgtgtgcccacaccaaaggtaccaacctgaacttgcagacaagcgaaagattccaatacgcataaaaaagttgctttcaaacaaatctgtaaaatcattcaccccttgaaacttttgcaatgcagaaagcaaagaattattgatggggagttcacattattcaatctccatctttacatttttcctttgacaccatcgtacaaaagtcgggcatacttggttgttctgagacgacatgatagctgctaactatttttagcatgttgttgagatgtatcactatgcctttgaatctaaaacagaaggaagttggctgacatctagaacatatatactgtacataccatatggaattggcaacatagaactgtatcaagaaatgattaatctatctgtattgctgtctattattagggttccattttattacgatgtggtactgattaggagggaaaagactttatttagatttagggacacaagaatgagagcacaagctacactgagcttgccaaataacaaaaggttatttgagacactgacaatgaaacaagctgcaaaccacagaacagaacacaaggcaaacatggaaatctcagtttataagcatatgccactggcaaaattgacttgttgctccaactccatatcgtactataattcgctcgcaccttgttttcctcttctggaaaggagagcatctgtagcccctggttagaaaaactcaacaaagcgttcatagggcatactccctccgtttcacaatgtaagtcattctagcatttcccacattcatattgatgttaatgaatctagatagatatatatgtctagattcattacatcaatatgaatgtgggaaatgctagaatgacttatattgtgaaacggaggaagtatgcactaaatgctctaggatacgtgagtcgtgctgggaaattctgctgctcgctcaaccttacgagcaagactaagtgcgagcgatttgctatactatgcttactctgggctcactgtcaaagacacagttacattgttcgcccttttaacaagaactttaaatggcactccaaccttgtcccccatgatatcaatgatctggaataaatattttatttataaatatggtttaacatgctcttggctcttggattgaagacaggacaatataattactaggttcctaaaggaatactgtaagtgatacactagttagcttagttacctctttgatgcttcaaccagtttaccatcaaattcaacgaccacatccccaggacgaaatcctgcatgttcagctggtgatcctggtgtaacctggttgacactcatatggtgtcagcagtgccaactactattatgatcataataaaaatagacgcatgctaaacatgtgacaccagatttgcagttgagttaaacagtcatagactccagccaatatccaaaggccattgcactgtgatgattaaaactgaacagtaaaattcaattcaaacaaggtgattagatccactctacccagctgcaagaagattcatcagacatgatgaattaagcatcacttaccattggaacaagcacaccattttttacatctggaaaagaacttgatctttctttaagttgtgcaatgatcattgggttaaggtcaagcatctttaaaccaagccatggtcttacaactctcctgcattgcatgttggagaagtataagtagcagctaagcatattacaagctaaaccagaacaactaagctaagtgttcattacaaaagcaaagccatgtctgatttcaagtaattgttcactattgaatgaggtttcattacttctcttcgcacaagagaaaccaacaggaactagaagatttaatcatgataaaataaatgtgacgataatacatatattacagaactttactgttgtaagcatgttgaaactattttgaaagaacacacccattttaccccatttgactcttatgagcccccaaactacaaaagcataggcctcaccagtgttttcctctctctctctctgtttctcttatatgcaactgccagcagctgagcgccgctcccttcccaataccctcactgtcaaagttactacacgagcaaccttgtcactgtcttattttcaaatatgcatcttctcgtaattttatctccccaactatcctcaataatcctgctgggtctaagcagtgctctcattcctcacatcttaagccatggaggcaaggtggagcagtggccaagatcaaacgaattgataagatgcaaagttggctggttggaaaagtcttgctgtcttgaagaatggtacaaaagttcacatactcatcaagagtgaattcatatcattttaaacacagcgaaggaaaacaggtgaaatggaaaaccacatgtatgctaccaaaaaattgaaatgggtgagaatcgccttcctattcacagtcacctactcctagtcctcatctacccactgatacggattgtttggggaattcgaactaaatataccagcccatcccggaaaattggtcatgatttaacccgtgctaaacaagacttgagtgggatcaatgactgctatggtgaggaactcaataacatggtagctaattcaacagctttatggctgtgtaaggcaccgaaataaggtcagtgaccacaactgcttgaagcggcggtgatcagcatgaaactattagtgagggcttccatgtgtgcattagtatgccaactgtgaccatgtgcacactaatatgcacatgaaaaggacaagtagggtttgtttttgccaagatatagttactacattaggacgtgacgactcgaaatttcgaatgccatgtcaatcaaaaccacactagtcttgagagtaaagggtttactgattttgataatcaagagggtgaaacttagacggtcatgtagttgaagggttgaagttggattcttctggtaattgagggtgtatactagatatatacctatttcaaaattgacagaaatattacaagctgatttgaaagtatgatactatgatgctagatgtcctcataattcattcttgtacaagagtgcaatgcatgtggaatttatgtcacaaaaaaaagaaaactattcataaaagtcaatgcataaagacagactaaccaccaaacggtttcttgtattttatttctcccacagaacaagttggaaacaatgagggcattccatttaattctcacatttatagaagtacctaagtgggtaaactacaggctttaatcactaaaaaaacctcaacctgaactgaacaaatatatttcaaaagaaaagacgaaatacacaggaatggtatctaggaataaatagtacaatgcaactggcatcatacaacttagaaggaaggcatacccatttttcttgaagttctccactattttcacaatagagtcaatcggtactgcaaagctcaaaccatcagctgcccaaactttcatcacattaactccgacaatttcaccgtcaagattcacaagtggaccaccagagtttccctgtgtccaataaatgcgtgaactatttgacatagagaaattgagaaactagaacaggaactagggaaaaaaatatatcctagaagtcggtacatgtgagcccaatcatccataggacagagtacagaaccaacaaaaaataactccaacagacacaaaggagtttatgttcctccaaacaagtataacaagaaagcaagaaaattaaaaggaaaatgggatggttgacagcacaatgtactatatttttagttgggtaagccctgataagaaggggaaaagtaattcacaattttccgattacccccttctgcaattactagaattgcgatcctgaatcaaattgtatatgcttcagtagaattgaactctaggatcaaagcgtagaatcttagacctattccaaagtggcatgagagtccgtttgatcaccgtggcacctaatttgattcatttatcgtttatcttagcaccataatactgtattcctcttaataacataataccgtggaatacatgcattattgactgattttttttcagcaatgtgcagtacattccatgggttaatggtaagcatgtttattagatcatttacacataatttggttggtaaatatactccctccgtcccaaaataagttcatctttgcctccacttgtttgtcccagaataggttcatttttaagcaatcattacattgtagtttgtgaaagtagggggacaaatgcgttggaagtaagtgggggacaattccatcgggatttagttggagggtattctagtcctcttgcttttgtattggtatgtatgtgatgggtgaaaaatgaactaattttgggacggaggtagtattatttagcaactaggtcacattctgatatcatttgaacaattctacgcctagaatagcaattttaatgatcttgacattttatgtgacaaactaaactaaatatatgtaatccatttttactttttcatccttcaggattccaaatttaaagagaaaatctaattcatcaaataataacttcaaagtaatcaacgtagaagttctaattctttccaaacctgagaaagaccacacaagccaactcccagaatggtacaatcttatacgatcctacacgactagtgatcctatgactgggattacaagcattcgtggatgagctgtagctcagtggtagatcacccagtagaggtctcggtgggcttcgtacccacttccctgcacaaggtttcgggggccccttctttaaagccaactcaagggggacatacttgccccttcattgagtttttttaggattgcgagacttccagatatgattcttgatatgattttagttgtttggttgggtggaatcgtagaaatcaccctataactagaatcgtgattttaacaaccaattgttaccacccagtgagatgatataccaatggtaaccactcactgaacaaacagagtacataaaggagataacacctatgagtaccactcactgaacaacagaacagagtagctgagaactgtgtggtgttacgttaattgttttatcagtgggtttgaaccacaaaactactttgacatatgcttattagatatattaaaatttttctgcatttattgtgatggtttggtgacagggagtagtacaatggcataaacattagtataaaacaatctagtgtactcataaaagcaatgacttaggggtataatgtaaagggtcttgccttattgatagcacaatctgtttgcaaatactcccttcttattcctccaagacctaggtcactgcttttccggtcaacacaactacaagagaatggggtggaagtgaaacattgaagccataaaaacaagtagaaagcttgcaatcagaaggtagctaataatcttagtgatggacaacaaatgagagtacaacaaactaaagagattaggtctgcacttagggaggtgttaaccttacaataccagctgtaactgtgttttgaagagaaagtgggcagcccaaagcaacaacccaatcacctggtcgaagtttagatgatgatccaagatttgcagatggtaaaggggtcttcgatttaatcttcacaacagcaatgtcagagtgacgatcagcattgagaacagtgccttcaaactcacgaccatcttgcaaagtcacactaacctattacaatttcaacctttgtaagaaaagaatcaggatttatacaaacacattgcaaaaataacctatatcaaccaaaatcatgcaagaattatcaaatagtactaagtaagaaacagtataaaagtatttatcataattcataagcacaactattgtataataatttttaagaaaacaagtacttagatgatccggaccattaggcactgaattatccattctaacatggacaataatttggccccacacttcatagctatcataagcacagctataataatttgaccatactaaaatttaggattttaccactagtacagagaaaaaaattattctacgtcattctctttcttcaaaagaacattaaaggcctataacactcagtttgtccaagcgcaaagtggtatttgaaatacaaaaccaaacagtaaattccaatacaagccaattgtaatttgttgcatctgtactaatataaggaaataagttagtacataaaagcctgaattctaaagcttggagtatatcagataagtgtatttctgatgtccaagattattttcccatattagggaaaaaaacactaaccccggaaaagaagaagaagaagaaaagaacaatatgatataaggggttatccatatcatggcattgagtttcatcaaatgcctatgtgtgccactaatgtctcaccaacgtaagacaactgcatgttaccctcacattttctttggcatatttcagatattgatgaaaactattggcacagcatggatttatcctataaaatactggtatacttcccccgtgagtaaattatattcaggactgagcaaaaatcacagatttatatgaataagtgcaggaaacataatgaagaagtgtacagcttgagatgaacagaaaactacgaaagttagtgacatgttaacaacctttcccctcaagattggttttgtgctttgaaaatctagaacaacatgggcacatgtcaatattgtcccatctgggtctattatggttccagatccaatgctcttctctagaacccatccatgagtttctacaaaaagacaaacaaaagtttattatgtatagctaatgtgctgactgtaagttttcacaccctcctttagacagtttttaccttgtgtagaagaaatgttgacaacagcaggaccaactgcagctgcagccttggcgattgtatttcggttaatacatcctgggcaacattttgaatcatctgagtttccatcagagctctggttgctcaaattagtgggtggaactgacgcagatgcgaaggaattttgggtgggaaaccctgcactccaatttgatgcagatgtgaagaaatttaggaaggaaaaccctgcacgtaaactgtacacattaagatcttcaaggaaaaaaatacgagagattaatcaagaagatatggtggctactattgttttcagcaaaaataaataaataaataaattctcttgagtgcttctcttatatagtgaatatgttgttaagttacacatcgtgaatattctcataacattttattgacaatcacagaagctgttcagctcaaatactcataaaaggcatttatacagtgtagaggcaatttcataccttctacagaacaagcgaaagtcaaagctaactgttaacagctgaaatctagcacatacttacatggtcagatatacgcagattctgcaatgtaatgggataacatactatgttctcatctccacacacaacatgccatcagattggtcctcaaccagtccttttggtacacagcacaatagagtacatataatataacatagtgggggcacacgctcaatttaacttttttattttaggaatgactgaatttaaattaactacccatcaagaaagcaactgcacagataaacaaagaaaaactcccacgcacaggatctctcacccacctactaaaaattcagaagcattgttcatttccacatcgaaccaccatttccggaaatcacaatggtggttaaactagaataactccagcacattgatgcacaacaccgtagctacacaccacacgctagaatgtatgcatatgacaaggcggccacaaatttatagctcaatatcacactatgttcatacatagttggcaaaatacattgaactcgcccaggaaagcagatcacgcatctacgtcgagcaatcacagtaggaaaaaaaaacaatgaatcaatccaccgttgcgagaaccgtacacgtcaccccgacgaacgacgacgccgaaaaatggcaggagctagtctgaaagaga

SEQ ID NO: 2983 - DNA, 10725 bp, Oryza sativa
tcatgatgcacttagaagttagaatgcagttcagacgatgacaaacggaccattgcaaacaaaaaaataagtagaattaatctcgtaaaatagtttagagatgatgctgatgaactgtgatggagacctgtatgttgacatgttgtgtctctccttaattatgtagagcatgacaatttagtgtgataaaataatagtaacatttcatgctagctagaatgactcaacactgtcgtttggattgatccaatgggcatctgattcgacaaccacagccacttgcattaacaagttaacatcagctgcaagcagacatggatactttggcatgcagctctgatgaacatcagtagactcactgtactccagtccactagacttgtctgctctgcatatgccatggaattctctgaactttgttgcattttgcatcatgctgcctgcagaagcctgaattttacaaggcagagaacgaccagtccacatgtcacaatgactttgcacggtgctgtactgtagtactatgtacttttctctatgtccaaacactttctctgaatagtggtgatcttggacagttcagaagctcagtacgtatacttttctgtggtccaggagaaagagttttttcatttctttcttgttctgttctgcaaataactgaacattaatttgatcgatttgtatgaggtggtggctccatctgttgccttgtctggctgcagtgttctcgaagacagggactgaattttactttcggtagtttactcctcaaaccaaaaaatgtttctagaagcaaaggtttggatgtggacatattttgtagctaaactgatgtggattgatgggggttaaagaaatgcatggaagtggaagctgcaggaaggttttcttttctgaaaccatgttcagcatcggtattgtataatactaatagtttcattgtcttgtatgtttctttctcatttaaaaactttttagaggcgcatactttcgtggtatttgttaatgcagataatgcaaataacccgctacttgccactgcttttgtaaaacaaaattctggcataatgttaacataagcaccttctgtgtaaaaaaataatttctagctataaatctaagcaccgtctatacccagatttaaagttagaagttgattttttttcctgtaacaggggagcagcggggaagtgtgtatacctatctgtaatgaactgacatttctaaatagctatccttaatggtggatctaaacaaaataacgggaaagcatagtgcttccttcgtttcaaaatataaggattttcatgttgtttagccaatcccaaggttaggtcaaaagattcatttttagtcacttaagttgttaattttgatattctaaattacttagatcctctttctaggcatgtgatcgacttaaaatcactaaaataacgagaatcatatgaatcaatatagaaatcactatatagtggtataaagttcgagttccagaaattcattgtagaatgaagggaggaccaaagaacacgtgatgagtagaaaaatgttgtgaaaacacctgcacagcacctctactgtactccgtcaaaccggcaaacccatggcggctgcctagcggtcgtcggttcctttggtcggccactgcttctgctggatctgcatctgtggagacaacaaatcgtgtcttgaggaaatcattcaagctcatactcgtattaatcaacatcaaaattctctctctagatctctctcccaattcatcatcatgtctaagactaagatcgagaaggtggaataagggcaatcccaaccccctacctcagttagtgtccatagtattaaatacactgtcacatatgtaaaattttgaagcgctaaacaggggcgaagctagcatcaaaacaaggggaatgcactaccattgagaatctagaaaatttcagtacaacactgtacattctagtgtttttaagtgagaaattaggaatttgggggttcatgtgcacctccaatataacatagcttcgccactagcgctaaaagagttaacaagaagataggtaaaaagatgaatacactattttttatgtaagaaatcatctctatacaaggagatatgtggctaaaagagaagagaagagaggtgattggatgataatttaatttgaagataccaatggtataatgtttatatggcagagcaagtacgtggttgggattgtcctattgcatcgatcaatctctcattcaatcgtatcatgaacccaggatgggccagattcatcacttaccggcatggcagggagatccaaattaaatacagacacttgcctcgttgctttacatgtcatcgattgcctctacatatcaccttgattttctttttcttcttttgtcctttggattgttctgggggcagcctaatctagttttgtgtgattggttcacggtggtataactttagttctggtttgtgcctttgaggattatttgttgattaattaactttagtttgcgtttgtacctttcaggttatattgattttgggtctgttcactttgatgtcatttttaaccatactaatttttctgttaaagttgtcaaaaaaatatctacgtttagtttattgccaaatttggtcaatacataagaaatcctgtcaaaattttagcaatattgccatcttgctaaaattctaaaaattttgatattactaaaacttgttaaggtttattttgactacaatctgaacagaacaggctctttaggcaagctgttagaaaagcaaaagcttctagaaggaaactatacatcggtgtgcatggattctttttaccagcctggatgttgatgggtgagtcaacactcgagacaccacaagcgtgagtgcgtgacatgtactgcatattccaaatggagggatttttacacacaaggacaatagagtttagtacttttggggaagaaatgaccggacatttggagttaacatatgcattttttactattgttaccacaaggacaattttcatgaagtcattatctttgactgagtacacccttttctgggtgtagaggttttaatctattgttttttaagaaaataaagtatttatcttattagtacaagttatgattttattgtaccgtttcatgcaaatagatgatggtgaaattttgtcaaataaatatgacattgtgctatattgtagtactatagtatttatagaaaatttcataatcatcagggcgcgcacgtttttcctgaagcttggatattgtataatatctaattaggctgagttctaaatagatattcagaacgtctattttctttcgtgaaaccagctttctcaaaccacgtgtttcttgtaaaagttatatatacacatgtttttctttaaaaatatttttaaatttatagtagttaacactaatttatctcgtttgcatgccaaaaaatcctaaacagttatagagttgtgtatatagatcaagaaaacaaaaccggccttattgtcaagtaccagtaattaagcactgaaaatgatacttcctccatccattaaagttagacatattttatatttaagtttttcaaataagttgttcctacttataggctctacacatttaaatagagaggaaaattaaatgattgatcagaatccgagaaaccatttttatactaaatggttgtacgcgtgcatatatctttgttttgttatataccagatgagttaattttttttggtcttggtgataaaaataatgtgtaatatttggaaaggatatgaagtaccacatattttatcgacgagagtggtactcccaagatccacagcaaaattaattttggatcgagtctcttcatcgcttttgtcattcggctccagctcttctcagggcactcccaaccctccacctcagctagtgtctatagaatttattaggctgccacataagcaaaaatatgatgtggcaaagaatttaatgaagggagagaagaaaaaaagagagaaaccgtgtctcatgcacgaaacggggtcgggcgcaggcaccaagactacgaaacaagagaaactagcgttgggggcaactcatcgtttcttccgcccggattttcctcgagctctcgatctgctgcgcccgcctccatcccgccgccatgcctaccaccgtcccgcgccaaatcctcacgatttttcggcgcgcccctaatcctcttcgcgccaacaccagctcgtgcttctctctatccatctcgttgcctccttttttccctaatcacttgtcttctccaatctctctcgtgacagctagaatcagccaaaaccatccccaatcgctcatccctgagaaagtagttctccctagccatgcgcaagcatgaatctgacggaatcgaagatgcgtcgatccaaatccaatcaggctgccggtgaatcgactgcccttgatccagatgccgctagtgttgtgggagccgacggtgctccagattctactgttgttgcttgtggtgctctacgagctagtgctctaggcgctggctttcctaccgtaggtgctcatgccgccagtgcatggtggcaggaatcatctcccggtagctcggaatggtaaggtgcaaatttttgtatgcaaagatttaggttaatcaatgttattagtaaattaatgggttatattaggctgacaactttttgcttcagagaattgctaatctagtgttgtatagctggcacttttttactttaaagaattttttgctagcctcggtggcaagatgtatagctggtactgctaattacttgtattcacctgattaatttaagtcaaactcatatatgctagtttatggggactgatttttttctgaaatatattgtgcttgtatttcaccacttctgttcttgacacagatattaattttttttgttgttttctttttcaagatgtatccaccaggtggtttcctaaattatttacagagtaataagatctctccatttacccagacacatccatttgtgaactatcataatgcaagtcagctgccagaaaatttccactttgttggtgcaccaatgagttattctacaatgtcacctacaactccatgttctaaagcgataccgtcaccaactgggaggtgtgctgcagcacaaataggttcacaagataaagaaacaattgatattgaggacgatgacaccatcgagcctgctagatccgatgctaggtccgagaagcgattgaattggtcaaatgaagaagacattagattggtaagttaattttctttgtttctttttgaagatttcagtctgtatgcatttaaaattatttgcacttcattaaaggtacggtttattcttctcctaattgtaggctagtgcttggctgcacaattcaattgacccgatcaatggaaatgataagaagtcatatcaatattggttagatgttactgctacatacaacagtaccactaagagtaaccgtatgagaaatcgtaaccagttgaagcaacgttgggagcgcattaagaaaccagtctccgaattcaatggttgctatgcaagaatcactaaaatacatcaaagtggtatgagtgaagaccaaaagatggaccaagcattccagctatatgcctctgaacataatgacaagcctttcacaatggtgcatgtatggaggatattacggcatgagaaaaagtggtctacatatttgaagaaaattaacaaggaaaagtacaagagtataacttctaacccaactcatgttgtgaatgtcgaagatgctccaaaactgcgtcctattaggcataagaaggccaaagatgaacgcagcggaaaacgtctggcatcagaggctatttctgttattgaccagaaactagataaattcattgaagcaagcagcaaggctgagaagataggagaggtacaacaaagtttggcaaataagaagctagaagtagccaaccttaatcataaagcagctcaggaacaaacaaagagtaaaatgattgacctttacaaagacttactgctagctcccacaagtgatcttagagaaagttcaatactatagcccactactagctccaattcatctatagccaatctaatagctaatttatacaatgttgcttcctataatattaatatatggtcccacctgccatacacatattgcatcttggagcctgtgctacagctggctacaaatctgtagtctgctgctcttctctcttattatttatctcattaaaatatatttatagctggctaatagcctgctattgtacctgctcttagtgaagaagctttggctgagagatccaaaacattggagtgtatgagattggctttgtttgctaaagataattgaggtatgtttttaatatattgttggcaaacaaattgtgttgtgatagtaccattcaaatctgaacaagtgttaattttgtcaattgtgtgaactcattttatttttctagtgcttgtttgaacacaattaattatgttaactcattttttatactgcatgttgaacacaattaattttgtgaacctattttctttttatactacaactgaatactatcaattgtgtgaatgcatcctctttttgtactgcatttgaccactatctattgtgtggacccattttatttttctagttcttgtttgaacacaactaattatgtgaactcatttttttatactgcatgttgaacacaattaattttgtgaacccattttccttttatactacaactgaatactatcaattgtgtgaatgcatcttctttttatactgcatctgaccactatctattgtgtgaacccattttttctactgcaactgaacaccattaattgtgtgaacccatttgactaccctgacatatttatgtgtgtgtatatatatcctctagctcacacattctccccctcctctgccttccacattctttcttccctctttactcttccatcttctctcatccttaacaccatgtcgaaccaatctgatggtgattcccctacacatgatgattctcttgatgaggtgagcagcatagatccaatggatctgtacccattggatgagatcagcaacatattgggtgatcttgctgatcatgtggtagccgaattgaagtccgaagttgaagctctacaagatatgagacctactaggcagagtggtccgaggaggtatgttgataggccttatgaagaatctaaacatgggctattgaaagattactttgtacagaatccagtctataatgatacaaccttccggagaagattcaggatgaaaaagcacctcttcttacgcattgttgaagccctaggccagtgggataaatatttcacactgagaatggatgctcttaaccgcccagggttatctccacttaagaaatgcacatcggctatttgccaattgggaaatggtagccctgcagatcagcttgatgagtatctaaatattggagatagtactacagtggagtgcttgaagatgtttgtgaagggtgtgattgaggtattcggtgcagagtatttgcgacgccccatggtgcaagatgttgaacgcttagtgcagattggtgagcgtcgtggtttcccgggcatgttagggagcattgactgcatgcactggcattgggagaaatgccctgttgcatggaaggaaatgtatacccgtggtaatcaaggtgttcctacggtcattctagaagcagtagcttcacatgatcgttggatatggcatgccttttttggtgttgctggatccaacaatgatattaacgtccttaatcaatcaccattgttcgtccagcaactaagaggggaaggtcctcaggtgcagtaccatgtcaatggaaggcaatacaacacaggttattaccttgcagatggcatatacccagaatgggctgtctttgttaagtcaatacgtcatccacaatctgaaaagcacaagttgtttgcaaaacatcaagaagggaaatggaaggatgttgaatgtgcttttggtattttacaatctcgctttagtattttgaaacgacctgcacgtctatatgatcaaggggatcttgagaatatcatgctagcttgtattatccttcacaacatggtaatcgaagatgagaaagacatcgagcagcttcctcttgatttgaatgagacaccaagcacattaactgtataagaagctacaatctcacaaggacctaacccagagatggaagaagtgatacaaagaaatgctattattcgtgatcgtattactcataagcaacttcaatcagacttgattgagcatatctagcaaaactttaggaattcaaactaattaggtgattgttaatcatttaaagtctaatttacaatttgcgtgttgctaataactagtatgtttcattttaagttgcaatctctgttacattttagcctagcagtaccagtttagctaattatgttctcacttatttttcttgatgtaaagcttctgcattattttgatattgacttgccaactattttctttttatagatcaagtcctgctattttggtgctgttgtgctgctggtggaaatgctatggatcaagttcggtatgctgtcgaagcgtgtggcagacttatggttacatatgtttttttggtttggtgttgcagtgcatctagaagaactgctcatgtcataagagactaatttgagtccaactattttggctgccagtttgggtcctaccatttggctacctatatgttttttttcctttttattgtactgagatggatgaacttgaaaattcgctactactttatgctcatatatgcactgatatctgctagtttctactcatataatgtgatttgcactaatatatgttcatgttttgatatttggcactacagtactatgtagattggcgttcatatttggacgtatgcattgatgtgtgtcacagttgatccttctccatttacaggacatgcaaatagctattaaattttcttctcttagaaactgctatagacactgtgcattggggaggtagtgtctacaaatgcatttattattgtttctctcttctagacactacctatagacaccatggattgggagtgcactcagaccgtacgtcaagagcaataaatatagaaaagccgtgctataaaaccgtttcgtactttctcattgcttcggtcaaggagccgtttctcacggcatttaacgcataaaatccgtattagtgaagatgtgcacatttcgatcgtgcagctagctagctagcacgcaaattttgtggcacgaccgtgtgccacgccacgacggctactcgcgtcgaccattattcgtaaaatctcagttggttcgttttccacgcgaggattgtaattaactttggatgacgcccatggatatatcgagcgatagacccacacaacacgcgtcgatgatgagcaaccaagcggtggccgatggatcgatatatccaccgccggaattgaccgaaattccgtgggcgcgccggcaattttccagccagcgagaccacggatcacgtggccggcaagtttaagcttgatcatcccctaagattatttttaggatcttctaaaaaataattattctccctaactagtcgtgtctctctgtttatttgtatgaagaataaatagacataatttaatacgctgcatgtaaccacggccaagattaatttatattagtgtaacctcgtgcaatatttaaagcttgatgcaattcacggggcacgagcgacgtagcatcttaaccgatgaggattaatttcagaattataaaggttttattgtctttggcctttacattctttgcttaggtgatgatcaaatcaggataaagggagtagtaggctatgttcggatgtatggttcctaactttaattccttgttttccacgcgcacatttttatactcggtgcatttttataagaaaaaaatataggaaagttaattttaaaaaaatcatatgaatccatctttcaagttatctttagctctgcgccatgaacacaatagatccaacctagtgctcgctgcatttggcctcggaggcaatggtagctcaagcgtcggatctggcttcctctacttcctcggctagttggatcctattgaagctcaatggtggtggcaacagatgctttgcgtcgtgatcacaacctccctaacgcggtttcgacctttgctcatgtgcatcattgtccttcgtcctaacaatccgtgacaagattcgtgtattctcgtgagggcttgcgcaccctagcaagggcataacccacgcttatgtggacgggaatcttcgagctgacgaggtgaggccaaccactatctcaccacactgtaaatggcctaagtatagattttaacaatgtgtagccatggaattagaaaatgaactacactatataaagctgacaaaagcaattctttcagagtctcatatgttagctactccctccatctcaaaatataagcatttttagtttagtgacaagtcaaacattatcaactttgactattaatagaaaaaaataaaaaagattaatcatataaaattgatgttactagatttatcattaaacaaactatcataatatgtaatttttttattttaaacatcttactt

SEQ ID NO: 2984 - DNA, 11435 bp, Oryza sativa
catcacaaaaatgattttacatggttttcatttttattttttttagaaacacagtacaaacatcgtctcactatcaacaggtacgtcgcttaccactaaaataatagttagccgtaaatacgagcacacgtgtcaagtctaggacttgagctcgggtgggttggtttcaccacaaggaatctaaccagttaagttacactcaatttactttttgttttatttttataaacattgaattaggaaatataagaactgaaatgcatattgaaaactacgtagattggtatataaatgtgaacaaacattgagtattgcccactactttctccttgcgtcttaggtcctactaatatttaggaagctgtaaattaattctgataagtagtaagtgagaatttaaaatgttagattaatttttttgagtttattttttaactaaatctgtacccaacgttcttaaatatgagtgaaagtgatctaaattatttaggggttgttcagattgatgttgtttcaaatcatatcttttttaaagtaaagttatcaaatatgtgcatacatttttttccaaacttgcctaaacacatataaggaatcctgttaaaattcaataatattgtcaacttaacaaaattttgataatgccaaaattcggtaaatttcattttgattacaatctgatcagctccttagatagctaaaaattatggaagctctctaaacatgagctataatcatattcctacatgtttggaacacgggagacatgaggaatatctctatggaataagtgaaagctaacatgagaattgagattaatttgcatgagatgagtgcctgacacatccacacgtgcataagcttcatcagttccctggtcatcaggaatctgcacagtacgtatatatcctacttaattatgtgctccaccatgttatgagatctaaagattctctgagaaccgagcgttgctcggttggctagcttcgctggtgagcgagcagcccgcgcgggttcgatccctgggatcgtcacccgcgtgtctcaccgggatttattcccaaataaatttccagctctcccgtgccagcgccacaatagtagagtgacgtcctcgtcacacacaaggttcttaggtggctttgtgtatctcattagtacgtgtgtgtatagttgataggtctagcatgcgtgtaggggtgtgggtgtgtgtgcgtggtggagtgcgtttgcacgtatgttcagatactacagcttgtactcaaagtggagagctctcaaaaaaaaaaaatctaaagattctcttagagagagtataatagcagactaatagctagctataaatatattttagtaagataaaagatgagagagaagaacagcgggctacaaattcgtagtcagctatagcacggactacaagacgtaatgtgcatataataggtgggatcatatattaatagtatagtaagcaactattatataaattaactattagattggttataaatgaattagagttagtagtgggctatactattaaacttgctcttggagataactatgaaaattagcagatggattgccatggcagaggggatcgatcagtacgatcgatttgaaataataatgctcttgtcttcgctttacatgtcatatcggagcctcttcatcactttatagtactccgtacatattttttttgtaaggtgctagtatatgtgtaagcgattggtgcgtggtggggccatcgtgtttgtgcgattgtgggatcgatcgatctcacgatggatgggtacgggtgctcatgcaggctgtgatcggtcgcaatgattgaaatgatttgattgaaatgatttgctacgcttcggtgcagaaattattaagtaatttttatttattttttttgacaatcggctataagtaaaaggaaaaaataataaaatgtgagggtttattagtatttatcatcagacaagcaaatcattactcgcgatttaatgtggaacagattgataatatattgataagtgcatgttaaatactataaaaaatgatatatagatttgttaaaatattgtaaaaatgatgtgagggatgatgattagatatacttgcagattgatttgtagaattaaataagttatagatgatgttgtatgtttgtatgatattaaatatgcaattattgagtgtgtgatgatgtgccatggttgcaagttgagttttagaggttagtggacattaactttattaactttatagtaatataggattaaagcaaaactctcgtcgtccacagatcgcttttttttttcatcaaatccaaattacaatttgctcgttattcggtagcacatcttttaaactgttaaatagtatgcttttaaaaatcctatttacatagaagtttctttaaaaatttagattaactcacttttaaagtttgtaataattaaccactccatcctaaattataagacctatattttttatacgatccttgatgccatattttagttattaatttatttcatattatacttccaacgaatatgaaaaatacttgatataacacgtgtaatgcttagcatagatatggttagtatgattatcagttaaaaaataccgagtttaatttcctttaaaaagaggtgccatataatttgaaacgaagggagtaatacttgattatccatgtgcgaatgacttatcttactttatgtgccgttgaaaagctaaagtaagctaaattcaaatagccatatcaaaaaattaattctaaagttgattttttttttgaagtagtctatttttaaccttcttttaaattgatataatatacatatgtcaaagtttatactgtaaatcagctttagttgcttcgtttatttttttaacactttagtcgtcatagctctcaacataatcctatttatttttaaagtttatattcaattaagtgttgctaatattatttctctattatctattaagctacattagcttaattgttcctaacacttgataattaatctatggtccaaattaccctatcattttttctcttatgaagtcatatcatcttagctttgtatttagatgattaatttatattatctttcttcttttctttctcttattgagccaatcattttagttctaattttggacgatcaatctatatataatttaaattattataaactacattatcttaattatttataggccatgttcttttctctaacaaaagttggattaaattttggatactcgtggcatgcttttcaaactgctaaatggtgcgttccgtgcgaaaactttctatataaaagttattctaaaatatcagattaatctattttttaaatttgaaataattagaactcaattaatcacatgttattacaacctcgttttacgtgaaacacttaatcttcatattaatctttattttcatgacattcaaacaccaccatagtttttttaatagtcgatcaaagatgaaaattacataaagttatgttgtctagctctcttaaatattatttgtactattatatacaatttttttagcaacatgcgaggtttcatctgattaacctggaattagagcgataacgtattgtacctatctaggttaaagccatagtactgcagctggaacatcttctagaagcagagatcgatggagctagctagctgagcaacaagaggatctggatatgaatgtacgatgcaaccttgtcaccagctcagatgttgacccttgcatgggaaaggcgccaagaaaaaggacattgtagagtagtgattcagatgttgggagtgaataattaagtgcagcttaattagatcagataggacagtgatgagtggttgtgtgtcctcaaattaggcacttttgattagttagtatcactcaaatgtacatatgtaaagtctatgttagcttttagggcaccatgtgcaaatgcttggtcgtccttggccgatagatgtgaataataagtggtgaaaattacgtatatttttcgtttagtagggtatcaataagagattgttaaaccagtgcgatgttttaatattaacttactcatactattagattagactccgtcttatatatagatttactggaaaaatatccgtacgttgcaacgggtgaagaatattttaatcttattattgttatatggtttagttgagatgaaattcactgtgttaaactcacttggataaatagtttgttagaaaatcatgagctgtaattaggagtccaattgtctcaagttaatatgcgaggtttttgaaaagatttcttatacgattccttctatatttttaaaagcgaaagaacttaaaacccgtctcaaatatagattttgtatttctaaaagcgaacggatttaaaacccgactcatatacagataacgtagcaaaaacatcttcaatttttataatagtagagattattagcggctttgacatgtcactctgccttatcaacatgacttggtgactaactagctaggtggagtactatggtactatgccttgatacttcaattgtgtaataaagtttgctcgtctcacacatccatcagtccaaccagttaattcttatcgtcttgctatctctatcagttggtctttttttcctcacattcattttccattttctttgtacaagatgaaaaggaaactcgttgaaagaccccccacaagtagaatgtacaggaagatattaccttttccgtcttagaaaaaataacttttacctacgaatctaagttaaaagtgattttttttacagatacgcaaagaggccgagctatcctaataaccaggatttatcttttcgtttttgaagtaaatcgctcttcaccggttcacccaaaaccgataaacaccaacgactcacggtcaacaccttacgaaaatcggctaatatccaacggttcaataaagcattgtccaggtcaagtgatgccgtcctacgtggaaggattggaacgggtgagctggaaaagtgactaccaggtgggccccaccgatcctaaatccgtttctcatttttttactgcaagtaataactatccctcttttctttgtcccgtactggacggttgaaagtacatgaatgagaggcggtggtggggcccgcggctggtaaggtgggcccaccgacgacttgtccacccagcgggagagccgggcccaccggccggccgccgaacacccgcctgcctgcctgccccatgtgggctcgggcccaccaggtttttttcccttttctttttaagttttccccgtagtaatctatacaagctgttgtcattttcttccttaaaaatgtgatcctaatccaacgaatactcctaaaattatggagaaacttattggtttattatagcactatagttgaattcacttctccagtgttctaggtcaactgctaatctccaccgcggttcacaccctgcccaagttcacaattaccatggcaataataatataatatttttcaccatgagaaaatcaaagaataatgttttccccattttcaacctggtgtaattgattacgtacatggaaattttaggacaaaataagggcggtgcaacataagtagatacgcaaacgaacattaataatttaattagtcggcggtttttgttttccacttgtttagtgataaaggatgcgctgaaccgggagcgctaacgggaatcgagcgcccacctttttctccctttttcttctcttcatcatccaaaagccaagttgccaagttgcatatatccatgtcatttatagttttcaattctagctttggtgatagattagggtcaagtggtcgatttagttatcaaggaggaaagctagtgcccaatatccagagtaatggtaattaataataaattgtaagcacatgaattacatatataacataaatcttaggactcttcaacatgacaaaagaatcggtgaagtgaacacctccaccgatttttctccaaatctgggcaagtcgcatgatgcatgcagacatgagcatcagtggacaaatcattttgtattttatatcgtttttctaaatacttttccgagttggattcctttccatgatggcagcgggcggcttctactatagttgtcggtttgtcatggcaagacaaatattgccgcactaggttaaagttgggatatagctatacaaactatgttattaaatagcgtcggtttgtacgtcatgcaggttgccttgtctatttatttagaaatataattttaagttgcatagattattttaaaaatatatatgtaattactgttaaactcagtattgaaattgggttcaatgtcgtcatacacacggcgactgatggttaaacccattaatcataacaattgagattaattatgcatgttagctagtgtatcattgtctctctccatgaaactctacaatctagtactatagtatatcttgcagtatatcccatgtcctccaattaggccgctgtttatatctactgtatgccctaaccgctggattcgatatgattgaggagtactggattgaaactatcatcgaacgagaacataattaattaattaattaattaacatgttgtaaaggacactacctttttccccggcccatctccatctcaagaggatgacagcatgaatatgtttttcttcagacaagatgcaacacaacacactgaaaatatctacatatatctgtgtgctataattaaaccacccaatgcaaggccccctgttctagaagctggatcttacggttgccctcttgcaaagaaatagttttctcgagggtatcatctttagtggagtatgtggagatagcattaattaagctggtaatctcaattaactaattagatgatcaaagccttgggactatggtactgtttcaataaagaaaataaaaaaacatggaagatgtttagccccattggttgtcctaataagtcaaaaccaaagaaaaaaatttaaattttcaaacttaattttaaagttgattttaaactatttgcaacgtaatttttttcagcattaacttaagtcgctaaaaacacatatataaaagttttatctacaaattaatttttattttttaatagtaagttgttttggtttattagggaatatgagcaaccaataaagcgggttaaaatcacacggaccttttacttcacctctgtcctatgtccattgtccatattcatctttaagattggatttatttttggacagagaaagtacgtgcgtatatcaaatttgacaaactattcatatccgcaagcaaatgcagccaaaatggtgagatttgagagctagagatcgcacgagacacagttgccgacttggcgttctcttctctccaacaatatcgccacaactatttatttccaacgaagaaaacgtaccttttctatcacacaggaaccgggagaatctttccacatgactgacgactactaatattctcttggaacataatctaattaatctagttttttagctcgatttttcaactcgaaaaaggaaaattggaaaaggaaatcagagtggcagatctctgccacttttctcgaggcaatcttgcatatcacacctctacaaaactaatatcccagttgtcagtggtataacccatattattcagttaaaagcattctagagtagctaaatgtttacgtggtttccacacaacttttgtggtttttcaccataatttactccacttcccccgagacaatcttaaaaaatcacatcctccacaaaattaatactccttccgtcacataatatagcaatctaataccggatgggacatctcataatacaataaatctgaatatccggttatatattatgggacggaggaagtactagcttcgatttgtttgtccctataacccaaatgattccgttggaaaagcataccctaccaacatatccagtttttttttaaaaaaaaaaccaacatatccagaattacaaaagaaacaaacctctgcagagcatgcacgcttgcttctggagacactcatgacatgcagtctcctttgatctgatcttcactccatcactgaacctgaaaacgaagtggcaacagctcaaaaggtagacggacaactcacactcctatctcctacttgagcttctagaagcttgtgcttttgctttgcttgataaccagcttagcttggctgatcatttcatgcccttggtgtgatccactgatcactgctgagtgatgactcaacaccaagcggccctcctcctctctagctaagctccttttagatctgcattgtggggcccactgtgacttttaggtggcccacatgtgccaaaaggtacaaataaaaagaattgtggtttgatttgcttcgtactagtccatactaaacctcggaatattgtggtattgatttaattagtagaaaaatatttcgtattacatgaaacaattatcacacaaagctatatgcgttatgcaaggaataagtttaagaaaaaggagaagtggtggtaatacaatttatagctaatccggttggcaatggatgaattaaataaatggctgataaggagttaaaaaaaatagaacttatagctatgaacctaaacatggttttgttttgtgagcttaaaattcggagaagctactggtttatagttaacatctgtaaatctaaaaagaagttaggtttttccacattctggcttgtaattcattttttatctacactatttatgagagttagagaatatggggcttttaactatttgccacacctatctcaatgacatgtgggtccacatgtatctatgacatgtgggtccacatgtatctatgacatgtgggtctagtggcaaatagttaattgccacatctaaaagtggcatatatagttcaatatctcagagaatatgggaaaagctataactgctaaaagtcccctctgataggttctaggagtctatcaagggagtttctgacggttgcagcttatctaagaatctccagctgccagaagctcccctaaacagtccaggatttcactcagaattttagaatgtgtagccgtagaatttagatactattagttagaaactaggtttttcagcccagattattaagagctgactaccaattaattactcttaaaatcataagtttccaacagggcccaagtttgtggtagaaattggtgtccccatcatttggcttatttcgtaataagccaaaacggtttattaggaaataaaaatgaatttgtagataaaacttttgtaaatgtattcttggtgacttaaaagtcaatgttgaaaaagaaactacgttgaaaatatctcaaaatcaatctcaaaattaagcttgaaaatttaaaatttagttttttctttgaccgattaggccatcagataggaccctggatttttcgaccaagggtaagcagcgtaggccctgaccctcttaacagctgaacaaacctgaacactgaagcaagtgatggagaccattctccttccacctcacatgagctgtccttgttgcccagcctcctctcctctcctctcctctccaccctcatccttatcctaatccaaatccacctccatctccatgttcatctcaagcttctcagtccccacacaccccagaagcctcatcacattcactgattgcaaaaaaaaaaaaaaacaaatcactcaaggataattttaagatcactgtcactgattgatcctttgcatcaggaggttcttttattgtttccatggaccaagtttggatggcatcttttgggggtggaaaatttgggtccataatatgttttttccattgtctggattttattctgggggtgttcaagaagagcaccaagttggacaaagaataagtctacaatgccatctagtcaaatttgggataagaatttagaaacagtgtgctttgctggtctatatggtgacagcatgtgattaatttatttagttttctttgtgggggagattcggatgctgttctggactctcgttttaagcgcgctggagatttatattagtgggacatcaaaatggaatttttcaggtaagagaatgcaagctaaataattgaaatagaattattgttatttttattattactcatgccaagatggaccggctagtatctccttaactactactgtggataaattctaagcgctataattaacaccactacggtgaataattatttttaaacttaacgataagtgagctgctaattaattaaatcaaataatattaagaggaaaatgttgtcataaaaagtcaggcaaaatgaaatggagtaaaaaaaacactctcattataggcactgcaataattcaacaaaagaatacaaaggccttgtcaggttgtcatggactgttctactattatagaagtagcaaggaaaaatgaagcctttcttttggccataaaaataattagacagcaactaatttttcaggcaaaaaggcacttactagtcattatcaccttttccatagttccatcatcaaaaaccacaagatcaagttttccagctcgctctttcttttcttttcatttccctgtgtacttgttctgatctacttctactcaattacacctcatccttgcatacaaacaaacaaaaaaagtaaaaaaatgaatttccactaatgatcattacctgtaattcaagcccctctttaagcaacaaaataaacttttttttttatgaagagttgcatgttgaaccggcagaaaaacaggctttccaaacaggttgctttcatttttaaaatttaattttcattaaatttcgttagcggtggagatccaccaatcagaaggcgccacgtagccttgagtgagctctatttaaaccactcctctccccccagagagaggcgacccacagatccagaagcagcaaaaaaaagagaaaaaaatcagagaaaaaaaaatgaggagcccgaggagccgtgcgctagagcgcgacgccggcggcgtcgccgtcgagcacgtcgagctcatcccggggatgcccgacgacgtcgccgtcgactgcctggcgcgcgtcccgcacggggctcaccgggcgatgcggcgcgtgtgccgcgggtggaggagcgcggcggcgacgcccgcgttcgccatggcgcgcgccgaggcgggcgccaacgaggatttggtttacctgctccagttcgcgaaccccgcggcggccgcggcggccgcggaggaggcgaaggaggacggcgacgcgccggcgaactccccggcgtacggggtggcggtgtacaacgtgacgacgggggagtggaggcgggagaaggcggcgccgccggtgcccagggctgcaggaatt

SEQ ID NO: 2985 - DNA, 34676 bp, Oryza sativa
gccgccgatgcggtcggcgaggtctttcttcgcgtgcgcggaggccggcgggaggatctacgtggcgggcgggcacgacaagcacaagaacgcgctcaagacggcggaggcgtacgacgccgtggcggacgcgtgggacccgctcccggacatgtcggaggagcgggacgagtgcgacgggatggcgaccgtcgccggcgacaggttcctcgccgtgagcgggtaccgcacggcgaggcagggcgggttcgagcgcgacgccgagtggttcgacccggcggcgcgcgcgtggcgccgcctcgaccgcgtccgcgcccctccctccgccgcccacgtcgtggtccgcggccgcgtctggtgcatcgagggcgccgccgtgatggagtggctcggctcgcgcggcgggtggcgcgaggtcggcccctcccccccgggcctcaaggccggcaccgcccgcgccgtctgcgtcggcggcggcgagcgcgtcgtcgtcaccggcgccatcgaggactccgacggcgggtccggccgccacgccctctgggtgttcgacgtaaagaccaagaactggaccgtggttcgcccacctccagagttcgccggattcgccttctccgtcgccgccgtccgcatctgatccgatccgatccgccattgacgacgaaccccgccaagatccaagatctcgatctggatccagctgctccgcctcaaggagatctctactacacacaaccaaatactactctactctactagaacagtagtatgtgcacaagaaaagaatcacaaggagaagagaaggagaggaagctagtggtgagtttgtgaagctcctctcctctctctatctctccccaatctgttgttgttgtgaggatgatgatgatgatgagtgtggtgtttttgtccaagaaaaccatggaggaatcaaggggatgatcttggatctcctcctcatcctccatcgttcaaccatggttatggttatgagtagcaataatccaatccattgtacatattatgaccagccgtttgaggtgcagattgcagagtccatcttttgtctcaaaatgaaaccatctcgtcttatgatttcttgagaaatttgaatcagttcttgctgcaagagaaacacaagctgtggccggatttgcgccgggatcttggccggtgtagagtggttgacattggcgtttggatctggaggttgtagttaattggtcgattattggtaattaattagctgtggagcgttgcgtgaggcgatggaagcacgtcgccatcggcgaggaaggaaggaagggagataaggtcggcaccgagtaaacctcacatttgctttgcttgattgcttctcttttcgcccttcttttccttttcgtttttgtttttggttctcacatgggagatgacgagatcctctcgtttatggacttctccctctgtttttagctcccctatgtttcatcgtattgtatgacccgttttgattctttataccatgttgaaacttttaaagtttaaccaagtttcttgaaaattttagtagcattagtttcattaaatctaacacatatgttttgataatacatttgttttgggttagaaatggtattatattttttataaacttaataaaactggtctaggaaaaaaaattcaaaataactataatatgaaacggatatagtatctaagttaaggtttgtgatctcgttttgcaccgtgtttagatcccaattttttcttcaaacttctaactttttccatctcattaaactttcctactcacataaactttcaactttttcgtcacatcgtttcaatttcaaccaaatttctaattttgacgtgaactaaacagccttggggtcgaaaatgctaagctagtcaatgaatttttacatagagggggcctgttttatagggcttctaactttagcccatctacccctctcccgctcactcatattaggagtccttttagtttaggtgataaaatctggataaaattacattcagttgcggtggaaatcaaaatgttttcattgacggacagttttacaactttgacacaatctcatgttttctgcatttccttgtgaaggagtacttaaaaatactacctctgtccaaaaataagtgcagtcatggatatccgtgcccaacgtttgatcgtccgtcttatttgaaaaatttgtgaaaaatttaaaaatatttagtcacacataaagtactattcatgatttatcatctaatagcaataaaaatactaatcataaaatttttctaaataagacgaacggtcaaacgttgaacgtgaatggtataaaactgcatttattttgggatggagggagtaataacatacagtttttgacctaagttacttttttttctatccttgaagcccgtagaacagattttcccttctgatccaaccagatgtccacagatagtgctaatgtgatggagctatgcatttactaacatgaagtaatccatacttctgacggttagggggtcgagaggcagccaacggcccaaccccctctctctctcgttgcttggaaacgcaaggaattgatgaatccaagccattgaaacttgtaaatagccaagtgtcacactccattgccacatcagtgatttccttcattgacaagttcatagagtatcgacgatgatatcgtctgcaccgcgcgatctctttgaactattcaggactatcgcgttcgtagttgacttcctttccaaaggttttgttaagattttcggtggcatgaaaatagttacagtattgtactagtcgggctgtgtttagatccaaattttggatccaaacttcagtcatttttcatcacatcaacatgtcatacacacacaacttttcagtcacatcatctccaatttcaatcaaaatccaaactttgcgctgaactaaacacagcctcggttttgtgagaatttatatcatgagctatgccgccgtggagttcaaattcagtgttttggaatgttctatttcaagaatttagttagtcccaaaacgctcgtctcggatcgagactaaactcaggttgaaacgaaagactaaaactggagtatttgtcaccatcaccccccgttggcttttctttgtataaccatgatccaagcaattttaatttccccttccatgcttggtcccaaagaaaaacaaacctccctaaaatcaaagaaaaaaactaaaaaaaaaggtaaaccttcttgccaagaaaattgggggagaaaaaaaaagaaaaacaaaggataagatcgagagaggcagccatgacggcgtccatactccgctggcggttgatgctgacaagctgaggcacgcagttttgatttgtagcgtccggagaagaagagaagagaagcgacgacttggttgtgaggaatcatgctgagtttgctgacggctgtacgttccagcttaggaagaggagatcgacttgatttgttgaaagctccagcaaacgaacttgtctggatcactttgatcaagaggtgacatggtggatgaacaagctgtgttcgattaatacaaaggttcggaaaatcggaacctttctacagcgcacgaaaaacatgttaacttattattgcaaaactaactaattattagcttaaaaaaatttaaaaacaaattaatattatttctaaagcaactttttatttttttaaaaaaacgtacttgctccgttccaaaatataagagattttaaatagatatgacacatcctagtacaatgaatttgaatagatggtccgcctatttagattcattgtgctaggatgtattatatccatgcaaaacccgagggagtattctttagtaattggggaagtgtgcttgtggaaagcgagagaacaaaagttggaaaaatgcaggtgagaacacaccaagccttgcaaggtagcttagctacttctagttattttatacattttttaaaatgctaaacaatttggttttttcaaaagctttctatatacaagttttaaataaatcaatctatttttaaaattataatagttaatacttaattaactatgtgctaatgatcttactcgttttgcatgcatctgcagtttagccttggcaatatgctcaaacgatcgcagcttaagtttcaccccttgtgtttgtcagctagttagcgttctaaaaaatttggattgctaggttcatgcgtgtggggaggcccaacggcatgttggtttgccacaccgaaaaaaacacgagaaaccagagtcttacttttgaagttaccgaattctggggaagctaaaagttggttaaaacttaaatttcagttggagttgggaaagaagaacatttccatccatcactccatgagaacagcactgaaactgaaaggagttcgtgcccatcaatccgtgcattctcatggtttaatttccattttctgttttctcctcgacagataggcatgggagatgcaaccaacatttaatgaaaactggaaacagcaagcaatcctcatgtatatatatatatatatatatattttaaaaaattctcctttgaataactaaacaatgttatcgatactaactaacggtagctatcaaattatttcagttatttcagcattttcgcagcaggtagcattaatcagattctctgtatgcatttgtgtattatctcggaagtactacatgttgttgcgaaacctaatagaggaagctaggcagatgtgtgtatcaatcattccaattagcttaaaataaaatttattgtacaacctttcaggttcgaaaattgagcttatctcatccgaacttttattatactgcaagttttgtgtacttgtaccattcaaagcagaattattgtgcctgatagacctggacctataggttccaattaaactaaacaagcaatgaaccctcgctcagccccagggcgacatgggcagcaactcgaggctgccccgccgccggcctcctctccctcgcctcctccgcctcactgctacctgagcagccgccggcagagccgggtggcggcaaggacggcggcggcggggcctttctaccccctccaacacccggcgactggggttaatggaatttggtggttcctgtacagcagtacaactagcatgcagtggtgacatatatacaccctgtttagattccaacatttttctacaaactttcaacttttctgtcacatcgaacttacctacacacacaaacttctaacttttccgtcacatcgtttcaattccttcaaacttccaattttaacgtggaactaaacacagccatagtccacatttcctaacaagagtgttgttccaagggcctttgcagaaagctccacataacaaacttcaattgggtaacttggtggatgataggaaaggatgaacatcgatcaccccataaaaatgccacctgatgcatttgtcatattgcttcatgcatttggaaaggctcaacaactttgtcaagtgaaagccttggctgcttggcacctgtttggctcagccatacgaagcacgtgaagccttaacctgaattctagcattactttaaactgggggtggttaatcaaaattcggctaaaagctagagacgtcaagaagcagaagattcctaaatttgtagcatcattaaaaatttagttcccgttaatttgtagcatcattaaaaatttagttcccgttggtctgttgctgccaatatacgtgcagtcaacacacccggcagcgtagatagctcccgggtaggtcaggcgaccgcccggcctccacaagtccacagttgtctatcggcgtataaaagaatcggtagatcatatagaaatatcattagccgctcaggctcgatagcgtcactggctccgcctaggccctagccagtggaggttcccatcggttgcccatttggcccaaaatggcttatttggtttattagaaaattaaaattaatttataagtaaaacttttgtagatttgtttgtagcgacttaaaagccaacattaacaaaaactacgttaaaagcattcaaaatcaacttcaaaatcaagttcaaaaattcaaattttggcttattatttggctgtttaggccaaacgatagggcaaggagtctagtggagttctattgaactccagtggtagaaatcagatacccaaatgcaactctacggtggtgtttgaatcttttgaaaatggatatgaagatgaagataaagattaagtatttcacgcaaaataagatggtaataacatgatattaattgaggtttaattattacaaacttgaaggtccttgttaacatggataacatgatattaacatggtaataacgccccttgttaccctagttgatagaaccggcccatcttgaaggtccaaaccgatgataagtaattgaaatcaacttctggccttgttactgtattacaattaagggagagatttcatttcttacactccacaaattgggcttacatcctggacaaaataatcaatgtggcaacgaaaaagtgtcaaattgttgagcttttgagtacaagctttgtgtatttgtaccattaaaatcagaaatattgtgcctaacatggttaataagatatgatagacgtggattaattacctataggttccaaattaagttaaacaagcagccaaccacccaatctagacttgaattccatgtctataccaggtaaataatcagttggcagctgcccagtgtaatcggttgttaggcaggtaggcttgctacaaagttacaattaagctcattaatttcatatagtagttaatggaatttggtggttcctgcatactagcatgtatagtgacatagtgaacatttcctagcaagagagttgttccaggacctttccagaaagctccacataacaaactttaagtgcataactcgatggatgacaggaaaggatggacaacatcaccccataaaaatgtcacctgatgcatttgtcatatagtaataaaaacaatttggattgcttcatgcatttggaaaggctcaacaacttttgccaagtgaaagcattgatgctatatgtttggctcattagccatacgaagcatatgaagcctaaccttaattctagcattaccaaaattggaatggttaaaagttgggtactaccaaagttcagctaaaagttaagagagtacagaagcaggagattcccaaaattttagcaccattaaaatttttagttccccttggtttgttgatgcattgtgcatgctgtgaacgcttcatgctgccactggggttctagtgaacgattcttccttgtagcagaaatcagatgctggatgcaactctagatgtgcatgggctgggccaagctgttgttggtctctggatgggcccccttgtctcctagttgatagaaccggcccatctcgaaggtccaaaccaacgataagtagttgaaatagacttttggcattgttggttaattaccttactatacccccttcagcttgtaatgtttgacgttgatgatttttggacatatgtttgatcattcatgccttctgttccaaccgatgttatatacgtgcctattttcacttgtcttccattccgaccggttgattcctcaacacgtatgttgcctctccatcactgaaaataattaaggaaatatagttaggtaaccttgctaaacatttaaattacgcactagtttaccattctagtgcgggatgcgaaacagcagccctttgtgttggatggacatcttaaaagaaaatgtaaagtatcgccaagctatttcttgaatggaactgccaggaatttgcgaagcatactagtatccatctgtttcaccattcaagaatgacttagactgaacttggacagcatcggtgtgtaatcactttaatcgtgccatgcagtgtagcgtcgcgcgaactactttatagtacatgtaaacatcaatggaaggttgaatatagaatcaaaattaggaaatgcagaggaagtgaaaacgaagcaagaaaactgccaaaaacccttgtttgctcaaatttaacagaacacgaaaatagttgtcgaagcaacaagacatcacatgagaagtaaggacgctaagctagcaagattaaaacaatcacaatcgagctgctgcataaatatccatgacttcaacttgcattagcattatcagcaatcagatcatttgtagttctaccattgactgatgtcgagatttgagaaaaatagatgttgccatgactaaaaaatcaacagacaacttcagaggatgaagtgttgcattagctataaagccagagagacaactgacctccgatatctgtctgtcttaagatgttgagttagactttgtgcaggcgatttgccagcatgaacagcggcataggcatccgtgagaccaggaagagcatcctcgtggcgatcaatgtacctcgctacgaaatgttcattgccaaaacaaacacaactgtagtaatcaacatcattttttatcaaccccttctccacaagggcttgtagaacataatgccgcggcgccaaccgcttgtccaggctgagcgtgagcatcacaggcctctgcaagatgtattcagtctccaattggaccttagtgagcaagaactctattttgccgcgaagcgtcttctccgagaatcctagaatgctcggcttcctgctgatcgcagagcgtagcttgtccatggagcaaccaagagtgccgcgcaagaactccatcctcgcggcgatggtgccctcgttgttacgggcgacggtgcacacggcgtccttgaacgcccacgatgaagtgggcacgccgagctcctcggcgcgccgcacgacaatcttcagtcgctctgggttgaacgtgagcagccacgcggcggtctgggtcatctggacaatatcacaaacacctagcccgcactccccgagcagcgcgacgttgggcctgaccaccctgtcgacgtcggtggcgaggatcgcgttgcacctcctgaggatcttgaggagcatgtcgaaggagccgaggaaggggacccagaacgcgagcttcggggagacgtcggacgaggcgaggtgcgccgcgccgccggacatgaggaagctgcggatctggggcgcagacaggttggcgcggccgcggagggaggcgatgcggcgggcgatggtgccgggcctcgcgcggagcagccgcggctcggcggcgacgacggcggcgaggtccgcgcgggagagggagagggagtcgaggccggcggcggaggaggagaggagggcgagcacggcgtcggggttggaggaggagttgagacgggagagcttcggggacgccctgcgcgcctgagcggcggtgaggccgcaggtggcgatgaggtagtgctcgacggagaagggggatcttgcggcggtggagagaaggcggtgggtgaggtgcagaggggaggaggaggcggtggaggtggcggcgtggagcagcgggaggaggtggttgcggaggtggagcatgtcgccgcgccggcgacgccgccgccgccgtcgccgcgtgacagcgtcggctaggcacaaggcttttggtggctgtggggtcctgatcctcgacggattgagatcttctacattgcaccgtgtcactgacatgtagatccgatgatttccggtctcatatgtttagtgataaaggcgtggtgcagtcgaccgtagaggatcttaaagtatcgatgccttaacactaccaaggtttaatgaaaatattgaaaaccgcaaaatttcaaggttttgaagcgggacaaaagtagattacaagtgaaatttcgaaaggatttggtgaactaaaatttagagtagtaaaaatcaatcaaaataactcaatttttttgaaaattcggcaaaaattatggtacaatcgaaatccgatactcaatggaaaaagtgaaccaagcacactagtactctgaatcactacaatactattaaattaataattttactagcaaaaatacctgtgcgttgcaacgggaagcatacagaccagaaaattgagaaaaagttaagaaaaaaattacattatgtaattaattaaaatataaatttgctaaaatatttggtatttttaagtaggtaggtgtataattaaatcaatttaaaagtaaagcaagtgtgagaaataaaatgacatggttaaatttttattaaattctccttgattagttacgctctttgaaattttattgaaattatcagagcttaattgctaatttttaataatacaaacatcatttaacaattatttaattggaaaatgaatcaaaatcctcgtttttagtttgggccgaatatagaaaagtttatataacctcccttttttctattcaatctgtctggcctatttcctttctccgttgaagtccattttgtgtcctccattcggtgactcaataggccggtggcccgacgtggcagcaactagagctgtccgatcgaatggacggtccagattaatcctaacctaaataaatacacccaaaccgtaaccctaaccctaggattcattctccccctccccctgcccccaatctcccccgagcgacggcggcggtgacgccaccccctccccccttcccccaagcggctacggcggcgcggagcagcgaccggcgagcggcgccctcccttccggcgggaggggaggcggtgaacaggtgcgccggcgcccttcccttcgccggatccagcgggatggaaggcggcagcggcgccccccctctcccggatccagcgggaggggagctggcggcagcctggcgtccatgcgacggcagcggcggcagcggttcgacgacgacctccgattttatttgtgtgattgaattctgattgggaatttttgttggtaggggtgattgaattccgattgggaatttttttttgggtgggggtgattgaattctgattgggattttatgggggagacgacggacgaaaaattggcgtacggacgaggtgacgaacggaaaaatacaaatgtttatattaatttattgtatcgatggtttaaggtacgtctgaaaagtcatgaaaattttatttatgattaaacttttattatatctaagtaattggatgttgaaaagaaatgctaaagagtaaactatgataaaagcacccaacataatcttgattctacaataaaaaaagaacaaaaaaacagaagtagaatttaactattcatacgtaaaaaaagaaccaaactttaacaattccatcgcaatgcttcagcaaaaagatgacaaatatccaacgtatgtaaaaaaagaacttgttcagtaaattcataatggcatgatccaattaatccattttctaatggaaaattattaaagacatagagacactatctcctcaggattattcctgataacaacatagcttttttttaacaactcgcacgagacggtgcgaagttctattgatatggctggaaaaaaattacaagattacaacctaggaaggtcgtaaccaggaaaaaggaaaaaatataccaccacacccacacaccgacagtgtcaacacacaggttggggagaaggctagcaccagaccagccgccgctaagcatgaccgatcgccgctaggccaacaacggaacacatacaagatcgcccaaaaaacgctcttacaaccaatacaaagcccaactctatccacgtctttcggatttagggagagggtgagagagaagatggaacacctctgccccctaggtcctccgaggtggccaacttgtagaaactacgacgccgccacaagaggatgagaatctagagcgtgattgcaccaattgctcgagtggtttcggcaaggggatgcctaaacgacgtctccaagaagagaagcgacggaaaaccgccaccgctgtccgtcaaggtctcaaaagagcccagactgggctttcgcccggcaaccacccttgaggggtgagacggcatgacaaagccctcaggagggggaatgacactcgggtgccatcgttgtcggtccggccaaggccgggctaggttttcacctgccactcaccacctgcgagtccacgactaacgcaccgatgctccaccaccatctaacctctgctgacatgtgggaccactgcaccggcaccccccgtcagtcagccttcatgcgccgtagaccgtgccacacccaccgacagctcctcctcgcaccatggtcgcctcctccaccgccgaccgtgcctctcgcgccaagccagccttcaccgctgctggccgcgcttcctcgcgccgtgctggcctccgctgccatcagctacgcctctctgcgccgagctggcctccgccccctcctccaaccactgccgtgccagccagatgcgaccgtctaccatgcccccggctagccgtccgagaccatcgtgcttcctcccagcgcaaccacggccacggtcgccacagcaaccatagccacagccgtcaccgccccagtcctccacccccagcgccactagcccaccaccaacagcgccacggccggatctggcgctgggggggggggggggggggaggggaggggggcagatccgggagccccgccatcagatccgtggtcatcgccaccaccaaccctgccgacattgccaccattgccaccccgccgccatgaagaaggccatagcgagcatagcgtcctccaccttcgtagcttcctctggatctggcagccaccgccgcccgccgcctacatccacgcgccagctcgctcgcacgggcgacccacctcgatgccatcttcccaccgccctgccacagcccgctgtcgaccatagcagccgcgcctccatgcctgccgcaaccgccgacgccgcgcccgcaccgccacagcccagatccagcggcggggacatcggatccagctacgggggtgccagatctggcgatggcggcgccggatcagccgccatgcgccggcgtcgcgtggccttcccggctctccgcgccaccccttcacgccgggacggccacgcgcaccggggtttgtagcctcgctgctgccatcccggcaggtcgcacggtttccggcgacacgctctagcggcggcgaggcgggggagaggaagggagggtggctgcggccgggggctagggttcaaccccggtcggccactaacaacattacttggagccgaaaagaacttgtgaatagcacccttttacgattcaataaattgaacttctcgttattgttttcctttttttttcttagcacctaacaaatgcttcttatagtatgcaacattaattctaaaatctaacatttgaagctatgaaagataaggaatatacaaacaaaactaaaagaatcctaatctgctaactaaagaagtaatggagtaatgtaccacgagatcttaaatcagaatcaacggaagaggagtgagtcaacccgcccctgcttgcctgtgcagtgacggtgggagcgtggagagatgctgcaaggtggccacgagtccgctacaccgtcggtggcagtaccatagtgttacgagtaagacctctgttcgccgctagtctgaagataaggagtagtcttcgccgctagacggagaagagtgctacggcgaacagcaacagtagatacaacttattattacctatgttataaaatataacgatataacgactacgaatcttatcctaatcgctcaatactaccacaacactctctgtataacactctgctatgatgacgagaataatggcgatagtaaaggactaccatgcctcttctctccttattgaactaagatcgtctattttcgaagtcacctaacttcaaacctagagtatcctgatccccacttaaatatgacgcttgttgtattatgtttttacggacgtcagatcaacttttgtcaatgtttaaattatttcctttattttttgttttggattaatgttgcagcaccttataataatataataaatgttccagactgatttggttgttgcagtatgtgtttctagctgttgttgtactgttcttatcaagaaatattgcttcctcgctttcttcttttcttttgagttaattggacttataactacgagtttatccttgaacaagatccatattcctattttcttacggtaaaaatttctttaaaacaaatttgatcatcgaaaatgatatgcagacgtactattgaactctaatgataagctggattgttgtacaaaatgcgttacacaacacacatgataaattgataattgataattgtttaattatcatcagatatatgttggcaacgtcaatgtgataactgtatgtgttcacttttctgaagccaagtggagtaatgcatgcaccttcaacagttcaaccaaatataagcccgggacattaaaaaaatgtgtagtaagaagatgtaagacctttgctaaggatttaaatcacacaacttcacatttctaatgcagtttgttgtttgcgaaataccagctctctactgttggacggacatctgaaaaaaaaagaaaagatagtcaagtacatcagcgttacagtatcacccagctatttctgcaatggaattgccaagcatagagtgatctcatggtggactgatgctaacactaacacatgggaatttcataatttggatcgtacttcattattgtggagacagtgcagatttgaaattgaaatgtactgcctctattttttaaatagatgataccgttgactttaaatatgacgtttgactatttatcttattttaaaataaataaataaatttaatttattttgttgtgatatgctttattatcaaagaaatttaattcaagtatgagttatactttagcatatttacactaaatttttaaataagataaatgatcaaatattgattaaaaatcaatggtgtcatctatttaaaaaatggagatagtatgtaccctgaaatagaaaatgtcggcaaattccaacccaacggaaggagtgaagatactaaacaggcccttagaaataaaattttgtaaggtctattaataaactattgatttaaaaaggtctaaaaaattaaaaaagtgatgcatatttgtttggtttgtgctttattcgatcagacaatagtatagtgtaaatagtttatgtatgttctaatttgtatcgtttcagcaccacaactagacaatatacctgccagtacatcctaatattatgataaaggaatatgtttacctacacttcacatgctttctatgtgaccgcgtcatcgcgtatcacaaagttaggctatctcattgcaagaaaaatcaagagcgccaaatgaacttaccacgcgatggttgtccgggctgtagtgcagtttgtgaaacagcaccctgcagccccatgatgatagatgcctggacagagatctgaacaaatgccaattatccccgagttatttcaagaatggaattgccaaagtattgccagcaaatagtgatctctgagaactgacatgcacagtaccggaacccatgggaatttgccaaattccaattagtactggcaaggataacacatgggaatttggatcgtacgtcatggcttcactcttcatttattgttgtggagagaatgcagatttgaattcgaactcatgcaccctgcctgaattaggaagtgtcagaaaattcaaaaccaatggaaggggttatttatctcactatctgtagatccgaaacttttcattcaggattaagtttataaaaatagtgatatcttctaccccctccattccaaaaagaatccaatcctagcaacgaacctggacacgcaggttcgctgctaggattggattctttctagaacggagtagtaaatccttatgcatgaacattccctgcattttggttgggttacgccaccttttaataagagctgttccatcaaatacaactatacaagtgggtagtggggtgcttatagtcgtagatatgaatagacaattagcagtgcattgcctgaactcagaagaaaggaagagtccctttttgagtttaacatgagcgcctcgtaccaggagttctccgttccccgcgacccagttctccaacatcgccgcttcatcttctcctgaagacgttgttgctgccacgacaccatccctcacctggcagaggagagagggtgtggcgagccctcggtgagtgggcgatggcgcactggtgccctgacattcacaaacattcataggattagagaacttaaaactctatttaattatttgactgaaccatttatgagaatatgagctttgcatcccctggggaaaaaaatgattttgttccccaatgaaatttcatccagaggaaaaagatgattcatatgctgccaactgcaacggtagcagcagtctgccgtcctggagacatggacgaacaagagatgtgattctgtttacgggttttaaacagcgggtcagcggcagttcagttgtgatgagttgttaattactcagtgattcttgtcgtgcctgtaaaaagtaaaggagtcattcctagcgtttgcttattcattgaaaatacacagttacttgatttgtgccttatacggacagtagtaatttgcatcacagcacctcaactacacaatgtactggttagtgcatccttatattatggtaaaagaacctactccctccatcccaaaatataagcatttttagcatagtgacaagtcaaacattttcaattttgaccattaatagcaaaaaaatacaaaaaagatcaatcatgtataattgatgttactagatttattattaaaacaatcataatatgcaactctttttatttaaagcatcttacttttatagatattgttggtcaaagtagcatatcggagaccgtgtcaggataaaaaatgcttatattttgggacgggagtatatttcatatgctttgtatgtaaccgcacacaacaaaattaggctttcatctactcaaataggcccagaaaatctaatggctcatttgttcagtaacaggaacaagagtccgtaacaccataatgatgcacctctagtgttagcatgccaagttgtactccctccgttttttaatatataacgccgttgatattttaagatatatttgactattcgtctttttcaaaaaaattatataactattatttattttgttgtgactcgatttatcatcaaatgttctttaagcatgacttaaaactttttatatttacacaaaaattttaaataagacaaatgatcaaaacatttgtcaaaaagtggacggcgtcatacattgaaaaacagaggtaataatatttatggagtactaaattagcaaccgaacaactcatcgtgcccttgcaggagcatttcgatcattagacacccccaagaaaaataaagagtgtcaaatgacaaacttaccagaccacaggttgtccaggctgtagcttcttagggtaggcagctattccaactttatcatacctgtgtctgacaggaccagaacaataaaatcttaatggaataagtagagattttcaaaacaaaattaattgtactagtagttgttagacctggatcattaatattgtaacacatgcataattataaatcaatgtttattatttcaggaatttatatttttaaacttaataagtccattaaacattcgttagagtctctatgtaagcattaatgcagaaattagcaattaatgatttctttgtcataattgaacccatccaaaaaaacgatgaatcttcggtgaatatgttcagcgataccctcaaagttttttatccaacacacacacatactagtaaggcctaactttttgtatgactgatccaaaatataactattgcagatgtaaatctatcgtaacttacatgaaccacgctatactttcatcaggtttggaaacttcgataagcttccaacggatgcactcaatcttttgccagttttctccattaggtgcctggcagcttcttttcaagcactcgcagtcttgtatttcaatttgctggatagaattagggaaatctggtagagatgataagttggggatcctgacaaatttgatcctctccagactggacaggttcttcaaactgcttggcaggtacatgactttagaatccctgaactctagaaacttgatagatgtgaaatttgcagagctttgaaatgtaatggatggctcgtcgtattgttcaaaacagagtttctctgggagcatgaaatcctttatagagagcatgagactgagcatagcagagctactaatagcgagtgatttccatgcatgatgccgggaaaaagactctgcggtaagatttggaacatttatcagatgtatgtcctggagatgtggacatgataagccttcaagaaagcacaagtctggcatgttattcagtgagagtgattccagggaacgcagatgaccaatagcaaatgatgaagagcttcggcagcatgtgatggaaatgctacgcagacgtgggaagtcagtactgaggaaattggcccctagtatgcagccaaatagagagagctttccaatagaggatggcataacagctattccattttcatccaccaactctaatgagatgcatgaatctatcttaacttctgaaagggaggttgcctctcgtaagccacccaatgatctgaggcaccagcaagaacggatatataatcttttaagcatcgtcaagcgctgcagcacctgcggtgatgggaacgaagttaagttcataattcgctctatagacaaccatttcagcgaggtgagtccttgaaggcaaacagctaaagctccatctgtgaggttgcatgaagaaagagagagattctcaatcgatgatgggagaagcaacagattctcagtgggtcttgaatagataagtttcgtcctcttctcttggcagtacaaccatgcttttatgatattttcttccaacaatacttcctctctttcactttctatagcactttttatggtttggagttgtgcggatatatcatcatccatcaatgccatcaactgcttcagagatgaatgttcgaacaccaacgtgtccctgacctttttactaatctttgatcctctctttgcctccaggatccttgcaagggtggatgacaaattgcccactttcatcaaatctgtatgttgtacatcctgtccaagttcttccctagaaataaatctaagcaacgggcaacccatcatatttaaggatacaaggcctcctggaaagcatggtaatgtcttcagattcaggatgttgcggagggctatatgacggaaatgcttgatgagctgtacactggatggtaaacattccagggaagtgcaattactaagcacaagggtctttaaattaacaaaataagaatcttcgagcaaccagcttggatatactggagatctgtagcctgtaactataaggtcattaagttcacgaggtggcttgagaccctctagaacctccaaatgcaaattgtcatttatatgcaagtcatctatgtaactccaggaaagttccaaacgatcaagccgacttttattatgcagcatcgcctccaaagcctcatccttcgttctgacattttcgagatagttaatttgtaaaatgtttctaagctctctcatgtcccttaactgctgtagttcataacctatctgttttgccacagagaattccaaaacatgttggagtttcgtcaacttacctatataaggaatttgaggcacaggtagttgtgcaattggtccaaatgaaagactaggagagcatctttcaagatgccgcaatttacttaagttgcagatcttcgcaggcagattgttaacatcacgatgtacccgaaggaactgtaaatggtaaagagtacacaatgatccaggtaattcagaaattgaagttttgaggatgttcaaatacctcaggtgcttgaactcatcaatagactgaggcaacttcctgctattgtaaaagcacaaaagcaatactcgcaatttcttcatgttacagaatacctcatgaaatagtttatttgcatcatccattactggttccatgaagataacagtacgcaaatgaatcaacttgcagatgctttgtttatgctgtcccattctatcaacgtaaacagacaaatgttgaacagtgtgcggaatttctgtcaccatacagtcttctaatctgaaacagtctcctctggaaagtgtttccgcaaagtcatgaataatatcatgcatactatatgatgtatcaaagcttttaggaactggctgaaagaaacatgcagataccatctcacggaagtacgccctggcaatatcttctactgtcctactctgatcggatgaattgacatcagatgaatcaacaacaaacccctctgctacccagaggtgaaccaactcattaattacaaacacatgaccttttggaaataagctgcaatacataaagcacctctgtatgttaggatctagattctgataactccacagtagagatcccctggtctcacctaagttatcactcttcagagcatctttccatgcagtgatagtcatgttcctgctcaactgagaaccaacaacttttgctgccagaggagattgtccaagcttttgagctattctccctgcaatatctaatagctcctcgcttctgtgctgctctctcattcctgctccagaaaatgcatggtatttgaagagtgccaggaactcagtgtccttcatgttctgcaaaggaaaaacttgtttacaacaaaggggagctgggagtctccctgatctagaagtaaccaaaacttggcttccccgttgctgagaaactagaggagctagcagttttgcccattcctcctcgtcctggaaaccataaaaccaaacatcatccaacacaagtaggaacctctgtgactcttgtaagacgcctctcagcgcgcactggagattgttaaggttagtaaaatgcacaactcgattattgtttgtggcagactccatgatctcggctgtatggcgatgcacgtcgagtttacgagaaatacagatccacatccttacatcaaaatgattcaccacacgctcatcattgtagatatactgtgccagcgtggttttccctgcacctccatgtccaacgatggccgaagtacagtagtttctctcaccactagtgttagtgtcatctgggttgcagagaaaacttataatatggtcacgatctgcgtcacgaccaaatacttttgaagtgggaagcgatgtggtgatggtactgctgctgctgttgacatgaggccctgtgatggctgctgcagtagtccctgctgaaaggaactcccgatggaagttcttggcttccaccaggatgttcttcagttctgtcaacttacggagtagtcttctgttggcagggagcaaattggacgcggtagacaccaaagcaaggcgagagttggaggttgagggcatagaaatgtttccagttgctttgcgctggaggagtttgtactcatgcatgtcgagcaggtcctcggcatcatagaaggctgctttgagcttccaaagccagcgctctaactccatccggcgggggctcctctctgccgctttgatcacgaacctgaactgtggtatgacggtggtctcaagatcgtccagctcctgtgccatgtccttgccaaggtatgttttagcatcgttgatgatcttccgcatgattggcgacacgacccaccctgagcccgccaacaccaccacttctgccattgtactgcaagtctgcaacttcacaactcagtcaactctcccttgccctgtgtctgccagcttgtgacccatctgtgtttcagtgatttgttttgtcacaggtttaactagacaaatatgatggcatgagaagttgagtactgattgagtggttcgttccaacttccaaatccggtgtgctgatactggtttcaaaaaaaatctagtggcagcacccagcaattgagcgaaactgcaaaacctagcgatcaagttagattccaaagccaaatttctgatgtgtgcacataaagataagttatcattgcagtcagactagcctgatgtattgttttctaaagaattggtacatgtctgcaaattaatactccctccgtccaaatgtaagtgcagttgtgggtttctgtgtccaacgtttgaccgtccgtcttatttgaaattttttaatgattagtatttatattgttattagatgataaaacatgaatagtactttatgcataactttttttttatttttttcataaatttttcaaataagacggatggtcaaagtaacgttggacacagaaacccacaactgcacttaaatggggcagagggagtagagtatatcattggagaccgatgaccaaatgtacatggttatagtacagttgcagcctaccgtgaatgcaacttcaattaaaacacatcaacatgagggtataaaagtgttatcagcagttttagtaaaatgcagcctcaattaaaaaatatcaatatgggagtacaaaaaagtgcttcatatgctaactgttgctttcctgtaaatgcaattatacagcagttttagtacacttacagcttacctgtaaatgcaacctcaattaaaaacatcagcatggtgatataaaactgccagatgtgactataagtgatatcaggagcccggttgatacccttttaacaaaataaaagaaacacacagataatatttttgctatttatctattgcctagtttattttccttgtttatcagtcacctaaacttgcacaatcgatggacctacaagcaactcttcttcaacttgtattttaatatgtggagatttatatctacacaagggcatataggtgtgttcttttaaacttctctacactaaagaaattgtttgtattgtatatgtggggatttactgaggtacaattcctttattgtgagaacagtgtttattcatcccaagaaaaagaaacatacgagttgtgggatgttgatataatagttggtaaaagagctggtagataaaaaaaacagaaagtcagttgatgaaatataaatgcaattccaagagaaataaagtgagcctccctgcgggcatgacgcacccgggtagctgagcggcaaggagaagcattgtccaatggaggatgcaccaaataaatacttgtacacttcaagtacaatacgaaatttcttcaaatggctggaaaagaaaatatctgtatcaacacaaagcaagaatatgccaatttcaaattctcaaatgggtgacgaagttgtaaacttcgccttttaactctctctggtaaaattcaatgtacggagagtcaagagagacacagataaatcatactcaatcaataatattgtaagaacacattgtagaagctatatagaagctgagcttctgcaactacataagaacagacatggaaagcgaactacggcatttcgtcgaacacgtcacacgcagaacccaatccatcagcaaagacgctgagcaagacgtacctgtaccaatgaatcccaagggagatcctccccgttgagtgcggaaccgacatcccgagtcgccgtggggattcagcgacgtgatgtgacctcatcccgataagagaccctctgccccagcgccggcgaccgaccatggcggcctcggtcggcggggctcgtggtggtgtgcgacccgcgccaagaaggagggcacttcggcaatcgtcaccaccgccgccgccgcctgcactcccatcccggaagcgatggtcgtcggcggcggcggcggcacttgccgtcgagtttgctccgcccagccttggaggcttcgacacgttgacatggagaatgggccgggcccttgttggatagggcctggcccatcttgaaggcccacaggaaggcgatttttcatcaaatttaaatgttgttcgtgctgtccaagctcaagctgttgagctcttcgctggaaacaaacgtaagcaatgggaaaccctctatttcatcaaattcacaatcaccagttcaatcacgctaactgtaagacataattcttatcagaataataacttgtgaattagtggtcttaatactccctccgtccatattataagggattttgggtggatataacacagagtctgtccagattcgtgctactagaatgtgccacatccactcaaaatcccttataatataggacagagagattactttaagagcaaatatagaagaataaaatacgatgggaaaatcacgaaatgaatttttgaaatttaaattttggctgcgcctttacaagttgaagggtaaactgtggtagtatgagattgttaacgtctcggtgtacagctacaggtaacatgtacagcttcaggtaatacactcattcataggaactgtaaatggatccaacagcaccaggtaattcagaaaatttgaagctttgaggatgctcaaataccgtatgcacttcaactcagtaatagttttgacgcaactcagtacagttgtaatagcacaaaaatcaaaactcgcagtttcttcagattaccgagtagcacctcatgaattgaaacatatgacggtgcgcaaaagaatcagcttgcagatgcagagatgctttgttatagaacagcataaacaaacactgaacagtaagttcggtaaaaaaaaaaaaactaaacagtaagatgaagccctaaaggacaaaaccaaatctttaggtatgattttttttagttttcaacgcttagctcgttttcaccttgtttaagaaactaggaagaaagcccgcgcagttgcgcgggcaatttatttattgtttaaaaaaacctaaaaaaacattatatcaccatattcactataagaaataaaccataaattttgacatactaaattataataatgtccatcatatccaaacaaaaatctttttgccctcatctatcatcactacttattatcgttgtcttgaaatatagatattttttaatagttagaactgcatctctatccacaaataaacccaatacataattaataccatataaaattcatatgtacttcatatgcaagtactcataccttacaggtatccgaatctatatgtaaatatttaaaaataccacatctactaattaattaatatgataaaaacattaacttatatatgaatgtccctttaataaccggtgaagccgactatagccgctaagccttttttctccaatgccttgattcatgtgtgccttattgatatagttgtgctcctcacgacaaccttggagcacaattttataaaggattgcatcggtaactaggctagttgagctctattatcaatggtgacctcttactcggaccacttctgctcaataatgcgtacttttgccgtagttactacaatgtagccagttgaggtccatgcttggcgccctttagggtatgagtaagagaaaatgcaggtgatgaaaatattttttaaatgttttgaatcgatttattttatagagtatacataatttatttatggtgttaatcgatactactaaattttagtggtacatatataattttctcttttaaagattagcagagttgatcattggactctactttgaaaaatccaataggttcagtggtgaggaccactaaaaaaatatttggtcaaattgtgatcttttgctaacatacaagttaatataggttttgattttttttcttctattatacatctaatttacctatgcatattcatgggactaacatttgatgaaatttgttaaaattatttgtgctaattgttaacactatttggtagagaacgacataaaaagagatataatgtagttacatctatgtttttttttctagtgaacagtagtctctcgtgtggatgtttattttttcttttttttttctttttggatgattatttgtcaatcataagaataggatgtacatttttctattcatagtgtgcatctgcatggatttatatgagcttatgtgatcgccttttaaattgttagtaaataatactttaaaaaatttgacaggaagagggtggagcaacgggtggcatgaggtggtgtcatggtgtggcttattttaccaccttgctaggagtggtcactacatctatgctcaatttagaaaataaaccttatagtcagaacaaatgagaaaactaccatataggacagtcatatacgcactcttcttttttttattatttttatatatctagcgtatgtatgtacataggagttgtgtatgtacgtaaggagagattagacggtttttagatagagagattattgtcatagatctaatttaatggttgaaaataatggaatcgctaattttgaggtgtaaatcgatgaatagttgtttttcttttattttatagtttttcctagatactctctaattagagcgtcacataacatcttagaagcgtttgtaggagtatagaaatgctattacccatagtcacaatctacttgtagtcaactattgtttgtggtggattatgcaacctctacttgcctatcatttgttgatcgttgcacacttagtattgtcctttatcttcggtgcttgacgacatacatgctcattagatatcagttaaccgttagccgttaggtgcattgtgtatgaatatcttgtaagtgatatgacttagcgattagtaaagagtgacctgtatataaaacttacatatatggggatcagtgatgacatgcaattgatattttaggctaggatattgaccaattatattgcgtactacatattaagtttttaatacctaagtaataaatttaaggcagtgttgtaaagtgcttataggattaactactccctatttatagcgagtacgtttgtcaaactactatacggtgtattacacagtacgtgttttacaaactttttatataaaagttttttaataaatcgaatagattcatttgtattttttaatatttaatacccaattaatcctatgctaatgacatgtatcatcttgcacgtcctggataagcacagctaatgagctaaatcgatttaaacctaagtaggagataaaagacatcgacacgatttgaaaagaatatatttgatccttaatttctaatgatatataaataaagataactcacaatacgtgaaaatacattcatgataattttagtaatattattttgatatatcaattatttttatagtagggagtgagtaattttgggaaagagtaattttgggaaatgttactcacaactgaagttgttttatttttaaaaatgtaagtctaatttcactatacaacatacaattatataatgcatattattcatttatttagatttttatggatgttttgatgatgtgcgtattgtagaatttaactcaaaatagcatatattttgacaactattagttgaaattattaatttggtttttatctcatgagagagaaaaagaaaaaaaaataagggaagggggtggccacgtatgaggtatgtacgtacgtgcacgtacaggttcgggagggattgttatggacgtgcagctttttaaagataaatctatttggtattttagatttaacggttaaaaatatggacctaccagattaaatgaaaatcaatggctagatgttttttcaaaactttctaatttattaaagtgccacttggcggcttaagagcgtttgtagagatgccatgtggcggtttaggagtgtttgtaggaagtttaatagacttttagtatataaagatagatagatagataataaataatagatagatagatagatagaagatagatagatagatagatagatatctcagaccataccatccacatctatctgcagcttatcaaaactggacagcctgcattctactgtagcttatgaaccactcacacatcctcaacttctcttacaaaattgctcgtgtacagagtgaactgttatatatatgcttcttcgtggattcggttcacatataccagacatcagctgcaagattaggcctcaatttccgatcactgtttgtacatgataaccccaacagcagtaacttcatggcatcgcctggtgtccagctctcaggggggcatccttggatcaacgattttcagctttcttctatactgcacttggttatctttactccggtgagccctcttatgtgaacccaagtgccattttagtttatttataatgaaaaattagcaagtgctaaaagagtgtgtattttgactaacatgaagatgagaaaacgattgaatctgcttgctttaaataggcttataaatactgactgaattgctaacaaattgataaccgaaagatctaacaaatcctatcttcctatatagttggtacccactaaaaagcatttactcctataaagcaagacatgcaagaagccacatcatcgataattttaagcctttggatcgcattagtatgagaggtatcagccatgcattggatcaagaagctggctactcatccattcacttccctttagctcataatcactcgtgacattgttatccattatgtacatccaaatcctcaaagataatactaatctttttttcaatacaacttccattattacataagatgtgagctttcttttgttataaacaattggataacatacaataattaggtatcatgaatccaaaccaatttttgaaacatacttgagatgaagcagagaagtgctacactacctaattgtgacagtatccagattgtacatgaaaataactttcatatatcataacaatacataatgacgtttcaaaaaataaaacataaattgtatcgtaataacagaagctatatatgaagccgcattatcatctattttatatatacaaagaagtgcatctaatcatttaaaacatttattttattctgtgattaaactagcaaatcccgcgggcaggcgcggggtgccaactagtcctatctaaatcgcaagccggtaagtactgtagctgtccgacacgccgtcttacgctccctcccgcacaactcctgccattgtaaccgcgtcctaagcactcggcgtgctgtgtctggacctgtgcgcccctgcgacgatacgtaattccgatcatgacattgttggtatgcagtacctaggatcaaccttgttgacggcgggctgagaccaaactcaaggatagttggagtctagcacgatcaacaatgtcgagtgataaggttggaatgcgagtgtacccggtggacggacatggttcggagagaacattgtaatttggcggcatgtcaaaacgcaaggaggaaatgaaggaaagatagccccatgtattagtaacgtgctgatgcattttgccgtctcgcctgtgtcgagtaccacctctataacatgttggccctgtttacacccaaatttagcacctaggattagaataggaaagattgccaaaatttggaaatctaccggtttcctccgagtgggccggtctgaccgccatgtgttgggaggtcagaccgccggttgtaggccggtcagaccggtggtgtgtggccggtctgaccggcgggtccgagtccaaccctgtttcgtcgggtctcgaagtttccttgctcgggaatgcatgtttcgggtttcctttggattctaccccgagttggatgtggaggagggcctgtataaggcaagaccaacccctatataagggacaggccggttcattgtaagaaaaaaaatctactatcaatcaatcgaatcgttcttttcatattgcttttagttttctcttagtttgtccatctttgtcggtttgcgctgtaaaccgtccgccgccgctgcgagagtgcgacacctctttgtaggtttgtcctgaaaaccttccgtttgcccacgagacgggtagttatctagaaatcagctccgctagccggtttagttatcaaaacccatctagatttagctttttgctagatcgaggtggttggcgactctaggatcaccgcaaggcttaaggtgctacgatcgtgcttgtcaacttgtcaaaaaagttgccaacacaatttttggcgactccgctggggaagagatccgttcatcgtcaactcgacttcgacttcgccatgacgaagccatcatccaagacggaggtggagccatctcatgtgataccggtcacattggatgactttgaaggagaggatcgcaaagccatggaggagtacatcaacgagctcacacgggaggcgttgatgagagcaactactaggactcgtcaaggcgtgatcatcaagcccgggccacgtcccaagctcgctcccgacgtggtaagtaatgacgaggtatcgcaatctatcaaccaacaaattgcatctacaatagattcatctatggctaattttaaagatagattagatgtgatgtttaaggaaaaagttgatgggtttttaaggagtaggctaggttcttttatggatgattacactttaaaagataaagcctataccactgctgatcaacctcctatagatctgatggggtctaaaaccgacggagcggcgttcgtgaccagtccgaccgggcctaacggccggtcagaccgtgacacagccgtcggtcagaccggccagatggccggtcagaccgggtattatcccgtcggaccgactggccagatggccggtcagaccgggtattaatccaccggtcagattggctctcaggccggtccgaccgcgcagcttgacgccggtcagaccgggccctgggccggtcagaccggtgcaattgtgccgatacagggaatcgatccaatgactaatgctagttatttgtatcactttagaacatttgattcccctgtatctactgccaccactagtcctcaaattcccccacatattcctaatatttacaatgatgtctctaggggatatcctcccgatactaggccaggccaatataatcatattgcgccacaaaaccaacctattaggccaccaaacccaccaccaaatccgcaagggcctaataacatggagaacatgattagtgatattatgaggactaaattcgggatcgagactaggaatcgtgctagagcttataaaaaaccatatccggattattatgataatgtgccgtttcctagaaattatagagttcccgaatttaccaagtttagtggtgaggatggtaagaccacatgggagcatgtaggtcaatttttagcgcaatgtggtgaggctaatagtgatacttttaaattgcgcttattttctttatctttatccggtaatgcttttacatggtttacttctttaccggcaaattctattcatacttgggctcaattagaagaacaatttcatgattatttctatactggagagactgaacttaggttatgtgatttaacatcggttaagcaaaagtataatgaatctgttgttgattatattaagaggttcagagatgttagaaaccgatgttatactttggatataactgatagagatttggccgggcttgcttttaatggtttagttgctcctcttagagagaaactagatggccaacaatttcttgatgttagtcaacttatgcaaagggctctggctcaggaaagccgggttaaggataataaaaaaattgctagaccattcgataaaaagcctaatgttaatgtagttgattactctgatgctagtgatagtgaagaggagggtgatcatgatatttatgttgccgaatggtcatggactaacaagaataaaccttttgtttgttctaatttaatgccgactcatcgtaaagatcggcaaagtgaggttaagtatagttttgatgtggccaagtgtgataagatttttgattatcttttacaagagaaataaattagattacctaaaggccatgtcataccatcacaagaggagttaaaacatcgagcatattgtaagtggcatgattctcattctcactctaccaatgattgcaatgtgtttcgacgacaggttcaatcggccatagatgaaggacgattgaaattcaccgatggctccaagatgaagcttgatcatgatccttttccggtgaatacaattaatttcaatgataagaaggtgttgattcggccggagcaagccgaatctactaagggaaaggaagtggtcattggtgagccaaggcttaagatgatggtgccaaagaagccggaggttggtgtttggaaggagaacaagggtgaagcttcaacttctaaggctcataggaagaccaaagtaaccttcgatatgctcttggagaagtatgagaagcaaggtggtgagagggatcacaacaaagggaaaagaccaagatcaccccctagggagcggtttggtcactcaccaagacgatcgcgttcacctccatattttcatccacaagacatgtcatggggttcttatccaatgccgccaccgagttatccttatccttacttcatgccatggggggcaatgccgccaatgtacaatcatatgcctccaatgcaattcaacaaagggtggggaggaccacggaggccaattcatgagcgcttatcttcaccaaacaaaagccgattttatggtaaaaatcgggttaatgaagaaaagagggaatgaacgcgcaccaaggtggaggaaaggacttcggaagtgattaccatcaagatagggtcccatgatgtgcctataccttctggagatggagttggaaagttcccaagcgagaaatccgaagccggtaccagctcctcgcagtcggccggtctgaccaggccttccggccagtctgaccgcggtcatgtagccggtctgactgggccatcaggccggtctgaccgccgatctgacgacggtctgaccgacgcctcaggccggtctgaccgcacgccacacgtcggtctgaccggcgcgtctggccggtctgaccggtggtctacagccggtctgactgggctccagcgtcggtttgatgagagggctgcaaagggcgatgtgagggcttcatcgtctccaaacaaggttaatagagggcattatttgcctcctggaacagagccgaatcctaggtggatgcctaaggatttgacggctacgcaaaagagaaggttgcaacgtcttcgggcccaagaattaagagagaaaaaggccgaagaacagagggataagaggttcaatgagttgcgaccaccaccggtatggaggcctaagtccatagagaaggcaaaaccgattgatgtagaggagaaggaaggacaatcggttgatgaaggtaaatcgtctccaaaggaggacatggatatcaacatggtgtgtatgttgcctatggagttttgtgctatggatgaagccgaggttgcccaattctcattaggtcctaaagacgcggtttttgaggaacccgatgaatcaaaccgtcacatgaagcctctctatctcaaaggccatgttgatgggaagccggtctctaggatgctagtggatggaggtgccgccgtgaacttgatgctgtattcgctattcaagaagttggagcgtgaggatgatgagttgaagaagaccaacatgattctcaatggcttcaacagtgaaccaacggaggcgaggggtatctttttggcggagctcaccgtgggaaacatgacgctaccaaccgctttcttcatcgtcgatgtgcaaggtaactacaatgttattttgggtcgttgttagattcatgcaaattgttgtgtgccttctaccttgcatcaatgtttaatctaatgggacggcgatgatgttgaaattgttgaagcggatatatcagccgaggttgcaatggccgatgctacttttgagtggcgtcatgggaatatccaatgcttatcggggagggatctttctagctatgattttattagtatctccgatggcaaatttgtacctatttctgtaaagccggctagtgtagcacggctaagccatgtaaatttatataatgagtaaagaggctagtttagagtggttacaaaagagggtgcaagaatatcggtctacaaagaacgatattggtgaaaccgttgaagattttgatgaagtggagaagcttggacaagggtttacatcggctgatccattggaggaagtagacataggtgatggaactaaaccaaggccgacttttataaacaaaaacatgaaagccgattataaggttaagataatcgagctacttaaggagtatgttgattgctttgcatgggagtaccatgagatgccgggtcttagccgtgagcttgttgagcatcggcttccaattaaaccgggttttaggccttataagcaaccaccttgtcgttttaatcctttattatatgaccgagtcaaagaggagattgatcggtctattgaaggcggggtttattaggccatgtcgttatgcggagtgggtttctagcatagtcccggtggag

SEQ ID NO: 2986 - DNA, 2222 bp, Oryza sativa
ccttggaagatttattttgatggttcttcttgcaaagagggtcaaggcataggggtagttttgatttcacctaatggcatgtgttatgaggcatcggttcgtttggaatattattgcacaaataatcaagccgaatacaatgctttattgttcggcttacaagtgatggagatggttggagctaaatatgtggaggcctttggtgattcggaattggtggtgcaacaagttgccgggatctacaagtgcttggatggatcactaaataggtacctcgattcatgtttagatattattgccaattttgataattttgctattagacatattgctaggtgtgataattctagagcaaatgacttggcacaacaagcatctggctataatgtgaaaaatggattatttctaatattagaagaaccggtgcttgattttaaatttttgtgcgaaattggcaaaactggagaccagaggcggtctgaccggcgttgcacggccggtctgaccggtgaccaagggcggtctgaccggccgaatgccgccggtctgaccggcgaccacgagcggtctgaccggccctgtgtggccggtctgactggttctgggcagaatgctggggggtacacttcaatcgatttagaggccgagttaattgaaaattcggacatttgtgcccaggatacagaagaggattggagaattcctttgattcaatatctaaaagatcccacacttaaggttgatcaaaaaattcggcggcaagcattcaaatatacattgcttgatggagatttgtatcgccgaaacatagatggtgtcttgttgaagtgcttagatgaagatcaatctaaagtggctatgggggaggtgcatgaaggaatttgtgaaactcatcaatcggcccacaagatgaattggttacttagaagagcggggttctattggccgaagatgattgatgattgcttcaaatattatagaggatgcgaggcttgtcaacggttcggcaatgttcaattggcgcccgccgccgtgttgaaccctataatcaaaccatggccgttccgaggatgggctttggatttcattggtcaaatttatccttcatcatcaaaggggcatagattcgtgctagttgctatggataacttcaccaagtgggccgaagccgtgcctttgaagaatatgactcatacggaggtaattgactttattttgaagcatattattcatagattcggtattccgcaaacattgactacagaccaaggtgcttcttttatgtctaaggaagtgaagagttttaccgaatcttatggtattaaattgttgagttcttctccttactacgctcaggctaatggtcaagccgagtcgagtaataagacattgctaaagctagtgaagaagaagattgaggaacacccgaagaggtggcatgaggtgctttccgaagcattgtgggcgcatagaatatctaaacatggtgccactaaagtcactccttgtgagttggtttatggtcaagaagccgttttaccggtggaggtaaatcttggttctcttcgttatatcaagcaagatgatttgtcaactgaagattacaagacgttgatgggagacaatcttgatgaagtcatcgacaagcgcttaaaggcattggaagagatagagaaagagaataagagggtggccaaggcgtacaacaagagggtgaaagcaaaattgtttcaagttggagacttggtttggaagacaattttacctttgggtactcgatccaaggagttcggtaagtgatctcctagttgggaaggtccttatcgaatatgcggcattgttcgagggaacgcatattttttggagacacttcaaggggagcgttttcagcgagcaatcaacgggaaataattgaagaaatacttcccgagcgtttggcaagatgcttaggaggtactatggccggtaattggattatcgtcctaagatcaaaaacatgctctatgcttttagattcacgttgttcatcaaaaaggcaggggggcatgtgtttgcacccaaatttggtatctaggattagaataggaaagattgccaaaatttggaaatctaccggtttcctccgagtgggccggtctgaccgccatgtgtggggaggtcagacccgccgttgtaagccggtcagacccgtggtgtgtggccggtctgaacggcgggtccga

SEQ ID NO: 2987 - DNA, 19118 bp, Oryza sativa
tctactatcaatcaatcgaatcgttcttttcatattgcttttagttttctcttagtttgtccatctttgtcggtttgcaccgtaaaccgtccgccgctgctgcgagagtgcgacacctctttgtaggtttgtcctgaaaaccttccgtttgcccacgagacgggtagttatctagaaattggctccgctagccggtttagttatcaaaacccatctagatttagcttttttgctagatcgaggtggttggcgactctaggatcaccgcaaggcttaaggtgctacgatcgtgcttgtcaacttgtcaaaaaagttgccaacaggccctatgtataagtaactttaggttttcaaggaattgcatttttatgataattttctctgctattgttgtggtgagttgataatttagtcactaaatatgtaactttctgaaatttactcaaaataaaatatccaaatatttcagaatttctaacacatattcagtcattttaagtatctcaaataaaaaggtcgtcaatgacaaagttgtatatctcgttgacctacacaattttgattttacctttgtgttcactcggatttatataaaaaagtttattattcttttttttaaatgttcttgtaaatatcactaccggttaattactcaatgaacataacagtccagaccatggtccaaaatatctgctccatagtatcagtgctggcttgtaataccaacttaacggtggtactttttcttagagagaatccctttatatgccactaaaaattagtctgatcccttgtatgccactgaaaattggctttttccttatatgtcatatatctatctatctatctatctatctatctatctatctattatctatctatctattatctatctatctatctatctatctatctatctatttctatctatctattatatactaaaagtccattaaacttcctacaagcgctcctaaaccgccatgtggcgctcctataaacgctcctagattgccatgtggcgctttagtaaatcctagaaattctaagaaaaaagcaaaacatctagccatcgattttcatttaatctggtggacccgctattttaaaccattagttagatctttgttaagaaaaaacccaaatcaatctataaaaaaaaaatcccacgttacccccgcggtgtccccgtggacctgtacgtatgtacgtacatacgtacgtacgtatccctgtaagtctttttctttttttttcttcttatattcttatattagatgaaaaaccatgttaaattaaagttgtaaaaatacatgctatttcaagttttattctaaatagcgcatcgcatcaaaacatccattaaaattattaataaattaaaattgtagattatatgattgtatatctcttaagaacatagttaaattggacttatattttcaaaaaataaaaagaatttaaattatgagcagcgttctaaaatttactcactccctactgtataatattgatatgcccaaatgacattattaaattatcatgaatatattttcatatattatatatgttcctttattcatatatttttggaaaattaacgatcatatatttttttacaccatgtggatgtattttttatctcttaggtttcattcggtctacctcattagatgagcttatctaggacacgcgaaaaaaaagcatgccatcagcgtaagattaattaagtattaaatattacaaacttgaatatggatttatttgatcttttaaaaaaactttgcatagaaagtatttgaaaacatgcatcatttcaggaaacatctcaccatagagggagtagccaatccgataagattttagaactcaaccttaaatttactataaaatatatagtatataatatattttgtcaattaggaatagagccaaatatatcaatcatatatccctactaattcctatgtgtataagtttcatatacaaaccactgtccaccaattatcaagtcatattaattacttatgaagcatccgtgcttaatgcacctaataattagatgacatctaatatgcagtgtgttatcaagtactgataatggacaatactaaatgagaaaccatcaacaaatgataggtaagtattgataccaccaagccacaacaaataatagttgactacaaatatattgaaactattgggtaatagtgttcccacacacctacatacattcctaggttgccacgtgacgctctaataaattagggtaaatctaataaaatttataagaaaaagtaaaacatctagccattgatttacacttaaactggtggataaattatttttaaccataagattagacctcttcaagtaatccattacgactatgactaatagcattcctgcacttccaagatgccgcatgacgctctaataaattagagaacatataagaaaaatatattaagaaaagaaaaatataactgtttatttacacataaaccagtggatatattattttcaatcattatattatatctattcaaataatccctcactatgtacgtacacaagaaatgccataaaggaaaaaaagaagagtgtgtatactatcagccccatcaagtagttttctctatctttctttgcagctctgagattttccacaaattgtgcatatgagtagcgaccactcctggcgaggctgtcgaagaagccacgctacacagcaccgcttcacgccatctcgccaattttcttgaaagcattttttttactattaatgttaaaggcaatctcgagcgcatatataaacgtgtgcacacccatcatagaaataggcatacgcacacctaccctaagagaaaaaatatttgtcaaaaaaagaggaaaaaatatgtacttagtatttgccaagaaaaacatatatataaatatatatatatatatagcataaaaatgtcgcatgtaaccacattatatctttttaattatatcattcccatctatataataatatgctaattattaacattatagattattccatcgtatataaccgaaacaattcgcactgtcattatagtttaagggtgtaattcagactatttcctttaaaaaaagtcatttcaacacaataaggattcataatacaaatttaatcaatactaatttagtaaagtacccgcgcatatgcgcgggccaccttcctagttggtctaaatttacgcatcctctcatgtcactcccgtcagttgactgtgggttgaccgttaactctaaagtaaaaaagatgtatttactcttctgaatataagattctttctactttttattcctctgtcactgttagctcataacaagaaccagcagtggtatatcaccgcaaatgaactgggtagtgatatttagtaacattgtcagtttacttcagtttgggcaaagaaaccaaagtgaactgacagtgataaattctcaccgccggttcataccgaaccagcagtgatgaccacttctgtggtagtgattgctgcaatttatctatccatatgatttaacgcgcgcagcttccgcaccgcacacaaacactaacgccgtgccataaacccaaccaatttgatcgaccaccccggcagtcattaattgttttgatttgttacactaaagtattgagatcaactgtaaaaacttgtaagcgtccaaaagtcttgtgttttatgcgaagtgaattccccacaacacgcatggcaattgtttaataactccctccatttcaaaatgtttgacaccgttaactttttagtacgtggttgaccattcgtcttattcaaaaaatttaagtaattatttattcttttcatatcatttgattcattgttaaatatactttcatgtaaacatatagttttacatatttcacaactttttttaataagacgaacggtcaaacatatgctaaaaagtcaacggtgtcaaacactttgaaacggagggagtatatgttggcaacgtcaatgtgatacaactgtctgtgtgttcacttgtctgaaaccaagtggatcagtcaagtaattaattgtataacagatacggtacaattataatgacatccaaagaaacggagccggcaatgcgcatgtcatcttccattccagccggctgattccccaacacctacgcacctctctatcattgaaaacaattagcaaaatataccaggtaacctttcttaacatttaaaactgtgcacttattacaattctaatgcagtttgcggaatattgccttcactattaaattattgatgccgttggctttttagacatggtatttgaccatttgtcttattagaaaagctatataactattatttattttgttgtgacttgttttatcatttaatatattttaacattagtactaaatttttaaataagacgaatggttatcgtcatttccaaaagtaaatttccaaaagtaaacaacgtcgtacatttaaaaatgcaggagtagcagttctttgaaagttcaacggacatctgaaaattattctgaatttgttgttcatgacgattctgtacttctatttgtaatttacatattgcatacttatcctaaactacaaatattctctctgctctccaatctttatttttcatggatagactgcatattaaaggaactaaggttctgacacttggaaacatagcccaagaagtcagtgcaagcaaacatggacagtgacaattatcctagaaaaaaaacatgtacttaaccactggacggcaagccaacattactgcaaaaacataataaatctacgtaacaacaaattaactatcaaaagaagacatctttgacagcaagaggggaaattcttatgatcagatacagatcagatactatatagatgtgacaggctccaattttcgttgatactaatatccatttccatgtcctgacatagctctggatcatggagaaggggcaggagataggagcgtcagccggcgagaaaggttcagagcagcacgccattgacgtccgccccggcgagcatggcgccatcggagtcgtcgccggcgccgctgcagaagcaccggagaaggagagattggctgttgttgaagaggagcccaggaagaaaagcaagagggttgcagctcttgatgcctttagagggctaaccattgtggtatacatatatctactgcatatgcagtgaaaaatatgaatagttttgtttccatctagttacactttggtagtacttatcagtgttttgatgatcagtgtaatttagtattcatgaagtgtagaaagtagcacccctttttatttacccccttcaataaaaaaaggaagttgttttggatgtttcaagtaaaaccttagaatgtttggtcattaattaatgctctttaattatttagatttgaactatgaaaaattgaaaatcatctatatatatttgtctcaaaagttacttccataaaattataattttatcggatctttttgtaaaaaaaattataatagaaactaactgacaaatgtgccgatgtttttatgaccaaagggagtagtaaaaacagaagttgaaattctttgaatgagcatgaatgtgacagtgtaaactgttgagttgcattgtgcagctaatgatactggtggatgatgccggtggggcttacgagcggatggaccattcaccatggaacggatgcaccttggcagatttcgtcatgcccttcttcctcttcatcgtcggcgtcgcaatcgccttcgcgttgaaggttactacagacacttgcacaagagcacctcttgctatgaatctatgaataatgctgttgttaaattctggcaattgatcgtctggcttatacatggttgcagagagttccaaagttgggtgcagctgtgaagaagatcaccatcagaacactgaaaatgctcttctggggcctgctactgcaaggtaagtaaaaccttcaatgaacatgcccactatcaaatgcaatgtgcatatcaacaaattttcagtttgcaacttgaatgttatgacaatcattggcactgccgaatttgatgtttcgcatgtatgaaggtggatattcacatgcaccggatgacctgtcttatggggtggatatgaagaagataagatggtgtggcatcctccaggtccagtaccttaatttgctgaaagaaaacaaaaaattgttcagagtttatgttctgtttatttcttcagaatttattagttctgttttgacaatgcagaggatagctttggtgtacttcgtggttgctctgatagaggcattcaccacaaaagttcggcctacgacagtgcggtccggtccatatgcaatcttccacgcataccgatggcaatggtacacaaatattaccttgatatttggctaacaatgtcactgcaattcagcgaacatctgttcaatttctgaaaatggtgagcatttctggtcttttctgttatctgacaggctaggcggttttgtcgcgttattcatttacatggtcaccacattctctctatatgtcccggattggagctatgtctaccacaacgatggcgatgttaatgacgggaagcaatttacggtactacttgcagttttccctgatcatgtgagcagagctgcaaatcctgtatttgctacagtactgtcttatccctgcaggtacaatgtggtgtgagaggtcatctggaccctgcctgcaacgcagttggttatgttgatagggtggtttggggaatcaatcatctctacacgcagccagtttggatccgatcaaaggtagaaactgtaatcttgcaatgatcagatgtacaatatttgtccttctgtaatcaagtgcaaaattttgttttgttaacctgtaccctgcaaactctgaaactttttgtgaactgcaattatctttgattaggattgtacatttagctcaccaagggcaggtcctctccgagctgatgctccagcatggtgtcttgggccttttgaaccagaaggcttattaaggttggaaatctgacaacatgagctaactgaagctgaagttaatttgtcttagaagcttctttgcactacgtattaagtaattcagctgtctaacaatttattcttttgcagttcaatatcatcgattctgtcagggacaattgggatccattatggacatgttctcgttcatttcaaggttattttgtgttaatttatactattttaagttaatatttaacaagcacaagtttgaaacaaaagtgtctgaattttagacccacagagagagactgagacactggcttctgctgggattttctctccttgcactcggcattcttctccacttcacaaatggtactactactccccaaaatctatttcccacaactgataaaaaaggtcaaaatatttattcaggacttttacatccattttatctttcttgcagccattccaatcaacaagcaactctacagcttaagctatgtctgcttcacggctggtgcagctggagtagttctttcagctttctacatattggtatgatttttcattagtacattgaggcctcgtttggtttggtgtggaccgagattttagttcaaagtcccagcctataaacacggatgggctgggttcgattacttgaggcccatctaaacgaggcctgatatggaatttcagtactcattttcatgaccgattttaattttatttatttactggattattatttttttattaatagattgatgtctggggactaagaacaccattcttgttcctggagtggattggcatgaatgccatgcttgtgtttgttctagcagcacaggcaatatttccagcatttgtcaatggatggtactatgattcaccaggcaatactcttgtaagtaactttgttgcaagtttatttttaatccatcatgacagcatggtgacatctacaggcaaagttttgacatgagtttgatttggtttaatccattacctaaaaaaaaatctgcaggttagctggatccagaagcatgtgtttatcaatgtatggcactcacaaaggttgggaacactgctgtatgtcatatttggggagattgtcttctggggtgttgtgtcaggcatcttgcacaagctgggaatttattggaaactatgaggattttggatttaagtgtaaacagcgctaaggagaaccaattactgttgcttttacagataaagtctggtttctgatttgcatgtgatattattttgtatgatgctattatttgtataatcgaagcaaaaatgagatacatatattttaatctttgaagcattctttaggatattgatgttgatgtagtaagtggccatatatatgcttgttcagtgtgacaatatgctatttaccaaaaatcagtatgtatatcccctcatgatttttgtagataatggaagttttaattaaactgagttgattacatcaaggtgatactacttcactgagaacactcctggcctctgcataatctcctcatgattctggtagaatgatctcaaacgtctctgaagagattctatcacaccgattgatttggccatgttacaacgggatcacattcttgaaaccaaccgtccaagccagtgtaagttcagagttagaatctctgatgatcttcaaagccttcaaactgaaaagaatcagatcagtcacagtctcacagagagactgactgcagtatcagaagaacatggacaagttgcaactgtggtcagggatcccgagacaagcctgcctgtcctatctactcattgttcagacatcttcttgcaatcaaccaaaaggcccatactacatactacatggataacagccaaattggctggcaaaaatgcctaattggctgcagaatctagtcactctatgctcaatgttatgcgttcttgcccttatctgcatatatcattgggcttgggatccattgcatcagacatgttcagcaagcatggcaatgccaaattgccaatgctactggctttgtttccttctgcttgaatcagcaaataaacagtgtgaaatggcggcatccatggtttgctccgttttgtatttatgctggtttcttatcctgcaataaagtacatgtttgtatttattttgtttttaaaattttagttctgttttttggtgccttgatgtgctgtaatgttgtcttgtaagaacaaaagagaagtcttctccccatacttgtcaatcatgcaaatattgtcattttcccctgttaattgtcatgttgttattcttcaagaacatgaaaggccctgtttagtaggacaaatattggtcttatcttccatggggctaaaaatttttgtcagtattgttgagattttgattccaccagaagaaaaacaagattctaagttgaaggaaaaataaactggttgctccatgaagttgcaaaaattaattaaccatactgcaagtctgcaacctgtcttaattggtattaatctgccatgctaccagctaacaccattatattttcagagagtcacagatctaatcctaaaaaaaaaaggggaaaataatcacagatctctatagctttggtgcatgcagcatgtatgtatcttatgatctgtcagacttggtatgcttatccctgaacataatgcattgctcccatgcatgaacgttgtgagatcagagagcagatgatcagttaatcaattgtgcatacatgatcataaatttatattataatacattaatgtataccgttgtgaataaaagaataaaattatctgcccaatgttcttcgatgaggaaacaaacagtaaactgaaccaacggctaagtagatgaatgtacagctatagtattaaaaatatatactactagtaagcatgtaaaaacaataaaattataggtgaactaatgcattaaaagaacttatccacttctgcatcttattaacttaattaatcaatcaggtattgcatgcttgctatattaacgcatggtgtgctcctcttcacttgccaatctgagcatatgcatgggaatctatcacaacagttgacattataataagcaaaaaaaaaaaaaaaaacagatgaataactacatttttaggtcaaaatattgactcctagccggtgactgcatgaaggatttagatgtgtatatatactgtatttgcataaactactaacgtttgatgctctgcacccatccatatgcgcatcgatctgtgtattacatataataaattgttggtactgcaaaataagccgacatcgatctctatcttattacatattttccccaactttatcgtaaccccaaagagaactattatatatgcttccctattaatgaaaaatatcgaaaaagatagagccacaaattaaaatagtattaataaatgtatataatttagcttacaattaccaattgtttccttctagacagcggcggagctagcactccggctgccatgagcagctgccggggctcgccgatgcataccaagaggtgaaaatgctatgtggctaatattgggcgctgccggtagactatcatagtgggttttatacgggtagtatatctatcaccgttttttaaggatatgtttggaccaaaggatttaaagatgatattttttgtgtaggatttttttccttggagttatctggattaattacgggaacggtttccgaattccatcttgcttttctactatgttaaggtgtttttcctatttttatgtttcatatatattcttacatgttgtggaagaacacaataaggatcctctcctcttagccggcttttagcaaaatacattttagaggaggaaaaaaatgcaagataaaccccgaagggtggaacttaattatatatctatatgaatcatatatattcttggattttaagatgatcatgcattgtgagtcaactactcgcaatgtcagcgaccacatggagaaggttgatggtcagttacatgtccactcccgaaaaggtcaacctggttatcaccaaattaaaaagcgattattgcaaacagctagctgcaacacacataattcaccagtcaaccacttagcttttgccgccaactaatttgtgtttagtcaacgccccattaacgcaaatttgagctggattctccacagtagaggctgcatgatagtattattcatctggtcagtgccttgggcatgccgtgtccattcatttcagttgtagttaactctgttttcaatcccattgaaatgatactaacaaaattttcaagaaacatatatttttgcatggttatattcagtgcttctatatgaaaaatgaaaaaaaaaatatactccttacattttttaaatatatgatacggatgatatttggacatacgttttgagcattcaccttatttggaaaaaaaatagtaaaactatgagttatgctcattatacatttagtaataaaacaagtcatagaaaagtaaataatatagaaaagtaaataatgtttgaacaagatgagacgaacgataaaagtacatatcaaggaatcaacggtatcatatatttaaaattatagtagttaattagtacataatgtatctcttaggatgcatagcattagcaatcttaggatgaatacacatggccatgtaagtgaagctaatttttaatgagagttttacacttttactcttagtatacatcatttatttggttttagattaagcattcaagaaaatactgatggaccaaattttaaaaatttaacaaatctcatcctaatgtcaaatatttttgaccgtatggaagaaaaaagaggagtatggaagaaaagaggagagagagagagatgcatagcatcagcaatcaacaaaggccagtaacggaaacccaaaaaaattaataaactaattctgaaatgtagtcctgaaattcaacaataatattatgtgcgacttatctcaaatcgcacggcagagaggaacatggaaatgcatcagttgttgccacgtggtatatagtgcttgcgtgcggaccagcctaattggtagctgttgagacgcgtccgatccattaactaaccgtggttgtttgtagttgaataatggagttgccggtctggatatcagacactcaatttaagtggacactactaaatgtgtagtgccaatcataatcaagcaagagcatatattttattttggaataaattcaccggaggtccctcagcttaacagcgagattttttaagatctcttaaccacaaaataaaaaatatatacccctaaactcacacaaaccatgcactcaagatcctatggcggtatatatggatggtttcgctaacgtggcatcctagtcagcaaaaaaaaattaaaaaagtacgtggagcccacatgtcagctgcacatttctttcttctccttctcttctcttcttttcttaagtgagggaggctggcgacgggcagagcagcggatggaggaatggcggccagaatgcggcgtcgcctcgagcaccgtgataggaggagggaaaggggaggcgggcggcgggcgatgggggaggggagaggcgcgacaataaggacggcgcggtgacgggggacggggggcgcgacgcggcgacggggatggcgaggtgatgggggacgggacacccggtgcggggtcggcggcgggaggagcagagtcagccgcgtagggtggcagaggcaccgcagctggtggaggagatcgagggcgggagctcaagaagtgtgacggcggcggctacagctcgagaagcgtggtggcagccgccgctccgcccactttgccacgtcgcctgccgccgtcccccctctgcggcctactccggccgctccgctccgcccactgccatgctcgcccgccgtcggtcccccctctgacgtgcttgcccaccaccgctctcccctctgcagcgctcgcccctctccgcagccgcgcttgcccgtcgacgccgccgttccacctacctctggccgcgcgccgctgccgccaccacgatcccacgccaggtcggcgcggcggttgccggcggcgcggaaccgcctcgtcccgcgccgccgccagaggagccaagggcagacgcggaaggccagggtctcctcatcagtgtccttgtcgaagtatatccccacccccgccacttaggaggacgccggggtggctggggacgagagctggagcacgacgcggagcaagaggccgagggaggtgcacgtccaggacagcgcagcgagaccgaggtgggtctcatagatggaggtcgctaggctaggccccgcggggctagacgccgcggccgcgcgcagcacaagcgtgccatcgctgctctgcccgctgcagaagagaagagagaaaagagaataggagaagaaatgagaagaaaaaaatgtgcagctgacattgggccacacttacttttttttttttgctgactaggataccacgtcagtgaaaccacccatatatactgccataataccttgagtgcatggtttgtgtgagtttaagagtacacatttctagttttatggttaaaggacctaaaaaaatctcgatgttaagttgagggacctccggtgaacttattccttttatttttcatattaaagagtatatatattttattttcatattttagtataacctcgttatagtttgtagtatgaattattatttagttcatatttcgatcactctaatttcaaatacttgtcaccggatactatttacattttaactttgaccgatcatattattccttttaaaaaaatatactccatctgttttatattacaagtcattggaaaaaatttgtacaaagatatagtaatattttcaatacaaaacaaacttattatcaaaatatatttaatattaaatttaataaaagcaatttggtggtgtagatgttactaatttttttataaacttgatcaaacctaaaaaactttgattatgaaaaaaattaaacgacttataataggaaacgaaggagtattagtcatactgatagtctaaagttaataatggtcaaagttaaaatataaatggttgtgacaagtaaaagagagaatatatgttcatatacatgtgtagcatctcaatatctcgtatacacaaagtcacaaaccgctcacacaaaacagaggcgggtagctactggctttgcttggtaattgaccaagtaacaaacatttcattaaaacaaaatacagtgaacaaacatgtcctggttgcttttgtttctgaactgctcaacagcacatccacgttgccctgttctgcagcattgcattcaaagcagacatctcaagtccaaaggtgaacaggttcagagtaattccaaaccaagtcatcacctgacctaccaaggtaccaaggactaactccagcagcagcagcatgcaactgcaacaatatcttaaatttctccctttattatagccacttgaaaagcaagatctccttaattaattaccttgcatcattccaaaaatttcaacctttttgcacagcaacacagcatgtatatattgtgatatattggtccagtagatatagtatgtccaactaaaagtattgtatggtatgggtggcattcatgatggtcatattaccaatggccttgcctacatgctgcttgaatgatgccatttaatctttctgagatctacctggctaggtgtcgaattgtgtgacagccagcatggataagggtaatttgtgtgggaaactcatgaggttttttttaggtttgattttcatagccaattacttgtgttcccctgattttcaaaaataagtctgataatcaacatttgattaataaataaaatatcggttttagcctttgcaccaattgataatttacagaacggcacaactagttattgggctagttgggtgggcgcacgtctcaatgtcaatatatgcagcacacggctagtttctgaaatgcgctatgaaaacccaccggtagctaataaaagctctttgctgctcaagcttcgtaccatccttggctctccaactagatatccacacatgaaaatcattaggaccggctatattatcgaattatgccgtattattttagaaatttaacataagcatgttttctgatttgctaggcagcatccaaaagtcacattatattgctacatggattatggctaggtttagaggacatgcatcatttataagaccttatctgccaaagcatatcccagttcaccttttctcctctaaagcaactaatgtgtcacctactgccctaagtaccttgaatttaaatagtacaatcaactctagatcaaaaaggtcttaatggtcctattccttctgacgtggcatgattatttcctttggagcttggttggcacatgtatgtgcaatgagagcatattatgccataaaccccacaaaaagaaggacaagctagtgcccccaaaagacatcattttaacccctttataattaattcatcacttttatctcacttaactataattaagtttggtcccttaaaagcccaattctttcctttggagagtagccctgcagccaagtgcatgcatgcctgctcaaacatgccatgtgcacaaaccttcccccagcatcttcctttgcttcatctctttatgatctccaaaggaaaagaatcatttcctttttcaattgctctagagttacagcatacaaccactaaaacaacatacaaataacaactttaaattgtgcagatgttttcttctctaatgaattaaaggataagttgtgtgcaaattaagattgctctcctacaccagttgatgaatctagctatctcgacagattaaaagatgcaacatggagtaaatatgggaaagtaaatcaattaacatatatactcgtttaaaatagaagtacatctcccataacaacatattctagtggtcatttataattgttgttcaccaacccctcacttgtgttgcgctctaattaagcagggttgtggttgtcttttatgatttatgtgtttttccttaagagaaactacgaacaaaccatcggataattttctatgttgctacaaccacacaatactattaagcaaagaaccaggccattatgtattcgtacgctcgcatcgaaatatataccttttatcattgaccggcaccgatccagcatatagctccaaatacactctactctaaacctatatatctgtaagaaccacatgatgacccggattattttacggcatttggtcggtgcgcgcacaacatcccctccccgttgggtaagtgtagcaatacacacattaccccccatctttgataccattggtgtatatccacgagggcaagcaagcaagcaagctccacctctctgtcactggcatctccatgtgccccaatgactgcatgtggtgtggctccacaccccaatttccctctcctctcctcttaaaaacctccctctcctctccaccattgtccacacacataaaaaaaggcaaaccaaaatacctactccacatctaactaattctacaccagcttatatatttatacacacacacatctccatctccacatctccatttccatttcagagagagagagagagagaaggccaatcttactaccccaattccatccccctttgcatattctcactcactctcaagtctcaactcaactcatcaagatatcatcatcatcagagaggttgtagaagctacctagctagctagctagccaaaagagatatctttcagaagaaaggaaggaagaagaagaagaagcaatgagcagtggtggtggctcctctccaacatcatccccttctgtctgctccagatcatggtaggcatgcatacatgcaaactctctcatcacacaaaactatcaacatctattcatatgttcaccattttttgtttctttaatataatcaccctatatgtccataggtccgtctagtcttatcatgagttgcctatcaacatatcaacattattttggacagaaaattcacgtgttaatccgtgaaatgcatgagcaagaaaatcagtgaagattaatgaattgcctgatgacgatcatgtgttaattattttgatttgtgtgtgcaaataaattaattaattgaatcaggtctataagtgaggattcgttgaagaggtacgtgagctacgcgagcgagagctgcatccaggagctcctcgccgcgtcggactccggcggcggcggcggcggcggcgacgatgggtggaaggtgctcgcgtactgcaacggcgtggagatatcgaagcggcgggccggggcggcgcacgtcttccggagccggtggctgctgcacgccgtctcgccggggaagttcatggccgtcgccaacgccgtcgacgccgccaaggtacctgccactttaattagcagtattcctggcactgctaaaccaagcggacgaattaacgcatgattaattaaatattagttaataaaattttaaaaagattaatatgatttgtttaacatattttctatatgagacattttaaaagaacatattgtttagcggtttgttgaaatcgtgtgtgtacatgaaaagcgagagactacaagttaggaaagcgtggaaaagaacacaatctcaattacttttactgcttttatttaatggatcattaactaaagcctgggaaactaaaacgttttttggttaagtaatcatcaataaaggaagaaaacttaattcaagaggtttcactaaagagagattaataaaaggtatttttttgcaaaggattttttttgctttagattaaagtgaacaactaattaagaccttttaataaggtttgaaatatatccttccttttcaacgaattaatttgtactgaaaactaaaacactttctctcgagcagtagctctcaatacccaagttatccgtcctttctcatcaatctccaacgacaaataattgctagtacctacaactgatcaaattgtcgaattaatattgatgcaatttcactaactaattaattgattaaaaagcaaccaacaacaacgtactacccctataccgtactaccgtgactgtgagagtacacacattacgtacatatggtgtgaaaatgcacagcatttttttataatactatggcattgtttagtttggaaaaatttttacgtttggttgtcatatcggatatacggatacacatttgaagtattaaatgtaatataataacaaaataaattacagattccgccagggaactgctagacaaatttattaagcctaattaatctatcattagcaaatatttactgtagcgccacattgtcaaatcatgacgtaattaggcttaaaagattcatctcataatttacacgcaatctgtgtaattagttttattttttgcctacatttaatattctatacatgtgtccaaacattctatgtgatagtgtgaaagtttttattttaggaactacacaggacctacgtaataaatgggtataattgggtaacggtgacagtagattagtaaaacgtgttaccattgatgagtaaagttaatgcgttgttgtctcgtgatccgaccgccagcccaacccaccgtacctgtcgtcgtagctagtatctttgttacgcccgtgattcttaaaggccttcaaattaaacgtacccttttttgtgcatggtacaaatctaccaatttgtaccattttgaacgacctattgtacgataccatgaatgcaaaggaatttaccaattgtacgagcatgcagtaattaacagtccaggtatcagtgataggtaaagtgtgtctatttttttggtacttaattagaaacctagcccttgtacatttgtttttccagctttattcgatataacatgatgcaataagtattagcatacctataactaaaatgcctaaccctaatcgtacagtaaaatttaaattttaaaacctattttaagagttgatttgattttgatgttttttcatcgtatagttgaaata

SEQ ID NO: 2988 - DNA, 3941 bp, Oryza sativa
taaaccaaaataactaatatgactactttttttagctctctagatcagagtctacaaaacatgtggcttggaaaattttaggcttaccaactacaaaagctcaaagaccacattattgattaacaaaagccaaagctaacaaaattaattaatggaggggtattgtgctgcagagaagtctctgttttctactgtacacagactgtatagaaatactaatgtaacagtaaccaaagttcctactactacctagctagccccactacacctctcctcatgcacgctgcaacaaaattctgatgccaacttgtcgccatgctgctcccccggccatgcatgtcgcatcgtcagattgacacgtacctgacacatccagaaaattgttcccaagaaattattattactgccattggaaaaaaataaggaaaacgacagcctttactaaaatattgcattatagagccagcgatgtcgtgaagcctgaggacgaagaacattttttagactttcggttaatttttatgagtatttttcgtgtcgttaataataacaacggctagctcaggagctggctccgtctctagctatttctgtgaacaaagctaattaattgagaaaatactctcttttactttgaatatgagttgtttctttacttgtgctctagagttaaaagtaaaataatcttattgcccttgaactacacttgatattaattgggagagagtagcattttggtagagcaaatatggagaagaaaaactttaaaagaaattgtaatatttaaaagacaaatttaaaaatgtaaaacaacgaagcaacctacattaatctactaaagacagaaaaaaaaagaaactactgcagtaacatgtgtgagacgaggcaggcatatgcatgaatctacgagcccacaagtacaggccaaatcatttggcacttcgagatcagcaaaaaaaaggggaaaattagacagatcgagagagaaagagatgggtatatgaggatgattaattagagccatgtgtgtatcataatcagagagatgtggtaattaatcaattactccaattaattagatgatgcatgcacgcatgtatgctgatttaattacgctctaaactcgtgggctggcagtagtgtcaggcaggggcacacggtgccatgtgagggcacgtgtacccacatgccaaaaccttaattaacgtgaacatgattgtcttaacggctaattaaaggcacgcagcctgtcagattgttgtcagcaatttcctgttttaattcaaaacgaaaaagacgatgtgcatgtgtgaaattaccaattttgttttcttttagtagtcatctccgtcgagctggacaccaattaaatttctaaaaattagatagtgcaaaacagtggtaaaaactacgcaagtgcaagtgaaaaataagataaggtttaaaacaggggaatagtaggaaaaaatagaagatcgaaaacttctttgtacgtaaccagctatctggagtattgatcggcaagcttaatttgaattaagcaggaaattaattaataccattctgaattaaatcggtcccgatcagacaatttgtgaccttaattaattagaatggctctcgcctggtcggcagctaattaattgtacttggcgaattaattagtgaaatgggccatttatgggcccaaaattactaggccagatagtccaatggctaaaattaagatctttgcatgcagcaatggtcctcttccaaacatctttatcttttgactagcacatccctcatataaccactttattaggtgtgaattgaccgctttaatctgaacattgaccgtaataattttcaagtataatttcactagttaattagtaaataaagaaattatagttgtactttctacgtttcaaattacaagacacttaaaaaatttttctaactcaaacttttttaactttaattaagggtatagaaaaatataataaaattttaaatataaaacaaatatagtataaaaatatattaacactatatttaataaaatatagtaattttcaagtataatttcactagttaataagtaaataaagaaattatagttttactttctacgtttcaaattacaagacacttaaaattttttttctaaatcaaacttttttaactttaattaggggtatagaaaaatataataaaattttaaatataaaacaaatatagtataaaaatatattaattttatatttaataaaactaatttaatgttatagatgtggtacaattttggataaacacggtaaaactcatgaaagtttaacttagaaaaattaaaatgtctcataatataaaaaaggtagaaataaattgatattcggtgcatagttatactcttgaagagggtccaataatccaattgaattacactgcaattactccttccgtatagtataagtcgttttgactttttaagtcaacatttctttaaaattcataaaagaaaacctttagcaacatctaaaacagtaagctagttttattaaatatatgttgaatatattttaataatatgtttatttcgtgttgaaaatgttactatatatattttaataaacttaattaaacttaaataaatttaactaacaaaacagtcaaaacagcttataatataaaacagatgtactggtatctatttaattaattaatttttacatatccatatatatttattaatactgcttaattaaataaacaaataaaacaataatattgcagcagtgggagtcggacctggtggacgcccggtacatcagggagctgggcgacgacctgagcatcgtccacctcaagctcggcgccgacgcctccaagcgcaccgccggcctcttccgccgccgcgacgtcgtcgtctacgagcgccgccagaccatggacgacggcacgctggtggtcgccgtggcgtcgctgcccaaggagatcgccgcgggcctcctgccccccggctcctcctccggcgcccgcggcgccggcctgctgctccagtccggctgggtcgtcgagaagctcgacgccggcgacggcggcgacggcccgccctgctgcgtcgtcacctacgtcgtgcagctcgaccccgccgccgggtggctgccccggtgcttcgtcagccggctcaacagcaagctcgtcatcatgatcgtcgccaagctcaagaagatggccctcgccaccatgcactccgccgccgccgacgacggcgaggtgatgccatgagtttagttaggaaggagagagatcatctggattaattaattccggcgatcgatcgatgtggcactgtggctacaagctcgccgtcgtcgtcgtcttcgtacgtgagtaaatacgattttgtagaagagtgtggtgttgcgtgtgtggaggtgttatttgtgacatgcgtcgcttgcatgacatgcgtttcagcatctctctatatataaatatgaactttgagagtgagaattgttaccgtgtgtatataaattaattaatgtgcttttgaattttcttgaagaaaggctgcatcctactccctccattacataaaaaacaaataagataggataaaaaagcatactcatatccatattcattgtactatgaaacgtcacatcactcactctagctagatccattgtactaggaatgaaaggagtatgtatgtggctaaatccccagctagacatctatgatggatcatctatcatatatataaaagacacgtgttagatgacttatctccgacagataaaaaagaaaccgttggatctataacagatgaacttatcgaaatttcaatatggctgcaggggattagatgatccgtaacagatgtaatgtcgcccccttgtttaaacttctgtgattggagtgaccaccgtcgtcagggctgcaggaat

SEQ ID NO: 2989 - DNA, 930 bp, Oryza sativa
tgtttttctcttcatgcgtctaaaaatttatgttttttttcctatgtgctaatcaaacgatagtttggagactttcttgtgtttaaaaatcccctaggaatccaataagtatgtcattctattgctacgtttttcctatttctatgtttttctcaattatgcgtttcaaaggggtacttaaaaggtttcaagacacaagaaagttttaaactaacgtttaattgatagaaaaacataggaccacaagggacgtgaagaaaacataacgtgaaacctggtgtttattttcttcctaaattcatctaaaatagcacatcttaactaatgaaaagtgaaactcaaaatgaaacgaggatgagccacatcattcgataaatattagccgttgaattcactataagacaaagaggataagtgaatcttggcagttggattagatggatggtaaacatagtaactcaagaggtttccggagatgaagctactagaaaatgaaagaaagaaagaaagaaggaaaagctaaagaataagcataggaaagtataaggttatgtatataatttagggtttgcatctattgtaaaaactattttacaaataaaccctcatcataaccaaagattcaccggtcaagattgagctatttagagcttatacaaaatgtatattcatttgattaattttatttctaacaattaattttaatatatttgacaacaaaattgctatagttgcatgcacagtcatggtcacccgaacataagtttaatgcttttcatatgaattcaaaattaaatcaaactcattccttaaaaccttacaaatatttgtatataggctataaagagcacgtgccgacaaaaaaaaacttataaaaaattgtaacaaatattaagctttttaattgtattatcataatattagtcatcc

SEQ ID NO: 2990 - DNA, 872 bp, Oryza sativa
tatatgctccttccacttcctttctagcttgcacaatgtgtgtgtgtgggggggggggggggggactggaggtgcctaccctttggacttggattttttcttttttttgctagtgttataaattttggagagaccagacacgtagttgttggtaatcggaacttgcacactgcatataaagaatccatttcatctccgtcataacttcgaatttacttcctacgctctgcattgtgcaacatggtaaagagcaatcgttttctcatgcacaaatgatccatatagcataaggtaattgaagaatatgaaattctgcaaaactgccaacacagattgctaaaaaaaaattctgcgaataaaatagcacaaggcacaaacttttgacatggctcaccaaattggaagccatttgaactgctaatgtttctgtatattattacttactaacgtcactttaaccatgaaaatctgaagtggagtagtaactcaacatcattattttacgccacttcaaccatggtggcctagtgggaacgctgctgtgattcgtgaagttaggaatttattctctttgcagtttgatgtgataaaggttgtgtattgtcgtagagcttgtaatagtgttgcgcatgactagcaaaaggtgctgcctttggttcctctactcctgtagtttggtcaggacagtttcctgagtttgtttgtaacctggtgaacagcgatatagctgttttggtcaagtaatgaagttcttttttcctctaaaaaaaacattgtggcctagtgggaatcttaccacaatgtcaatgtaaattgatactgccacaattaggcaacttctcttttcaaaaacaattaggcaactacaagta

SEQ ID NO: 2991 - DNA, 2414 bp, Oryza sativa
cttacaacaacttgagcggtccacttccaccgaacattggatccttgagtaaccttgaaagcctgtaagcacaaaattaaatgtttatgttagctcattgttggttgattaattcataacaaagtctgaagctggattattcaaaagtcataaactgatcatttgattagaacaaagattccatatcatgattttaatataatatcaattttaatttcattaatgaatcgcttctctcactttctcttgtgcatgacaggagcgttgttggctgccaattttctggtgacataccaaaagaactcagccaactcccaaagctgcggttcctgtaaagatctcaatgacttggaaaatattgttaatgatctcatatacctgcgtcattttttttatgttaataagaagttgtgacggtaaaaagttgtgacggtaaatgaagacagtagtttagacttagttgaaatttcaatttgaaaacccttcttttttcacattgacttatttgttagctcgaaaccatttccatttcattccaggtaaaacagaaaatagtttttatctgttttgggggatataacaaacaaaaggaaatgctaactgagtatcaactttgtattatttcttatagtatcatggtataagagttgatggattgtattgctgcaggtccttgaacaacaacaggtttactggaagtatacctccatcaattggcaacctttcaaatatgtactggcttgacttgggtgaaaatcgtctgactggatcacttccagtatctgatggaaccaatactggattggacaatttgacaaacgctctgcatttgtgagtacctttcttaaaatatctaccaggctttcagttcactggcttccattctaaggaaaatgttcggactgctctttattcagtcattttggggtcaaccagctatcaggcaccataccaagccagctattcaaatcaaatatgaagctcatacatctgtaaggcaaagataaccttagataatatttgcaaactgtttcattacttttaatctgttatgtcatgctcaagattacccattgttcttgtcattcaggttgcttgataacaacaatttcactggcggcattcctcccacattgacccttttaactaaacttgaagtcctgtaagtgcatactttttctgagcaggcttataaccagctttcttctaactgagtgaccattcagtatataatccatacaactcaatatgcacaggcgtctcgacagaaattaccaactgactggacctgttcctgccagcatcaatagcctcacaaaactacaagaattgtaattttctggttactctgaatctctgatcagtatttgaatgtgctagccttcaattctaacaaataaccaaccttattctttgtcaggcatctagaaaacaataaattgacaggccctctgccagacttgacaggaatggattcactatatgttgtgtaagtgccgaacacactgtggtacactctactgaaattttatcataggaaacccttgtatctggcatattgaacttttggttcatttggccagtaagtacaactaatctgacaacacatttgcagctccatgggcaacaacaacttcagttcatccaatgttccaacctggttcacagctttgtcagccttgacttcactgtaattcttctctgcacactttttgtagaacacaaggatgcaattttttttacactcgctttcaaatctcggtaaatgcacaggaaccttgagaacctacacatcactggggagcttccgcagcctcttttcaaactcccggctatccagacactgtgagtggaattagtgttatctttgctcataatatgtggttacaagaactatgcactcaatgaacaaaaaaaaaagagtaaaggaaattgaacatgtcagtgctaactagcaaggtaaactggtggtggcaggggtcttaagggcaataatttcaacggcacactaaccatcggatcagactacagcagcacgctctcactgattgatttgcaggacaaccagatcaccactctcgccgtgagcggggctcagtacaacaagaaactcatgtaagatccatcaaatataccaagagaaattttacggtcctttaaaaagaacttcgaggtacctaaatttacactaaagattttggaacctcgagttacctagtacctggaggtatcaagttttacaccagaaaatgtgatacctcctggtaccttctcaaggatgataaaattacccaatataccaattcttcagtatgtaggcgctcttatatatgctttcattcacactcccatgtttctcttctcatcacagacttgttgggaacccaatctgtgttcaggggggctgcaggaat

SEQ ID NO: 2992 - DNA, 4717 bp, Oryza sativa
ttcgctgagagtaagtcaactgttcgaaaatctcaactactgtagaattaatccactaccgaattccttttttttttttgttgaagaattggcactactgatttctagacttcttcatgattacacagcactatcagcacccagacagacgaaaaagaaccagtccctcatcattggtgtgtcagctggtggagcttttgttgttgtgtcactgcttgttctttttacagttctgtttttcaggaggaacaaaaggccaaagctgcagccacaacccaggagcccatcttacggtaagaagcattggataaaaaaaaaatcatgttttttgtccatttgagttgaccaacacatgagctggcaaataaaattacttaaatggctgtagcttcatgggacatcaagagcaccagcatcagcaccccgcatctccaaggcgcgcgggtgttcacattcgatgagctgaagaaaatcacaaacagcttctccgatgctaatgacattggaactggtggctatgggaaggtaatatatagtatatttgttgaaacgggtatgtgactatctttagtgcctgacatccaaagcgataatgctgatcaattgcaggtctacagaggagtactcccaaatgggcatctaattgcagtcaaaagatccgagcaagggtccttgcaaggcaacctagaattccggactgagatagagctcctatccagggttcatcacaagaaccttgtcagccttgtgggattttgctttgaccagggtgagcaaatgctggtctatgagtatgtgcccaatggcacactcaaggacagcctcacaggtgtgtccatatgttcagttatgcatgactgaatctgcaattctcctttgtgaaaataaacatattctgctcacatctttttcagggaagtctggggtgcgcctagattggaagagacggctgcgagtagtacttggtgcagcgaaaggcatcgcgtacctgcatgagcttgcagaccctccgatagtacacagggatataaagtcaagtaacattcttcttgatggaaacctccacacaaaggtttccgactttggtctctccaagcctctgaaccaggatggaaggggtcaggtcacaactcaagtgaaaggaaccatggtgagtttcacagctctcttaactgcaatactgcaacgattaagcacattggatactgtttcctggttatttttcatcaactctgtaagatgagtatacagagctgtttaaagattataaaatacttgtcatgtagggatatttggaccctgaatactacatgacccagcagttgaccgagaagagcgatgtctacagcttcggtgtgctactacttgaagtgataacggcgagaaagccattagagaggggaaggtacatcgtgcgtgaggtgaaaggtgcaatggataggaccaaggacctatacggcctccatgagctcctagacccaatgctagcacccacgtcgctggccggcttcgaactgtatgtcgacttggctttgaagtgcgtggaggaggcaggaatggaccgcccatcaatgagtgaggtggtggcggagattgagaagatcatgaagatggcaggcgtaaacccaaaggtcgactcggcatcaaactcgatgagctacaacagcaggacaccgcgtcatccatacagtggagagtctcaatttgattacagtggtggcatcccatcttcgtccagggttgaaccaaaatgatcagttcggtcggcccacaatgatctccatgtaaataacttggcgcttgtttgtttgtgtacagttcatcaaggttctgaactgcttcgtacagtgactttcttctggaatttctgtatgattaattagctaacaatctgggtgtgtaagttgttgtgctagaaatctcctgttggtaatgccttttatatacgacacttttttagtgttatctgtcatatatatgtttaacgattctatggcgcaaaggggatttggggaatttgcttctccagtattataaccaaataaccaaagaaccaaaatttttcccaaatgcaacaggctgacactgagaagatgagcaattcatcatcattttcctttccaatcgaccaacggtgtaatctagactgcgccccacaaccacaacattggttctgatttcaccgattccagaactaatcaaacctcataaaccaaaatacagtaagtagctaaactagtactgatagtggggataaaccgatcgcgcgacaaaacgggtcgagatctccgtaatctagtaataaatcgatcgcgcaagtagattcagattgggggttagtgaccatggcgggaggacgtagggggcttacttgggatctgagatggtgcggcgcgcctcctcgtcgaccgaggcggcgcgcgccggagagggaggcccgcgacggtgggggctggacggaggcagacagcgggcggcgccgcgggatggaagtggaaacgtggcttagatctaaggctgtatttttctgttcctaacgttcctgctaattttttcacgcgcgttttctaaattattaaatagtattatatttttataaaaaattatagtataaaatttgttttaaaaattcgtactaattttttaaaacttttttttctagtaagtactccctccgtcccaaaatataatacttcatccatctacttttgacagtcatatttcatcttggcacacagacaaaggataatcaattctacttatcatctatttaagcatactactagtcattcctcgtaaacaagcgattcattaatatttacatttatcgatgcccatatagccaatcttgtgtggaagaatagagagtcacgtgttaaatatgagaaagtcattaagatgatagggtgctagattgaaatatgcctatcaaaaataaattttttagattaggaaatatgcatatcaaaagtaaatgtagggagtaacttctagcctctagaatttgtataaaaatataacaacttttacaccaacatcaagatcctctattatttaattttcccacataccatcatttctcatccaatcacaaccctcttctatctaattctacataatttcttaataaccacgtccaactttaaaaatacttacattctgggacggatagagtagttaattatgcattaattcatcctatcgttttgaatatccaactaatacctcccagcacatcataaattctaagggggtgtttagatgaaggggtataaaattttggcgtgtcacatcaggtattatatagggtatcgcatggtgtgttcgggcactaataaaaaactaattacataattagtttactataccaccatattgttaagcctaattaatctatcattagtaaatgtttaatgtaccaccatattatcaaatcatggagcaaataggtttaaaagattcgtctcgcaaattagtcacaatatgtgcaattagttattttttagcctatatttaatatttcatataggtgttcaaacattcgatgtaacaagggtgaaaattttagggtgggatctgaacagagcctaagtgtagcttagagcatgatggtgacaattgtttccataaattctaataccaaaatagcaaaatctcatatcaaattctctaaagagtatttatgatttaaaatcacgttactatctaatggatggatcaaaactttgactctgtaaaataaaaatataggccaccctaaattaacaataaaataaataactttatctaatgagttagtttcaatagtttgaaggaaaaagtacacccaaggtccctcaacttgtcatcgagatacaaaatcatcctcaaaccgcaaaaccagatatcccacgtcccttaattaatcaaaaccagtcacaagaggtccctcttaatcccggtttggtcctacgtggctgccgagtccagcgtgggacccatgtggggcccacgtgtcatggtaatccacgtcatcacccttcctttttctcctcttctctctttcagggagaggcaaagcggcggccggcgggtgcagggccagaggccagcaggagagaggagggcgacggcggccggcgcccagcggcggcagctggcgggaaacacggcgacgcggcggccccgacggcgatgtcatcgactgcgtgccgacgcacctgcagccatccggttcgggatgaagcagccacgcgtcgccggcgtcgtccgccgcgactccaccaatgacgaccgcgactccacctgctcgtgcatgccgaggcggcctctgtgccgacgctcctcctgtgcgtgttcggctgcccctggcgagcgacgttagactctgcttcgcggcggccgcgccggaggccgtggacgtgccgcggctggtgctccacttcgacagcgctgggtcatggagtagcagagcttgagcacgggggcagtgccgcagaactcagggattacgtcgcagctgaacccgaacctgagatccacgcaccccttcagctcctccaggtcgtcgtcgactcgtcggtcaggctccgcgcgtgccgccgccgccgccatcgctcccgctcctcgccgtacatgcgccgccgccgaagacgacgacgccgcagggcttctccttggcgaccaccaccggcttcgtccgccgtggccacgccgcctccaactgtaccccgcacca

SEQ ID NO: 2993 - DNA, 1704 bp, Oryza sativa
gcgagccgccgcgcgctgctcatcttccacaggccgccgcacaccgtggcctcctcgccggtgaagactcggaggtaatagaggtagagaggggagaggtggacgccgccgccttgccgctcctactcgcccgccgccatcctcgccacgccgtttcccatccaccacgccacgccgctttcccatccgccaccccactgcgcggcgccgcccctccgctggccgctgcctgtctcctcctccccgtgcctccgccgccgcccaactccaaggcctcccccactggcgtcgcggccctcgcacggtcgccgaggagctcggccgggctgccgcggccgccggccgccgtcgcggcgccgcccttctctcccgcctcggcccgccgaccggcctcaggctgtcaggcacagagagcgagaggagtaaccgaggaagagggggagagtgactcagcctgataagtcgggcccacgtggatcccatgctgactcagctgccacgtaggataaaaccggaatcggatccaccgaaggactgaccggttttaattagttaaggggcgccggatatctggttttgcagtttgcggatgattttgtaactcgatgataagttgagggaccttcggtgtactttttccttgtttgaaagggccaccgaaactgggcctcgactaggcccaattgcctcggaatttgaccagcccaataccgaagtgttaccagtacacaccaccctcttcacttcgccgccgccaccgctggcgacggcgaccgcgagcctccgctatccgaccttacctcgccgctgccgctgccgccggctgggagagtgaggggcggacgcgcggaggacggtgcaggcgcttcggttacggtcggccgaggacctgcagcgagttcggttcgatccgtgagttctccagctcgtcctcttccgcgactagaaaaaaaactgtgttatgcattctgatacaacgagtctgtgagttatgtgatgtttgttttgaatcgattgcaattgcctgtccctagctctactagaaatttactgaaaatgttaattggttgtgcacttgtgtgtgatgcattaggttaaatttagtggaatcgtcttagatcgatcaggttggtggccacattaggatggatggaactcaatggcaatcgccaatttggcatgtctgttcagttgattgttgcatattattattattgatgcagtaacggagctctgaagcttgaggatatacactgtgggagctagggtgataggaacacactcaatttagtatctctgttgttagaatagaagtggtaaaatctgtgacatgttacgaatgattttaggaagaatgatggtcttcctcccatgattcatgccgagactagccggaccatgaagctgtcttttgtttagtaaaagtctagaattaagaactgcaaaaggttacacttgaggatttcttttttttcgcggcgctatctgggttggaatattctcaaatgcaaatttttgtgatggagaactggtgaatccttgattccccttgtttctttgataacttttgtgcaagccaaaaggaagagagaggaacacctgagaacagtaggtatgggaggcattgggaaaacacgggaacatattgtgatccctaattttagagggaaatgatggtcgaggctttcctccatgttcccatgc

SEQ ID NO: 2994 - DNA, 365 bp, Oryza sativa
cacttcaagtatttttggcctctggcgcttgcagataaagcgctggcagctattgaaaccatagcaaaaggattttccatgcctatcaatcagcagatcctcctcgacaaccgcccccagggcgaagccgtggccagcaacttcaagctggtgtcggcagagacccctgcgcttgccgatggccaggtgctggtgcgccaccactacctgagcctggacccctacatgcgcggccgcatgaacgagagcaagagctacgccgcatcgcagcctctgggcgaagtgatgattggcggcacggtgggcgaggtggtggaaagccgcaacgccaagtacgccgtgggcgacaaggtggtgggcatggg

SEQ ID NO: 2995 - DNA, 3547 bp, Oryza sativa
  unsure (1)..(3547): unsure at all n locations
actcacttcacatttgaattgatctagtgcaacacccgataaatcctggtcaagaaatttcttcactgcaacttcctgcaatagatgaggacaataaattaccagagcaagaaactcacaaaacaatggcaatttaggtgaaaatgaatcatatatgttttgtttcttccagcttggtaaatttgttacagtgggcctgatatttccctattttgttttattggccttcctaggcaacaaacctttgatatccaatagttacctgttaaaagtcactgctttgcaatacaatgaaccagtggtggctctatttatgagctagttcgtacagacacagtagttatccagtcctgtactgtcttactatttaagctatagaccttacgaccacttcgtactactagcaaaatataatataagaattgctcttcaaatatgtgacttacagtgccattccaatctgcatgatatacttccccatatgaacctgcaaaaataaatttagtttagaacacagagagtaatggtacaaaagaaaagtatccaatacattacagagtaatggtataaaataacacaaaatttaacttagttcagtatgtaaaaaaaattaaaaaggaaataacgatggggatcacattgcaaaatccagctaatttattccactctctagcctgaataagtgcagttttatttttatttttcagtgtctccataatacaactttggccaataacacagaaaacaccattggttgacagcgaattataacgcaatgaaagtggtgttggtttagttgtaaaagttcataatttagaacaccttcattctaaaactgaaccattagcaagttcctgaataaaaaaaaatccatgatacgcgcagcagatatcgtatattttggaaattagaggcattcagacaagcaccagtcgttaaaatagaacaatgtctgtgaaacaagatcgatttcacaatacanagcttcaaagtggatgactaccanaaatgttaaggaagaaccataaaaagtctgaantttaatcaaataaatgaatgtatttattactaatgtatttagtgccatgtagagagcaagagacatttactctttctgcatatatattcatgtaacttggtgttcattgtaaacttgaaatgcagtatgttgtccccttagagaagctacctcttaataactacttactgctatactagtaagtggtaatataagatcttggaattaatgcagatacctagaccaatgcgctctccaatatgaagatcttcccatggtatttcatagtcagcaacgtcatctataacagagctgattgttttcgtgctagaacagctcgacttgtccaagtttccattgctacttcctggcatcttcaccaaagagtcctcagaaaacctttggtcctcgttggcaatggcatgagctgtatgatcatgcaaatccaaatttctgccaattgcttctgtattccccacatcatgctgtgcatcttcatggaaacaattcactactgctagtgttttggtattgccatgttgcaatggagaatcttccgctacatgaccatttggcaaattttgacctgttttagcgattaccaaccatcctgcagttttgtcatcttcagaagcagtatgtttgcatatttcaggtttctcataggtgggtagcaatgcagtgccctccaggagcaagtcttgcaaattttgtgcaaactgtgggtccacttctgtgggcactaaatacatgggagcatcgttgactttcatcagatgcggaatttcccctccatcagatatggtactttgtttaagcgggttctctgtgtggaagatgtcttccagctgtgaacttgcaagtgctaaagcagatttttgttcagatgaacttccccccatgtcacttgtattcttacatccagcactaatctgctcaagggctatgcatagttctgcaacactctcctcgatggcatcattgctcagttgactattgttggagtcctgaaactgactgccagaaatatctgaagggattaatgtgcctggagctcccatcagatcaactatatattcaacactgcaataggatttgattgttatatatcaacacagaagatgtcctaatattaaatactgaaagattgtaaagatacaatgtagatacctgtcaaaatcaattttaaccaagttaatagccccttcatctgtccccgtataatatattcctttgacaagcttgcatggtagattaactcgatcagctagtacctgaaaccaatctgatcagttattttctttgtccaacagaaacctacttacgtagaaagctgtcaccaagatatgtagtcaatgaaacaaggttcaaaggtgtttctttttcatcaaccatttcaattatccattccatacagcaaattcaagatttaccgatgcccataaatgaactagattggcttccacagttggactaccacagctcataatggacaatataactggttgaaggtgagtactaaacatctaaacatttttcaatatcataactggaatcgggaatcatttgtgctttaaacaaccattccacaatgtaaattgtgcaacaagatggaaattgttaccatggggctattcccatattttcttacacttgacataatttaatgccctatgtgaatgactggattgaagtagaatacagtacttctgcagagatactaaccttaaatagcaaagatctgtggcgcgacaacccaatgcgaagcaaaccaagagggagaacaatactgttgcgctgaaggcatagcgcgcggctcttcactccccattccctgttcatttcatcagcatcatccaccggaccgcccatagcatcaaccacaaggtttgcaatcttctgcacgagctccggcgaagcgactccaccatgctccgccctatcctgcgcggcaattgccagagccctcccttcgagccgcttcagcgccggatcacgctcccgattgaccaaaactgccacgtacgcggcgtctccaccgacgggaaccgccctgagggtggtcagggaggggaatttggcctggaagtgcggatgcatcggcgcgccgcacacatcgtagaacccgtcggagagcctctcgtcgtagttgacgacgcagtggttccagtaccgcgcggagagggcctccatggggccccggtccccggcggcgccgccgaggctgatgcgctcggcggcccggatctggaccgagtcggcgtccacgagccccgcgtgatccgacgccgagatggccagcgcgagccgcacctggtactcctcctccagccgcgtcatcgtcgcgtccgcccccatccccctcggctccgccgccgccgccgccaccggagccgcaacaggagccatcaccggcgccgctcggccgccgccgccgcggcgacgaccggaggaggcggcagcggcgggggctgcgccgacgaccgccgatgctgccgcgggcggtggtggtgctcccccgacggggcc

SEQ ID NO: 2996 - DNA, 24403 bp, Oryza sativa
tcctcctcctcctcctcctccctgatccgatccgcctacccaacccaacgaatcagcgtaccccgacgaactcacctcctccctcctccgagcaccaccgccgccgatctaccaatccattcccgcgctgctcgatcgcgcggcggccgctgtaaattcgttgcttcgcgtcggcttcgcctcggcgcgcggggggtagcagctgccaaggtgaagcgaggaagaagaagaagaaggcatcggcatcttcccctctctctccacttttttttttccttttttattatttttggattattattattattattattattattattattattattattattttgggttgctcgacgtgtagtagtggtagactggtttgggttgggttgcttgcgcggtctccggtttggggggatcggatgatgatggggagcgtgggtgacgtggcaggtttggatcgtgcggctgggattgatccgcaggcccgtggtccagactagaggcttccgagtggatggatggataactcagttttttggatggtttgacactaatccccacttctagattaacctagctctgtatggacgtgttcggcaaattgtgggtttataataaaaaaataaaaggtcattttagtttagtgtcaattctcatcgtaggagtaccgactattttttttaaagcaactcaatgtgtagttttggataatactttttttttttaggctgggaatccttcccctcagcgcttaaaatggatttacagtctcacagattaacataaattattaagtattgattaaaaaactttaaaatagactaatataaatttttaaaataactttcctacgttttttttaaaaagacaccgtttagcagttccgttcggaaaacatacgtagcaaaaatgagagaataaaagtattaaaaaaggaaagaaaaagcacattcttaggcagtcatttggattggaacaaacttttaccaaatctatagagctgagatacatctgttcaaataaaaatttggcaacattaaaagttgaaatattacacctaataaaagatgttttaatcttaggcatccttacatctcacaccttttattctaaccctccactagtttgtattttctaatcttatcctttatagccctaaatgcccctattttgattagaaaatcatcgctctatcggcaaaagtttcttctaataacttagcatacattcataatattcaaagttgaaagcgacaagttaaaaatgagctatgtatatcatcaacccgattctctttgttttccctctcacaacatatatagggattttttttttcttctcaatacatccttacattcttcccctctattaagaacttaaaaatgacaacgaaaagtaggatcctcgtcatgccggcattagagagaaaatgtgcgattatccctgaccttctactacgttcttctccatcatgacaatgtgcgagtatagtggaagcttaatgtcactttacattccgatacaagataatcactagggtaacaaaaattcagctggtttcaaaaatcaagattcttcgtgtaccatgtgtgttcaacaaatgaacaacttttacacgtctagaaaaaggaaaaccttatatataatgatctaacacctcattggtttatatatgcatttctctctcagctctagataacttaatttttactcaatgctataaaatcatagtagttttaccaagaattttacgctattccttcaaagatcaaatcttcataaactatcatttggaatttctaggtttgaccaagacagctagacctactaacgttggtcttcatctactccaaactctgttcacgtttcaactttttatttatttgtaacaaaatagaagccttcagtttttttttctcctttaattttcggtaaaagtggttgcctcctggcgatgatgagttgtattagccggcaagtatagccatgaaggttttgtttgactttcaacggcagatttggaaccatgcagacacccacattcattggccgagaagcgtataagcactggggccggctctcctgttgcttaatttgtcgtttaattaattacactattttagtgaccgagtcgccatcgtcttaacggactgagcgtctcaagctacagtaaaagaatttacttagctgcatccaggtcaagcagggcggaggtaggaagttatcaagagtaggaccatgtagatgtagtttcattcattgtgtttaaatttcgggtttgtttggtttggaaccaatttttactctaccaaaatcttggtagtgctaaaatattagcaaatattggcactaccaaattaggtagtgttgaatttgaactattgtggataaaatttggtagcaaatcaaatatgcacttgctactattgaagttaccaaaattttggtagggcaataagttggtatcaaagcaaacaatcccttcatctaaattttagtgtttttccattgattattttttgttacatatggggcccaagactaaggccctgtttgattcagcttaggattattataatctagattattatgagtaagctgaaataaacagatagcttattatgatagattattacaatctatacgccagattattataactagctgggtggcccgcgcaattgcgcggctagcacccaaacaaattcatataatttttagtatgattttacttaaaatttattaaatagctatctcattatcttaagactttgaaagaccaaaccttatcatcctcgtgtttgtacatatagtttttaaaagtcacaccagttgctacctcttatgtcatctccttttttatttgcttgctcgatctaccactattttaattcattcttcttgaaacctttaaaaattggattttataatttttagagtttattgtcacgttgggttttgcttttataatttccatatatcacgttaaacgttgctattatactgctctacggtccatccactgtttcttctctttattgtcatgagatattaaaaatcgaacataattatcgtttgggttcatttttactttctagaagtcccgccaaaccgtcagcggctttgcgattgtactcctctacggctcacgcgctgcctcccttctttattgtcattgagattttaaaatcaaacatgattatcattggggtttttttttacttttttgaagttccaaaccttttaaaattggacttgtaattttattttttataatttttagaagtcccatcaaacggtaccactatgcccctctacagctcgtccgctgcctactctttattgcactgtgattctaaaaatcgaacataactatcgttggaatccattttttattttctagaagtcccatcaaccgtcggcggctctgcaactatactcttatacaccccgcctgctgcttctcctttttattgtcattgagattttaaaaatcaaatatgattatcaatgaggtttattttttttactttctagaagtcccggcaaccgccttacttgtttgcttcacggcctgcctgacgtccctccttttaatcgtcattaggattctatttagtgttttattaacagtttttatatgtcgtaacaaccgccaccactatactcctttataggcatgttacttaatttatctcgtcatgtgttttagatggtcatttcttttaatagtctttatttttatcacaaatttagttatttataaattgtatttctaattgaaatcttatttttctttttctaattttagaatttatttttttaaaaaaattagttaacatcgtattgtgttcttttagtgtttttattttttattttcaatttcagttgtttcaaaattgtattcctacttgatctctcttttaatttttataattttggatattattttattttttattcaaaattttaattaatctcgtattgggttttttatatggattcttctttcaatattgcttatttttaattccgaatttcagataatgttaaattgtattcctacttgaactcttcttttattttcttttgcttatttcggatttatttttatttttattctgaattttaattaatcttatttttaattctgaatttcagctatttttaaattgtattcctacttgactctcatttccttttttaattttggattttattttatttttatttcgaattttgattaatctcgtattagattcttgtattagattcttatatggaaacttctttcattatttcttatttttaattccgaatttcagctatttttaaattgtatttctacttggactctcctttccttttgtaattttggattttatttaatttttatttcgaattttgattaatctcgtattgggttcttatatggaaacttctttcaatattgcttatttttaattccgaatttcaactattttttaaattggattcctacttggactctcctttttctttttctttccttttctaattttggattttattttatttttatttcgaattttgattattttcgtattggattcttatatggaaacttatttcattattgcttatttttaattctgaatttcagctatttttaaattgtatttctacttggactctcctttccttttctaattttggattttattttatttttatttcaaaatttgattaatctcgtattgggttcttatatggaaacttctttcaatattgcttatttttaattctgaatttcagctatttttaaattggattcctacttggactctcatttttcttttttttctttttcttcgattaatgtgagaatttctagcccccacagcgaacgtgacgccacctttcaaagctgttttaataatataatagatctggtaatccactctaaatgtgctttttttaattattagatagctaacatctaacaaacagctaataatctagagaaacaaacaactaacagcttattctatatcaacttattataatccagcttatagtaatttggctcaataatctagattacaataatctcaaactaaaacaaacagggcctaagctgccccacaagtagctccgtccctgagcgcttgttgcatgctatgcaagcatgtatgtaaactcagtggcggagtcaggaaatttactatatgggatcaattattattattttagtatggtcatttatgtaaatttgaatggatttataggaaaaattaagattcaaagggcaatagtgaaaaagttgtggggttagccgacctcacaacttacacatagatctgccattctcagcgtaaacccggtttgtgccatcaagcaaaacaagtaccggttcgatggaaaatgtatgtcatcgctattattattggatcgccagtattgacgtaataggctattttaagtaaaacaaatttgtatttaaaaatgactggctagcatatatgagagcatagtataaccagtaagtttttttttcctggaaatatcttggggagtgaaagggagctagtggcatcgtggctcatgcatggctgtctacacatgtgagatggtagatggtactatctcctagttgagcattaatctataattatcgattgattaatcaaacgtgtgcttatgtgtgtgcacaactgcacatgctgatcgatgcaagttgacttatgcacacgggttcgtgtatgtgtatccatagctagccgacctattttgtcttgaagcaaagaattatacacaagtggctcgacctgttgacttatagtattaaaaaagggtacttttactttgcaacaaaataaagcacttgaattgtttatcgaacaaagagaagaaggagatacatgatggggtcaatggttagtgttatccaaatccgcttgcatcccaagggagagacggcagagcaaaatatctagagaagttttaacatctagacatatatatgtttagattcattaacatctatataaatgtgggcaatgttagaaagtcttataatgtaaaatggatgaagtatttcatatgtgtggttggtgtagacggagaaaaaagctattattttggaatttgtacaattatctaggcgatttcttaactcatccttttggcgtatgtgaaatgagaaattaaataccgaccattataagcttggaaaataaatttatttaattatttttatacaacttctatatagaatgcttttaaaagagtatcattttaacagtttaaaaacatgctaaaaaagagaaagttgaagtttgaaatcaaagaaaataagtaaataacatagcctaaacattctacaatttgatccttttaaaaatttatattacaaacagaccttccgcaaaatttgttctcccgttctctctctctttttttccacctttcggtgttatcatcgaatgggcctccggtgtaggcccatcatttcatcatgggcctcattcctgccagcccattcgtcagcccaagccgtcgagcggcggcgcgtctccgccgcgagcggcgccggcgagcggcatctcctccccacgccgcctcgccgtcggcgacgacgtccccagcgccaaggtcagccaccggcgccgccgccgcgcccccggtccctcctcccctttctctctggcttctctcatgtcccccctctatgccctccaccgcgggctgctccgccgcttcgcggcgcgcggccgtcgcgctcatccgcatcgagaagcggtgagctacaacccttgccgcattgcgatgttgtgacacgggcgagtcatggccgtcgccgccgccgccgccttgtcgtgccatacgccatcgcaacgcgccgccgcgcagcatagcagggcacgcccgtttggttccctctcaaatgggttcatctcgagcgatcggatgaatcggaatcgtcgaggcgctggaaggttcggttcggtcggttgatgatcgatttccctgtggtacgtacgattcaggaatcccatgcctgtattttttttctctttgcaaaaattccgtttcatcttccgctgcttaattctgcttgtgatgcgtacgaatcaggaatccacaggttctcttcagtgccaactagtattagttggtcccaatcttccagaatcaccatttctgcttggatgtttctaagcatgatggtattagtgaggtttgctcaatcaaactctatcgtgcacctgttcttctattttgacgaatcaccaacgattattttgtaataatcaggtgtcgtcctgctatgaagattccggtgccggaaatagaggagatgtatctgaaggagcacctgggtgttgatttagtgtatcattactttttttctttgacaaagaaagaatctatcatcactgatgatgatgtgaagaattgctagcacattgcttgactcgctcagcaatactttctggatcggtgagtccttatccttccctttttttttgctgcttctttatgttagcttccctgcatattgatctagattggttctgaaagatattacacgtggtaatacaggagttcttattcacattctggacagttaatccttatccaacatctctatcaaaaccatgtaactcttggtcactggctgggtaggacaaacacaaaaaaacaataagtaaatcttttcaggatgattagcctgacttttatgatgtgcaagagaagttgtacggacagtggccagcaatttcatagttaaatgaaaaatgaatagtttggtatgatataggtatgactttacgtatgccagcacatgaatggcattgatttcttctttctttattgttttatgttgatgaagagtcaaggtacaaaagtaaggaaatgtgaaaagagacatgcaaagaaatcacattaactgtgcttattctacagtatcctcatttaccaactaaatgcatgtgaactgtgaagtatcctacactatactcattttcttcctgctgacatctggtggaaagatttttctttttattttttttacattcatcaaccttgggctgcattcacttgcagttatttattgatgatgcatttttcctctcgatctctattccttaggaggttacatgaagtcaagtgcctgggctatagcagattcaattataaaaagaaaaacttgattaggtatctagtaatagaaattgagtaatgcccggcgaaaaagaaattgagtaatcgtgatagatatatatgcctgaaatgcatgcttgacggataaattgggttgtatatgaagtagtgtgtgtggtctacatgcactgatgcggatatttcagcatgggatcttgccaacaagattgttgaacagaaaattatttgcatttgaaagctttcactacatgacattatttttgtgtgaacccttttaattggctccgtgttcataactgtctcttttgtttcagcaatcctgtccatattcaaggtcaaaacaagaatgattctaccttaacatgggaaagctcgtgctacttgacaatgtcataatgaatcgcagtcaatctctgatattcgtatctgaagtctcctgcttgtgtccatttaccatgaaaccatcctggatgaagcccaatgaattgtggctgagaacagttgcctgattccagtcattttcatgtgccctcagttcactggcacttgatctgggaagaaaggtacacatttgttcctattgtattgctgttgacttgtcactatacacttagttctgcagttcctttattgtgtaatatcctggcattatttgtgatgtatgactctgcaatgtttggtaggcaacctgtttgagaggaactgcccatcttgaggtaaaccctccaggccttgtcgacaatggattcgagtcagcagtgctttatatatgcaggtaatttgttaagaaaactcatatcaatcaatatgtcactttcatctgtagactacccagacttagatatgtctatgcagaagtttctcatggcattccatacttcctaagttcctagtcccgattccaacttcagtttgcattgccaattgcccaattagcgtatggaaatcttttcatgcttttttgtttggatgtcaagtctgattgattagtctaaccaaatactgaaatactattctttattgcatcagctcgcatgatggttatttatctctgaattttccatctttcaagtttcaaacatggtcagtagtccaacatagcggcatacatatatattttttctttcgcaaataagcagacatgctgcttagcagggagcagatctggtgcagttgtgcgtagtccttaacgtcaaatctttttcacttccattgaacggaagtgcctgtcacatgtccttagacaattctttgctcctttagtacctttccaaccagattaatcctcaaggtgcatgacttccaagtactttcaaagtacgataggggatcgatggatacttcggtggttcttagtccctcgttctgttctctgactggaatattatgcatccatggtccatatggatctatatctggtccctcatctagattctttctgggtagttttccaacaaaattcaatgatcataacatcaatgaaaatccacaggaactcatcaggcatgtcgggtttgacagcaatgcgaaaggatcctgtctatgattggtgtctggtgaccatcagcagcggctggtccgggaaaacggatgccacagaaggatatagcggctcaaattgcgacctgtccaccccaccaacacaaaggtatatttggtttttgacctaagttcgctacacccaatcttagccatgccatttcatgccacaatttatcaggaaagcgtttgattaatttgattaatttctgcgacaatagcaacccatctttgttagtgttttggcccacttgttaagttgttattctaaccagactgtcaacaacaaaatgtcacggtttgtatgccgcggcacaccttaactaattttgttgtagtaaagttacttatcaaataaatccttaaccatataatataactttttaaagatgaggcgttccacaatttttatggctaacaaattattttccatgaggaaactgggtctacgataagagaggtactaaatataatgttttgtggtgtgtgaaattttagcagtaaactagttggttagtcttgccaaagatgtatcgaagtgtggccaccaatcgaaaacccttagtagccacaagccggcaatcctgaacttccactgttggaggatttccaattagaaaaagggcggtcaaatgttacagttgaccaacaagtgaaacattaagttatatatgaaaaaaaaaatcagcaactgaagcatttaaaaattttgtgaaacacggtgaagatacacattgaaacatgttgctatcacatataaaacaacgagtgttaacggattgaaaatatatgttttttttcatcaaaatataatcatgtgatatcttattataaagatttaattacaacgaatacaatggtgcgatcggattgtagattggataactaggtaggagaaaaatcattttgaagatcgctaaaatgcatacatacatgcatagagtggagagagagtagtgacaagtagtcccgtgaattttgtgaaacacaccacatattgaaacatatcactatcacgtatgagacattgagttttaatggtttaaaagacatggttatattttattataatataatcgtatgatatcatgttgtaaagatttatttacaacgaatacaatggtgtgatcggatcgtaaatcggataagtaatttaggagaaaaaaatatttaaagagagaagaaaggaagaataagaagaaattaactagttaggagtatgcatgtgagagtgtagggtgctcgagtctgggcaatctctcatgcatatgcaaacaattctctatgtatagaagggggaataagatgaaatttgttgctagggtcttagtggacaacgcaattggtgttcggatctcattgtatcccaccattagagtttgaccagtccccaaaattattattcgaacaaacatatagtaaatccgtagaaaaaattgccagtttaaaatatatgcatctgtaaggccgtttacacacaaagttccatctcttcctctctagaacgcagttcaaccatgttgtaacaccgggctagctttgtcacaagtcacaaccctgttgaactacatcaagaattcaaaaagaatgcaaaattgcagcaatatctgctcccataccatccgcccatccccaattagatcctaatcgaatggttatatttctcctccattttacctcaaaagcttaaaaagaaaatctaagctgtgtttggatccgaatcccagaaatttcccagagacgaaaacccctcatcctccaaacacccgcttcaaaattccaaaaaaaaaaaagagaaaatgatcttgatttgaaactgatctacttgttcaagccccaaatgcgtacgtacgtgtgcacgcgtcaccaaccccaacttctcgaagaaggaagcgcacgcatcgatcgatcacgagctggccggaccaggtcgaggtgagggtcaaagccgacgggctacggcggcggcggcggcgccaccaaactctcgacggccttcgcgatagcttccttgagcgacgcttcgtcgaattcgcccgcctgcaaaggttgtcgcaagaatataaagatatcaatcattttttttagataatgataaagatatcaatcatatgctatatacacatggttttggtaattaaattctccagcatataaaaaatacacatccacgtgctgcactgtctactacagtactccctccatctattttctataaacttaatcaaacttaacgaggtttgactgaaaaaaatcaacgacttataatataaaatagaggaagagtatatacaacctcattttaataaatgacgccgttgatttttaatcatataattgaccattcatcttattcaaaaaatttatgtaattataatttattttttttataagttgttttatcgctcaaagtattttaaacatgatttatatcttatacatttttataatttttttaacaaaactaatggtcaaacatgcgtttaaaagttagtaacgtcatttattaaaagacggagagagtatatgtttaccgtggagaaacatttttttttgtgtgtgtattgtaacaagtatttcttgattattgatacggtgtgaggacctaattggagccttggaccactactactttctactggaatatagcgctaagttctaatttgattttctttttttgggtaagaatctagatatatgtagaggagtaaagatatatccatactcaagattcaaaagttttgccgcacatatatctgacattaattaggaatggacaaaaagaaaaatcaaatatcatggctcagcttggatcggctcattgcaaacttgaccatggatcgacttgaattcatatatcgtaatgagttgagctaagcttgaggttgagggaatcatgcgagctacccgttcatagcatacaaggtcaccatatctttttatacttcggcttattaattagtggttaaccctttaaattactttcaatccatcggataattatccactggtttactagttagtgtttattattttaaaatagatgataaattagtatatgctgaaattatagaggtgatataaatgagcctaataacgagcaacgccctatgaaccgagttggctcgttatgaccgtatatgtcacaacgggctcataattaagtagttttaggcaattttggtctaaggttatggttccatcgtttgcttgttggcttatcagtcacaaccaaaatttaaattttaaaattaaaaattattatactttatttttgtatattagctttcaaatcactaatgatatactgacggggttaatttcatggactcataagaggggcaactagccaaaccactggcctggtcaaagtcaaggcgagttgattgaaacggcccggtaattttatcttgttcctcctcctatggctagatgaagctcttcaagcaattctgcagatttggtgcagttaccagatgaagctcttgataaactgtttgctgaaaggaacatgacatcgattgggatttggatggaaatgaattgaaaacccgggcctctagtgttttggacttgtatgctgtctgtccgtgacgtcatgcatcccacacagcaacagccaacaggggcagtcaagttttccagttgagttttctccggtgggccccacccccgtcgctgtagggtaaactaggctgatctggttgactttgacctaggtttgaacaaccaaatctctctttcttcgtcactcacctctctctcatgagcccatgacaatgaacacaaaatggagcagctcaagatagtagaccagctaacagtttggatatatatatatatatatatatatatatatatattgaaataattgttataaacatttgtgatcattgattatgactagttaggtgagatatgcacaacaattaacagacgtctggaacggaatccaaatataacatatatacgaaacaatacaatctctatttgtaattttataaaatcaatcttgtgtttcaaataaaggctacatataaatattactagcattaagcttgcactacgaatgatatatataaaaacggatactccctccattttaaaatacaagacatagttcaatcttgataactttgacaaataataaatcataatatttatgtttagtgtcatgtatataagttagatttgtatttgaaaatattttcacatttcatataatgtgtagcattaggcaccgtataaaaaaactatatgtgtcttataatcttataatttggtcagaggaagaatgattttttgcacgaaacatacgtttcaacagggtaagcatccgtaccgttgctcgtagtgttaggctggcctgagcgacgccattgccgccgccgccgcccggctgcctcgcgtcgacggccaccaccgtgaagccgcccatcgccttgagcagtgcgagcacccggagcacgagctccgacacgtcggcgccgccgcgctccggcgcccgcaccgccaccctcacggtcacctctggcgccgacgacgacgacgatgccgatgcgccgccgtcgtgatcaccgccgccgatcacatggacctgcaccctctccggcgagccgccggcggcggcggcgacggctagccattggtgattatggtgatggtgaacctcgttgactgttcggatcattgatgatctcgatgatgatgatccattggcgcgttggtggatttgggtttggagtgctcggttcttggcttcgagctccgagatttgagctatcagcaagttcatgtactctagtgtcttggcaagaactgtggccttgtctttctgaaatgccagtagttgatttgattaagatcgagaagctattaataattagtagaacagattaattagcagagttaatgtgcaatacgcaaaataaaattgtagtaattaaaactggaaaaatggcaatgtgtagtatttcattggttagataatggaaaaacgttaatgatttccgcctgatctgtacttcaatctgatgagaacaatatgcaagtaatataagattctaacaatttgaactagcaaataatgtttagaagcatttcaggttgaatttgaacaagattttctggaagctaattaaaatgggtttaatttgcattgcaacaaggacacaagccacaaggtcattaacatgatggtgcaattaactcatgttaattattaggagtatagtttacctttgatcctggaggaagcaaacctctcaagtgctcgaagctctcgttgagccgctcgcgccgccgccgctccgatatcatatggtggagctggctgctcgtcggcggcggcggcgcggccgtggcgtcctcgtcgtcgccgccgccgctccgctgtgccgcggcagcgctggcagcggcggcggcggcggcggcgcgctcctggctgcacctgaccatgtgcatcctcctcaggatggagaagcccatcttgatcatccgctgccccggcgcgcccggcggccgccgcgacgccgccgcgcgcggcgccagcgcggcgttgtacgcccggaacgccgtcgtcgtcggcgtcccacgccgcggagaccggatgatctgcgcgcggtgcttgacggacgaccacggggcgtgcagcgccgccgccgaggacgacgtcgagggggaggagatgacgtcgagcatcgcctgtgccatggcggcgtcgtcggcctcggcgctcgggaagtggaggacgccgctgccgccgacgccgccgtggcgggagaacggcgacacgtggacgtggtgcggcgccggagggcgcggagagccgggacgacgacgacggcgtcgtcgtcgtcgtcgtcgtcgtcgccacctgcgccgcgagctctcggggcgacggcgtggcggatgacgaggccatcatgggcgtcatcgtgcggagcagcgacgtggaggcggcgccgtcggccgggctgccgacgagcgaggacgacgacgcgacggccgcgtcggcggcagctggaggagctcctcgagcagcgactgctggaagaagtcctcggagaagacctgctccacgctcgcctgcaagctgccgccgccgccgccgccaccgtagttctccgccggcgccgtcgagaagccgacctcgatctcgccgctctcgcatcccatgaacgccgccatctgcacgccaccaagaatggcccatgtcagcttcatccttctcgatttctaacacgatcatcttacgaaacaatattatgaaatggattacgaaccttaatgccagcttcctgaaagaattttaccacaaaagatcatacgaattcgttagtaaatccataaatttctcaggtgtttgatcaactaatggaacccaaattgatcaagaagcaagtggatcaagcagatcgaacaagtgcatgcaccggtgagttccgagttctgacctggtagaagctttgctgcaccggcagcgaggcggaggcgacgagctcgagctccgagagctccatgaacacgccaccgccgccgccgacgtacgcccaccccggcacgcacccggtcacggcgccgcagacggatccccggtacgcgtcgaacagcgcgcgcacgcagccgccgccgtcctcaccaccggagagccatccgtcgacgcagtagagcagacgcgcagcaccggcggcgccgccggaagaaggacgctggtggtgcaggccggcggcggcgacgagggggaggggagcccaggcgcagacgtaggcgcagccggggaggcgcgcggcggcgcggtggaggatgcgctgccgggactcttggccgagcacgaagatggtgtccatgcaacggccacgatcaccacatggtctccatgactacctaacttaattagccaacccaaactactacttcttcttggcccgcctcggcgagatggcgcggttgccgtcgacgatagaatgggagatttaggggtatatatatgcgcgcgggaaggaggggagcaaaggtgaagactgaggacgaggacgacgacgagggctgcggcggagatggggatgcatgggaaagacatgcattgatgcatgtgtggatgggagtggatcggaggcgggaaaagtaggaaggtagcttaggaggaataggagaagcaagaatggtgaaatgatggtgggggtggattggtgaagggtttggtttggggagaatggatggagacattcatggatggatggatggaaaggaaggaggttgaaaagtactaggggtagtgttatctattggaatagaaagtcgttcaaaggtcttccctgtgtgatggtgggtgatatgatgctgggtgccttgatagcttaagatgatcttgaaaaagggtcaaacaaggtggcacaaacgtagctaccatggggggctgcccgctgccctagttctgtgcatgtgttgtttaaaaggccaaaaaaaattgataagatatatcaatatgcggatatgctattttacaaacatgtaaattcaaattcgacttatacaatttaaaaaataaaaaaattgataattgtataagttgaatttgaacctgtattttttagaatgacatcacatattgatctattttactatttttttcaaatctttatagagaaaattaatttaagtgacatgtaaaaataagaggatatctcctcaagggattaatagagttccctaggctggctgtacttggaggagccaagccactagccatttttcggttagctacttaggcctagttcgaatgtacaatttgatttgtcttttcggcaacatataaaacgatataagttattagcacatgattagttgaaataaattattataaacttttaaaatatgtttgtttgatttcttaaggaaacttctacataaaaagtttttttttttagaaaaacacacatttaacaatttaaaaagtgcatgggctagaaaaaaaagttacaaacaatggagcttaaggctcaaatagtggctgagcgtgaaattactcaacattaggactgtactagggctcaaataccaaaatttatatagtgattaaacttgattttggaggcatgtcggctgtcacataaagcttgattaatctctatggtacgtatgaacctcttgttattttaatttcatcctgttttattttctgcaccagcagtatgcaatttcatattgatatagcaaaaagaattaaaaaaaatatggaaggctacaatcaagaaaaaagaaacataacaatccaagaaatggactagcaccaagccagatgccgttacctctacggagtggtcacaaacgcaccacccatcaccaactccaagcaaaaggtcgcccaaattagactctcatatatacccacggagaaaggttgccgagtgagagggtgagagaaaaagatacactcgtgcatcacataaacctaatggtgaaaccatgagagtcgctaaagactaagatgcttgaaggcagcacatgtgagaaacaaggcatcttaattactccctccgtcccaaaaaaaaggcaaaccctaggtttccgtatccaactttgacggtccatcttataattcgtatttttattgttgttagatgataaaacatgattaatattttatgcgtgacttgtccttttatttttttcataattttttcaaataagacggacggtcaaacattgggcacggaaaccagggtttatctttttttgggacggagagagtagacaatacttctagagaggtcacgatgtcaagagaatcgccaccacctggccaagacacctcggacttgattttcacatgaagagccccactagggagggagagagagatgcctcacaatgtccagccccaaggggggaccgtgacgctcaagctattgttgctagtcctaaaaaaatgtcgagccaggctttcgcctacaactccctcccctttgagggagtgcccaatagaagatgacttgccgccaccgccattgatattgttcggttgaatcgaacacgccatctagaggcaccctcctttctgttgctgcaaccactagcctcacctgctgcaaagaaacattcgctagccaggaagcttgcccacagcctccggtagcctttgccaacatccaggccatgactaccgctagcctctgccgctcacaccggccacccgctagagtcgcgcacgctagctcccaccaaggcttcaatggacgtcgacgcgtacccaattgaccttggctagatctgccacagaggcatcggatctagctatagcagcgctagatctagccaccgatggcagtgtcctcttaaagccttcaaggccacagacggtgcccaactcaatgtggtgaagccccactgctgccttcattgcagtcgtgcagacttctggtggctcactgatcagacgacagtaaggtgtagagaaggaagaggaatgacaggggcagtgacgatgagttccacatgtgtcaccctagagatgatgcggggatgtcatgttttattaggtctagtttggaacacaacaattagttttccttagatttatagaaatagaattgactaatgtggaaatcctacatgcattgtgttagtatgatgattattgttatcatgcatattttgttttatgcttgagttattcaagattagtaagtgcgtgggggtactttagttgttttttatatatcaaatatttaattctcacataatggaagagtttcatgaaaataaaaaaacaagagggctcgagatagagcaagttttaagagaactagctgggtggcccacgcaattgcgcggctagcacaaaaaaatcatatattttttaagtatgattttacttaaaatttattaaatagctatctcattgttaagactttgaaagaccaaaccttatcatcctcgtgtttctaattatatactttataaaaatcacaccagttgctaccccttatgtcaactccttctttatttgcttgcttgatctatcactatttctattcattcttcttggaacctttaaaaattggattttatagtttttagagtttattgtcacgttgggtttcgtttttataatttctagatgtcccgtcaaacgttgccattatactcctctacggcccgtccactatctcttctctttattgtcattgagattttaaaaatcgaacataattatagtttgggttcatttttactttctagaagttcccccaaatcgtcaacggttttgccattgtactcctctacggctcgcccgctgtctcccttctttattgtcattgagattttaaaatcgaacatgattaccattgtttttttttactttttagaagttcagaacattcaaaaattggacttgtattttcattttttataatttttagaagtcacatcaaacgatgccactatgcctctctgcagcccgtctgccgcctactctttatgtcattgtgattctaaaaatcgaacataactatcgttgcaattcattttttatattctagaagtcccgtcaaccgtcggaggctctgcaactatactcttacacaccccgcccgctgcttctcctttttattgtcattgagattttaaaaatcgaaaatgattatcaatgtggttttttttttactttctaaaagtcccggcaaccgccttacttgtttgcttcacggcctgcctgacgtccctccttttaatcgtcattaggattctatttggtgttttattaacaatttttatatgccgtatcaaccgccaccaactatactcctttataggcctgttacttaatttatctcgtcatgtgttttagatagtcttttctttcaatagtccttagttttatcacaaaatttagttatttatgaattttattccttattgaaatctttttttttctaatttcagaatttattttttaaaaaaaatagttaataccgtattgtgttcttttaatgtttttatttttaatttttaatttcagttgtttcaaaattgtattcctacttgaactctgttttagtttttctaattttgtatattattatatttttattcaaaattttaattaatcttgtattgggttcttatatgaattcttctttcaatattgcttatttttaattccgaatttcagctaattttaaattgtattcctacttgaactcttctttattttcttttgctaattttggatttttttatttttattttgaattttaattaatctcgtattgggttcttatatggactcttcttttaatattccttattttttaattccgaatttcagctatttttaaattgtattcctacttggactgtcgtttccttttctaattttggattttattttatttttatttcaaattttgattaatctcatactgggttcttatatggaaacttctttcaatattgctaatttttaattctgaatttcagcaatttttaaattgtatttctacttggactctcctttccttttctaattttggattttattttattttatttcgaattttgattaatctcgtattgggttcttatatggaaacttctttcaatattgcttatttttaatttcgaattttagctatttttagattgtatttctactcggactctccttttcttttttttctttttctccgattaatgtgggaatttctagcccccacagcgaatgtggtgcctcctttcaaagctgttttaataatatattagatagattgagaggtaattaaacacttgctctattcttaacggttgcaataatttgacagctttcatcatcatttcctaaacggttgaacttaccgcgaaaactcgcatcccggccatggcattggacttatttttgcataaccgaggggagctacatatgtacagtatatatcctatggtcaagctggtagagtttgatcctttttatgaaagacatgatagtgccatttaccaaacgcctccttaattggatctcaaaaccacaaaaagtatatgcagtcaaaatcattgatagacacaacttagagaccaaaggtttggttatccttatattatatttctattagtccttcaggttaaaaaccctgagagattcagattcttcgtttcttttctcccctccttttcgtcagttgatttggcaacaagcagtttggttaatttaattaagatgcataaatatgaatacatggggtccatggagatcattaacaccgtgcacttggtccactgcttttgggcctttttctctgctaaattgggatttggtcttcgcccgtataccattcttcagtaatcaggccaggtcaaggatgcaactgctggagtgctggtgcacagcacagggtgcaatggaccatggcatctttcgtactatcctcaatagaacaaatgctaattaatcggttcatcaattaattaatttcattgttacattgcacaatactacatttgcagtagtactactactagtcgtagtcaaagaaatgcagtggctaaatggctaatgtgtgctttgttttagcttattaattaatcagctgatgatcatacgaacacagcgcgtgacactggttcacattgaagctctagttgttgattgggatttcattattagtttaagttgctgctggaatattgtatgagccatttgggtgcgtaccaacctcgatcacaatctggttgcaattgactattagatgcatgctgtcaattagttgtgcagaattgtagtggtgattggtgaactagtgtgatgtcataacatttgatatttagagcaatatgcatagtgtgaacttaacctagattgctagagaagatggtaagatgaacaatatcaaaggcaaaaacagaggaatattatcatagtaaattacaattcattcctatacacgacagcttctttggaacatatggattttacaggattttcacatgaacaattagttaaatttccgtataactcctataaaaatatcatccattcgaaaggaggattgaatagggaaaaaaaatcgtattccagacttggaaagtaaagaagcctttcattcacaagtgttcaccacctgtgagtcattttaaatgaaaccttagttaacattaacatgggtgctagtttcagagccagtcaaatttcagtcttctttcgcacacttccgccataaatctaactaaactttagatagtactctgaagttgatcaattaaatttgttgtctctgaaaaagaccacaaaaaagtattagtattctccaatctttagatcctgccaaactgcatagatatgctatccaagtccacccggaccaaatgaaaactacatatatgcatgcacaaccgaatcttgatgccattgacagtatctgatttgatgcagaaaagtagtcacttacttgatgacatgtcttgtataattttccctttaattaatgcagataaaatgttttgcttagatcatttgattagttgactgggatccacatccactcgatctagtacctcataagttgagtttaccacttttaattgattccaaatctagctaacacctatttgtttatcgatttaattacttagtgccacatgtctgcacttttagaggtttgaattaggttaaccatgcttgtacccgtaaagttgtaaacctccctttttgacaagttcggtgagattcttgtataattaaaagctccaaaaggttagtattaccagcaaacaattaattgctaggacacttggcaagcctatatataagtattatatatacaatgtgccgcatgtcttatatggtggttatactggaacttgatcatttgatctacaaaggatatagcggtttttttcgtaataccaaattcatcataaaaaaatattcgtaaaaaatatacggcagttttgtatgtgaaacggacgtgactacgtgtccttgagacaatgagctgcatacgtcaaatagaaagacacaaaagaaaataataagttgcaaataaattaaaggaacttataaaattctaatggttgacaaaagatttgtcttggaaatggctatcatacgaaacaatgaaattgtttggaaaattacgaagttcattgaaaaaaaaaagagacatctttgaaacgttttctcaattcatgcctttgttggtgcagtctttggctggtgagttggaacttggaagtagcggcagcaacactgcattttctttttcattttttgacgaaactactgcaggagataaattacacgtagttaatatattaaaagcaaagaagcttatgtacaagacaggaaaaaaaatacaaaagggtaagccatgcttctacgtgatttctcatttctctagcttttgtctttattttcaaaagatcttccttcaaaagacgtctccaagtagctatcaaacctactttagctactttagcatcaaaaggttactccacttcgctgattactccattacgctgtttctaaatatgccaagcagcatagagagtcatctcgataaaatttaataaactataaaacttttagcagtgaacatcgtattggaaaaaacaaactcaactaggtacccaaatgcttcacaacactttaagttttcttacaattttaatccgtgcgtcctattaaagacgatctgttggc

SEQ ID NO: 2997 - DNA, 3614 bp, Oryza sativa
tttcgcatgcggtcgttttcgagggtcaaattccggtcaactcaaataatcactgcaggtcgtcgatcgagtctgtagctacagacttaatcaatgatggattagtaataattgttattatctgtcacgattttgtatgtgaatgtgacagtatgtgtgcccacccggccgtacaaatgtgattagtctttggtttcgtagtaatccatgttagcctgagctatactataagctaggcgtgcgtttatacgcgcagacgacctgtttgtgtcccgtcgatttcatttgccacgtcagcttgctgcagacccacagttcgttggctggaaaatgagagacgggaaaaggaagaaggggatgaatggagaagccatgggtattttagtcctaaaatataagaaaatacattgaaatgatacgtagtggtacatcgaaaattataatgatatggttacaaataggtgaatagtaatggcatattttaaaaccataaaaattataatggcatggatcaagtttcctctggaaaggatggattaagttttggattttcgtggcacgcttttcaaaccgctaaacggtgcgtttcgtgcgaaaactttctatatgaaagttgttctaaaatatcatattaatccattttcaagtttgtaataattaaaaattaattaatcacacgttattaccacctcgttttacgtaaaatacttaatcttcatctttatctttatcttcaggagattcaaacacctaaccaatgaaatatatactagtattatgaactcggacatatatgtctcattcattatggttattataatttgggatgaaggtagcatgacattttctttatagattccaataagaaaatttcatatgaaatactttagaataaaggattaatataatatacctttgaaattgggccaatccatgagacttttggaggaaaataattatagggttgtaccgcatgtttctttcttcctatgtctcatcatggttcctgtgttttcttatgtgttattcaaatgattttaaaactttgcctataattttatatttttctttcatgtaatgtgcatggcatcctatccatgtgttttcacaattttgcattcagaaggggctttagatttttttttatccacattgatactaagctcctcttaagtatcttacattttcttctaaattttatctctcaatatcttctattacctcaatcccaggatataatgatttgtagggttgaacataagtattaagtaagtagatggaattaaatgtgaaaagattttgattagtagagaggagaaagtaggtgaggaagttgttatattttagaacaaaatttaaatactatgttattatattttgagatagaggaagtaactcacagtgaaaatataaaaatacatgagaaagaagatattataaagagtaaatttaagaaaactgcaactttagtgacaaaactatcagtttgctacaacattagcaacatgtttcagtttgcagcgacatgtttcagtttgctgcaacaataacttttacaataacaataacaatagcatgtgaaactatcacaaaactataacttttgcgttatatgctgctacagtacatataggtgacaactgtagcagcatataacgtaaaagttgcagttttggaataatttttcacgctattgttacagcaaactaaaacatgtcgctaatgttgtagcaaactgatagttttgttactaaagttgtagttttctgaaatttactctattataaatgtatgtgaaataatatatcataagtcaaaatttactatgtgacgctctaactatgcggcattggacatatgtgacactaaaacaattatgtcactaccactggacacttctatttatcgaagcacactatattcactatataaatatatttggttcaaataaatactcatttacaaataacgctttgtgtcccttagccaaatcattgcaccaatcgattgccgattcgagatctctaatcccttgccactcccctccccaaatcaagcagccacatcttcgccctgatccgtcaacaatgttttgtcttctggcgataggacctagtttgtggacgatggttgtgtggtagtggtgattgtgctggttcgctttaattaacaaaaacaagttcgtttggccaatcctgatggagcttggcatcgctgaattacttgtgaatccatcgtcaaatctcctataattgattagaattcctcttgtacgtgatttgaaagatatattcaggtgagaaacctcttccctccggtgacttgttttttaaaaactagtacgtacacatttacggtatagagccttgaagaaaccaaaaagaaaaatagaaagaaagaaagaaaagaaaagaaacgaaaaaagggagaaaagaagaagctaaagcgaaagagagacattgattgaaggctctccgcagctactagagttcactgagatatatagcaacagtggtgaagggatttgagattaggggatgagagggtggggataagcaataagaccgagagaacttttccggtacaacatactgatggtatacactgccagtataaatgatttaacagtgcagattgatttgatcttctaattaattggtttgcagtacaaaaatttagaagggtagatttgtctttcgatgcggtggttcaggtccggcctctccctccttggtggcatcgttagccgaccaagggctctcagcatgcaccaattgcgttgtcgggcacgcacacaggtgcatgaggttctgtggccacttctagcaccttcaaggtgctgctatggcagtctctggaaactaaaatttgcttgcatggacaacagcctatagcaccgacatatgagaataatctaggtgttgtggtgtatgttagtattccaaactaaaatgagatattgtgttttttacgtgcgccgcaaatgtggaatatgaaactgcatttgtcaggtttgccgccgtctctcgtgagtgtagccaagcagcgacgagtcacaccgtcgccatgcgcacgccgtcgaattgcgtcgctgccagagctcgtcttcccctgtctctcgcgagcctgtcttacacattacgtcacaaatataatataaggattctataaataaggattaattgagcctgaataatgaattacaattttttatcaaattcctaatttacccttgtaaatactagcagcatatactgccagtacaatgtactgtaaaagttctcaagactgattgaccaatatcaatagcaaagaggtcaaatagtcactatcaataacaatcaattcgtaaactagttctttaaaaaaaacttcaattctagctctttaataatatcattgaaagtttggaacaagtctttattgctaaatcctttcaatctaaactactgaataatctcataaataagtatattctattttaatttgaaaaaaagatgagaaatcacaaactaaatttgaaatttgtagatcatgttctttctaattttttttcagaactgatcttgtaattagtacagccatataacaacaggtgttgggggggggggggg

SEQ ID NO: 2998 - DNA, 18566 bp, Oryza sativa
ttttgaataagatgaaaggtccaatgtttgttaaaaagtcaacggcgccatacattaaaatacggagggagtatttaatacttcacgtatgtcttcaaacattcgatgtgacagacatggtgaaaagtttttgcgtgaaaactaaacagggcctaagctaagaacactagtagccagtctacttcatccaaaaaaaaaattaatagtaactaatatttgtcaaaaaaattgattttctattctatacctatccttagttcacaaatcaagttctatcctttcaatacaccttattttaccaacccattaacactatttttctattaatgagagatactttggtcttttatttctcgatgcaaaatttttcttaggatcctaagaatcgatttattttccaacggatgaagtaggaattgggaaaacgaattgcatacgcttgttaccttccgaagaaggtgcacattgtcaggttagaatgtcgatcctctacaatactgctcgtctagcagcagttgctcctgcctcctggttcttgttccacatcagtgtgtggctgtgtgcaccagtggtattgtggaaaatcccggcattcaggagttatttgataggagctattttcagttgtatgaaaattctctataattccttcaacctaataaagtaatagaaatcaaccttaatgcctcctttagaataaaatgttttcacttaaattagttgaattcatctaaatttcatccaaaaaaaaatcctccatagcaaggaaggccttaatcgcaaatctatatacccttctaatccaacctaaattttagctgaactggctaggtttacggttgtggaatcagccacccagattcaaatcctaaatttaggccgtgtttagattcaaaattttttcgtcaaacttccaacttttacatcacatcaaatgtttggacatatgcatggagtattaaatgtggacgaaaaaaaaaccaattgcacagtttgcatgtaaattacgagacgaatcttttaagcctaattacgattacgctatgatttaataatgtgatgctatagtgaacatttgctaatgacggattaactaggcttaataaatccgtctcgcaatttataggcgaaatatgtaatttgttttgttattagtctacgtttaatacttcaaatatgtgtctatatacttaaaaaaaatttagcacacgaactaaacatagccttaatatggatgctcacatttacgactatctgttttttaattgataggcaacatacctatcaacaacaagattttatcaatctcaagatatgctggcccaattgcgaaggggagtgtgtgcgtgatgcgggcggccggctgcatttctactctttctcatgccaaacgggcccacgctagaataaatgaaaaatgtcgtgggcccacccatcccacccgcagaaccacctccttcttcccttccagtgcgccaactccctttttcactcagctcagctcagcttcacactgcaccctctcccataaaaacctcgcccccatctactgcagctgctagcctgcaactgctcccacttcactcctcttctcgcgagtcgagtccaaggatcaaaattaagcagttaaaaactgagagagaaaaaaaaaacaagaaaagaaaggcgagctctccctccatcgccattgccaccctccacaaaacaccgtgcggcgctcttcacgttgccgcctcgcacgcattgctcctctccaagaagcagctcactgctctctctctctctctctctctctctctgtccctctctctctctcacgccaagagagagggtgagcagaggagaggtagctagctcggagctttctttggagaggggacacacttgcaatggcgccggcgccgactccggctgccgccgccggccgccgcgtggcagtgctggccgcggcgctcgtggcggcctccctcgcggcgagcgtgggcgtcgccaacgcggccgtgtcgtacgaccgccggtcgctcgtcatcaacggccgccgccgcatcctcctctccggctccatccactacccgcggagcacccccgaggtacgtaccccccatccatggccgccgcccaaatgcaccacttctcttctctctctctctctcacgtacacctccggtttctgattcttgcttcgtgtgcttcgccgtcgccgccgccgcagatgtggccggggctgatacagaaggccaaggacggcggcctcgacgtcatccagacctacgtcttctggaacggacacgagcccgtccagggccaggtactttcactctcacctcaccatttcttcttcttcttcctatgagttcttggttgatgacctcctttttatggcagtactacttcagcgaccggtacgatcttgtcaggttcgtcaagctggtgaagcaggccggcctctacgtccacctccgcatcggcccctacgtctgcgccgagtggaactttgggtaacgattcttctacagagtctcagtgttcttgggtagattttggagcagaatgtagcagctgcagcattgcagtttcagtgtgtgtttggttgcaagttgttgcatctgaaaaacgtttgcaatgttggtgattcttgcaggggctttcctgtctggctgaaatatgtgccgggggttagcttcaggacggacaatggcccgttcaaggtattgtgctaacacgaatgcagcaattttggtctcttacattcttcaagaattggggtttatgatgtggtaaatatctggtgcttgtaatcgtgtaggcggaaatgcagaagtttgtggagaagattgtgtcgatgatgaaatccgaggggctgttcgagtggcagggcggcccgatcatcatgtctcaggtgaatccctgaagaacagcttctctgcttagtccgttgcaatctgcaatgcagctagcttagagtgtagcttaactgagaattgatgtttctgtggtggatttggtcaggtggagaatgagtttgggccgatggagtcggtcggtggcagcggtgccaagccgtatgcaaattgggccgcaaagatggccgtcgggaccaacactggcgtgccgtgggtgatgtgcaagcaggacgacgcccctgacccagtggtacactgataattgatagtagaaactggaaacaaactactccaccttccttggtggtgtcaaatgaatgagtttgttgtgcagttcactgtgccagactgcgagttcttacccttttttatccccaaccatggcagatcaacacttgcaatggattttactgcgactacttcagcccaaacaagaattacaagccgtccatgtggactgaggcctggaccggctggtaattttcttgttccaactcatgtcgcacttcataccatcctaatctgatgggaatgatcttactacggttttacattttactgcgcgtgaaggtttacatcgttcggaggtggggtgccgcatcggccagtggaggatctggcttttgccgtggcgaggttcatacagaagggtggctctttcgtgaactattacatggtgagaagagagggggctcactggtcacaccaacactggtgttgcagtgaatgtagttttacttgttctgaccgcatttcatgttctggtgcagtaccatggaggaaccaattttggccggacagctggtggtcccttcattgcaaccagctatgattatgatgctccgattgacgaatttggtatgcagtgattgccttctttgataaacttgaattcctgcctgccttcttgagatattttcggaaatttgctgttttttatcttctgtttataatcttgattgacatggatctgactcagttgataaacggatggcatgtacatctcaggtctgcttaggcaaccgaaatggggtcacttgagagaccttcacagggccatcaagcaggctgagcctgtgctggtttctgccgatccgacaatagagtctattggcagctatgagaaggttggtgttgctacaatcttgcacacaatatatgtgatcatccatagatattcctagattcataattggtcaaatcctttaggcatatgtcttcaaggcaaagaatggagcatgcgcggcgttcctgtcgaactaccacatgaacactgcagtcaaagtcaggttcaatgggcagcagtacaaccttcctgcttggtccatcagcattctgccggactgcaaaactgccgtcttcaacactgcaacggttagggaacactgaagcttgaacctttatgtggactagctggaccttgctggagcacatggtctaatgtacttacatgataatggcacaggtgaaggagccaacattgatgccaaagatgaacccagtggttcgattcgcttggcagtcatatagcgaggacacaaactcgctgagcgacagcgcgttcacgaaggatggccttgttgagcagctgagcatgacatgggacaagtcagactacctgtggtacaccacatagtgagtgaccaaccttgatatgtgacaaaatttcaaccatttctattagaagccatatgaattttcccttaaccctgatgaattcttgttgcagcgtcaacattggtacaaatgacttgaggtctggtcagtctcctcagctcactgtctactccgctgggcactcgatgcaggtgttcgtgaacgggaaatcatatggtactggcacttagctacatttcatgttagatcaagccaacaccaatcattttagtgaatgttcatgattttgcttcctccgtaggatctgtttatggtggttacgacaacccgaagctgacatacaatggacgtgtcaagatgtggcagggcagcaacaagatctccatcctaagttcagcagttggcctccctgtgagttgatcacagcttaactgatatcccggacacttatatcttgtctcaaactacctgtaacactgatatctgataccattttcagaatgttggcaaccattttgagaactggaatgtcggagtgctcggaccggtgaccctctccagcctaaatgggggcacaaaagacctcagccatcagaaatggacctatcaggtcggcctgaaaggcgaaacgctgggtctccacaccgtcaccggaagctccgcagtcgaatggggtggccctggcggctaccagccactgacttggcacaaggtaagtgctgaattctgaagaagcaccagcaatgacaaagtggaattacagtttcatcacgctcagactgaatttgtgtcacctgttgctgaatttccttttgtcaccattgattgtctcaggctttcttcaacgcgccggccgggaacgacccagtggcgctcgacatgggcagcatggggaagggccagctctgggtgaacggccaccacgtcggccggtactggtcgtacaaggcctccggtggctgcggcggctgcagctacgccgggacgtaccacgaggacaagtgccggtccaactgcggcgacctgtcccaaagatggtaataaattcagcctcacataaccatcttctcacacaactcaaattttctctgaacaataatttttagataatggaagttttatcaaggctcggtcaattacatcaagataatataatccaactgagtctgcccttagcttttgcataaaatgcacaaaaccaaaaaagaaccacaaaaaaccacatcccaagcacacaagtagagcagaaacacaaagattagtgactatcaatccatgctcaacaataataaaatgttttacaatgtttaaataacaaaaagaaagagacgtttataatagtgtctctgctactgtagtagaatcaattttaccactactcaattactattagtagaacgattttttttgcctcataaattaacgcttaagatcacttctattggggagagatcaccgtaaaatgtacctactattttggataaaatttcaggtaccatgtgccgagatcatggctgaagccgggcggcaacctgctggtggtgctggaggagtacggcggcgacctcgccggcgtcagcctggcgacgagaaccacatgaacgaattgcagcgagagatcatcaccaccatttgatacagtcgtcgacggccgcgtgaacagcttcctcctgtagcacgcagaattcgtcgatggtatttacacacacagacgaacaccttacaagtaaaaaaaaaaaaacacaggagcagcagcaacaggtgtgtatttattggggagtcggagaggtggttgtctcgctcgccggtggccttcactgcggctgcagcgacggcagtggcatcaccggccaccggccggcatgcagacgctgttcagttgtttgcgttgctcgggaatttgttacggtgcatagagcatttgttattgtaacttgtaatctttgtcgacattataaattactagtattactagttgtgagaattgattatgcaggaaatcacaaatagttttgtcaatccgttattgtctgtagctatccatttttaggaaaactgtttgatgtgttggagattttacgagaagttgaagttgttaaaagctctctagagggccaatttaggatacattctaaacagcttatcagaacagtttacttccccgttctctgtggcatagtttcagtcagaaatgttttgtgaaaaaaagagtttttttataagaaaaatcaaacaaatacaattttaactttgtacttcctctgttttagattataagactttctagcattgtccatattcactaggcaaaagtcttataacctacaacggagggagtaatagtttatatttggtaaatcagcgctaatagcatctcctgttttaacctctgatcccaagggaccatttgtttcataagattggcaaagcattttcatattactcaaattcctacagacatttttctatatccctttgatgaaaaaatttccataccagtgtattattaggcatgttcactttgttgtcattttcaactctaccaaattttggcagggtaataaactaaacatatccgtacctttaccaaactaccaaaagttgttgattctagaaaaaacaccatcaaaatttggcatggctccaaaccaaacacatttaacactatcttaatttgataacgccaaggtaaaaaacaaatggtaacactaaaatatgccaaaatttgataataccaaactttggtaaggttgaaatggcaacaatgtgagcaaagcccaatatacttctcttttgttggaaatgtacaaaaggtacgagctttttgtaagctttcctttgttttttcctatcgtactgtcaaatgatgcctatcttctttccataagatcgttttacctgtactcagggtgtgtttagttcacgctaaaattgaaagtttgattaaaattggaacgacgtgatgaaaaagttagaagtttataggtgtagaaaagttttaatgtgatgaaaaaattagaagtttgaagaaaaaatttaaaactaaactcggcctcagtcaaaccgggtctaatctctaatgtgtcatccttaaggagtagtcctagtaccagtaggatcaagtaggagtaggagattttttctgaagttgcaaacctgacgaggatgtcacttctgaaaaggagtgaggagtccactgttggtcagtgcgtcaagcctggaaaagtggggtgcaggaatccattggattttaatttggaggttcttgttgcccggctggctactagtggatggtcaagagcacagctgcacaagatatgcaaaacactgtggtatagccttcacttctgttggtggcttcaggcagcagcaactgtagtattaaattcgaggctcagacttcagagttcttcagaggcagagagggcagagcaagaaaaaggagaaatcaaagaggaatggcgccaagactggcaaaaaaattggcgccaaacatagctgtctgttctgctagtgctatgtaacgtctcgagtttcgcatttgaaaatagaagaggatccatgctaatgtgcataactagagcaggtaaaatagcaggctataagccagctgcaaacatattttaagtagataaataagaagagagaagagcagcaggctatagatttgtagctagctgtagcacggactttaagacacagtgtgtgtatgacaggtgggaccaggtattaatagtgtagcatgtaactattatatgaatgagctattagattggctacagatgaattggagttagtagttggctacttactcttaggaggtaaaatccgcaacgtgcgcgactcggtgtaggttgtaagccgagatcagccaacaaatctatatcaatcagttccaacatataattttggtacacaataaatttgagttttctttaatagacactcaatatataaaggtcagagaccttaaaacctcacgaaaactcctactaaagcaaagcaccaatgtgcatgtaactattgaatttttatgtagcgaccactgtatgaaccataataaatgaagcaatgcatctacaaccacactgcccacagaattgcaaagtgtttccacttgtcaatcaaaccccacgaaacaacatggccaatactccctccggtttcagttcgattgaaaagtattgtcaagtgcactttgtaaggactttattattattattattattatttgcaaatgcgactttgtaaaaatatgcccgtagctatatattataagtacattacaacattaaaatcggcaccatttcaaagattcagtatgtttcaatttgggcttattgtcctttgataaaatttgcactccatccgttctaaaatataatcacttttacatctgcattatcttctgaaccaatcacaacgttgcaccattcaaattttctacatacttctctcaaccaatcacaatttttttatttaatttcatctattttctaaaactggggcggtcataataacatattcacataaacgttagattcaaattctaatcccattcatacactgttatccgtatccaagcccataatgtgatgggcttgtttacctcctaggcatgtttcggtccacacgttgctgggcttcacaatccgagcccaaatattcatgggccgtcaaggttagcccattaagttgcgcgcgaaccaggcccatctcaaacccgcacgatttttaaaggaaacacccgaattcaaatccaccgtggggcgcacgagctcctcccgctcccgcgcgcgccttccctctccgtcgccgacacggtctcctcctccccgccactacatattcctctcgccccctcgccgtcccaacctccacctacctcatcgccggcgaacttccaccgcacgcgcacaaccagatcagtcatcgcagtctccggcgatctctccatggctccatccggccgatctccgggcatggagttcccacgtacgtcctccttcatctctgttttaattgtttctcttcttttgttcgatcgattgagacgatgaggttttccggcgatggctcgccgtgcagatgcaagaggcggcggtggcggcggcggcggcaaattcatgtcgaggatggtgacgggccagaagccgatccatgtccggccgccgaggccggagaaggaacgcgtggacatggtgccccgcgacgtcgtcgagcggtgcatcgtcgcgctgttcgagaagcgcgggtcgacgcgggaggcggccatggaggacctcgtcggcgcgctcgagggccacgtgtcggcgcgggaggttagctgcaagtacaccaccatcgtgtcccgctgcgtcttctcgctcaagaagggatccgtcagggaggcccgcctcgcctaccgcgccatcggcatcctcgcgctcaccctcggcggcggcggcgacgacaccgccggcgccaaggatgtcctcgccgaggcgttccccttcctcgccaagacggtggaggcgtcgcacgacatggcgaaggtgctcgccgcgatcgacggcctcgccgtcgccacgttcgccggcgaggacggagacgacgagatcgagaggtccatggacgccatctggggcggcgtgatcgacccgagctcagctgggccgggcggctccaggctcgccgcgggggacgcgaggaagacaacgcccgaggccctcgccgccgccgtgtcggcgtgggcgttcctcctcaccgtcgtccacgaccggtacgaggcggaggagggcgagagctgcaaggacaagatcgcgctcctcgccaagctcctcgacgaccacgacgaccgcggcgtccgggtcgccgccggcgaggcgatcgccgcgtgcgtcgagctcaagctggcgcacgacaccccgccggaggacatggaagcgctcaacgccaccgtctcctacctcgccaccgagccctccggcaagggcgccggcgacaagcggcgccacgccgggcagaaggacatcttccggcagatcgaaatcttcttggacgacggcgaggccccgacgaagtcggtgaggacgtcgtcgagcaggcagagcgtgctcaaggtgacaacatggacgaagctcctccagctcaacttcctcacccggtacctcggcaatggcttccacagccacctccagcacaacccgctgttcggcgagacgttcgaggtcgacggcgacgaggtggaggggctaccggcggcgaggaagatgatgagcaggaagcagagggagaagaagcggacgctggagcggaggaggtgccgcgaagccgtgtggaaggagaagaacaagttcgggctgccggaggaggagcccgagagaggcacgacggcgctcatgctgctcccggcgctggcgtgctgccaccacatgctgccgccggtgcaccggcagccgcatctgctgccgcctactgcaccggcgacggcgagccacatgttgccgccggtgcagcagccgattttgttgctcgagtattagtagttagcactagtaattattagctttgatcgatcaatatgacttagagagcttttatggtgtttgtgagatatttagaagtatcgagaggtgaagtaatgtgaacaattgatcgagagagggataaggtacggaataaaacttattataaccgatgacagggaagtaattattaggtaataaaatatggatattttaagtggatggtatacttggctgaactaatctggtaccgataggtagaaaaaacgtaaatcaagcattgatttacgcatcgaatagatctccacgggaaaaagatcagatccgtcttctttcttcttccgcattgtcttccacactagtttgttcttgctctaggatttgacctaaattctccaaaaagaaatagagggagaaccgtcagaattgttgagaattcaacatgagacgagatcaaccagtcaatggcataggtgaagcccaataggtgagatcttattgattagttatttacgtagttcacaaattctttcgtataagggaccggaacgagacctcctctgttcttataatatagtttgaatatgtggacccgcaaggagacatgatcaagggagaagctgatcatgtgttctttcggatatagtttgaatataaatctatagaagatcatgcaaatgagaatttttatgctagtaatgtgttcttggaacaaaatataaatctagagaaaatcacacaaataaaaacctcaaagaacacgatgtaaatatataggaaaccacacaaaagagaacatatacgctagtacaggcaaatgacttaagtggtacaattctgctcttttctctctgcttgcaaatttatgttctatctttaataccaaagttgaggataattctaccattttctctctactagtaaatttacgttctatctttaatacctacttcctccgtccaaaaaaagacaaaccctaggtttccatgtccaacgtttgaccgtccgtcttatttgaaaaaaatatgaaaaaaaagacaagtcacgcataaagtattaatcatgtttaatcatctaataacaataaaaatactaattataaaaaatttatattagacggacagtcaaacgttggacacggaaacccagggtttgtcttttttttttggacggagggagtaagtagctaaatacctacactaatacttaaatactttttacattatacctgttattgggaagcgttggatttttatctttttaatgcaaacaccgtaccaaatatattgaaaaatcttccccctaaaaaaaagcccaatatataatcccctaatttaattccaattttgatcacacgtaccagattgaatcacatcggacggtgcgagagctctcccagccgaatctgatcagatcggacggccagagctctcccgtccgaatcgaatcagccccagccgcaccgcaaactccgattcggaatcagcacagccgccgcgcaaactccaactccgattcccgattcgcagtcggttctctggtcgcctacatatcccctgcccctcctctccactcccataccgatccatcaggattcaggaacgcttctcactgcgcctgccaagtgttcgatcgattgcctcaaccacccggtcactgtgcaggcgacctgttcgatcaattgcctcaaccagtcaaccaccgctcaccatggttatggggaaattcatccgccgttctaacggccacgcctcctcgtcgtcgtccatgctggacgatgacaccagcagcgcttgcggtggcggcatgagcatctactaccagaagattaatcagagggtcgccgtgctcgagaaggccgccgtctccgtgcacgagagccgggcgtccacgagggaggcggcgctggcgtcgctcgtcggcgcgctcgagggcttcgtccccgcccacttcatcgggtggcaccaccgcggcgagatcgttcgcggctgctgcgcctccatcaagaagggagccgccaaggaggcccgcctcgcgctccgcgccgtcgcgctgctcgccgtcacgctcggcccgggctccaagaggaggatcttgccggcggagacgtacaacccgctcgaacccggccctggctccaagaagatcatggcggagacgttcccgctagtctcccgcatcctcgaggtgtcaaccgacgcgtccctggtgatcgccgcgctcgagtccctcgccgtcgtcgcgttcgtcgacgtcgccgcggagaacatggacgacacggaggcgtgcatgaaggcgctgtgggggctgatccgcccaagcacggggcccaagctcggcggcgcggcgaggaagacgagccctcatgtcctggccgccgcggtgtcggcgtggacgctcgtgctgaccacaaccgacggctggaagaagaagaaggcggcgtcgtcctctcccaccgcgtggcgcgacacggcggcgcacctcgccccgctcctccactccgacagccgcgccgtccggatggccgccggcgaggcgctcgccgtcaccatcgagatgaagctcgtgacccgggacagccacggcgccctcatctccggcgtggcggcgagagcgtccgagctcgccaacgaggccgccggagcgggcgtcggcaaggccaacttcgtcgagcagaaggagctcttcaagagcatcgcgtcgttcctcgccggcggcaaggcaccggcgagctcggtgcgcgtgtcgtcgtcccaccatgggcggctgacggcgtcgacatggacggacattgtccggctcaacttcctccggcgattcctcggcggcgggttcctgccgcacctccaggggaaggtggtgatgggggaggaggcgccgctgatagggcaggtgttcgtcgtgaaggaggacgacatggccatggatcagaagaagaaggtggacaagcagaggacgctcaacaaggagcgccaaatagcctctgacctcaagttcagtatgaaactaggaaaggaattttgggccaagcagagtccagtgcatgtaaagttattatgtagaaaaataattatctgagagagtaaattgggttacttatggaattgcactatgaaattacgtttgaaagtttttcacaataaaattgtacgataacctttttttcttagcaattctcatcttggagatggtcagtgcaacccattggcccaagagaatctatccatgactcgaagtctcgaacaatggcctggccgatctaccgccgagcataagccgcatgctggataagttagtatgaaaaaagtccatattatgtccctaagtatagtccatattagtactttataaccagcgtattgatttgatttaccaataggtcgcaaaatgctatggttgtttcatatgatttatgcatttattcagaagtaaatcgtcgagatcgtgcacccttttcttatttattcgaaaaatactaaaaaatattctaaagtgcagccggatagatccaatctattcttgaaatagacaactcgcacacgctccttttccaaaataaatcaatacaccaaccactacagttagatttattagatttgttgctaaaatattggtattaagcccgaaactccctcttggccatgtttagaacttagactgtattgaacttatcgttttttaagtaatgagattaaatttattaaaattcttgcaaagaacatacatttgaaagaagctgtggtgtgctcgttttatttacagtccatctatctttttaaaagaaattatctagaggttaatagcataatgcccgtgcgttgcaacggattctaaatagtattcattgacattaattaaaatcctaaaccatatattacaattgggcataaatgatgaagggaatataaacttataaataacaacactacaaataactttgtccagaacgataattcaatatcaggaaaattatataacttaatccaattttctcatttagctataaataatttaatatagagaaaattataagttataatattttttagtggatcaaatagtgctaaaactaataatgtaaatgaaaaacaactgaaattagctagaaattggaaaaacttcttttaacccacatatgaaaatttgattcactaaatctgaacgggtgtctgttttattgatataaattacaattttcatattctattcatactcatatggtctaaatattatgcgagtggtctaggagcatggttataatagaccaagaagaataatgcccaatagacattgttcattgtcttccctagctaaggcgagaaataaaagagtagggaatataggctgtgtacatcctcacaaggtgtagaggccgggtttattataatccattattttaaaaaaaagagtagggaacatgggcgccaatgcttcagcgaccaaacgacggtgagggaagtggtaggacgtgtcccatgatatgactcgtccgtagatggtggcggttggcaacgaaaaaaaatcagaacaatgggaacgcggccgacaacaacatagtcccaatagagagaaacaacaatggtgagctcctgtggtgaacacggctgagtgagtgcgtcaaaatgtgttcccgaacaaggaggttccgttttccttgaatgtgtaagaggaagggaacgcaggggagaggagggacgccgctcgggagaagagataccgagggagagagggagcgtgtgcaacgagggggagatggggggtgccgggaaggaaggagggagacgggagaggaggggcgttgccagggagaagaggggttgcgggggagggggagagatggaggcacatggagggagggagggaggcggaagcggaggcgtgggagggaggggcccggatggaaaaagggatgattgaagccttacatatttttaaattatattattatttggtatagatttagaagttagaacacatgatttttattgcagttacattgatactcacaaaattcctgtagcacttgatagcgcataattgacttcctgttcgtaaaggtttatttttacgatgtcttactacaactataatcacaaagtcatcatatcagagtatcttgtagcagaatttgaaaaattaataatgcttgtttaattagaaaatatatatggcaaggaaatcaacgttgtaaaattttattacccagtgtttctgacatgctatgaaatgactcctggtcgacatgttttgttataatgtaaagcctaatcctccttggcatgaacaagattaccctaatttgacaagttcatcccataaaacattataaaaatttgacaagattaccgaatcgtatttggcatgaacaatattaccctaatttgaaatgactcctgatcggaaaattgtgtagagttgtactccacttctacacaaatcgtgcgtaccaaattaaacctcatcagatcggacggtggcagggctcttcccgcccacgcccaatacgactcggtctcgtcctccgctctctacatatccccggatccccctcccgatcgatcacgaaatctctctgcgccagcgacgtgttcgatcaattgcctcctcaaccaccgcctcgccatggtgctgaagaaatccaccggccgctctagcggccacgcctcgacgtcgtacgatgcctccgctggcggcggcgctgtggctgtgagcgcgtatgagcagaggatccgtcgtaatgccgccgtgctcgagaaggtcgccgtttcggtgcacgacagcctggcgtcgacgcgggaggcggcgctggcggagctcatcgccgcgctcgagggcttcctctccgccgacgacgcggagggtgggcacaccgacgagatcctgcgcggctgctacgtctccatcaagaagagggccgccagggaggcctgcgtggcgctccgcgccgtcgcgctgctcgccgtcacgctcggccccggcgccacctcgaagaagatcgcggcggtggagacggcggcgaacccgctcggctccggcgcgaataagatcatgaaggcgacgtacccgctcgcctcccggattctcgaggcgccacaagccgacgcgtccctggtggtcgccgcgctcgagtgcctcgccgtcgtcgcgttcgtcgacgtcgccgcggagaacatggacgacacggaggcgtgcatgaacgcgctgtgggcggtgatctgcccgagcgcggggcccaagctcgccagcgcggcgaaggggacggcgagcccccgcgtgctggccgccgccgtgtcggcgtggacgctcgtcctgaccaccaccggcgggtggaacaagaagaagaaggtgtcccccgccgcgccatggcgaggcgcggcggctcacgcgcacctcgtctccctcctcggctccgacagccgcgaggtccggatggccgccggcgaggcgctggccgtcgccatcgagatgaagctcttcaccgagaaaaacaatggcgccctcttctccaagatggaggccagagcttccgacctcgccaacgacgccgccggagcgggcgtcgacaagaccaacttcgtcgagcagaaggagctcttcaaggacatcacgacgttcctcgccggcggcaagcccccggtgatctcggtccgcacgtcgtcgtccaactacggcctcctcacgacgtcgacatggacggacaatgtccggctcaacttcctccggcgattcctcgccggcggcttcctgcaccacctccaggggaagggtctgatgggccaggtgttcgtcatcgacgacgacgaggtcaccgggaagctgtcggcggcgaggtcgaagcggagcctgatgaaggacacccgcattgtgaaggagttgaacggcggccgtggcggcggcggcggcgccatggatgagaagaaggagaagaagcaggagatgatcaagaactcgctggagaagaagaggacagttaagaaggagcggctaatagcccatgagctcaagcatggatcatctgatctatgaaacaaggaaaggaattatggataatttaattagggttgcatttcatatatatgatttatcttttttagggtttatagggcagtcttttagggttaattactagatgcaacgtactgcttggtttccctttcaatatcactatgttattttcgtattattgtcatgttcattcatggtccacaattgtacttgggagttacattcaccacgattcaatcacgctaattagatcaccactagagtataatcacactaattagatttttttagtgtgtactgcacacttatgagattggcgaaatttagtcactccttttaaaaattgttcaaatgagtcgctcttcctgttccgactttagagggtgtaagtctcattaaacagacgacatagtgtcggccattcattgccaagtttggatgtgatacaaaatacttagggcatgtacaacggtgagtaataacggtctcttttcgttactatgcaagtaaaattaagagaaaagtacattttacc

SEQ ID NO: 2999 - DNA, 12927 bp, Oryza sativa
  unsure (1)..(12927): unsure at all n locations
cccccccccccccccccccccccgaactcgaaaaccggtcatttttcaccctcaactatcgataccggatgaaaaacccccctgagcagttttgcaagcggttttggtctacgtggcagcccagtcagcaattcttttctttttaaatcagtgggtcccacgtgtcagtctctcacctatcttttacccctcacctctctatctctctccaaaatcatctctcttctctctccctcaccttaaggacggtgtcctctctcttctctggcagagctcgaggcgacgaagggggtggcggaggagccgaggccggtgggcgggtgcggaggcgggtgcggaggcggctgcgggcggcgggtgaggagccgaggccggcgcgggggacgaggcggctgcgggcggcactcgttcggacggccggttgcggcggccggctacggaggaggaggcgcacgcactcggacggccggcggccaaggcggtgctcgcccgcgcggcgggcggtggaggcggagctcacccgggtgtccgctctctctctctctctccctctctatcctaatctctccctctctctctctctcttctcccttccctcactggcggcgggcgggcaagggcgggggcaagaaaagttgctcaggcgctggcggcggcggcgggcgacttagtcggaggcggagtgggcggccggcggagctccctgggcggctgaggtggaggcggagcgggcggccggcagcggaggagctcgtcggggcagctggtggcggaggcggaggcggctaggggtggcgcgcgaggtcggaggcggctggtggcggcgggcgcggaggcgaggccagcggcgggcgtcgaggccgcggctggggggcgtggaggcgaggccggagacgggcggggtcggaggcggctggggcggcctcgccgtcgctcctcgtccgcctcgactggaacctgataggagcagctgcctcggctccggccacggttgggtcgccgttggggaggtggggatggtgcgatggagattgggggaggggacggcgacacgtagaggagggggtcgatgacggcggcgggcgaggtcggaggccgtgcggtcgacgcgctccgtctccgcctccagagaaaagagagagagaggggtgagccgaccagaggcacccatccgcgcccgtcaccgctcgccgccaaccagttcgccctccctaccgcgcccgctgccctacctgagctgcgccagtcgctgcttgcccaaccgcgcccgtcttgccacgttggactgccacgtgcgcaagtctccagtcaaaaccgcccaaagtatggttagggggggttaagtgtccggttttattagttgagggggaaaaatgaccgatttttaagttcgggggggtttttcggctaaccgcattagttcaggggggtaaaatgtacttttctctaaaattaatgacatagtagagagagagagagggggaggaaagggaaacatgattgctacgcatgataacggtccagagtcgactcttttattaaaagaagttttgttacatggggtggagaaaaggaaagaagggtagtaaaaaaatattttggtacagtaatggtaggaaattttgtttgtctcaactattttggtacattaattgtcagagtatacatttgtatatgcccttacactgtgtaaaaatataaaaaactaataactatatatcaagacattagtatatacaaccaaaagttactgtactcgtccaaaagttactctacgaaaaatctacgggtgtgtcatctaggtccttgaactcccaaaatatatttttttatcctcaaacttatcttgagtgtcgcataggtccaaatgtattctaacccgctctatgcgctgatgtggtattgccatggtgcctacgtgttagtaggacccacatgtcggtcatttataaaaaataaaatttaaaaccatattttctcctcataggtagagaagaaaaaaaagatagataaaaattattctaaggtataggataaaatatttatttagttttatttttgtatatgtaactgacacgtggatccgactagcacgtaggccctatcatgacatgccacatcatagagcgggttataactcgtttgaacctatataacaccaaaaataagtttgggggacctaaaatatgcattttgagagttaaggaacctggatgatatacctacataagtttagtgaccgctcgtgcacttaattcactaaaaaattaataacaaaaagtagggataccttccatatatttaggtgttgcaatccatatatctgaccaagcaaccaataattaatccatatgtgacttaagcctaagctaatataatcaagcaacatgtacattatacaacactacagtgcacatcatctcaaaaaaaaaatctataattcagcttagtaaaagctctgtactcgcatgtgcaccagacacacaaaagcatggtcaacgacttagcacatgtgcatgagacatgactcggtcatgcggccccaaatgacttggattatatttctacataaacaagtggcgtttaacataagaatgttctttaggacaagttactaacagctactgatccattatattggatgtgtcattatagggttttctattgtaagtcgtacaagttgtactcattaattgtcacctaattatgctttgccttgagtggcatgtaagggaaaaaaaactcgacatgctcaatgtggaggcttgaagtccatgcatatccatctcttcgacaagctaggttaaatgcgagatacatatataatacattagtacagatcacgaatagatcaaatgatcgtaatgtaatcgtccatagggacatacataacaaaatatatatgtaatacaatattactgcatcatatgtacaaatgccagtttgtggcttgacctgcagtgatattaattaattaatatcgtcactagaggtttattatggcaggaattcgatatgatctaccgatgatagagtggtacttcctccgtttcacaacgtaagtcattctaacatctcccatatttatattgatgcgcatcaatatgaatgtgggaaatattaaaatgacttacgttgtgaaacggagggagtactaaagtttgtgggttgtgtttgttcgattgtactcctacttaataaaaaccttgtaacctaaagtgtaggtggtagtgaacgggtttgttgcacagtggttatgatattatagtatgcctaccagcccttaggttcgacacatcttgagagataatttttgagctggttttaaaaatgtactcgctaaccccttgtttaaaacacgtgttaagaaatgacttataattacgaaccatcgtgtacgagtaagtgcctcaaagcaaagggttaaagcctaaatcatggggtggatctgcgtgtcaaggagccagggttcgtggccatccttctcagagaaagtcatgagagtggtatatcccctgccggtcaattaaaaaacagagttgcacagttgcactaattacatattaactattataaattttaaataaattatgtatagaaacattttacacaaaatatattgtttagcggttccgaatgcgtgctaacgagaaataataaagttatcatttcgagttgataaacgaactgtcaaactcagccttagaagttgttattcacaagctaggtagctttagcgggggaaatatgtagtgtaaatttgaaaactcccggattcaatcatgagtaagaattttactagaagaaatttttctacttttgatgatatgaataaatatcatacatctatttttgaatcaaaggtaaatttaaattttccaatacatatgcggtttccactgcatgattggtagcgtgtgtgattatccatattgacttataataaaaagaaaaaccatgaggaatgcacataatttgcatggtagcgtgtgtgattatccatcttgtcctataatccaaaaaaagaaaaaccaggaatgcacataatttgcattgtgtgattatccatcttgacctataatccaaaaagaaaaaccacgaggaacgcacataattttattcaacttcaaacatcgtattgaacttcacacaatgacaaaccgaatccctatacttaagaacctgcccccacaagcacgcgaaagtacacctttttcccaatttttttaggtcaaagaaaaaagaaatccatgcaaatctgaccaactgacagcgaccatgcatggacagcgtcgtcgccgcaccaacactcgccgctcacgcgcgccgccgcttgacactattatactccgcgccgcgcggcgccgtcgccgtcggcggcgcgggtcagcgacgtgaacgtgaccaccggctcaagcggcagctcctccacgtcggcggcgaacgtgtcgtaccgccggaacagccccgccaccatcagccgccccaccgccaccaccatgtccttcccggggcactgcttgttcccctccgatggcgtcccggtctccggcccgttcgaccacaccacgtgctccagcagcggccgggcggcgcttccggcgccggagacgaaccggtcggggacgaactcgccggcgcggtcgaacaccttctcgtcgcgggtggcgagcggctggtacccgaacagcagctcccccttgcggacctcgtacgccgcgtcgtggctctcgacgaccatgtcgcgccgcgcgcgcccgtactggaactccaccggcgggttcatgcgcagcgcctcccacaccaccgacttcaccagcggcatctccttctccacggcggagatggtgatctcgccgccgccggcgggcgcggcggcgcggacctcggaggctagcttggcgtggagctccgggccggcgcgggcgagccacttgacgatgtgtggcaggaagatcttgaagccgccgtaggcgttgaagacggcgacgaacacgaggttgtggaggagctcgtcgcgcgggattcccgggtggttcttctcggcgtcgtcgaggatggccgcggcggcggcggcgaagtacgccgtgatctcgccgtactcgcggcgcaccaggaacggcggcaggcggaaggtgtggaggaggaggtcctccagcggccacggcttgacgaccttgctggcgagcgggtgaagctggaagatgagccacttcaccgccttcgtcacggcagcgtcgcccatggccttgctcggcggcgcgccgccgaacagcgcggcgcaggtgaagtcgagcatgtaccgcatgttgagcttgttgaactcgacggggccgccggcgacgaggccggcgtcgacctcgtcgaacatggcggcgaaggcggcgcggaacgccggcgcgacgtggtgcatcctcgccgcggcgagcgacatcacgacgcgcttgatcttggcgtggcgagggtcggcggcgtcgaggaaggcgagcgggcggtggccgccgaagagcgcgagcgacggcatgaaggtgccgtcgagcgtgtcggccttgtccaccatggagtcgtcgaggaggacgcggaagctgcgcgcgtcgaggagggcgacgacgcgggggtcgccggcgaggaaggggccgggcggcatgttgacgcggagcacggtggcgccgccgtggcgggcgacgcgtgagcggaagaactcgtcggcgccctggaagtaatagtagtcgaggcggtcgcgcagcggcgagaggaagggcacgccgtagccgcccggaatctcgcgtatcagcaggcccgacggcgagagcttgctctgccctccgacggcgccgtcgttaccgtcgccggagttggctcgcggcggcgccatggacgggagtagggtactggctacgtatacgcactacgtactagcgtgcaggtgtcggatcgtcacagccacagctatgaatcattgagcatctgttgtactggggttaaataggctaaagtgagaagcagacaaagtaaactcttttcctttttttttcattgtgtgtctgttgctgactgagcattgatggtagtatcctacttgtaatattttgacgctattgatttttatcataccgtttggtttattaaaaatatattaaaatttataaaatataagttatatttaaagtatttctaacgataaaacaatccctacgaaataaataatattatttaattaattttttaataagatgaatggtaaatatatgtttagaagtcaactacaaccaagaatttttttaaaaaaaaaactgaagggagtaccaactgcttgttcttatcatggactgtgaaggaataaattttaaacggtcgatgggatatctaatggcgctctctcttgtggtttgtttctttggtgagggataactctagctttgatgaatgcgatattggtgacgtcagaacaagttcaggatgtcgtacaatcactgtaccacaaatgatgatgcgtgcttgatgatctttgcaatctaaatattatgaataggtaattaagaacaaagaaaacattggaagtgttttatctaatcgactcggcaaatcaacacaccaattattggaggctctgaatctatagtaaagcgactaaacaaccgaggactacatagtgaatggcacttggcaaaatttagctaaacaatatccaattgttttatagggtgtacatagatatttaaagaggaaaatagctctaggaatgtgtttaggtttgtggagatcgacagaggcattttcgagataggcctagtctattacaaagtctaaaacttaagtttggtttcaacaacagtgcaatcttgtttggatgatttccgttgactcaggatgaagtttatcgtggatgatatgctttgaaatgtgactccataagctctcctataagtccaaaattaactaacagagttagcataaaggcgctaggtctgtttgtagtaaatgttgtcctaagaggccgaactgggctaaaaactcactgggtttgaatatctacatgttgagggttcaagatgacgtggtaaccttcaaaaatagttgaggaaggtcttgaaataatattacattagccttgtagttcatctatttaccagatgtattcttaagctatgatagcatctctggaaaggaaaatacgagtcaattattgcacaacattatttgatcaaatagataatatgtaaatctaacataaattgtgagtacctttggtaaatgtcttatatttccattgattgtaacatgtcatctaaatagttataaaaatattaagaggatagattaatatgtgatttaatcactttaaatacgtacaagttcaacttctacaagttataacaaaagggataaatggaactctagctagttaacatatacatataggccctgattagttcccacataaaaattttacacccgtcgcatcgaacgttgaacacctacataaagtattaaacatagactaaaaaataattaattatacaaattgtgactaatttgcgagatgaatcttttaagcctaatttcatgatttgacaatgtggtgctacagtaaacattcatggtttactgatggattttgtaattagtttttttaattagtgtcaaaacacctcatgcgacaccctatataatacccgatgtgacacgccaaaactttacacctctatatctaaataccccatagtcaaattatatataacatatcaatctatcttatcaaaatttttatttttttataactatttggatagaatgcaaagatcgaggggatgcccactcgagagtttagaaacgttccctgggagcgtggtgcgttaacgaaattattttaatgcagaggtagcaaagtaatagtactaagtaacttcgatagtgtacttttacataaggaagaatacctcatcggctgttgatcaagtggaccagttcaaagtatcgtcacgtacgatcgagatcatcatatgggactatatatgatgatgaattgatcaattgatgactatgtggacgattttaatatttaagcaagtatcacgcgggagtattttaattcgagctaaatctgacacaggccattatccctattggcctgtattcataacccaagaaaccattatccctattggcctgactctagctattattaccaataattttctttatctgcacagggccgtcgatagctagccatgagcaacacgacggctgcacaggccgggccctcgatttttttgggggcgctcacccaggggccaagctagcatcaaaacaaaggggtacactactattgaaaacctagaaaatttcaatacaacaatatacactctagtgtttttagtgtttttaagtgagattaggaatttgggggttcatgtgcactctccaaacacaatatagcttcgccattgccctcacctcgaagtaggcatgtgttaattagtgatatgccctagaggcaacatagagatgattgtatcacatactatatttatatatttatccgacattgttccttgaaatagataactatttattggttaatgaatatgtgattctttcatgagactctttatattgtttgttactatttctaaaggatccctgatcaaatatcatatgtggaacaaatatgtttatatgatcagcacatgtattaattgatgatcatgtctcatggatcatggtatagagataccaaattaataatgtggacacatgttggtgaacatgttgttggatagacccaatatgagacactgcaagagccatatgtgttgtgtcatcggtgatctcatttagtattggtgttgaattcttagacctgagattatcatggttctcaacatgtgtagcagcttacttagggactgctaaacgctactccgtaaatgggtagctataaaagtagttttcgggtatgctatgaaacatgtagtgggatatgaataagcaagatgggatttgcccctcctatggagagatatctcttggctcctcgatgttgtagattatggaagtgcatggccatgccaaaggtgattgaggagtcaatcacaagttatataatctatcaacaggttcgagtgaatgattgagctactagaggatggcacatatctagccttgagcttaatcgatatcgtgaggcaaaggggttcatacaagtatacactagaggttcagccgatatgatctttatgtatgcccggtgggtcaatacgttctgctaggtgccgctgttgacgcgtggaccgaaaaggagttttcgggttacagccgagtatatatgaacctacagggtcgtacgcttaatgagccggaataaggggattggatagagatccaatatgagcttaattcggatagggatccgaataggagtcctacgggccttggaggcccgagtgatggatcctatatattcgtgaggggcgtgaccgacggaggcattgcatcacgtgagaaaccctagccatcacttccctctccgagcaaaaccctagccgcgcgcgggtgctagcacatctgcgcgtggcgttccgtccctgtacgtgtggataccggtagaggcgccgctggtttgcggtgctgatcggcgtgggagtatggcgaggagaacgcacgtggaggagaaggtcgagccggtgcgatcgactacttcctctacatcgacgcgcactacttcgcgagagttctttcgacttctcagcgtcttcttcctctgcgcagcgcgtcgagtggtaacgatctatgatctaatacttgcatggttcctgatttacgcgatagaaaattttaatttatcctatcgtagcctacgcgtatcccaacagcctgcacacatgcctggcctgctaccattaccaaccgagcgaggagtgcaggggcagaaggcgaaaggcgtcgctttgcattgcgtcggtgcgtgcgtgggtcgtgggctcgatcgtggcgttgtgaccagtgaagtgacttcaatttccaactgatgcatgcgcctacgagatggagagtcgagacaaacgagtcgacgagacgatgacgcgaggcggcgatcgacgcgcaggcaagcagaccgactcaccgacgataatatcgagcgatgagcaggcaccgcaggtgatgagcgacgagcgacgagcggcggcaaggcgagcaccgaacagcccaagccctagcggctgctggcggcgggctggctgtgcggcctctgcggctctgcctcctcgtcgagtcgtcgtcctcatggtcatctcctcgtcctcgaatcctcaatccaatctccctcaaaggctcgaattatcattgacatggccatctcgatctactcatagctatacttttcttttctgaagtcatgtgatttctatggttccatgtatagcttcatctacgtgcctgccaatccatccaactatgttctcacactgttatccttgttgccaattgtttacagcgactatttttctcacactgttcattgactgggatggatggatatatattcatatgcatatacattcaaataaaattatggtattttgaatgaccaattagattgattattcaaccaaaaagtaatataatgtcttgtcttttcttttgtttataaaacacgagaagaattttatttcctcaatcattggcatgtcttctacaaataagaagtatgattcaggtgctgaaagtgatgtattggacaatattaattatgaagatataatcaaatatttcatttcaaaaaaacaatagatggatgatgcttttcagtacatcacgaggttggtactacctttactctcttttattttagtattaatatttatttgatgtattttttgaatatggtatgaaataacacattaaagttatatagttgacataaaatatgcttagttatattatatctataatttttaaaaaatttagggccataatttacatttcgtcacggggctccaaattcctggagaggccatttttttaaactccataattatcttttaagaaactgaattaagtttatacacgtagattttatcgcggcgagagcaaatttaatgataaagctaaccactaactataataagcacatctaaaattagtattccctccgtcccaaattacagagcgtcctctttttaagaaaaatcaaactcggtatcttttgactaataatcatactatatctatactaagtatgcattatgcatgttatatcattagattcatattttgaagtactttcatatatatgatgttaatttcatgtttattgggatcatagaatgaaataaaatattggtcaaagtatgttattgaagaacgtgtaaaaaatataggtattataatttgggacaagggagtatatattacaactaacatgtgaaataattaagcgattaaggtcatctctattttattatattatcttttttttcctcacttatatatttaatgcatctcttttaaggcacgtgcaaagctaattcttggagaacagctgtcaatctgttttatctctcctgtacatgcgcaaagaaataattatagtcagcttataggctattttttgtgcttgctcttggtctttgggtcgtctttgaaattaaagcatgaaatttggatgactttttattttatgaaaggataaccctagctctctctttaattaagaatatcgctactacgtagttgatttttcgggatgagaccaccttcagattgtagatagaccataactactcccgcgtgcaaaaattgcttccctaagcacaggatagcatgcgaaaatgcccatctctcttcccactcctttttctctcccctctctctctctcccacaaaatcctctcttctcccgtccacaactctccccactctcctcgttgcccactcctctcctactaccagtgactgcgggtggcggtggcggtcgggctttccagtctctactccgccatcggagcggagtagccggtgggcgtgggagcaaattagccagtagggcatgtgagcagagcagccggcgagcgtgggatctgtcatcagtagcgaaggagtggggggcgactaggcaaatccagcagctgtaggaggcgacgaatcaggctggggcggatcaagcaacaacggcgacaggaggtggcaaatccgtcggccgcagcaccggctgggtggatctagtggcggacccgtcggccgcaaccccaaccgaggtggatccaatggtggcagcggcccttctccccctcccacacttcatctctgatcctcgacagcgacaatgactcgatggcaatgatgtccacgaccacgccctgtttgctgcgatgatgactggcggcggtaggcgcccagcccgagtggatccaacgggctttggactgcggcgaccaggtggcgacgtatctggctagggtttcaattttaggaacatttacttttttttgcctttttttcacagtcggatgacataagtgtccgcaatcgaaaatacatgcaggtggaccacccatccgcctgcaaaaaatgatttaaccacatgaaaaatcggttagatggtagtagcgtgttgtcccggtctaatctgttttatgaattcaaatgcatgtgaaacatggggagttgaatacaaaaccagaccaatcaaaagacgtacctgtcgctctaaaaaaaaccgtacctgttcaacctaatttcctggtgaataatacgtgtggatgcatttgtaattttttttttaagaaacgctttgaatgcatttgtattgcgaaaacgttctttccttttgggccctagaaacaaactggtccacccgnnnnnnnnnnnnnnnnnnnnnnnnnnnnnnnnnnnnnnnnnnnnnnnnnnnnnnnnnnnnnnnnn

SEQ ID NO: 3000 - DNA, 699 bp, Oryza sativa
cattagttttgttaaaaaaattataaaaatgtataagatataaatcatgtttaaaatactttgagcgataaaacaacttataaaaaaaataaattatattacataaattttttgaataagatgaatggtcaattatatgattaaaaatcaacggcgtcatttattaaaatgaggttgtatatactcttcctctattttatattataagtcgttgatttttttcagtcaaacctcgttaagtttgattaagtttatagaaaatagatggagggagtactgtagtagacagtgcagcacgtggatgtgtattttttatatgctggagaatttaattaccaaaaccatgtgtatatagcatatgattgatatctttatcattatctaaaaaaaatgattgatatctttatattcttgcgacacctttgcaggcgggcgaattcgacgaagcgtcgctcaaggaagctatcgcgaaggccgtcgagagtttggtggcgccgccgccgccgccgtagcccgtcggctttgaccctcacctcgacctggtccggccagctcgtgatcgatcgatgcgtgcgcttccttcttcgagaagttggggttggtgacgcgtgcacacgtacgtacgcatttggggcttgaacaagtagatcagtttcaaatcaagatcattttctcttttttttttttggaattttgaag

SEQ ID NO: 3001 - DNA, 1131 bp, Oryza sativa
caggccgtgtatttggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatgggt

SEQ ID NO: 3002 - DNA, 1848 bp, Oryza sativa
tgacaaattgtttatcagaattcagcaatgcccattaaaatggagggatccatgttcctctttaattagcaattgcatcacaaaaagcttcatgtcgtatagactaataatattgtaaatacatgcattttttcatgcaggtgtcagattttggcatgtcaaggttgaaacatcacactttcctgtcctctaaatcaacagctggaacagtaatatccttgatgctctggtgactttctttttcatgttttacctcgttttgattgtatgataaggtgttttttttttcatctttgttctccagaaactctggaatatcgcactattgcactttacacggctaggatatgcaaatcatttgaactttagacttcaaaataacacattgattgctctgcctggtgtttagatgcaatatttgaggcattggatagtgccggtgtcctcaaacagaatggtttatgcaaaacattgtgcaatgtagtttgctctgcacaactaattttgtatagatcagttcaagccatgctctctttaccctagttactttcacagggtctttttatttttttctggaagtagagcctcaccctttttagacaactcattgttaatccaagatcatgtagtggcatagtgtactatattaataacatttttattgttcatttggtgggtgtttcctgtaattagctaattattccatcaccttgaccatattttatgttgggctacagccggagtggatggcaccagaggttctacgtaatgagccatcaaatgagaagtgagttgcttagttttctcatgacatgttggcctttccatttacttcctgtcatgttctcctgctgattgaaaattgaatgctggcatcaggtgtgacgtatacagttttggagtaatcctatgggaactagcaacaatgcgtgtaccatggagtggactgaatccaatgcaagttgtaggagcagttgggttccagaacaggcgactagaaattcccaaagaaattgacccactggtggctaccataatatcttcgtgctgggaaaagtaagaacaaaccagcccggataacatgctactcttctcattctacctagttttacctgccacttgctccactgataatgacccccaatgttctttcgtgcagcgatccaagcaaacgaccatcgttctcccagctcttgtcaccgctgaagcaattacagcggttagttgttccagaaaactgctgacatcccttcctgagaaaaaaaagctcaggtcaaacaaaaaatacaagtatgtaagctctactactacagaggccaagtttttcatgttgaagctttgtggagatgtattcgcagtctctgcatgcaggatggatgtgcatggacgaaggttctatgcatcctgttgtgaaaaaaaaaatgtgacaaaactctctctgaagccgtgcaaaggcgctgctggagaaagcaatagtgtgttagttccaagtgaagaaatgtggtgcaacacgaagtgctctgtgccatcgaaataatttgttcagttctggaatttggaacggtgattctgagaatcagaatttaaccacaaagataggatcttggttttcgttcttttttgtcttgcttcataattggaaaaaggagaaaaggtcaggttaaaaaaaatggaaaagggaaaacgaaatcaaaagttttgtggcgtctgcaaaagttgcggcccggtatttaaccagatgcaaatcttgtatatcatttatacagagttttactctgcatcgacttgaatatgcatcttaatatcttattaccttgtcctctttcctataatattgaatggttacta

SEQ ID NO: 3003 - DNA, 6838 bp, Oryza sativa
aaaagacatgaacacaaaccgcagttaggcaagctgaattgactcctccctctatcccccaaaaaaccgcagttaggataagacataagctagaacaacgaatttgaaaacgctaaaagtaaagaatccctacaaatttgaatttggacaacgttaaaagaaaagaatccctatgaatttggacaccgctaaaagaaaacaaaaatgaagtgaatttggacaacgctaacaaaaaatctgacaaacatgaacatcactgtacctcttttacttgcataacaattcgaaaacatcagaattgccaagtttatcatatgagcagcagccgattcacaaggaatggtgtgtttccgatgatgattcgatggatagtgtctttaacaactaagaactacaagatagaagggccaaaactcttaaaaacagcacacagaaacgagagcacactcaatatagactaatataaccacaagctgatagtgttttctttttcagaatcatgaactattttcgaacggtaaatccaaaacctaaatagctcatttttccacggtatccttgctccaacgacgcctcacttgaagcatttcgcatccagcaaagcctcgccctcaaatggctcaaggtcctcaatcatggcgctgacgcgctccttctgggcctcatctgagatgtcaaccttggtccactcatagagctccatgtcgtagacctcatccatgacgaacttggggatctcggggccacggaagagccaaagacccttcaccttgaatggcggctcagagccgatcacaagcatcttcccgaaggcatatttgcggcacaggtccattcgctgcaggaacccaccaaccttgttcatggtcacgaaggacacggtgttctcatcattgtatttgtagtcgcagaaccacagggagtaaccttctgggtcatacatatcccagaaacctgcaatacatgagaagataacttgagtacaattcacagcagttcaaactcaacagaagttggtgtagatgagaaataatggtgtagaagagagaactaattgacagatcaggatcagctgaggtagttgttttgactgcaactttagcagtcaacacatatagccatccatcaagccaccaatgggctaagatgttgagcatcttctctaactaagatgttaattttctccatccaacaacaagaggctaacagtttttgcatgctataattctctagctaagatgttaattttctctaaactagaatgtttgagatacaaattgacacaagaatagcatagttaacagtgtcattttttaaagttctgaaaacaaggcgtttttttatttatagtccaacttaatatttttattaattttctgtttcattgatttcatggttttggaaatattcgataaagaaagaaaggaaaagagatgctcttggtctagccattggttgcttgttggattactggatgtgatgactgctgaagttgcagtaaaagcaacaactccaggccttcagctgatcctggacagctagctagttcacagttgaaaagtaactaacaacatataacatctaaaaaaagtcacatgcatgcttgctatttatgatgctacacaaacaaattctaacgggtatcctaatttgtattcatatcctttgcaacaaagcaatgcaataaatttgtctatctggaaactttttactgactagtagattccaaaaaagaaacttacccttgatagcaacctcacggaagtttgtttttgtgtttgagtataacctcttccactcatcaaggatcattttgcttggagggagcaaatcaagaggattctttggctttggctttggtgcttcctcttcctcctctggtttctcagctgccttaggctttggagcttcttttggggcctctttcttggcttcctttggcttctgctcctttggtgctgcagccttcttttgaacttgtgggacagaatctgcctgcttcacatcacccatgactttcttaaagtttggctggttaaccatggtccagaagtacctctcaacatgagggaactcagaagtaaaattcttggtcatgatccgagcaaagcccatgtagaggttgcatgtcatcacaatatcagcaagagtcactgaatggccaacaaggtatgtgtttgatgcaaggtgtgtgttgagggcacccaatgatctcttcaaagcagcaatagctgcttcctcactctgttaggcagaaacaagattagatcacaaattgctaacaaggagaacacaacgatacccacttgaccatacttacgacagcaacataaggagcaaatccaagacgtgggaagagccattttccagtattagcatcaacctctgtggctgaaaagtcaatccactgctcaatgtgggcctgaaagaaacaagaaattcaaggagctggtaaaataatcaagaatgatcctaaatgtctatgaaagatcaacctgaaagaaacacaaaattctaggagctggaaaataatcaagaatgatcctaaatatttatgaaagatcactcacatattcaatcagtgaagacccatagagtgggttgtcagacttcgagcgagtaacttcaggaaaatgagaggaacttagaactaaatcaagcaatagagagaaaaggattaaaagaacggaatccttgctatgtatcacttaccatatcgtgcaatcgcattgctttcaaaaacaggaccatcaggagtctctagaatagggacctgaaaggaaacgtgtccaaatcagattctgtgcaaatgtaccaaaattcagaggtggttttgctcaaaccttcccaataggattcatcttgagatactcaggagtcttgttggagacacccatctgaaagttctttgccaactcaaccttgacaccagagtactcggcagcaatgagtgccttgaatgcattcttgtttccatcgaaagtatgcaatacctacaccaatgcaagttacaaagttgagcgtgaaaataggttagggaagtgcatgacatgacaacactacaaggacagtttgactagcatgtccataaggatggatacacaaacatgataaacaaaaaatatacaaacaacgggacaaattcatagatcaagcagcacatattacacagtgactttagccattcaatgttctacagagtgatggtcaatacatacatattatataattatgtgcacaagtgctgagctataatgtctgcatgagacatgtctacatgctcatcggctattcagaaagcgaataagacttcatttccgaaactccaaataatcccatttgcatcaaacaggaagctgtaagcattctaggaaagcagagccctgtgcgaatctctacaggataatgtatatattgtcaacaaactgtcatgtgatcaggctttcatttgtatgcatttgaatttggtcttacatcatcaaatgtatataagaaaggctaactattggaaaaccttggcaacaatctttaacacttgggatcaaataatcagaaatatagactagaaaaatttcgaaggcaggtccttgcttcctcactgcacaaattatttaatattcacttgatccgccagcatttgaaccagaaagtaacaaagtaaaaaaaaaaaccagaaatctgcatttcaacgagcttgcaagacaacattaagtaaataagagatgctagacatagaccgaacattgtccaccgatctaaataaaatccgtgacacctaaactgtcaccaccctaccaaaaccctccctaaatgctgggtagaaatgcgcaccaaatcaaccctgatcgtgcagaaaaaaacgatatgctttacagaagactcatacagcaatccacagatgctacaatttgaaaatgaaaaaaaaaaaactacaccccaccgcatcatgccaagcttctccactaaatcaactaaagaacacgagcaaacgaggttagatcaagaatcacttacgagcgccatctcgacggggccgccgccttagctcccactcactcgatttcagatctgcacatcatgaggaaacaaaaatccaaaaaaatttaaaaaaaaatccgcaaaatcaacagtacgcaacaatggcgcaagcacactagttagttgtagcgaatcggggagatcttacggtggcggaggcgaggcgagcagtggagggagcagcaagacgaaccctagtggaagaagtagcagcggcagcaaaaacagtggagggattcgacgcagccgattctacttacgatctcgcctagggttgcgcgcgggtgatctcggccgtccgatgagtaagccttgcgacagatcggacggcgcagagcagatccaaccactccgtaggcgggcattcgtctggcactctggccccttccagtcgagcccgttggatcgaaacgggccttgggcattttttctaaaaaaaattaaatccatttctttcccataaaaaaattaaataaattttagaaaattatatatatataggttaatttatcataaaactacatacaaaagtattgccacacttgtctaagtgaggcgatcaaattcttggtcacactttagcaagcctaagaaaatcttgcaacacatttttgagtcaataacgtatatgactcgtttattggaagagaatcttgccacaactgtgactacaaccaaacaccctaaaatttactcaaaattaaactaaccaaagttattaaggggaaggagattagtattacagaatactgagtggagtaaggaccaacgttattaaggggaaggagatagtattatagaatacgaaatggagtaaggaggatttaatgttcgcatggtggtgatgctgtgagttaatttcaaggcatgtataaaggtagagtctaatatgagctctttatattaattaatattactagagactatatcctactacctccgtttcaggttataagactttctagcattcttcacattcatatagatgttagtgaatctaggcacacatatatgtttagattcattaacatatatatgaatattagcaatgttagaaagtaaacggaggaagtactaaagtaataaagacaataagttttctaaaccattaatgtataaataaatttttattatacttctttcatttttctccactctcatgcaacaaacttttcgttaatgaatgctaagagtcgactctgagccgttgtcatgcgtatcaacgatgtttttccttccttccatctctttctttcacgtgactctgaggagccgttgtcatgtcatgcgtccctctctttctttcacttgactctgaggagccgttgtcatgcatagcaacgatatttctccttcattccctctatttcttccacattaactctaaaccctaaaccgttgtcatccgtagttgtttctccttccttccctttctttctttaacgtcactaaatttactccgcaaatgcttaggcaagttgacacattgacaaaacgcaaatctctgatccatgcgttgtagatcccatttttgattcaggagattattatccggcttaccaagctatgcttttcatgtaaaaaatttctatataatagaagtttcttggaaatatttttctaaagcaaaattttaaattaatagtaattcgttcattcattcatttatataccctcaaatagccatcaccaaaccagataatcaagaaaatctcaatagaaacgaacatggccttcgtctgcgtgcccagcgctgaaagcaaaagaaaaaaaaaagaaacacaacaaacatgaacaacagaataaaatacataaaataacccagcaccataactcgttttgttgcctatttccaaaacattatcagaatggcaagtttaacacatgagcaacagcagattcgaatggtgtgtttctgacgatgattcgatggataagtgtcttaacaacttaactacaaggttaaaaagggccaaaactctagcaaacagtacaaaaagaaaagaccagcacactcaatattgactaatatagccacatggtgatagtattttttttttcataatcatgaactattgtagaagggtaaatccaaaacctaaatagctcattttccacggtatccttgctccaacgacgcctcacttgaagcatttcgcatccagcaacgactcgccctcaaatggctccaggtcctcaatcatggcgctgacgcgctccttctgggcctcatctgagatgtcaaccttggtccactcatagagctccatgtcatagacttcatccatgacgaacttggggatctcggggccacggaagagccaaagacccttcaccttgaatggcggctcagagccgatcacaagcatcttcccgaaagcatatttgcggcacaggtccattcgctgcaggaacccaccaaccttgttcatggtcacgaaggacacagtgttctcgtcattgtatttgtagtcacaaaaccacagggagtaaccttctgggtcatacatatcccagaaacctgcaataagtgagaagacatgttgagttcaattcacagaacttcatacacaacagaagttgggagcagatgacaaataatggtaatcaaagagatataacttgctaacagttgacaggtcaacaaacaaatttgcattgactctttagtagctgttataatttgtaagccaatttgtactcatatctttctagtgtactcacagcaatgtagtaaacttttctctgtggaaacctttttagtgactactagattcccgaaagaaactatacttttcta

SEQ ID NO: 3004 - DNA, 2123 bp, Oryza sativa
cttttcaacgtggaaacattttagtgacgactagattcccaaaagaaacttacccttgatagcaacctcacggaaatatgtttttgtgtttgagtataacctcttccactcatcaaggatcatcttgcttggagggagcaaatcaagagggttctttggctttggctttggtgcctcctcttcctcctctggtttctcaactgccttaggttttggagcctctttcttggcttcctttggcttctgctcctttggtggtggagccttcttttgaactggtgggacagactctgcctgcttcacatcacccaagactttcttaaagtttggctgattaaccatggtccagaagtacctctcaacatgagggaactcagaagtaaaactcttggtcatgatccgagcaaagcccatgtagaggttacaggtcatcacaatatcagcaagagtcaccgaatggccaacaaggtatgtgtttgatgcaaggtgtgtgttgagggcacccaatgatctcttcaaagcagcaatagctgcttcctcactctgttgggcagaaataagattagacaacaaattgctgacacaaggaaaacactatgacacccacttgaccatacttaccacagcaacatagggagcaattcctagccgtgggtagagccattttccaatattagcatcaacctctgtggccgaaaagtcattccactgctcgatgtgggcctggaagaaacatacaattctagaagctcgtaaaataatcaagaatgatcttaaatatctatggaagaccactcacatattcaatcagtgaagacccatagagtgggttgtcagccttcgagcgggtaacttcaggaaaatgacagtgacttagaactaaatcagatatgatagaaaaagattaagagaactccaattccttgctatgtatcacttaccatatcgtgcaatcgcattgctctcaaaaacaggaccatcaggagtctctagaacaggaatctgaaagaaaacgtgtccaaataagattctgtgcgaatgtccaaaatacagggatggtttttgttcaaaccttcccaataggattcatcttgagaaactcaggtgtcttgttggagacacccatctgaaagttcttcaccaactcaaccttgacaccagagtactcggcagcaatgagtgccttgaatgcattcttgtttccactgccagcatgcaatacctaatcacagacgaataatgtacataaggttggagacacaagcatgataaacaaaaacgatacaagcagaggaaccaattcacagatcaagaagcatatattacaaagtaactttagcttccaatgttgtgcatagcgataatcaatgcaaataattatataattatgtgcagaagtgctgagctacataaggtcaacgtgagatcagatattctgaaagcaaataaaacacattttggaaactgtaaatgaatccatttgcatcaaacaaaaagctctaagcgttctaggaaatcaaccctgtgcatgtctatgcaggataacgagtataatgttaacaagccggcatgacactgggcactcatttacttgcattgaatacgaacttactttggcaatagtgcaacacttggtatccaatgagataatcagaaaaaaatgacagtgcagaaaaaaaatcatagctccttactacaaattaagtaattcactccatccactagcattagaagcagagagtaacaaagtaaagaacaccataaatcttcttcaaccaccagcacttgaaccagaaagtaacagtaaaagaacaccagaaatcattgatatcaacgagctcgcaagccagcatgaagaaaatcagagatgctagacataaccgaacattgtcaacgatccaagtcaaatcctgaacacctaaattgtcaacaccctacaaaaacccttcctagatcgaaacactgggtagcaatgcgcatcaaatcaaccctgatcatgcagaaaaaaagattttctcatagcagactatacaacaacccgcacaagctataatttgaaatgaacaaccaaaccccccaccgcatcaggccaagctttcccactattaatccccacaaatcaa

SEQ ID NO: 3005 - DNA, 699 bp, Oryza sativa
gtgatcctgaccgtccgatgagggatcgaacggcgcagatcaggctcggcatctccgtagccgaggccattcgtctgggcctcttcagtcgagcctgttgggctgtaacgggcctcatgccttcgctttatatgttgggctgaaatgggccttagtcctttcttgttgggccttccagtcgtaacgatcctttattttttttcttttctgcttttttttttgtgctgattagtttattattattgcttctcccacggcgtcgggttgggctgtgctctctgggcgcggcgacgcggcggcgcggcggcgtcgccggcggcgggcggagatgagttgttgcaggtatacgcggccttctcatcgtcttccgctcctagaccctgggtttttgtgttggctggtgagatggaagcgctggcgtgatttgccctgcgacgctgcgtcgtcgctcaccacatgttcggcgaaatgcgcccccggccaagatttgtggtctggtacctttcttgcgtgtggcgacgctgggtgttgagctatatgagcttgtagaggtttctgtgcgtccctgatcttgggttcggctgtggatgtggtggtcggagaagcatccggcggtgccttagttagtgcagaaaattcggcgtttctttcggcatttttaccatttacggcttatttgcaccggtataaagttaggtg

SEQ ID NO: 3006 - DNA, 26911 bp, Oryza sativa
catcctatccattagctagtccattgtcttgacttgtcaatgtcatatgtttcttttcaaactttcctggatacacctttattttgttgttgcatggtacaaacattcacaattatttttgagacatgattgcaagatttaagcatgagagagaaagtacatgtagttgctcatacgctgtgttgttttctttcttcatataaatgaaattcaatgatgtgatggaaacatagcgagaggtagcacatcaggaatgttctcccaactgagctctgaacataatccatccattcaactatttgcatatggcatgttattttttttatgctttcttagtattatgtaaactattatagcttaatttacaaaaaaaaaattagaggtggaaattttaatggtgaggcatcacattagagttccaggaacgtgcagtgaaccaaaaaaaattggtgcctcaacagatcaaatcttatgattgttctgatattgtgtgcttctgttgtatcaaagtaggagacttacaaaataagtgggaacaatattatagggcctgtttgggggagcttaagattctaataagcagctgattagtatccagcttctgagaatctggaaaagctgggtttcccagcttctggcttctagttcatttcctgatctacaactacagtttctcagaatttggaccaaaagctggactgtttaggggagcttatgattctgggagaagctataacaactagaagcttccccaaacaagcccatagtttccatccttgatttggtaaaccctcatttccctttttacccctagttttgaaaaattacctggtgcatcattcactcgtagcataatctcaaaatcatgtggagtgacattaagccgaaaaataagtggttgtggctcagcccttcatcacacccctaggttaccttatccaattcctctcaattagtgtattctttgttttctgtctttttgttgtttctttaatagcaacggctcgttatggctgtgtgctgcgcagagccacttattgcattgcttggtaatcacatatttgtcttattatattatcataggtatacttttaaaaaattaaatcaaattatgatcatatctgaactattccatctcttattttttgtactattgtgattcattgatttacatgtttactagcagttactacatttctgatattattcctgtaagtgtcattgcaggcctcctttttcttgatgataaacttggtattgcctactcctagaagatgtttgacaattggagactgcagcgcaacttttctcaaatatctaggcctttctttgtcctaatgaagagaagtttgcaagattggaaaaaagaagtgattcttggcaatgcctgttgtgtatagaacattttattcacttgggtgccactgataagcctaattcaccatgaacacctctcagttgggtttttgtactttagcctgcactctggtatgaacacctcagcttcttcactcaagattactatttagattttattttctgactcctttttatttccctttcctcatttctacccctggttttaccatgattctgttaactgagtatttagagctaacagagaatcattttttgctggagtatttgggaacattttatgtttagcaacagtacatcttctgatattcttcatgaaattcattgctagactggcagcaacccttcaaagctgaacactgtagcgttctgttttctttcttattatttagtaatgatgaagtgcatgtatatacataaaccctctcatttgtgtgtatcatgatcccacacacacatgagggtccacgtaggcatggagcgtattgtgtctttttgcacaaagccatgatcccgttggatttgcaagagccttgtgaaagctacatttttgttggccacaagtctatcattgagctgggcaccttacatcttgtgacagtgagtgaatttattctcacagacactcttgctcaaggagtgattcaaaaggctcatacgtatacatcttaaccatcatacaaactagaagctggctgtctatcaaagtgaacattatccagctatacgagtggtacgataagaatttggtagtgtgggcctgaagttttcatgtaattatctgtgaacatatatatacggcctctctgtagtaccgtattagcgaaaagctggcgtttggcttcatgctatttttaacctttattttggggcatactttttcaatatttcaccggacatctttggcgaaacaaaagatcttatggtgttgtgtgatgttttgaggataaccagtcattttctagtagatctattctatagctgagatctctttcttgcttccgttacgtttggagaatatagcatgcatgtcttaacagaaacacgctcttacattattgctactactgtagcttaagcacatggactgtcagcataagtaaacgaatgatgtcacagctgcagcctttaccataagagtttgatccttcagtagatgttaaatttagatatatggagtagatgttaaatttagattcaatctccttcagtattgctcaagcacttcgaatgatattgcatcatgcataacaaaatggctcattacacaatgatgaggcaaggacagtactgtttgcggtagtatgggggatcatttggtcacttcttgagataagattgtgacaaattcatttagatgcttaattattgataacatataccaccttatcaatctcaaatttctgtgctgacttatagctgcactcttcttgcagtatctttatttatgcaggagggattactccggataaatcataaagggtctagatccaatgtcacgaagacaacttctgcattctgtctgaggatatgacgattcacaactgaaccatgcctgacagattattgcgcaaaccgaggcgaaaagttcagtgcagagatctgctcgtcatttcgtcgagatggtacaaacccaggtgctagcttctccaaaataccaaaagagctccagtcccagctctctcctacttcatcagtatccttcttcccacacagctcagaggtgcgtcaccgatctcgatgcactctgggaaatgcctacgcgacacgtgtcctactcctattgctatctttgatgatcactgattctctctgctctccattgtaggttgatcgatcaacgatctcgccaaacgggcgttttcgttgtcgacctctgtctcctttgtacgcatatataccgcgtacgtacggaggcgcgcgcagtgggcgcgctgcgctgccagccccaaaatctgctccattagttgcttgtttgggagcgctcctcgctgagctttgtccccaacgggatcacgagagggggaggaacaagttgcccagattttggacccttgccaatggaagtgtgtgggcttgtcatgtgggaagagccgtcgctttcagggtttaagctgtttctgctcctcctctctcttgctcatgggcaataagtgagattttggttgcgcattagagggatgtgtgccatgtttattgcagctttggctttattttagtccctcgacctctcccaagtgatgataaagactggttgaatagtcagcaggcaggccgtagattggctagcgtatgtaacagtatgatgagatcatgcagtcagtatatcctgttctgagtcgtggaaaagatttgccctttcatggacctaggtcgactctgttcatcacaaatcagagcaggtaaaaatattttgcctaaacagtagtatatttttaatctttgaactgatgatggtataaatgtcttgttgatgttgctgtaggctctggggatatatatatatatatatatatatatatatatatatatatatatatatatatatatatatatatatatatcatatattttagctgtgctgaaactcttggaatttgatcctccgtacttggcatatttcattaaggtaatctctctctcggcctcctactgccgccagaaaattatctgatataatttcgtatgatactatgattaatttcgtactgccggtgttagctcttggctagaggcaaaactacccctgttacatttgcttctgccgctaaatccaaaaaccatgcttgcatatgggcctggggcccttggcgcaggaagtgtctcattgcctgctcatgtcttaatgtttctttgtctccagtgcgtgtgtgactgtgtgagagagaaaaccagagagagagagggatggctaatggcttcttcatgcaaacctatctattagagccactgcactgattcttcacccgattttacacaggcaggcctccctgctgaatggctccagcttttgttcaaccgatctgtcgtttatactacagtgctgggaaacgtgcatgtactgcatgtactaacagatgcatggcatgtgagagttagttaactaggtagtagccctagctagctactccatctattccacgaaaaccaacctaggatatgatgtgattttttttagtacaatgaatctggacatacctctgtttagattcattgtactagaaaacgttacatctcattttaaattggttttttatgggatggagggagtagatgtgatcatgtcacaatatacagttatttacataggttcgcagtcaatgattgctgattagactattagtcgtgcaattaattattagttactcgaatgtgctcgtgcagtagcaggatttggatggtgtagggtaggatttgccagctgatctacaagctacttgcatgtaaactttcatgtagttcatacagggaacgcatttatatatattcccgtaaaaacaactccttcatgtgatgctaattaaatctatgcatcttcgaactaataataataataataataataataataataataataataataataataataataataatgatgatgatgtgcacgacttgtttgtttgatcatacatttcttgctcaacttgcagtgaggttttgattttgctggtaattagctacgcctagtcacaaaaggcaataatgtggctataggcatatttataagtttcagatttggcacactaaattttttttgacgcaagaaggtagagcatgccctaccttatagtcatttcattaagagaaatgaggtttataggttacaagttatgagtgtagcagagggggtagagggagcagaaaaaagggaaaacaggaaaaacaaaatagacaaaacaaaagagaagaatagaaaacagggggctggatttacaggggtatatacaaagcagtgtcacaaagacagccctgcacaccaggagaattggtacacttaattgatgtgtggatggctttcaaaagtgctttcacaaaataatatgtcaatatttaatatattttatgaatagagcattaaggttgtattgggaccatgctgacatgcatccaaaatgtcactataaccagagagagtatttaatacataatttattgataaattaattttggagccaaacaagggagattaaactccctctgttcttaaaataataaatgttttcaaaagtgtgatcaattttgtaaaagaaggttaatttgttgtatgaacacggaatcacttgttttgcgggacatactttttctttttttggggggtttatattggtgtattagagaacatgtcgatatctcattttttttcttaagaaacacagtataaatgcaagcgcccacaacgcacgtacagtcaccctatgaacgcacatttcttgagattgacgaaggcagagcacctcagaaagactgggccgacatttcttgagattgacgaagtcaccacatatgccttgttgttgatgggtacatcgcctaccactgaaagaataataagccgttgcgaacaccgtgtcaaatctagtttttgaacttgggtgggctggttccaccacaaagaacctaaccagttgagctactctcacttcacgatatctaatattacaagttaatctttgaattggaagcaaatttggtcaaatatatcccaactgatactcttaaattaataatattactcgaaatcaaaagctatagatataattgttgaatttccctggtttagtgaaattctatgccttgttttctctttgatcgtgtttttgaggaaatcatgacgcctattgtacttccaataccacatatatataggagtggattctaaactctcgaggggattatcccttgttatttgcatatcattcaaatgattatgaaaaaaatcaactagatagattaatatgtgatagatcactccacaaacatacaaattaaaattcaacttttacaagttgcaacaaaaaaacaaactaaactatggctagttaacgtgtattcatagtcaaatttattttttacgttacaacttatagaaattaaatttgatcttgcatgattgtggagtgatttaccatataataatctatcttgttaatttttttaatttttttcataaccatttagatggcgtgcaaataacgaggggtgtctccttgagagtttagaatatatgtatgtatgtctgtttgtttcacagtcgaaacccacagatccaaacactttatatatgcagagcgtgccatgcaatatttcattaggaaattaatattacctacattaaggtgctaagctgtttatacatgggaaatatatgtctagtgccattgtgcaaacatatactctatcatgggtgctaattaatttgcttactcgtcacatgagccgttggatgagattttggaacatatatatagtgcatgatgtatgcaacgctgcaatcatcctgcatcacggtcttgagataacaggcaaaatacttttgtagaaaacgatgaatactgctgcgccaggtagggcacacgctgctactgcctgcagctgcatgcatgagatcttaattggttgttgttttggaatgaatgttttgcatgttgtacagtgcgcagtgtgttttttttttccccactgtttgcctttggttttcctgtgctaactgtgttcgccctctttctcaggaaagggatcacacacatggcatccttctaaatcttcctaggcccgagctggagagggattgatggcagctcttggctcctcttgcttcccttttattaaaaggacatgcctctctccactgtccatgatcatcccctgggcccttgtaaattgcccctccaacagcagatcctccggcccctaggcagccacactactctcctctccacatctctatcttccttatatgcaatatccctgatacagttgtttgtactgcctgaagctacaccaatataattcccagatctcctcagctaagctatagcttctctcccatctctttcctcctcctcctctctgatatgtctactatctacatgagccagctacctgctactctccctctaatggagggggatcaggatcaggggctctacccagccttccatagagcaaaggaccctcctatcttgttccctttcatgatcgacagcgccgtcgagcaccaagggcaaatctatggagatcagggcttgaggaggcagcaggttttgggtgaatccaatcaacaggtgaggggatcgatcacatacatgtgtagaacaagctagctacttatacacatgtagatcagtgcttctttcttagtatatatgctgcttgccctaataattttagcttatactcctcttctttttctcttttttttgctcttgcagttcaatgatcacatgatgatgggcggatcagatgtcttcctcacaccgtctccgttccgaccaaccatccaaagcatcggcagcgacatgatccagcgatcatcttatgatccatacgatatcgagagtaacaacaagcagcatgccaatggatcaaccagcaagtggatgtcgacgccgccaatgaagatgaggatcataaggaagggggcggcaaccgatcctgagggcggggcggtgagaaagccaaggagaagagcacaagcgcaccaggatgagagccagcaacaactgcagcaagctttgggtgtcgttagagtgtgctcggactgcaacaccaccaagacccccttgtggagaagtggtccttgtggccccaaggtgagatttacttgctcttacacccctattaacaactgcccaaactcatgtgttgatctgtctgtctgggtgctatatgctaccttactatgtgcattttctctttgttttgttacaccagatcatcatgcatatgttaaagattgttgatttccttggtttaaattgtgtgttgtgctatgcatatggtgcagtccctttgcaacgcgtgtggcatcaggcaaaggaaggcgcggcgggcgatggccgctgctgccaacggcggagcggcggtggcgccggcaaagagcgtggccgcggcgccggtgaacaataagccggcggcgaagaaggagaagagggcggcggacgtcgaccggtcgctgccgttcaagaaacggtgcaagatggtcgatcacgttgctgctgccgtcgctgccaccaagcccacggctgctggagaagtagtggccgccgctccgaaggaccaagatcacgtcatcgtcgtcggtggcgagaacgccgccgccacctccatgccggcacagaacccgatatccaaggcggcggcgaccgccgctgccgccgccgcctctccggcgttcttccacggcctccctcgcgacgagatcaccgacgccgccatgctgctcatgaccctatcctgtggcctcgtccacagctagctagctagctgatcaaaactagctagctactagtaccgttaatttgatgagggcaacaaccagagtactatgtaccactactagcaatattttgtgtgtgccttgtgatcttttgttgttttgtgttgttgaggagatcactagatcaggatgaaggagagatagtgatcacatgtctaaggacgaaataaacgagaacaaactcgctagctagctactagccgggatcaggattatatttactatcagctgagtgattagcttgaggtttttttttattaccccctactgctgctaattaatcaagccacttttgtatcatgtttcttagttctttcttcttgtatctgttatgtttggagctaataataatatggagattggagagaatcggatgtagtgaaactagcagatcgtactgtaggtgtacttctactattcattgggtgtcgttcatggatgcatgacttgttcttgctgttacatatgtcagctagcttatgtatatatatgatctctgtcagttgtcaaaagctggccttctcactttttttgggagacaaacattctctctatcgtgtcagctatatatgcatgcatgtgtgtggcagtgaggctagtccgtagtgaaccctttgattttggaaatgtgtgtcctatatatactatagtacatacaaacttttgctacaattacagtacgtccatacatagatgtctgatggacaatatacaataccagctaccatattagctgtaggtacgtgttatttacatcaatgtattcaaacaatatcgttagataacaataagttaatccagaaagtagcaattgcttgtgtgttccgtttctaattaaccaacatgacgaacagatgtgtaacgttttcagtaaaaaagacatgccttaaaatatctatatattactagtaaacaacaatgaaacaaattaaacatatatccgctcggatgcaaaaaaagaaaaaagaagtgaaaaagatgatgaaacaaattaaacatatatccgctcggatgcaaaaaagaaaaaagaagtgaaaaagattggtagctagggaaaatacaaaaaagtcatgtatcaggccgtatgcagttatggttttttttataagaatgcaagaatgttcaaattgtttggagtttacacaagaaaaacacaagaaattaaaggcacaaagaaatattatatatgcacatgcaagtgagcaatgtaggattttagtgaaatcatgtgtgacggctgctagttcccgtctctttaaatgtatgttaaaaggcagatttgagggtatatgtggtgttgcgtgtgtaattgtgtatgggtgtctacgtctgcgtgtataagaataaaaagatacatacaacacaaaacgaatataattttgtaagacaaaaggtagagctagctcatgcaccctgaatggctgaagaagaattaatcctatttttctttacttaactgcatgcataaacaattcattaattactttcatgcacaagcttagcctagctaatataccgtaccgaactgctacccatatatgtaggagtaccgtaccttgcgtgcccggatcagtaaaagctaaaagcagccctaagtaaaagttactccatccgtttcacaatataagtcaatttaacattttttacgttcatactgatattaatgaatctagacatatatatttatctagatttattaataccaatatgaatgtgggaaatgctagaatgacctatattgtgaaacggaggaagtaatagtctctgtttcaaaatatagcaactaaaactggttaaaatttattttagtcaaaatttgttgaactgtacacaatatatttcattcagttttatattgttatgttttgagacgagaatagtagcatgcatgacagctcatgcagcagaagggacagtataggagtcggacactgccggcaaagtgccaggagtatcctgcaacatgcacacatgtacgtacgatactgtaaactgcacgcatgataatacgatattttgtttgttttttttttgtctgttacggagtacaacaatatcgtattaaccgtatcgagcttagtacagtaccagttctgtgaaataacagcactagttattgtataatttttgccattttattatgatgtgtgtaattgatttttattttctaggtgtttcacatgcacggactacatgaaacctcacatgcattgttgcggaagttctatatgataataagtagaaataatatttaagatagctaaacggcataagcttatataagttaacgtggtttacgagaatttaactagcatgatgatccaaatataaaaaataagatggtgtgtctttatgagagagaaaaagattcggaccatagattaattatttaaaggccaaaaataattaaggtgatatggcttgatgagataagaaagaaataacattaattaagtgatgatgaactatataggtatgatattgtaaaaaaaatgatgaagatatatattgaaatcactactacataaacacaaatagatgctggttggaaaccccacataggtgtcggttggagaaggcgacactgctgagagaaatcaaaggggccagttctagaaccggcacctttgaggtctcaagaatccaaaaagaaagtggctcgtgcatcaactcgaatcgagctgatgcatcgagcatctccccttcaccccgaccagatcaaagaacacatgaacatcaacaacatccaagaacacatcaatatgaacatcaagaacaagacgctgaagcttcgatggactactgcctgacgaggatacacatagggccgacgtcctactccacccttgccacggttgccggatgaagaggagaagaggaggaggggcgagcctccttctctcctcccgttgtagccgtcgccgcctcccctcccgccatcgaaggccgccaccgtctctcctcccgctggatctagcggaggagagggcgcggtcgtcgccaccccctcccatcggatctagcagaggggagggtgcgaccgccacctccgctaggctgccgcccgccgccacatgagacacagagagagagagagagagaagtatgggagagaaagagaccgaggcaggtgtgggcgagtggataaggtcaggtactcggtttgcctgtttggctaggtttggtataggtgtcgttttttcatataatatattatatttaaggtacagtgtttttaaaagaactggcacatactccctccatactcgtaaaggaagtcgtttagtacaatgtttaagtcaaaccttgggaatataaatcataaataactctcaaagttattgagtttgaaaaggtaaaaattatatgaatatatttgtcttgaaaaatactttcataaaagtatacatatatcacttttaaataaatatttttatagaaacaagaagttaaagttgtgttttgaagaccgcgtcgctgtcctaaatgacttcctttacgagtacggagggagtataaatgttgtcagcccgcgaaggtggaaaaagcactataggtgtcggttttagatgtttcgtgtgacttgtatatgcctttctgtagtagtgaatattatctgaatataggtatgtgatattgtaaacaatgctgaagatatatattgaaatattatgtgaattatgtgggatgatgatttaaatatatgcttgtattttaaagctctaaaatttaataaattatataaataatatagcatgcttccatgaggtttaaaatgtaataattattagtgaatgatgatgtgatatatgtgcgtgttgagttataggatatagtgttttgtaactgttttgtaactttatagatagataggattatacgtgttttggcaagactaattaagagaggttttgctatatcaaattttggtccaattcgtctcatttgaccataatcgaagtccaacctcgcaccaaatagattagtaactgtatacaatatgtattgcaaactttaattaaataggcatatataagaagtacgtttaaatcctagacttgataagggtgtttatttttacggctaattattttttcagtgatatatgacataattatggacagcgagatatcagtgatgactttgacaatctcaatatatgtcagctcagtttttcgtaggtgctcatagaaatattgcatacgtgtgtgtttatagaggggtgagtgtgcgtgtgttgtgtaagcgtttatgtttataccgtgtttctcgaaacaaaaaattaatcttaaactaatctaattaattaagggaagaattaatttctccaacaaaaaccagtaccccaccttctcttcgtggctttacggtagtgtaaaaaaacaaaagaaaagatcttttggtggttcacggacgagtgcgctgcccaccagccacgcagcgcagcatccaatgcaggccactctagcgaaactgcaaaagtttaccacacaacaaattaaaagggtccttttaactctggacaatctgtaaacaggtagtggattttttttttagaattacacagtacaacgcagacactcacaacacacgcgcattcaccccctaataaagcaaattctggagagattgacgaagtcaccacatgcgccttgctgtcgacgggtacgtcgtctaccactgaaagcacaacgccgttaaatcctgaaaaatttgctcccatggggagtcaaacctaggacctcaggtgctactgagtctcttgtaaccactaggctacaggccctttcgcaagatttgacatcatggattagtactacccaaatacctacccaatgcatgctaaaccaacctatgttaattttggcaacacaaataatgatactaaaaaaattattcacaggaagaaatgatatcggaagtaccaacaaaaagctaagataagatgagagatgcgatgtggcgaagggaaaaagatgagtatgtcattgtgtggtttttcgaccggggccgaggtggcatcttggcagcagcagggccccaaatggctgcagggctgcatgtagcatcttggcatttcatgctaaagccagccggggcccggacaggacactgtagtcgaaaaccaaaccagatgaggtcctctgcagtactactacactatacccgtggtattggcgtattgctcgctgatacataggtcaccacactgatagtaataacgtagagaatcgatattaactaccaacgtatgtataactagtataactagaaaatatatatgtaccatgtaacgattgttgggagattaatagaaatcacatataatgaacagagaagagtcatgtatagtttgtggggtcttgcggtatttgtatattcttagaaaaacataagtgcgcagaaaagattttacattatgttcttctcttcctaaatcttagatctaggccaaatagaccacatggtaaattagccggtgctggtggcctaatccgagcatcatacactactagaaaaactattttttctaggtggtcaaaaatggtctatggtgccaaaaattctcgccccccgtcccccattcacctatgatgccaaaaaacatacccgccaaggaaagaaaaaaaggatctcatctacggaaatcgttttcatagtagtgatataggatttgaaaacaaacgacacaatttgtagccaatccaatccgaaaattatttaatgcatcttataagatagtaattgggtgatacattgtgctttactatgaaatgaatgaatatatatgctaaatattatagaaatagtaaatgttaaaatattgtgaaaaataatgtaagaaagatgatttaacatacttatatatgttcaactatataatatgatattttaaatgtgtcatgcctgcatgtgaattaagatgctttgtatagtaattgctagtagataatgatgcggtatatttacatgttgcgctttaccttctaataattggtacaatggataccatctatatagaagttacatatataggtatagtaattagcaaaagatcgtgttgagctacaatgccaatttaccattttatcacacttaaccttccatagcatttttcggcttctttaatttacgctgaacaatattttccttctctatgtttccttttttactctttatacaaatatgtttatttttttagaaccataacaatataacctgtgaaaaatacttctaatttctctatgaaagtttccattcagttataaatcctgatttttgaatcaatcccaattgcttctaacctatgcaaatagtgataaaaaatttcaagaaaaatctaaggcatgaggtatatataatgctccctatcatatctcatatattttcaatttaaaatatgccatatgtaaaaagagacaaatatacaaatatcatgagggagtaaagtgagatcatttttaatagcttagtggacaaaaagatttgaggttaagtggtctaccaactagacgagactaaatggttatgaatgattaccatcgatcattcgaacatggctagtacgtagtagggaccttacctgatactgtacaagccaggggtacgccatgagcatgtcagaaacttgtgtatccatgcatttggacattttattttgtaccttttgatgccttcatcccacatggcaatatcattataccaccctttatttctctataagaactgagaagtaccactagctagtacatataccctcctctcctaaatataaatatttttagcagcccatcgcttggcgtacagctgattataagtcataacgcttattaacaataagaaaataacttatgagtaaaccttttagacatattgttcttagcgacttaaaacgtcgtgaaaaccaatgctggtaaacaaattgcaactaaaaccattaaatcaactataaattaaaattaagttttaaattttaaatactttatattatatatataatttaaatcctataaatgcttatctactaaaaagcagagtgtccatcctctcctctccacgttgtgcacacgtcgcgtgaagtgtaaccactgcctccccataaaaacaaaattaagaaattaagattggttaataaaataaattggatgatccaatggtttaaacttgatccacagtcctggcctattctgggtcagatgggcccattgcaatgtacagaatattggattgttttcatatggaaaagaaactactcaccggttagaaaaggagagtagtttcctttggagggtgctaaatattggatatgttttcatatagatagatgttgttttaaatagatttttggctaaatcttgaaattatactcactaatataaaaaagaataaatgcggaaataacattagtatatatctatcacaaaaatactctcttgcagctatttttaataatttgattattttacaagtgatttaaaaaaatctaatgataaaacatgtacatttcttattatgacggccctttaaactacaagtaaaatagagttaatattattttcttagagaggaaattttttacgaggttttaaaagaggatattgtatactaccacatactttaagtgcaatgcagatgtatcaattatttttgtgatatacagtacacataatcttcttttaagatatataattacacgtactacacataagctagcagctcagccggaagttcctcccattgataaggtaacacagtctcatgttagttttcatttttttttcatcttttagtgtgaatataccgtgatatttacaagaaagacagtaaagtttggagggatgcggctaatgtttggttcgtttgattctttggttaatggatgtgggattttggtgcgatgagaatgacgattgagggaaccctccttaatataaggggctgagagttgaaagacaattccttctttgcattatccaaataaatttcaaccgtatatttctttttccttgagatcttatctctatttaatctctctaccaattcccaccacttctatatgtcaacaaaataccgggacttgaaaaaaaaatcaaatattcatcctaatcttactattagttcgcttatctaacaacaaaatggcggtgtatatccacatgtggatatagagccagatttttatccattataaaaaaaagactcccagtactcatctcttttttctgattaagatatatattttatcttgatttctattagcatgttttttataatgctaacggtacatatcgtatgaaatttttctataaaagttgctttaaaataatagataaatctatttcttaagtttttaataatcaaaacttaattaatcatgtactaattttttctatcaactttttctatcgtttatcttcagtagaaacaaatgccaccttagagagttgccaagcatgtcgctcctctgacgtaaagtcagagggatgtgggtcactgacgtgtagtctctctgactttacgtcacaggagactcatccatttacctgccgtcgctcaactttacgtcgagtgtgtatggccttcctaatccccaaaaccagaaatcttcacccctcaaatgtttaaaaccgtgcaatcaacgtcctatgatagtatatatgagtggtttcactgacgtggcatcctcagcaatctgggcccacgtgtaagtgagaaaaaatgtgggacccgcataccttctttccaccatttacttctttttttaaaattttcttcttcttctatgttcctttttctcttcttttgttttctctttgcacggaagcgggcggcggagtggagcgaagcggcggcggcgacggtgggagaagaggggaggaggccagccagagaagaggggggaagaggctggcgggagagggggggaggttgcgggctgtgccggcgggagaggaggaagatgcgactgccgctctcgcccgccgccgccgcctctcacggagcttatccttttgcacgtcgtcaccgtggtagattcccaacagcagcggctgaagaaggaaagagaataaaagaaaagagaaaagagaaggaaaaatgaagatgtggaccctacatttttttctcacttacatgtgggtcccatatacttttttttaatcttttcttgctgactaggatgccacatcagtaaaaccaggcatctatactgctataggacctaaattgaactgttttgtattgtttagggacgaagatttctagaactgaggataagtgatgtcaaacaaacacagtgtaaaattgagggacggtatgtgaacttactccctccaaggattgattgttaaggctaggctcaaaagatgggctgaaattaagggccatgtagcccatgtaggattgatatagttgatgccttattaccttattacatctgcctattctagaatgagttgtttaattgtaaaaaagacggcgtaacagaaaatatgagtatatatatatatatatatatatatatatatatatatatatatatatatatatatatatataaaattcctcttacattgacatacagaacctagactcaagttgaaagacgacttcggttcacacgtgaaagtgcttcgaaaggtgtcagcaggtgcgtggagccggagccagcatgttctccagctgggccgagtgttcgcccacttctgagtcttcacctttagagagaaatacgtgtccgccccagcaagaaaacggctgcgcgttattgtactaacgcgtgactctacagcaccacatatgaaaaatgttgtattagtaaaatgcaagaaaggaatttgaaaagccactccaacaccaaatccagttaagctttctttttcaaaagattaaactacacagaatgatttcatgatctttctcaaaagtcaaaactacacggaatgatttcaaacaaccttagtttgttccctttgaatcgtttcattaacgtgtgtgtaacattacaagccttgctaaacaaaaggaaacctaaaaaaaaataacgtggcaactacaacctacagcatcctcctaattgaatcaaccatatccagatttttttttctacatatatcttctaagaacaagttgcaatccctcttctagagttctttgggttttatcagcatttcagcttctcacaagcaacttaacttgcttttcaccctccgttacctcaaaactaaatccctaaacacctaattatctatactcctccttacctcaaaattatcatttgaccgactacatagacaccaccaccattgatgctggtgatgagaaaatcctctgtcctggtgacaatatcctgtgtgggtcatacttcgcctttagatcggcaaccctgctccacttagcaccgaaatggcgttgccacccatcttgtgatgtgtaatatggcagatactgcttgcacccgatgtcctcattatggcagaatgccaacaccgcctcgttctctttctctaggcgttccacatcaccaataactgccgcagaacggagcaaccccacagcgtagaacacatcatcgtcgctggccactgccatcatacagtcatcccacatattcgtattcatgggatacatgaggatgacgccaacagggttggcaccagcgaagacacccttaaacacaccagcatcaaagtcaaggatgcgtgatcgagggacgaagaggtttagccatgggtgcggaacatcccacatgccgatcgatcggagcaccctttcttcctccctcacacgatcaaggaattgcacgtatctcacatcctttgtgaacacgaagccttcctcaaagcttagctgccctagtattgactccaatttctgcaaggaaaccaatacattgatcattaacaaaatatccattatttcctttgaggccatagataacaatagtacttttacatggtatctattgaacacaaatggatcataattgtatacctgatccatagtggtgctggttgactcattgtaatacatggtgccttcgattacgtagatcactcctgacacagacttcgaggcaagtccagcaagcctgccaatatcgctgctagagaagaagggcgtcgacttgggaccctcggtgagtgtccggttgagctggacttgtccttcgacgtagtcgaagccggcttcgctagcccgttttgatataagcagctcctggtctttagtgaacgtggccacatccgagtaggcgagccggacccatcgcacccgcttcggagccggcatgagcccaatgcgagcccgggttatgatcccaaactggcccagcccacccagcaccgcgaagaacaggtccgagtccttgtcccttgagcacgtcaccatatcacccgttcctgcattaatcattgttaacagtgttcattagccgcttaatcatttgattaatgttgttaacaatgttcattagtacaagttaattagattgctaattaaaggggatgatgagttgtattagttagtaaattacctgtgatgacgtcaagctcgagcacgttggcgatctgcgggccgtgccggaacgcctggccgccgatgccggcgttggagagcgtgccggcgacggtgatgcggaggtagtccgtccacacgcgcggcgccaggccgtgttccagtgtcgcgcggaggacgtcggcccacagctgctcgccgccggcgtccacgtacggcgccgcgcccgcggacacgttgacgcggccgcggcgcgacgccagcgcgcgcatgtcgaccacgacgccgcccggggcgagcgactgcccgcgggcagagtggccctgcccgcgcggcgccacggggaacggcgacggcgacgacgccgagaaccggacgagctccgcgatctcggccggcgtggccgggtggagcaccgcctccggcgcggcggccacaatgcggccgaagtccgacgacgccctcgccgtcgagttgcggtcgacgcggagcttcgaggcgacactgagcgcgaagagatcgccgggaagcccaccggagacgacgacggacaggcagctcgccatgatcatgaacgcgatcgaacaccttgcagccatctctccgaaatgcaatcggattagcgaactgaacactgcaactcagatgctttgctgctcagctcaggtgatggactgattagagaaagagatgattagcttgtgtgtgttgtgttgggtcaaaactccatgacatttatataggtagcattttggccttacaaacgttgacaaatgtaggtagtgcacagcattgcattgatttattgctagtattctgatggattgacttctgagagaaaaatgaataatggaggctgaaacattgttagaagaaaacaaaacttgatcagtctcgtcatctcctgatgttttgacttgcagagaattcttaatgattttgccttttaaagaacaaagaaagtaatactatatttctgtcttgcaggctgagacatttataaactatgaacactatgtctaaaaaaattaagattttgaaccattctggtaggttcactactgcttttgtttgctaaagatacaaatttttgtcaacactcactcagcaccacatcataactatctatctcaaattctcaataaaccaaatagtggatcttaacttgaaaacaattttagagcgtgcaaattttagagtaactttacagcaaacacctagcttagccttgtcttgtcttaaatctcagaaccaactggtgttaggagatcactttttccgagctatttgtgaccagtttgttcaaagctttttttcaagatttttcctatggattatttgttctacgcttctaaatatatatttataaaaaaaagcttctttattgtttagatcacttattctaagatatttatgaagtttatttctgaaaatataaatttattgtgttaattaagtaatcaatctttagaaaaaaaaatttcatggccaattagtccgtcaaatttaatgcatgaaatttaaagtaattttacagacttggcctaatgttagcttaccttcataatcaactgagatgcaggacgacttaatctgtcaacaactctcactaacaaatcatatacaaatcatgctatatgcaggtaaacttaaattgactcttactatcttactcggtacatcatatggcttacattcatggtgtcctctctgtttaaccttccgttttgtttatatccggcatatatatataacatagactctgaatttggagtttgatcgtgtgcaatcctatcagaaacttctacagaaagtttcaaacaaatattatactgaagatttgaactaaatagaaaatggctatgtcggcaggtcatttactttagcataaacaagataaacaaggtaatgaaatgaaatactacaaggttgtagtttgggaggatgcgggaatgtagagccatatatataattttcaaccaaatcaaatctgaagatatgtcaactaccggaatagtctccatgggttagtggcgatcatctctgttctttaagaagctgcagcaagcaaagccaaaaaaagaaaacgaaaaaaaacaaagctaaaccttgtggtgtgattttctgtttagccatcatgtcctccattttcaatattgtagctcttccgattttctattcttgtccctttttttccaaagtgtaattaaacgtaaagtcaatgagttacatgtgtgtgcaacactgtggtctatatagtcaattgttggaaataaggatttttttttgggggggtggggggggaggggggcaagtgtttacgagtcccttttcatgatttttccgccttattaattcttactccctccggtttcaaattaattgatatttttggtaggatctcacatatcaagaaatagttagttagggtgcatattcatgttttacccatactaaatacattaggacggcacatctaacaatcacatcctcttaacctagtggttgtggctgcttgtcccgatgcatcaggttaatgtgatgtaggagaggatgcagtgttgtgcaggactcgatgcatcaagtcactaaatgtgatttgcatgcatgcagccatacaagagtaaatcagtctaaaataatcacatgaggctaaaacgtcaagttttttcatccaaagtgtccaagctccaagcgtcaactaatttaaaaccggagggagtaagtattatgtctttgctatcgatgggtgaacaccagtagcagggacccgatgggacccctttgagttaggctaggggaggaagaccttgagctacctcggaacgggaaaagaaataatcaaggagaacttagacaggttcaggccgctcaggggtgtaataccgaactcctgtgtgttgtgtgctatttctttgcctaagttccagttagaattttccaaccctttctcatggtttcagtccctccccttatagaatccaggtggaagcacaatgatcgtaccaaagggatgggttaagggtacatgtcatagactacatctagcttaacctgacaacatcttccttcgggtttcatgctatcccaacttgcccattatgctcattgttgtggtcctctttcgagcagagccgaagggggaaggggcgtgagcacctgccatgtgccctcaattggtacccactagctttagggtgatttaatgagggcgtcgtcatccatagtcagtgccccgtggccccacctatcggtgtccatgtggagtgggcaaaatgtggtgggccagacgacttcacaaagtgaaccgtaccgcctaccagccacatcgttcctcgacggatagatgataaggttcatcatgtcccctgtgctgcatgcatggacaggtagatatttgtaatcttgccccaagagggacgacactcatcgctccaacacattaaatccattagaagcagtttgactcttgagcactttcttgcggcgctaggtagaccgtaggtgcttggggccaaccatgctctagacagcacatcccaagagatcggggatacggccttgatgggtgctcgggggacgacttgctcgggacccccaagaagctagtcttcatcggaccgcactttcaaccgagtccatcagggtgcatgatcatcacgacagaccggtgctaccctttagagctcggggaatggatgtcatggcaccaagctgccccatgtttgcgatgtgaggaaccctagttccaatatcacccatcacctagtttaaactatttcataacaagtttgctagcgtggctatgtagaaacattgtggtgtgatttttgtttggccatcgtgtccttcattatcaatattgtagcgcttccgattttttattcttgtccttgtttttccaaagtgtaaataaacacaaagtcaaaaagttatggatgtgtgcaacacaatgatctatgtagtcatttgttagaaagaaggatatacttttttgttaagtgcttatgggtcccttttgcataatttccatgccttggtctaagtattatgtcctttcttcttgtgatctattttttacatacaaagtggatgccttacattaatctattccaaaatgaacaatttaattgtaaaaaaggatgacttaatggaaaatgtgatcactaaccacaaaattgttatgaattcctccacccatatattatagaatatttttttcatttgcatacataacttatacactcaagttggatatgcaagaaaacatatgaaaatagttatacctaaaataagaacaagaaagtaatttcaaaagccaccccaccaccaaatggtatcatcaccataccaagcaaaagaagtggcggtttcatatttgctttctcaaaaatcaaactgtgcgtactttttataatgttcttgtcattgtattaacatttatgttatttcttcttatgatattattttaacaaagtggacgtattgcatcaaccaattccaaaacgaagcatttcattataaaaaaaggaggtgggtaatagaaaaacatagcaccaaacacaacatttatggaatgtgtccttcattaacatatgggaactataaactcaagttaaatctgcaaccaacatatgaaaaatggatgtatcaaaaatcaaaattagtgcaagaaatgaattcgaaaaatacattccaacaccgaatggcatcatcaccatacaccagagaaaaaaaaacaatttcatatttttttcgaaattcaaactacataaaatgatttcaagcaaccctttatttcctttgtacaaatcttcctatgtttattacatttgcatgccttgctaaacaaaagaaatcctaaaaaaattagtgtggcaaatacaacctagaacaacctcctaataaaattaatgatatacagttaactttcctacatgtatctcctaaaataaagctacaatccttcttccagagttctgaccagtatttcagcttctcgcattcaactcaatttactttcatcctatataacctcaaaattgaatccacaaacacctaaactactcagtcttcacctcaaaactaccatttcacatagccaccaatgccattggtgtcagtgacgagaaaatcctctgccctggtgaaagtatcccatatgggtcatactttacctttagctcggtaaccctgctccatttggccccgaaatggcttcgccacccatcttgtgatgcgtagtgtggtagatattgcttgcacccgatgccctcattatcacagaacgctagaactgcctcattctccctctccaggcgttccacatctccggggacaaccgcagaccggagtagcccaacgacatagaacatgtcatcattaccagacaccgctgtcatacggtcatcccacatgttcctattcatggggtacatgaggatgacaccgacaggattggcaccaacaaaaacacccttgagcacaccggtgtcgaagtcaaggatgcgagactggggcacgaagaggtttagccatggatgtggcacatcccacatgccgatagacctgagtattctttcctcctccctcacacgatcaaggaattgcacgtagctcacatcctttgtgaacacaaagcctttgtcaaaactgagttgttctagtactgacgtcagtttctgcaaggaaataacaaaattaatcattaataaaagattattcaccattccctttgagggggtaaagcacaatagtattttttgtggtggtatatactaattgcaaacggatcataattccctacctgatcaacagaggcagtagttgactcgttgtagtacatggcaccttcaatgaagtatattactcctgacacagactctgacgcaagtcccgcaagcctatcaatgtcgaaacgcgagaagaagggtgttgatttgggaccctctgtgagtgtccgattgagctggacttgtccttcgacataatcaaaccctgcttcactagctcgctttgatatgagcagctcttggtctctggtgaaggtcaccacatccgagtaggcgaggcggacccatcgaacccgctttggggcaggctcaagcccaatccgagcccgggttatgatcccaaactggcccagcccaccgagaaccgcgaagaacaagtccggctccttgtccctagagcatgttaccatgtctccccttcctggattccaattgtcaacaatgttaatagtcgctcaatcatttaattatcagtgttaaaagtgttcatgtgtaattggactatttagttaattacctgtgatgacgtcaagctcgagcacgttggcgatctgcgggccatgccggaacgcctggccgccgatgccggcgttggagagcgtgccggcgacggtgatgcggaggtagtccgtccacacgcgcggcgccaggccgtgttccagcgtcgcgcggaggacgtcggcccacagctgctcaccgccggcgtccacgtacggcgccg

SEQ ID NO: 3007 - DNA, 17656 bp, Oryza sativa
gagcgactgcccgcgggcagagtggccctgcccgcgcggcgccacggggaacggcgacggggacgacgccgagaaccggacgagctccgcgatctcggccggcgtggccgggtggagcaccgcctccggcgcggccgccacgatgcggccgaagtccgacgacgccctcgccgtcgtgtcgcggtcgacgcggagcttcgaggcgacactgtgcgcgaagagatcgccgggaagcccaccggagacgacgacggacaggcagctcgccatgaccatgaacgcgatcgacaccttgcagccatctctccgaaatgcaatcggattagcgaactgaacactgcaactcggacgctttgcagttgatcagttcaggtgatgaaccgagaaagagacgattagagcttgtgtgagttaggtcaaaactccaagacatttatagatggccttagaaacgttgacaaatgtaggtagtgcagagcattgcgttgatttcttgctagtattctgaaataaatgtattgacttctgacagaaaataataataatggtggctgaaacattgttaagaaaaaacaaatcttgatcatcagtctcgtcatctcctggtgttggactcacaaaaaattctaaagagttaattgttcttttaaggccaaaaagtataaaggcccgaagtattatccatttttgcctcgcaggctgagccagaaatatataaactatgaacagaatggctaaaaagcttcagtgcttttgtttactaaagatacaacattttgtcaaccctcagcgccacatcgtagctatacatctcaattaataaaaccaattactgaatcttaacttgaaaactattgtagtgagtgagaattttagagtaattttacaggaaacacttagccttatcttatcaactggcgttaggagactaattaatctgtcaaattcagagagtgaattttagagtaattttgccgaaaacacatggcctaatattagcttaccttactaatcagctgacatatatacaagactaattaatttgtcaacaactctcacaaacaaatcatgatataggcaggtaaacttaaattgactcttaatttcttatactacattataagggttacattcatggtggcctcactgtttgaccttccggttttgtttatgccctgcaagtataggagtaactgatatataaataactctctgaaactctgaatttggagttcatctgcagtcagatctgacgtttatactcaggatttgaagtaaataaaaaatggctaagtcggcaggtcatgtactttagtataaacaagctaatggaatgatatgccacaatgttgtagtttgggagggtgcgtgaatgttgaggcctatatataaatttggaccaaatcaaatctgtagatttgtcaactacatgaaacagtctccatgggttagtggctatcactttagaattctgttctttaaagaaggtgcagcaaaggctaaaaacaaaaattgagttaagctagccatctgctctgctgattcatgcatgtatcaaccagaaactgttagtggatgtacacactacacgtgtacaggggagagaggggagagatagagacaggtatgttcttttttgtgtgtcagagaaattggtgaggtcagagctttttttatttttagattccattcttgttaagtttattaatttgccaataccattcttcttcatttagtgctgtgaagttatatcgatgaaaatgaaactgagagaagtatggtcacattgagtagtactgagttataaaatccgttgtacacgatgagtaattttaccatacttaaaatggtatcagaaggtactacattttagtgtaaaattttaatatctccagatactttcccgagaaccgtaaaatttctctcatgatgaaccttgatgaatgatgagaataagctatgacatctccactacaacaacaaaaagaaatgctaggacatcttattatagtatgtcgcactagtacagaaagcatttttcaaatggttagattctatttttgcgtgaggttgagccgcccgtccgcccgaaagtgtaaacgaaaattgctattttcgcatgcgggtgtttgtgtcatccgcacaaagaaaaccaaaaaaaatcaaaaccctaccaccaagatggcgattgcgatggcgacgtggatccggccgtcccgagggcggcggcggcggacccgaccgtcgcggggccagcggcggtagatccacccgccgctagccgctcctgcttgagcctgccatcgctgagctcccgaggaagccaaggcgactgttgcaggccgagcccgccgccgatcacccaagatagccgagcccgctgccgcccagtgagagggaggagaggaggtgagagagagaagagaggagtctaaggtggagaggaggtgagagagataagaggacaaggatgatgcttgaaaatattttaagtgttgagagggaaaagagaaggtaagttaaccttctaggtggatccttaataggcctgcctacgaaagtaggcttattttcgcatgtggccccttaagaggtgcacctgtgaaaatcaatttttacatgttggccccttaaagagccatatgtgaaaatatcgatcgatttttgcaggtgcaaccagttacggtctgtctacaccctaaaaggagtctcgtccaaaaaattagttctgtattagtgtcggtatcaagtagactaacaaaccacttgtttcggtttttatcgaatatcaaactaaatttgtctaattttacggatttcgctcatctttgctgaggtccacgttttaacaccaaaacgaaacgaaattttgagtcgccctgaataaggcccaggatggcccattgacacacgtatggcattcccaacaatgtgacgggccactaggccaataggtagtacagatcatgtctagaagagcttcagattttatatccacggtagatttaatatctctatattaaattatacttttttaaaatttaaaatttcatctacaataagaacaaattgatttatccactttatgcatgaaattgtagatctagatccataattttttgtgaagttaggaatatccaacccccgcaaaatcttgtatgaggagttgtgccaaactgagcctaagcctcttaatcgacagctgacgtgaccatagtcaggtgatgacgtatgcacaccggccacagccctgtattgctgtatacggactttcatactttggttctccctcgcactcattctgttggccactgtctttaaggatgatactcctataagatgacgagatgattcattcttgacttgtttgttaatttttttttgatttttttttctatatgaagcatgagtagatggagtgatcgattaatcaatcgtatgaacacacaggccacaaaattctgtctgagttcagatcacgcgtcgcgccgtggcgcacggagagccattctggcgagcttttgcagtttgcagtggtggcctttttgagcggcggcaatggagatagggtgggtggtctcgccattcgcgtgcggtgctactttagcctcctaccccggccccactaacaaaagcttgcggcccggccttagctccccactccctccaacgctcatccccacaccaaccactcccatttataaaaatgaaagttggatttagcttaatcctttgctaactaaatactcatcggctatttgtcaaaatcttcagcttacatttaaatttaaatagaacatcagtagcagtactagcctactaggggcggaggcaagcatacgacagctaggcaagcatacgacagctaggatttgaaccccaagcttaccaccaaaatcaagaaggcaagcatattgcagctagggtgtgagcttcaagtttatctctaaaaccaagtttaaatccctttaaataatcctgtatgtaatagtccgtcctctagaaccatgcaaatcaatccacttgatgggtgggtccacttgctacacataccaccccacttaaactttcatatttgtttcatgataaaaggttaaaccataaataatatggttggaggaacaaatccttataagttggttccacaattttttaattagtaatgtgatatcaaacatattgacaccgttctcatgggccacacaaggcacatcctaattgggataagatgtcacaatgtaaattttcgtaaaaaaatatcaaaaactattaatgagccctagctactattttcttcaggtagataatacttattgttttgaacaaggacacaatctccaaaaaataaccttgatcactacttttattacaaaataaatatatggttttattgaagtactttttaccaccaatctatatatatggtctccacattcctaagacaaatatcttatgtgatatttatagtcgaagttttaaaaatttgataatagtcatattcaaaacaaagtattgtttatcctgagggagtagctactaataaaataattttcaacagccatcgctgtacacacactgttcaccttgccctcgctgccccggcaactcacgcactccatcctatccgatccgatccgtccatcacaacatcggacggcccacgttacacctgccatactcgtccagtcttcgcgcgcgccgcgacgacattccgtgggccccaccccccacactcgcgagcaagaacacacacactcgctagtcattcacactgcacgacaagccaccaatcccgccatatatctatatctatctatctagctccactccaatttggactcttgcgcgcaaagtcctcacagttcaccgattttctcctcctcgcacaccgagacaggtcggagaaagaataggcgaaggaaatttccgtcgtcgtcgtcggagaagatgaggagcggcgaggggagcaccgcggcggcggcggcggcggaggaggagaaggtgaaggtggcggcgccgttcaggctggcggagctggggctccgggtgtgcgcggtgccgctcgccgtggcgtcggtgtgggagatggccaccaacaagcaggtggacgagacctacggggaggtcaggttctccgacctctccggcttcaggtaaactcaccgtgtgctccgtcttgcttgactagttatcttcttaattaattacagtactaacactttcctgaaattgaattttactaatcaatcaccttgacatagcctccatcgtttcctccttacagtatcagtggctgccaaaatttatattttcaaaccgaattttaaagttaatttgaaagtttttattaaagtttatgttttactttgacatttaagtcgctaagaacacatatataaaaatctaatatataaattattattattttgctaatacgtcgaatggcgtattatctgcatttggccaaacaataaaggcgttattgggttctttttttattcatgtgctgatatgtatatatatttatttaccgtccctgtgctcctattaatctagttttagataaattataggatgactttgtgcagtttgttcttcagattattagataatcagtattacgatgctaaacttcaatgttttttttccatcaggtatttggtctggatcaacgccatcacggctgcctactcggtggcctccatcctgctgtcatcctgcaggttcatcactcgctttgattggctcattttcctcctggatcaggttttactcctaacctcgcttctccctctttatattcatctcatcagaaaacttctatattgtttctttaaaagaaaatctgaaaatgaaagaaagaaaaaatgatcaattaaccatatattttgcagcaaaaaaagattcaatcatatatagagtaagtattataatatacataagtacatacaagggaagtgtttagtactaatacttgctaggataagattataattaataagttggtcaaggctaaactgtacatcaataattagtactggaaggaagctagattcttattatgggcacaggataaaccgatagagaaacctaaaaggaatataatattggcaataaacatgccattctatcttgaactacttgattcagattttagacgcatatttcatcacagagcatattgaagggaaaaaaacactcttcttgagcttaacatgataccaattcactatccttatgtacaaatgtagcagcagcagcatgcaacctagtatatcctagtactaatataaatccagtttcatcaggagattattgttttttttaattttaagaaaacaagtcatcaatgatagtatatatcaacatatcatctgtttaatagaaccaacatctatgcatcgtagatatagcaattcagtttatcagatatgatcgtaaaggtaaggtgtccgttcgtacgttcatagtgatgggtttgcgcgttgtgagcggtctatgattgcgttgtgtttcttcttttaaggaaaaaagcatcgatgtataatcacatgagattcggagacatccttaactgtggatcaaattaaacaagggagtatgtaaaaaattgccgtatgttttttaagtgaaaaactttcaaatataattatagcataattgaagtgtaattaaactacactttaactgcattgtaacaaccatataatttatataaaacatgtattcaattatgatttggttggctagcaacatatacgtgatccgtgtgaaaatttctttcttgcattttttttcatgcacaaatattaaggcaatccgatgatcacaaatctaaaagtttttggagacaaaatacaaatactagcggaaattttccagcaattcagttaaacaatggcaacacataaaaaacactgaccgaatcttgatccggcggtggccgttgccggagcaggcgtcggcgtacctgctgctgacgtcggcgtcggcggcggcggaggtggtgtacctggcgcgggagggcgaccgggaggtgtcgtggggggaggtgtgctcctacttcggccgcttctgcggcgccgccaccgtgtccgtggcgctcaacgccgccgccctcctctgcttcatggcgctctccctcatctccgccttcagggtcttcaccaagttcaacccaccatctcaatccaactccaagcagcagctgtcgcaggagcaaggcaagcctgtagtttcaggctagttagtggctctcccaagtctgaactttcagttagatggtacttttactgtgttcagctgtttacggtgtgttcaggtcttgctttgtgtagatgtcactacactctaatgcgtgttgtctgaaaagaaaaaatggttgtgtagatgtaacctgtataagtgctcaaaataccatgaactagaattactatacatttacaattttatttagatgtactgtatgtatgtatacttgaagctgatcttcagagttcagactcggggtcgatactgaagtgtgaaaaaactgaactactattctctttcagaaagacagttgttttgtttggagatgttacagcttttacagggactgaagagtcaggatttcagacaggtatgtggtctactgtatatcgaactgtggccatgtgactaagcaagtacagtaactgacatgcaatagacagtcagatggcatccaagagaagagacaattgcaagatgacgaccctgacaaaacctgactagcttcaagattgacacgcagcatgcttggtttttgtcccctgaacaaaccaatccatgatccatacatctactagtagtagcaggttaattcagtcagtgacgaacaccgacaaattcccatcataataaaccaaccaaatcacactgaaattttagatcacaatctggccatgaatcttaactactactccaaatctacaacagtacaaacaataacccaaatctagcatgttctactaccatacaacttgcattgatcacaactcacaagaagagaaagcaaattctgaagctgaattgaagcagagggcattgcattacaaggggggggaagtctgctgctgctgctaccacttgtagcggcggaagagggcctcggcctgggcgttcttgtaggcgctgcagccgacgaggtagaggaagacgagggcgacggtggcgacgacgagggcgacgttggcgcggtgccactgggcgcggagcgccgcgaggaggcccgcgcggcacgactcgcactcgtagcacagctgcgacgggtcgttcccccacgccccgcagtccgcgtccgccgccggccgcgccgccggccccgcccacaccgtcgggctcacgtagttgtacccgcacaccgccggcggcttgcaacacccggactgcatatataacacacacacaggagattatttttttttctcattttcagatgatgaacagttattcatagctgatgagttgatattacacctctagtattgtctaattagattggacggtaaagatttctcattttatctcctttctatgaatgggataaaactgaaatataataatttataagcaccagaaagtttgattttagtctgattaagaataaattgagaatagcacgcttaatttaattttaaaaaagaatttgaatgttctttctttttcgaagttaagtacctccattttatgttataacacaaaagacatatgaagtttttttcttaaaaaaaataacaacatcgacaatagttttgttaacgtctattaaaaatattgctagtttttataagcttagttaaagttaaagaggtttgacttcgaaacggtttataatataaaacagagtagtttgcttgcaccaacaaagttaagccaaaacttatttttatttttattggagatgaaaaaaatataatcatttgtcggtgtggtatctatttcttggtacaggtagatctgtgagattttttgtttttggcttttacaccacatgaagcaccaaggatggatggtgccaaggcaggcagatccagagatacttcttcctagacagacgcatgagcctcgaggctaatcatcagtactaaaatgttcagtcacagacagacaaactctgcgcggatgaggacgcagagagatgataactcttaaaaactctaagccccatacgttggcaacacaaaatcagtaatgaactctaaaatcaacaagaccaaaattaatcacactcccccatgcaccgcccacgaactcctgtctccaatcttgtctgtaataagaaaaccttatgtacatactgaattatctcctttctctttttctctgggaaaaaggaaaactgaaaatgacctgtctctataatctttgtagctaacaaaagcatggagaatttttgttaagcaaagcacatccgaccaggaaatcgccccattacgcaattatattccccgtccatgtcattgcctgatttgtacccaaaaaaagcttaattacatggacctacacatggattcccctttagagcacttgcatttgtacactgtcaaaagagggatggcccaccgctcagtgacagcgagcagtgctgataattcagtcattcttttttttatatatgtgtcctactgagatataaagttgccatctgattcttctcttccagtagcatctcctatctctagatgctcagagaagctgatccttggaaagggaaaaaaaaaagaaaagttctacgctttgtttcagctagaagtcatagctgctcatgtgctcatggacggtcagggtaattttaacacttctgtttctaaataaaagtcgtcttaaaatgcaaggagttcaagtattgactatgttttatgcagtaaaacaggagtaagtgatatatagaaaagaggttaaaaggatttaattaactaagcttatagctttatcttcaaaaatcaaccgctagtaagtttatagtggtaacactaggatttttagataatgaaatcttattgaactcagttaaaatattctgaagatggtaagacaagtttaactagtcgatgagatgattaagattaacagtagctaataacagaatgagattaaagaacaaaatgagattaaagaaaaaaaaaactatacctggagtggcgagaggcgcgactggtagaactggtcggcggtgaggaacccggcctggcgcgccagcttcttgcaggtgtcggagacgacgaggcacgccttgatccgctcccaccgcgccgggtcgtcggagacgtagccccggagccacatggagaagccatcgaggtggtactcgtcgtaggcgcggccgagcaccgggtaggcgccggagccgcgggtgacggcgaaggcgaagacgaggagcgcgatgagcagcgcgatgagcgacgccatggcgaagaggtagaacgcgaggaggcggcggcggttccagtaggcgccgacgaagccggcgagggcggcaaggaggatgaggccccccaggatggccaccggccaccgcgccaggcgggcgcactcctccccctgcgccgacgcgaaccacacgcccgaggcgatcaccgggacggcgcagatcagcgccatcagcgtcacgcacgccgtgatgttgttgctcaccgccatggcggccgacgcagctggagctcgagctcgctctgctgctgctgctgccgcgcgctcgtgtcgtgtcgtgtcgtgcgcgcgtgtgggggtgggtttggcataataaaaggaggagatttggatctttggggggaaaggtggcggggactggcaggtgggcccggggatgtggggcagtggcaggtgtgagcgtgggattggctggacggttgacagcgtggcggctttgctctccgtccccgtcggcgacgatgataaatctgaactctgtgtacttgcttttctgccaggttgaagttttttctcttcttttttttttatcttctctctcagcgaatgagtggaagacacgtggcgcttcgcggtgaagctggccaccttctaggagcatcctgcatggctgcatctgtgtccgccgtcatctgggcaacaattcaacaaagctctgcatcagactgcatgcatggcacggccgtacaagccatggtggaggagaggagtgatgtcagcgtgacaggtacaaagccataatcatagctggcttgagaagaaaaggtgaagagaaggtgtgatccaggcatcatggccaagaatgaggagggtaagaaagagtacaacggcagagtttagttccaaaatttttcttttagactttagaataagtttatttgaggtcccttaacttgttaacgaatccgattttcgtccctcaactggaaaaccagacacaagagtccctcaactatcaaaaccagtgcagattaggtccctcggcggttttgagggtggttttggctgacgtggcgtctatgtggctaatttgacccggtcttcatatgacgtggcattgacgtggcgcttacgtggcaattcgagccggaaaaataataaaatcctcgggacccacatgtcagtctcacatagaaaataattaaaaaaattatgggacccacgtggccccacatgtcagtatcacacataaaataataataaaaaaatagtgggacccacgtgggccccatatgtcaatccaactcaccctcctcttcttcctcctctctccccgagaaaattgacatttagccatcttcagtatggggtttcgccagaatgccactccggattctgacttcgttataatgccatgctcggacggcgccacattgctgctttgccattctcaccaaattcgcatatttccaaatgatttccaccgttgtgtgaccaaattgcccctgtcaccaaattagttgacttgcgtgggagctggatccccatccagtcgtcatcttcctctcgtcttcctctcgacaccgctcccccccaacctagccgccgccacccgccacctacaccaccaccaccactgccgccatagatccagccgttgcagccgtcgccgcggcgtcagatgtagcagttgccccgccctcagatctagccgtcgtcgcgccgccgccattcttatggtgtgaggtcgggacagagacggttgagcatatggactgcacttggcatgagctcctcgccgggtaagttgtgaactttgtcgagctcgtcgatttccaaatggctggaagcattccgtcgcggactgcgcgcggactacggcgatgggggagtaccggcgagggcgagggcgagggcgagggcgatagcgagggcaagggcgacggcaagggcgacagcgacggcgacggcgagggcgagggggacggcggagcagtggggggtagcggcggagagatgtggtggcgctgcgtactctgccaagcgatgcggctggaccagctcgactaaaccgaccggcgagggcatttcggtccaaactaataaggaaaatcatcgaaatcatttggaaatatgcgaatttggtgagaatggcaaagcagcaatgtggcgccgtccgagcatggcattataacgaagctagaatccggattggcattctggcgaaaccccatcctgaagatggctaaatgtcaattttctctctctccccatctccccccttcatctatctctcatctcctcttctctctcccggcgacggagaggcagcggcacgcggtggccggctgccggcgggagaggagggagcggcgcagccaggcgcggcgtgcggaggcggtttggcgcgacggcgcggcaccggcaatgaaggggaggaaggcgaagtgagctccatgggcggcggtgggtttggggaagggctagcggcggcggggaactcggtggtggcggggatggaggtgagatcagcgcggggtggaacgggcaggtcggcgcggcgtcaacagcagcggccgggcgcggcggctcggcagcgcggccaggaggcggcgtagggggggaggaatcggggcggcaccgggcagaggagggaaggaaggggagcttcacggggcggcggtggattgggaaggccggcgcggcggtgtggagaagaggaggccgacggctgtggggatggagaggatggccggcgaaggtggggatggagaggatggaccggcgtggtggggaagggcgacacgaggagaggctgccgcgggcgacgccggcgcagccgtgctcggctgagcatcggccgactccgcgtggcggtgggaatggagaggtgcgccgcccttctccccgccgctccatggcgtgccatcgccttgcgggccgccgaaggcggaggagctcgggcgccgcccggtgacgccgcgtggtgcggcggcggcggccgcgtccattggcgtcagcggcggaagggacgaggccccgcgcggctgcggcccgcgaggcgatggcgccgggcatgctcctccgcccgcgaggcgatgacctgaacgccgcggagggagggggcccgtggcgatggcggtggccggaacagatcgacccgggcgataaaaggggatcggcgacggcggtaggcggaacagggagtcgccgaggatgccgaggtcgacttcgacgtcgtccgcggcggagggcggtcgccactccctctcccgctggccgccgtcggctgcgcacctctccctccattcgtcgccatcaagtccccgcccacggcgctcggccatcgccggcctccctgcgtcctccctccctgcccgcctcgccggtctttgcgcgttgctccctcctctcctgccgccggccgcgcgtcgccgcgcgccgccacgcgccgttgtcttccgtggcgcctggagagagcagagatagggagatgaagagagggagatggggagagaggaggaagaagagcgggtgagttggactgacatgtgggtcccacgatttttttattattttctatgtgagactgacatgtgggtcccatgggtcgaattgccacgtaagcgctacgtcaatgccacatcggacgaagaccgagtcaaattagccatataggcgccacgtcagccaaaaccgctctcaaaaccgccgagggacctaatctgcacgagttttaatagttgaggaacccgttgtgtctggttttccgatcgagggacaaaaatcgaattcagtgtaaagttaagggacctcagatgaacttattccttagactttcagcttttacaccacatcaaaactttcctacacacacaaatttccaacttttccgtcacatcgtttcaatttcaactaaactttcaattttgacgtgaactaaacacaccatcatcaccatctagccgaatgagggtcaatcgtcccaccaataagtttcaactcaattacaaaaactttaaacttaaattttaaaaaaactttcaactcaagatttgaaactttcaactcaaatattaaataaaaatcaagccaacatttaaaactttcaactatttttaaaaacttttaactaaattgttgatgtatattgtttttaaaacaacattaaatattaccattaacactaatcagtgtcattagcagcgagagagaggagcgcacacgagttacgcggctagcacgcgtgccccaattagcagcccccaagtaaacacatacaatctgatttgagaaaattcccgaaacattaatagacctacactagggatctcgtccataacttcccaaataaatacctgaccaatacaaggtgaaaaagaaaccacctaaaaaggaaatcgggaaagagagtgaaaattattcacatgggacttttcgtccttttaacatttcgtcggcccaacgaggcaagcccatcaactagcccccatccacgcgaaggaggcctgcttcgtcacgaccaaaaaagcccaccgacttccttcctcactcctccaccggcgaccagccccggctgcccttcaccctgcgccgccccagtccaccgccgcgttcgccggagcgacgatctcgcgccgccgcctcctcctcctcccctagattcctgacccggccacgccggcggcgctccccctccgccggaggctggcatggcgtccggccgcggcgggatccccgggccctctcgcgccctcctcgtcctcctcctcccggcgttgctgatgctcctggccttctccacctcctcctccgcggcggcgtcgtcgccgggcgcgatgcacaacaacaactgggccgtgctcgtctgcacctcacgcttctggtgagacctcatccccccgcaccgttgtttacttcgtctggccgagagatccagtttggaagcatgcttgtttagttcgcctattaagcgattcgtatttgctaggggtttgtttcaacttccagatgcggattacttcgcgcatttgatattctaacctgttctccagatgctgattacttcgcgcatttgatatctaaccaattttgtaatgttctccaggtttaattatcgacatatggcaaatactctgtctctgtacaggtagcttgattaattatgctcatgcatctgttattccctgtagtatctatagattatagattattccttactagcaaaacattgtttgtttcctccaggacagttaagagattaggaatacccgacgagcggatcatacttatgttggcggatgatatggcttgtaaccctaggaataactatcctgcccaagtgttcaataatgagaaccaccagcttaatctatatggtgacaacgttgaggtgagttccttactctgaaaatatgactcctgaaatatctgaatcctaaacatcacaatgaacaatttacatggtaaaatggccacttttggtgtatctagtcaatgcaatttgttggtaacactttataatgttcattcatgattaccaccttatggttatgttaagaataacatctgatttaatgctagttttacctttggccacctaatggcaggttgattaccgaggttatgaggtgacagttgaaaactttttgagagttttgactggaagacatgaaagtgctgtaccaagatcaaagcgtcttttaagtgatgaaggaagccatattctcttgtatatgacaggacatggtggggatgagtttttgaagttccaagattctgaagaacttcagagccatgatttagcagatgcagtaaagcaaatgaaggagaagcataggtaggatttgtttaccttatgcttttttgtaatatttttctttactcgtatacacagaatcttcttcttcttcttcttttttgccaaaaaaattggcctttgttttgctcctcttcatttcatacttcagtttttcaaactgtctttttctctgacctgcacttcagatttaaagagttgttgataatggtagatacatgccaagctgccactctcttttcacaggtttgtctcagtgtcttggtcattatttcccataacattttacttcaagcacctttacttacaacataagggtttcttttttgtaacttgagataatatttggttgcaccttcattatgtgcctgttcatttgaaagtttactgtcaagtcaataattcatactataaaatttattagctgcttatgtgaaattttctacattatgttttattgcttaagaactacttccactgttcacaaacaaatgtaatttaggtatcgaaatggtctcccagatgcaaatttgactcttagttttccattatgaaataatagtagaagccattaaaattataatataacgaaagtacttttctacatgcatcattcacctatttaattaaatatttaagaaggtattaatactcaagagtattaaaactttgactggatgcatgcccaatacaacaagtacttgtttccggagggagcattagacaataaaaaattccaaagactccatgctgtatttgtgcagagcagttggacgaatgtggactttccagtttccacttactacattttgatacactaatttatcaattgatagtgtttcacatcattttttagaacactaggggaatgctccactggaatatattacaaagtaatagaaataatatggcaagaaaggtttcctagaaacccatacactgtcttacagaaataaaaaaaaaaggtaaagtgaccatctagcaagtattctgtaggtaacagaccaaaactattttccaagcagatatataaataagtaaaagcactaagacctgatatagacaattttgtatgatcaatttagttatttcctttatcatggtcaacatttttctgcatatgaaaactatatctacagctgtacttgacatattaaatatctgcagcttcaatcacctggtgttttaacgattggtagcagcatgaagggtgaaaactcttattctcatcatcttgattcagacgtgagaacatgccttccatttacaattgtctcatatattatttggaactttttttgtcttatcactgggtgatacctgatctatttatttgtggcagattggtgtttctgttgtggataggtttaccttttatacacttgctttctttgagaaactcaacatgtatagcaatgcctcattgaacaggtaaaagactttgta

SEQ ID NO: 3008 - DNA, 830 bp, Oryza sativa
  unsure (1)..(830): unsure at all n locations
cgatgtaggtgatcggctcgatgccagtggttcatcatggtgaatcccctaatgattttggtaaaaatcattaagttaaggtggatacacatcttgtcatatgatcaaatggtttcgcgaaaaatcaataatcagacaacaagatgtgcgaactcgatattttacacgactctctttaccaattctgccccgaattacacttaaaacgactcacagctacgttggcttgccacgcattacttgactgtaaaactctcactcttacgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatggcatctagtcactcaaagactttaggctataagagggtgactaanagccaatcaatctcatgccaaaatctag

SEQ ID NO: 3009 - DNA, 985 bp, Oryza sativa
ataggggataaaggatccccttgcctaagtcctttgtaagtttgaaaacaattaccaatttgatcgttaacttttataccaacatgaccaccttgaacaaaagaagctatccattcacaccatctaggagaaaagcctttcattctcaaagtttgttgtacaaaaggccatttaactttatcataagctttctcaaaatcaatcttaaaaattacaccacttttatctttgcgatgtaattcatgtaaagtctcatgtaaaataaccaccccttccataatatttctcccaggaataaacgcagtttgagtaggactaattaccttttgagcgacatccattattctatttgtagcaactttggtaaaaatcttaaagctaacattaagtaggcatataggtctatactgttgaatctttaaagcctcagcatacttaggcaaaagaatgatagttccaaagttaagcgaatataaaggcaaactcccagaatgaaagtccttaaataactctaaaaggtcaaatttaatgacattccagaaaacttggtaaaactcagcaggaaatccatctgggcccggagctttgttatgttccatttggaaaatagcatccttaacctcattttcagaaaattccttagttaaggcttcattctctaaatatgaaacttgaggaatgtcagcaacataattctcatcaaactgaaggttatactcatcaggagggccaaaaagacctttataataagtggtaatatgcgactttaaattggcatcaccacttattaaatgatcactctcctgtaattgataaattctagttttcctatgttttccatttgccactaaatgaaaatactttgtattagagtcaccctctaaaatatccttagtcttagcccgctgataccatttaatttcttttctcttagaatgacagataacctactcctgaaaaaccatctaatatcaacttcctcttg

SEQ ID NO: 3010 - DNA, 22662 bp, Oryza sativa
aggcggcgaattttcgcttgccaacgctccataggagtattgacctcatcaaccccagaccaaactttttttaccatatcaacaaatccatcacgttacaaccaaccaagttcaaacttaaaactatgttgagcgttactaaaagaggaagattttgtatttaggagcaaaggagtatggtctgaaatatctctattgagagcaacaaaagaggataaagggtatttttgctcccattccgttgacactaaaactctatccagtttctcataggttgggtgtgccagattatttgtccaagtaaaattcctaccagtcattcgtatctccctaaggcacaacccatcaataatagcattaaataagaagggccatctatcatcataattatcattatttattaattattattattattattattattattattattattattcaactttgagacaatagccgtcacgtgcagagtggcatggcatctccaggcacaagagaacatcgcatgacgcatcggcatcacatgcatgagcacatgacgtgtggtgtcacagaatctttgggttctcctgaaaataaaaataaaaagctcaatatttcgaaagctactctctgcatcataaatatgttttctttcttccaaaatataataagttttagttagataagacatatcatagtattacgaatctggacataataataggatgtgtattatccaaccatatccaaatttttagaactacgaatctaaacatcgtactaggatgtgttttatctaattatatccagattcatagtgttataaatttaggatgtgtcttatccaatcaatttttttttatattttgaaacgaagaagtaacaactatctactatatagattaatcatagaacaatttgtacgctggtgtccagtccgacgagatgagcatgagctttctgtacgtggcagaaaaaaatccatggctggctgacattgcaccgtgccggacggtggcggcggccgcgtcgccttctcccttcctggcgctgtcagcttgtggggtcgggatgtcatccagcgtagcggaatctactcgcccgcccgcggatcgctctcgcgctgccgaatctcaaaaggtgggagcgaaacctttttcttctgtcaccccagcttttccttacccccacacagccagcgcacctacggtacccgtatggcccacctgtcatacaccacctgacatatccccctcggcttcccaccgcctgcaatcgggccccaccacgctccgtccaatcccagtgacaggtgggccccggacagatcggtccacctgtccgtgacacgtgctcaacacgtgcgactcgcaggtagtagtagagctgaaaatacgcaacgcatccgcgcgacacctagcccttctcgatctctctctcgctgcagatccaaaccaacctcaccgtcgacgaggaagaaggcggcggcggcggcggaggcgaaggcggcgaagatgcagtacaagaacctggggaggtcggggctgcgggtgagccagctgtcgtacggggcgtgggtgacgttcggcaaccagctggacgtgaaggaggcgaaggcgctgctccaggcgtgccgcgacgccggcgtgaacttcttcgacaacgccgaggtgtacgcgaacgggcgcgccgaggagatcatggggcaggcgatgcgggacctcgggtggcgccgctccgacgtcgtcgtctccaccaagctcttctggggagggcagggccccaacgacaagggcctctcccggaagcacatcgtcgagggcctccgcggctcgctcaagcgcctcgacatggactacgtcgacgtcgtctactgccaccgccccgacgccaccacccccgtcgaggagaccgtgcgcgccatgaactgggtcatcgaccacggcatggccttctactggggcacctccgagtggtccgcccagcagatcaccgaggcgtggagcgtcgccaaccgcctcgacctcgtcggacccatcgtcgaacagcctgagtacaacctcttctcgcgccacaaggtcactgatcccttatccctatccttccttccttccccccaactggatctcatcttccaaaacccatagcaatttcaatttggttgggcgatacgcgcggattgaatttgaattgatggcggttcacggatttcatgtgtaccaattgatgagcacttgccgatgtttccaccgcccagaacgagagctcgtttaaaatcgaaagcgaatatgtttaatgctggtattctagtactccaactgctgatgcgtagtactgtacgtaggtttggtgagttgggattaggatcagatccttctctttttcacatttattattgtctctttgatgagctcctagatcctgtagacactagtaccgttagtattccacctgcacggatgagtaagtagtataccaattacatgagaattttggctacacatgatagagcatcggttcgattcgcgatggtgacatctccgcattttcacctaaactttgaaaattaagcacaggtgagcagtcagggaggatgagtagtatagatctcatcctcctcgatgtgacctgtagcactacatggctccagcgatagtatttttctttagcttcagaactggagtagtaggcagtaatgtcggccatgcattgctttacattctcttgtgtcattacgccaggcaaaagacagagcaatgctgataatgaaagctcaagtataacaatattgtggagattacttagacaacaatgctcctttcatacttacaattggaagctttatttgatatttagtctttatcaggttgacaccttgatattcggtcataatcaaatgagatggcttacgtaaatatgtgagatctcaaaaagtttcagtttgggctcccaaaaatttttctatttggcagcttcagcacgcttaaaacagaaaagacagcatgagcttaagtagtcaaggtggagctttctatgactggtagaggaaaaacagaaatggttgtcattctctatgactagtgctacgaataaattagtccagagatttctcttgttgtctactgggaggatgatacaacctagcaggaaatgtacttagttatttatttttgctatgcacaatgcagatttctttttgccgggtcggctgaaaatcgaccaaccgaattgtattaagaagagagagaaatgaaccaggtacagaacgacattgtactgtcgcagggcataagcccccccaaaaaaaagaaaaagctcctagggatcaaggaacccaggagaagactcccacacactactctctatgcttaaacactccagcttccctccaaatcagcacttcatctctaatggctctgtaaacttgcgctgaagtgcaatctttgtgttcaaagattctcgagttgcgctctttccataacatccaacaaaccaacatacatagagtgtcaaaggccggcctgtagctcggctgaaaaagttgccgcacttgtcgtcaccattccatgaagtgttccccttcatcccccggcaaggaaaaggagactccgagccagctccttaacattcttcacactctgtttgtgaattgacagtccactaacaagtgacaatgcagatttctttatgcgatgctttccagaatcttgctgtaagatatttcagaatccagtaagtctaaaggagaacaatgttgaacttgaagaatttgagttgctagttcagtatagccaatgcaatgaattggacttggctacgagtcatgactgatccatctatcagcagatccattgctgatacagaactttttgatataaccataaaaggcatgtacactgtactgttctgtgctgacaaacttctgccattcaactgagtgtgtaggatcactgctttttctcaccaatgcattgtagcaagtccttttgaagattaagatggcaaaaagtttattgctgtgtgtaattgtgtaacaagaagtaacgatcttgtacttctgcaggtggaatctgagttcttacctctttacagcacgtatggcctgggtttgactacatggagccctctagcttcgggagttctcactggaaagtatgccaaaggaaatatacctgctgatagtaggtttgccctagaaaattacaaggtaatattggtaactttgtccctgtactagatacgtgcattcctgcttttctttttctgaattctgatattaaaatgttcatgcttattctcagctgccttgtgccatcattttttctatcgacaatactacgctgtaactatgctttttaaagtatcatgctacctgagtacctgactattaattactccctccatctacttttgatagtcatatttccaaatctgaaaattttatttttgataggcatatttcaatccaacaacctatcatcttaacgactttcttggatttaatgtgtgactctccattcttccacacaagattggctacatgagcatcgagaaatgtaaatattaatgaatcgtttgtttacgaggaatgactagtagcatgtttaaatagatgataagtagaattacttatccttggtctgtgtatcaagatgaaatatgactatcaaaagtagatggagggagtacctttgtccatgcatgaagatcacaatgtcatgttaagataccaaggataaaactcaactattactactatatcaattgcattaatcattggattgtagttcatggtggattcaatgctgcatgatcagtgttccagaacatagcgtgtcattgttgtgacttaggccctgtttgattcagcttaggattattataatctggattattaggagtaagctgaaacaaacagatagcttattgtgatagcttattataatctataagccagattactataatctggtaatccactctaaaggtgcttttttagattattgggtggctaacagctaacaaacaactaataatccggagaaacaaacagctaatagcttattctatgtcggctttattataatccaacttatagtaatctggctcaataatctagattacaataatcttaagctgaaacaaacagggccttaataacttatgtagcagctgctagcatgacttctgcttgttctgaacgttgactaaacgcttgtgtacatcatggtttttcattttctgaatgggcttatgaaacttgcccctaacaaatacatcgatgctacttcagttttccttgtcagatgtgtttgtcttttttctctttcagaatctgagctgttctaaacaaggcaacttttttctctttcagaacctggccaacagatctctggttgacgacacactgagaaaggtgaatgggctaaaaccaattgcttctgagcttggtgtttcgttagcccaacttgctatcgcgtggtgcgcatcgaacccaaacgtctcatctgtgatcactggagccacaaaagaaaaccaggtacgttccacacgcccgcgtgcttcacaagatatgtttcttttgccaagtaagacgccaattaatggtttttctgaaactaagaatactaatccatcatttggtaactaaaaatgagcagattgttgaaaacatgaaggccctcgatgtcattccgctgctaaccccagaagtcgtcgacaagatcgaagcggtggtccaaagcaagccgaagcgcaccgagtcatacagatgaagcggtacagggggtgtgcagagtgtgctccagggatttcaggatttacccggtgggattcttttagacgatattattatcttccattgtcttatgtttggaagctgctttatgtgcctgggtttgtgtagttgggaaatggtgtccagtggtactctgctctatatacattttgtcatgtggaccactcacttgttgctgtcggtgatatatataccttggtcttttccgtgtgcatctatccatccattccctgcgtttcttgctggcatcttttctgattctttggtgtcttgtgcttggactgtccctgcatcctccttcctggtgaccttgttctcgtgccattgtctgcctgccagcatcaaagattcagccgagcgagtgagagtgccaaggaatcaggagtgtttttatcatggtccttgctgatttttctcgctggcaagatttcaatggcaggctggccaccatgtctcatggcatgctgtgctgaggaatcaatctgtttctgttcaccttggggaagatgatagtactaccactacattgtgtcattgtgtcagtcacatctcatctggtagtgagtgatgagtagtagttgtagcatgcgcatgtgctgttgcttgcaggaatcctctgcattcacaggtgctaaaattggaggcaaaaatgaagcaggggaggtggtctggttgctttgctgcttggccggcagaggcaacggaggctggcacgctttcgtgcggatccgggaacggatcaggaatccaggggggtcgctgttcagtgtggctggcaacacgaaaacagccaagacagcaaacaaagtgtgagctatcagcattcaagcaaagcacacacacaaacaagcctctttcactctacattttttctgtctccggatgatgctgaatagatgatgatgccacatggcccagtacagcaactgcgataaggtccttttctcttagcaacacaagacttttttttttcatcacacatattaggaattttggaggtggattaatcaatgaaactccagggctaattcatagagatttgtgaggctgtgcaagagtcagtagtaatcaggtaggcacaaggatcatcatcaaacaccataaaaactactagaaagacatacttgtacatgcaagcagagcaaggcgaccatatgctcttgcagatcgacagtgcaaacaaaaacaggcaccacaaaggcaaaaatataacagaaccgggtgagccctgtggctctttcttactagccttctgctattttaactggacaagtaattaaccatcaagcacgctccaagcttcaccagcggtatagctcttttccttgtcacacgctctcaggatctgcctcttgttgaagcaatggttctgtgaattccctggtatcgctgacctgcaacggattgtcggtaaaatgagcgcaaatcaggttagaacctaaacgggtgcgttttagctgattaaagtgctaaaatcctactagtggcaaaacaagctatttcaagttatcctctagattcagttcaacaggttatacatacaacaataatcgattccattcagacgactgactagcatcaaatgtaataggtggtagaaaagaatctaaccaagaccattcgcatctgatgtcctcatgatcctcaacctcttcacagagctgacaaacattctgcgcacaagaacaaggcaacaccgtaataataagtcacctgaatagctattcgaagtcgccttgaaaattagaactataaaaatttctagtgcccaggttctaatagctacatagtgcaacgacttactcccaaggaacatctccaacgagcatccagtcaccatccctgtcctcgtaggtgagctggtattcggcagagttgtctagtagtttcagcgagtttgtattatctgaaaatgcgaagataaccataattcaggttcatggacaagatgaatcaacctatcatgaaaaaagcttgcgacttactaggtacaatatgaagcatggctattattttaatttgcaaaactatctcattgtcctacactattattatgtattgtgcgcagcaaagcttgattccacttaacttgatgtgatttgaaaatatgtgaaactgtgagctacttaaagtgacagttcagactcgagcttacgagaagcgcaaaggccaatggacggcttcgtgaacatgagttcaagggctaatgcaagggtcttgtatgagcggtgcgcattgagatccaccttccttccaatgacctctccatccatgttcaccttcacccatccagcaacccgtcctttcttttcgccctcctccttgtccttctgcacatcagattcattggtggcggtcttcttggtgtcggtttcagatgtgttttctttagcctgattgaacaggctgttcatcctgaactgtcggatcggtggccatcccaccactccaaagctgctgccaaaccaggaaatgcagttgggattagttgaaatgtattgaaaagtctacatgtgtaggtgtagctcagcaactctggtgctgatatatatctggtcctcatttcagagaaaatcttactagcgccacaagtcaaacaaaagtgtttgtagttacatattagagtgcagatcaagcaccaaacttgtcattttttgtccttgaatttggaaggataagaagcttatgcacagcacaggtgtggagtgtagataataataggttttggaggttgttgctgatgtgagttctatgcacaactacaggagaagccatatgcaaatatcctatgatgctaaccagtgagcagaacaagtggcaaccaatcttgcagacaaatttattactgctactcttactacttcagagaatcataaaagaaactgtttttgtatcgagtaataaatatagtgctatatatgaaattatgaggcagagaagaagcaagaaccctgaaggtgttgtgttctgctctgctctgctcagctcacctgtgtggatggccggaagcaaccgtcccaggcgaggtggtggcggtggggccctcagccctcttcccccccgccgccgccgccgccgcgggggatgacgacgacacggaggagtccggtgacagcgccgccgccggctgcaggtccctggccgtcaggattcggcacggcgcatgctgctgctgctgctgtttcttggagccaaggctgagcccgagctccagctcctcgtcgtccccagctgagctctcctccacctcctccgcctccgcctccgtccccggcggctcgccggcggtgggcccagctactcctcctctcatcggcgccgctgcttgctgcttggcttgtgcgtgtgcgtgtgtggagtggagaagaggacacggacgaacacctgggcctcgagagggaggaaaggaggaggaggaaggctataattaagctgaggcagcagcattaagcggcagttgtgggtagtagtgcagcaaagggctacctgggccccacctgtcctcctggcatgtggggcccacaatgctggcctggggtttgggggttttgtagctgctagagagcacccaaccattttgtagcaagcacaattcacttgggtttttcttggtgttggggtggattgtggtaatgtataggagtgctgcattttatttgtttggtagtagtggtagtagatccgttttgcctttttttgtttttttttctaaattggcatatgcgaaagaagacgatattatgataggaattgcatgacggtgtttttctataaaaaaaatagtgatattatgtttgtgttttatattttcacgctaatcaaagaagatggagttggtagccaagaaaatatacatgggagaacttactgagtgatcaagatgtaagatgatagaaatcatagagttacgattcatctgtctagggtaatatggtccttcctaatactaacaaatcatatgtggacaataagctttggctttttacttggccgtgatgtttgatttgtgctcgctcctagtcgtgcatgcaatagtttttgcaacaaccaaattactactaatgttttgattgctccaatcttagagtgcttactcaatcaatggttacttagttctagctctactgacacggggttgtgcatcactttttatctctatctcatatatacctcttggcttttagattgcgcttcattgttcgcatgccatatccaatggagttgacaagtactaattaatttgcatcatgcaattataaatccatattcaagccgttcaggagccattaggctgtatgattgacgtgttcactttttctgatttgtgaataattcttggtacctattactttgaattttacaacaaaaatgtgtgtgtgtgtatatatatataggtaaattaactggtgctacatggaatatgggctccaagattcaaattgagtatatacccaatttgaatgagtatgaaattttttttaaatgttagatatgaacattaacttctttactaacaagttcaaacaagtttgaactgagtttgaacttttttttttgctagattttggttctaggtatataacatccaaacatataattcgttaggtatgtaataatgaattgtgaaataaagttgagtttgagttgttttgttgttaggtatttgtatgaatcaaattcatatacctaggtatatactcacaatttattttttttaaaaaaaaattgagagaatttgtgtgttttataccttggagcccgggcaccatggagtcctatatgtgtatcatatatatatatatatatatatatatatatatatatatatatatgtatgtatgcatatgtatatatatgcttttattatccgtgtgggatggtttggaaactagtaacatatcagttatgttttttcacggtaactattacttactcctcacgtctaaatcatggatccgtaaccgatcacaattgtgcatattaactctaatctataggtttttctaagtttatacacttgcttaacagctggtgtggggacagaaaaagggggagacagagcaatttgcctctttgtgggatggttgccctttgggcagtgggccccggtatttgccttttgttggtgtacaaaatgcaagagacaagggaaagagaggagatgaaaacggagaaatgggaaggaggggaggggaaagggttggtcacgtgagtcctcacatgtcctttgcatcctttgcgatgatgcagcactgctctgcattctgtttagctacctacgatactaatagtacagtgtacacttgtacatgaacacagtacccaaagggctatgctcaaggttgtcagtatcctaattcgtatcctagtatcttacgatactacgatcctatcaagccgaaacgatactaatcccatctagtatcctaattttcatagtatctcgatcctactattcattactacacgttcctacgaaatcttaggtggtatcccgattctacgatccctacgatactacaaaatattatttaaaataatatggtttgaaaataatgtaactaaatatgctcaaatttatataaaaatcagttaaatatatcaaaaccaacgtggtttctcttgataaatgtctatatttgcatgatatatatcattactatatttttttatatagaatggctatatataattaatataaatattaattaaactttaaaaaataaaatcttatagtatcccgatactacgatatgatcctacgatacgatattacttcgagcaaaatgatactacctagtatcccgatgctgacaaccttggctatgcctgttcatggtctatagtggagtaaaaaattaatgtatcgaaactgatctgggtgaaatgtagttgtaacacttgaattaagctcttgcaaaccgtaccatagttaggttaatttacacttaaaaccttcccctttgtttgttttttttataaaatggaaagttcaattttttattgacgaggagatgaaattttcaataactagagaaacgaaattatgtgataaaagaaccaataaaataacatggtgataaaatagtactactaccgcttcctagctagagcaatgcatactcctgtatgtactctctctccgtaaaaaaaaacgaacatcatatttccagatttgtaatactaggatgtgatgtgtaacatctcatacgtggttggttttattttagtaccgatggagtactctggtagtgctcctatgtagcagtagtgatgtagtggtattcgatctggttgtgtgctggctagcaatgtcatttgttctaaggggtactccccgttcaaaaaaaaaaggtcaaattctagagatgaatctggatacgtgtgtctaaagactttttttttacggagggagtaggagcaaacctcggttattgtagcgttagagcacttacaataaattagtgtaaatgggttttacatgttaccatattatattttgcgcttatgtgaaagagaataaaagtgaactacagatttgtagtcagatgtaaaacgagctccaataaactatgtgagagggaaatgtgggggtatatattaacggtgcatgtatttattgttaactattgtatgatgagtatgcaattgagttaattatagataatgtgttaatttttgaagctagtagttatctatattaggccctatttagattccaattttttttcttcaaactttcaacttttccgtcacatcaaatttctctacatacataaacttccaacttttccgtcacatcatttcaatttcttcaaacttccaattttagtgtggaactaaacacatccttattaaacttgctcttacggacttaaaataccaacttagcacaatccgtttaaattcgtaatactaaaatataatcatttttggtttttttaagacagaggaaatactccgtagaatatacggagcaggagtcgcagctagggtgtagcagtagcagttcttttacagtagtactagggggtagcagtagtagccaggtttcccaaactgccggggccggggttaccgcgccccggcggtaagcacgtttaccgcacggtaaccacggtaactgtaaaagaccgtacgaaaccgtgcaaaatttattaaaaatttaaattattttttaaatttatttgaatttaaagaggttaccgcagtttttttattaccgtacccgcgctacggtaagtggaacctggtagtagtagtagtagggaaaggtagctgcacatgacatattgccgggcgggcaggccaaaacggtttggttgttgacctcgcatcgcagtggacaactctacagtacgttggatgggggtagacaagctcgtgtgcgcgtactagtatgcgataaagagatagaggtgggggggacaagccgacaaagaaggcgcgccaactgttgaccccgtgtgccccgctccgacacccctcgcttttccccctcccatcctctctctcctgtcgcctcctctctcctcatcacactagctatgccattgccacccccacttccactgctccactaccactgctataccatcgctccaatgtactacgggtgtgtttagttccacactaagattaaaagtttaaaaaaaaatttagaagtttatatgtgatggaaaagtttgaaggttgaagaaaaagttgagaactaaaccaggcctaccttcagttttaactttttctattatctaaaaaatagtttactccttccgtcctagaatatagcaacctaggatcggatgtgatgcatcatagtactacgaatctagacagggggctgttcagatttttagtactagagtacatcccatccggttctaggttgttacattctagaatggagggagtattttttaaataattattatattgaagttcgtaaaaatatattgagattagatagaataatcttctatcacactatccttcgtgatcgtcacagatactctcttctggttgataatacttatctttttgtcaagagtacggtctcaaaaaaacaattttgacaattattttctattataatattataatatgtataaaaatgttaacagatatatgattttattaaagtatttttttaagactaatctatatatgtagtcaccatatttaaaagacattttaaaaatgattcataatcaaatattttaaagtttgacctcacccttatctaaaaaaaggacaagtattatcagcccgaagaaaatataaatataatgatttctggttatacatctagacacacattcttatagtagtattaaggaacgaatatacagcatcatatatataccatcatagtgcaaataagatgtgagcagtattttggggccaaacagaattccgaactctttgggctaaggaatgggctaaacatctccgatctagcccacttcattatttcactagaacaatgttttgaccaataagaaatatgatttttgagacaaaattaatgtcattagatttacattcaaaagtaatgagtgctattagatttatattcacaaatgctttcctgtaattatacttctgtgtcacataaatataatatattaataaagcagttggtgattaaagcattgtcctaacaagcaaaataaattgttttatactgtattatttttttacagagaaagtagtactaagtattttggacaacgatcaggccaggccagatttgatttgggccaaattatccatgatcaggcctacccttatcaggcccttcaacatttgcaaccactgtgctcctctcagtgtttcgtgtggaacacttgacaaaacaaacattgagcatgcatgccccttattcgcataaattattattagtgcaaaatgttacatgaaaagatcttcaatatactgttacacctttcaccggagaagattacgtgtttcctgcatttagttttcggtatagatcttactgccagagtatgctccattggactgaccaccatgatgattttgcaccactgctttgctttgcatttctcttagaaaactgccgctaatggtggcgcacgtttgagaattggtcgaccgagtcaccccgctcaaacacagctgctgcccccatgccagatcctgcaaccaattcatgcatagttacatactagtacacaagatgtcatggaagtttaacaacgagggctacttgcatgcattctcctgcacacagagaaatccagagaaaaagaactcaccaatgcacatggtgacaacaccgaatctgcagtccctgccccggcgcttcatttcattcagaagagttgcgacgcaccgggcacctgaccaacagaggaacaatcaccccatttagaagacatgcttggatgatctgtagcaggtactaacagacagcaatgctacttccattgacacctgcacattctaaagccagaatgacgatctcccatacaagtatttgattacctgttgcaccaagaggatgtcctagggcgattgcgcctccattcacgtttacttttgacctgtccagtcccagcttgttgcagcaatacacgaactgcgaagcgaaggcctatacaagaatacagatggcatgggtatcaaccattgtagctaggtacgagtaaacgagtgagctaatattgtaaaaagtaacaaacctcattcaattcaaacagatcaatgtcttcaatctggagtccagcagacttcactgcagctggtattgctactgcaggaccaacacccataacagcaggatctactccaacagcagcaaagctcctaaatgatgattggaggcaacatatggatggatcagttaaaagaaaatgtgataatatattaggtcccaacagcaatagcaataacaatgatgatcacaaactccgttcacacctaacaataagatacactccctccattccataatataaggcacaaccacttttcttagatgttccataatataaggtatacatgcaaacatgcaattaactatgacatcttctccattaaattattacttttttaaatcctccactctcatgctatctaatcctattggatgcatgcattatatttattaggatgatccaaactacaagatgataataattatttcttggtctttgggttaagggtggttgtgccttatattttggaatagagggagtatctcatacagcattcaggaacacatgttaagactgaaccaaatgctgtatatacaaggaaatgcaaaatgcagcacctgaaaacaccaagaataggaagtcccttcttcatcgctacgtccctcctcatgagaagaacagctccagcaccatcgctcacttgactagagttgcctacatagattcgttaaattaaaaaaaaaaaacacatacacaatgtaacaagcaatggacaaacaaagcctggttgcaatagtagtgtcagcagaaaaaaaagctaagagtgctgcaatacctgcagttgtggtaccatccttccggaaaactggtttaagctttgccaatccagatgctgtggtccctggcctaattccatcatcaactgatatcacaactttcttttcctctccagtcttggggtcaacaatctgcacaggaaagaatatcagtgaaccttgcacaggtcctgattagcaaaagaaaaatccagtgacaacaaccattcatgagtcaacaataaccatgaacaataaactaggttacatcacatgaactaaatcccagagcctcttacctttgtaggcaccggaacaatctcatctttgaatttcccagcagctgtggctgcagcagccctcctatgagactcagcctgttaaaaacaaaaatttcgacagtgttttgagtaaaaggaagcagtgggaagaaaaaacacaaacagaatgtatgcaagtgactcacagcagcctgatcctgctcttgtcttgttacaccatatcggtgcgcaacattttcggacgttatccccatgggcaaaagacaatcctgtgctttctggacttcatttacctacaaagtacgtggtgttacaaggcatcaccagagaacaacagaaatacagaggatgctctggtgctcatagaattcatactttagggtttacttgtccttcccaacccatagcatttactgacatggattccaggcctgcaccaatccctgtttttgatggaaaaagacaaattagcacctttaaatgaagcaaccagtagcagagttagcataaccatattgtctagaacgagtaactagttaattacctatgtcgtagaacccagctttaatggccgcggcaacatcagccactgcctgtaatccagaggaacattgccggttgacagttctaacaggaacgttttctgcatcgacagaaaagtaaaatcaagcaaatgaaaccagtgtccataataaagaagccctgtcttcatatggtgatataaccgcaaacacagtattaccgggaactccagcatagaaagccgcagccctgcactcgattgcacgctgcgagcctggacctagcaccgtgccaactacaatgtcaccaatttcaccagggttgatcttagtgttgtccagaacagcctagaaaatacatagaaaaaaaaggagcaaacgattgattgagaacgcatagtctctaaattcgaagtaaccactgaatcacagcatacatgaagggcaatattagcaggcgcaaacctttagaacaacagtaagaaggtcctctgggtatgtatccttgaaacctcctcgcttggccttgcatatgggtgtcctgtaggcactgcaggtggataaacatggaataaagtggttagaagagtatctatcacatccgttgatcgattcagatacgtggtggcatattcacatggctaagcacacaaaacatgctacagccaaaaaagaaacactaaaaaaaaaacaaagcttagaacttgtagtttgtaatacactttgggtgataggtggtgaagagatagaattgacttgtagagtttgcgatcttttatcttgttgcaaaatagcagtaacaaactcttcttttttttttgcgggggtaacaaactcttgatttagtatgatttcagctactagtacaaggtttatcctaaaactaaagaggttaacttcaacaaaacgcatttgacttggatgggcgtacatcgcgataccaagcacctacagtaatcctgattcgtaagaaaagtcaatcagcgcagttgcttgaatttactactattcctcaaacatggcagcaactagtggtagtcaaacatccgccattaacaggtgaccttaattggtgttccgtgtaagtaataacaggtagtagtaggaaaaaaaaagggattagggatgtaaaagcttacgcgacgacgacgacgtcgtccccgtaggcggaagtcctctggtaggcggcgctgtccccggcggcgcacgccgacgcctgaaccaatcaaccaacaatcgaattgaattgagtccagtgagagagagagagagagatggagattacaaagagaattgcgagagagaggaagaggaattgactcacggagaggagcgattggtcggaggaggaggaggggaggaggtgggcgaggaggacgcgctggcgatcgatcgccttctccatggctgagatccgagcgcgcgagctggtcgtcttcttccttccgatggggtggggaagcccgccgcggtgtctggagaagattttctcttgttcgtatcgctctctctcgcgaaagcgccgattacttgacgcaaccaacgttgcttctgctttgcttatgtaggcgccactaccggataagctgcccactttttttttatttcctttcgtactgcttccagattttcttttctttctttctttttttctttcacacaggtagtactagtagtccagtagcagcacgtcgcttgcacgtaacggattactattttttttttgctctccgtattttgcctggtattcctacattcttgtgtgtaacagtattgttgtctgaccgtattgtacagtattctcgtatctctgcctggtaagactacgacgtgggtaagtgagcagttacaataacaagctataaacaggctataaccacgtaccgagaagaaaaaaaaaagagaaaaaagaaaacgggctacagatttatagccagctgcaacacgaactctaaaacgttatatctaaaacgttatatgtatatgagaggtaggacctgttattaatggtgcagtatatttttatagataactattgtatgaataaactattatattagttatagatgatttagagccaacggttggctattctattgaacttgctctaattgtgatgatacgagtgcacatgctaatcgagaatccgcgccgaatggtgatggtctgatggagctaaacgtggagttcgtctgcttccatgcttgtgctgacgtcaggcctgacggcagctggccggttggtgttagttgcagttggataagaaaggccaggccggtagataaagacaacagcagccgtaacagccaaggtctgcttcccacgatgacaaagcccatcttgtttcatgggcttgggcctcacctcatcatcacaacggcccagccaggatcacgtccaagcaaatgcaaaaaccagctcaacttgtccaaaacgacttgcatttttgcaaagacagtaaactctgctgaaatttacaaataagcttcttcttcttcttcttcttcttcttcctcctcctgttaacgaaccaacagtaggaaggaccaagttgtgagttttcaactgtcgacaaatttcaatcaaacgtcaaccaaccaatcccttctgaacaatttttacaccgatttgtacacgagggccattcttgccttctccatcaatcatcatcaggatcaggtagggcagatttcaggaacagggggatcgccatggagctttgcctgctgctccgaccagtaggcctgtgcggcgagcacacggtccaggagttcctgtggaactggagctccccttctttgctgcggcgctatgctcgccgtgtgcaccagggtcttccacttgtcctggttcatcaaatattgtttcacaggttttcagatagtgcatcctgatcctgatagaaagaggcagatctgaagaaaaaacgagatagatttaggcttaccttcagatcaacataggtcctatgatgaacattttcaaatgcgcggaatttgacgtccctccacctagacaaccagatcaagaggtccacatgagacacgcgaactgcggtgatgatctcgtgcctataggaataaaactactggggcattgaagccacaaaccttcctgttccaaggtgctcgacggcttccaccagcaactccacttcagcaacagtgaaaggcctccttatccgtctttgcccaaaatctggtcgctttgacctagaaagcggcacattggccagcgccagtgagtttggatctgcaaaagggacgatggcttgggagcttgctgatgtttcttgtgtgctccattccacgggataatcaacagaaccaggatcactcaagctgcagcctggaaaatcttgcataagctgctggttctcagcaggttcttcgcatttcaccctggaaatggaatattaaaacccttagatgaccacatacagcaaaaatctatggtcgtgtagtttccgaaacttctgcaaaacaacaacgttgacataaactatcagatgcatcctgacaatgttttctaatcatcacatgtaaatccaagcctcctgtctaataatgcaaggagaagatgctttcttgtaacctacgtagcagacttgtccacaacagatgcaccaacaaaatccatttcttctggcactattacaccagggtgagaatcttgcccagcttcacattccagagtaaagcctatgtcatttagttttttaccacggcaaatcccagcctgacgaagcgtcttgttgtcattttgaatattttttccttgaagaagtataccgacacggagaccgcgttcaattatagtagtaacagcatctgacacagttttctgaagacaaatagaaagaaataatgtggttcataagaaagccaatgtctatgcacagagataaatatttaagtgtaaagcactgacaggcagaaatattcaacatatataagattaaaataagtgtaacgaaaaggcaccaccttttcactatgtataagtacgttgcatcactaaaactagaaaactagatcagtcaaatacacattagcatggatcacagagcagcaaatacttgatatatttgagtttccaaaacagctgacacaggataacactaacgatactaagattattgacagcaaatggaaagagtatcaggatgcacacatgaatacatggttgccaactaataaatatatgttacagccaataacttttactgagaagatacacatatggtgttttaccttcaatgaaccaactgttgcattttcagggatctcaattagtagttcagggatgttgaaagatttgatggttaacttgactgaaaagagagaaaaaagtaagtcattgtgtttataaattaagcaatgattcttttaagtcaaccccaaaactaaaataaacatccaggacgccatcatagccctcagatgcacatgcggatttggatcacccatacaaaatggagttccactggcagaaatggcatgcccgtgtatttttaggaagtgtatcaaagcaggggttcagaatatccaatgctgtgtgtaagaaggattaagtcgtaccaactatgtgcaatgttacatcctggagcaatctaaataatttgtgacctttagatacaataagggaaacggacaacacaatacatactttcagttaggatctgagtttttaataaagcttccattatcaaaaaatactttcagttaggataccttcatcagatgatttttcggagtaaagttgagcaagtcttttcctcttcaaagttgtttgttgcactcttcggcgcgtagtgggcatcttcttttcacacaaactcagcttgttacctagttaaatgataaaaaacttggtcaatataaagtccaaatcctgctaactagctgaaaaataaaattaagtaggaaaagaaagtatcctctcttttcacaagctatggagctgtagaagagatgatattagcttgaaatacctttacaagacatctctccacatatcctgttgcgagctgccttccttaacctggaggcaaacaatctccttatcctgcggtcacctatataatgtggaatataaccacggttatttcctgaggtgcttggatgtacacacccagaagaattttcgtcatcatctctgtctgcagcatgctgcactttagccaaacacgagggatgggagttatgccccctgtcagggccgcagatgtgcactcctgagttactaccagagctagcctcagcaagaggtttggtgtccaaatccatggtctcgaccaaagcacatagagctgcagcatcactatcttcttgacttctgattgctgttggtctcgcccgatgcacttgtttaacctctgctgatcttgtggaccaaggttggcatactccaacagatccatactccggaattgtgccaagaccaaaacccaatcgacatgattttttactgctaacaaatgagtccttagcccaacacatcaggctttgctgttagtgactctagtactgaatcagctagattttgagtcgacgagttttcagccaagcacatattagcttg

SEQ ID NO: 3011 - DNA, 18446 bp, Oryza sativa
gtccaacctcttctgcaacaccatgtcttgtccttgactttaggaaatgtgttcagtgacagcaaggggaagtaaataaaacatgcgccatatttttctgcgtcgaataagcaagatttagcgaacattgatccaataccgaaagacatcctaatacagctcacaactaaaagaaaatgctgaattctatgcttctgaaatggaaagaattcatcattggtgagccccatcaaaaccgataatatctggcaagatgacattcgctgaaaccacagtctacttgtagtagtatatctttgctcttaaaaaggacaaattggggttgatggtgtgctctacaccccaccccgacatctgagatgatgttgtctggctagatctgtgtatacacaaaccgaatcaaacatgtttcggctcggcaattattcggttcacacctagagcataaaccccatcccgaaatgcaatcgagcatctcgcgtaactgacgagagggaagaatccgcattacccgtcgacgccgacgaagaggagggcctcgccgccagcgttgagatcgccgcagctcggctagggttttgcagctgcgtgttccgacagccgaccaaccggagcgggaggcgcagatcggggagcaccggagcacggcggaggggagcagatggcgcgcgccgccgcagcgctcgtcgcctaggattggttgacgacgacgacgacgatgcccatctgctgcttctgctgtgcatacaagaaacgaattttgcatataagtttccatttttttctccttttcttgaaaacatacaggagataatcagagcaggaaataaaatgaaataatcaggcaggttgtccgatcaagaagggtaaccttgtgggggatgggggaaggttccagaaggttcgagaagagcgggcggggaggaggaatcgctgcaagtggaaggcgcagggaggaggaggaggaggagagggagaggggaaaggattggaggagaaaaaccccgtggaagagaagaagcgaggattttccttgtgtttcttgctgttttttcttttcttttttttcttttttttttgatgatgggaagaaatggttttggggcagagtggttggttggaggtgggcttgcgcatgatgcatcacggcccattggatgatggatcggttgggcttaatttttgtttttggagcaaagcaatatgggccggcctggttatggcctggttatattcgaagatgggctgctctataactggaggcccaacctgtattatgggatgagatcccaaatgcaaaaatcacacaagtttgtcatgattttgtcgtaagatctgtccttttacgagtggaaatgaatagattcacgggccatggacttttctaacaatagattaacgccagcgcacacttcctgggctcctaaacaagtgcatttttttgcaaaaagaaaaagaaaaactttatatatatgaacttacttgtataatccattttccagctttacaatagttaattcattcgtttatacccttaatagttatcacaaatcattcggctattcaacaattaattaattaagcacaaacattcagggcggtgacaagatggggtctaccctgagaattatcctaagaacttggaagttcagggacccatgcacaagcaactttgagtttacgctacagttaattaatataaatcggaaaatatctctcaagaaattagaagtcaactaacacaaatcatattccccttatgatgcagttcttttctcccgttccattgtaggagtagtagctttcacttgatgcatctagcactgaatctacagcaaacggccaagctcgactgcaagttcagcaagcaacttggcagatgcatacacagcatcgaagcatccaagatcgatcgcccacctaacacggcgagctatctgttttccagcggcgaaagaaaccacgggcacggcgagtcggctcaccggccggccggtcggtactcagtaccaaaccaaaggtcaggatgatccggcttatccactgccacgtgacctgggcccaagagaatcccgccagccaatcgccgcgcgccacgtcgcccgctctgtccctgtagaacacacaatcatgtccgaattccacgtcagtccacatccaaacttggagaaatctgagagaattactcacactaacctgacttcttcactgatgaatgcaacccatcgtacttggtagtagtagtacatatccatataaccatatcctgtttcaggccttgtcagtgacaccttggttaaaaccacccatgcaccattctgctgctctcaaatcactatcctgaatacactaatctcaatctaattactaagtttcagccaaacctcagaatatgcaaaatagtcatcttcagcttgcaatttgcagatccataagttttgccatatgcatggactatgataaatgccacctctgaatctctgatagcagaaacaaatgatgatgagatactaacaagcactaatggagtattaaaaaagatctgagcatggatgaggtcaaagtccaccaataggatctgagcagtagcagtcattggtgggccagcacctcccatgcattcctatccacctcagctccctgacaatagacgcaagtatccagttcactataaatgaaggcctccggctacgatctgcaggagaaaaaacagtcagaagctaaggaagaaaaagtatagacacagtgatacaatggcctgcatcaacacattccagagctgctccgtcctcaagggagcaaagatcaatggtaccaagatcggaggagggaggggatcaccaaccttccggtgccgggcatcgacgttcatggacgggagcctccggctagagatcgacgagaaccctgaagccatcatctccggtgagtggccggagaacttctccctgctcagctacgacgatctccgcgcctacctccagtcacaggaggccgctgctcaagccgacaaccaggtgcactgatcacaccatatatacatagattcttcttcttcagatcaccaactgtcgatcttcttcttaagatcttgctaaactctgaactggttgcatggttggtgaattgaccagcgtgtggcgctcctgagtgaagccatgtcggcgcctgtgctggtagccactgccgagcagacgctggaggaggttgagtgccactttgagacggtctcaggtctcccagttatagatgccagcctcagatgtgttggagtgatcgtcaagagtgaccgggccagggcttctcatggggtcagctctctttctcctctcacacacacatacatgatacatatccctctcactcacgcacatactcaacaacaaaaataagtgctgatctattgcttcttgtaacagtcaaagacgaagattgcagaagtgatgacctctccagccatcactctaccatctgacaaaacagtaatgggtaatccatcgttgttttcgcccttattttttttggttattttccacttagctaccagttaagctaacaaggcatatgcaatgtctacagatgcggcagctctgatgctaaagaagaagatccacagattaccaattgtaaatcaggacagacaagtgataggtgagttttgagcagtggccaatacagaaaaaaaaagggctttcattttttccccttgattttataccatccttaacattgataattcagagtatgttgcatgctaaatggagttccaaacactattaacaggtatagttacccgtgctgacgttcttcgcgagttggaagccctgctggaggtttagacgtgcagtggtccatatgcttcggccttgttgtatatatgtaaatatatgccatggtgtttttgaatagcaggcatctctaatctgtaagagtgttgtagcgcgaatcaccaagataagcctgagaaaataaccggagagcttttctttgtacaataagcacactatgagacctccagtgttgtatgcctgtgaaaaaatttacgttagtgaatggtctccacaacaacatagatgaatgaatatgcctagttatctttcagaacaaaaccaccaaggtgcttcaaagatggatataaaagtgaccttattgaagtttcattgtcagaggatgcatagaacaataggacttaacagaagaaaataggaatgccgatgcaagagatatgcctattcggctattctttgccacttctgagcactaacaggaaagatggaaatgtgttatacccagaaccacaacaggtcaatcaagatagatggaaaaaaaaaaatcaacaaacaccaatatcgaatgtgacaaatctttagataaaaaatgaacctaatattataagctgaaggaaccgtagctatttcaatctcaggaagacccaaggagaaagaacatactcaatctgtatgtcgtggcaatgctgaggctgtcataactcagattcgagttgctgagacttgcccttgttgatcttctcctgaagcaatactagcagcagaaacgggcattgatgtagtagtactcatgttttctggtgaatcagaaatgactttcatctctaggtttgggattacaggtggctttgtcctccgagtaacagtcattttcaacccctcagttgtgtgaatcgttgctccagttgtcatctcaacctatcatattgatacttcacagtgattatctgtatgttgataactatgaagaaccaggaagcagacagaaattataccggaggagctcctggagccatttgaaaatcaaagcgcctgacaagcattgcagttgccaccacagtctgcatacaagttccggcatatccatgttattagagttggaatcttgcatgctcaatagttattgtactacattatttatcatggcatgagatataatgtccttatggtagacaacagaaggctcaaggcaacaaggttcagtaagactggaccatacataagtttgctatgtttccttaaaatgacattttgaaattaaaagaagaaatccttcaaaaactaaaacaaattacctcgaaagtggcaaacatgtcacctacacatttccttggtccgccaccaaatggcaagtaactgagaattcaacagaacacgtgagtcccatttagctatgtagattcatcaaatatattaaattagccagtgaggcagtgacagctaacagatgctagccgcaatacacagaatgaaagctaccacagcctaaaattggagcttaaaaagtttgacatgccaactgaaaatcaataatttggatgttgtcttgaaagaaagatgtgttccgcagtgagttcaatctaagctgacaaaataatgggacatgtcatgtgccaagtaaatgcagattaccatttttaagtttcagtgtgatgcctaggagacttgctgtacattatagttgatgatacgttggttgtttttcaattaacatgatttgcaggtcacaggttttatgccgtgcatcaactccctgcaagactgcaacacggaagaagtttgtagtccagtcggaagtcttcattaactcaggatggcacgaattgttacgtcttctaatcaagtaaggattttgttcaaagcacctctgatgtttgttgatccatacaaagggttctgctgttgacatacttgctacaggtaaggaactcatacgacatactatcagtttatacaaaattactattccaagtactgtttctgcgtaaccagttaacagttctggcgatgtggtaaagttgaaaagtactttcaagcactatcagtttgaaagtacaatagcattttggcacatgttgcttatagccatatgaatatcattttaacatgattgtcataaactgtggtttagctcccaaaaccataaatttaggaatcaagtcatcacagttatctcatctttactgcttcaaaagaaaaaggtcccatttttctttatgttgttgtgactgccttatgcactttctaagattgtggctatgcacatgccagcattagcactaaattaatacgaatcacatgaagaaaatttgatgatttgcatcaaagaagaaaacgaaaatcagctagagtttttgtttttgttatctctagaataattacaacaggtgcatcgcatgaccaaataacttagtgttagtagatgtaaaaacgcaaacttctcgtcaaacaagaacacaactataccgagcataatcaaatgtctactgatttttgtagtagaaagcagaaactaataaaatgggggaattagagtgataaggtgcatccaaataaagagctaatgcatttcatagcattaatagagatggaacctgaaattttggtttgtttcatttggatttggtccatccaaaggccatctttctggattaaaaacatctgcaccatcccaatgctttgggcaatgatgtaggttccacacggatatgaaaatgtcttctcccctgggaaacaaagggaaaaaatatcttatcagaattataggtgaagttcaaatttgtactgaaatttttaaaaaggaacaattcagacaattaaatactctagagctacgaccagaaatggtatacaagcagaagacaaaaatatatcacacaagattgggaagatattctctaaaaaaagattggttagataacttatacttgcacatatcttaggccctctttgtttaggcttataagccagcttatgagctgaaaagtctaagcctaaacaaacaaacagcttttcgcatgttttttttaaaagccataaaccactattacactattaaggctcagcgaactgttacactattaagacaaaagctaggttggaaaaggttttttggcttatgtgagatagaggtatgactccaccattaaacttaggactttaaatccattggcttataaatcatataagccaaaaaaactgacttaaaatactaaaccaataaacttaagcctaaataaagaggcccttagactcagtttcaccagaactttactggtgtgatactaggcatgatctttctgttttcctattccaattgtaacaacagtcaacaggactacaggagagatttcctacacttgagaaataagttctgctagagttttctttaccggccaattgggtaccctcccagcatatcctcctcaatagagcgacgaattaaaactggtggctgtggatagagtctcaatgactgcaaaagtggtgattgaatgacatattcattcagtgatcatactcattgtttaatgaggtagcactgtttatcacttacttcgttaattactctagtagtatacttcaatttcttcacatcctcaattgttggtaaacggtcacctagaacagtatcagcctgtccataagtgagtgaaacaagtcatttgcaacttgtaagatgtagaagcacgtgcctctaaaaataacaatcctaaatgtaaaagcgaatttacctcatcttggagtttggccattacatttggatactgcaagttaccaatgccaagaaaggtaaaacatgagtggtttgacgtatacaatattcatcattacatattgctacattaatacatcaatgatttgagttgctgaacatattttcttttgggaacagctacggaacatattgataccttagatagaagataaaatgtccatgtcaagactgctgcagaggtctcatggccagcaatgagcattgtcatcagatcatcacggagttgcttgctggagacctaatgaagacaaattgaagcaatgtgaggaccagaatgtttggagatctataatattttaaactgcaggtacaccatacatcatctccagatgccaaaagaaagtggaggatactggggtcttgctcattcatgtattcttcatgaaactgcagatcttcttcctcgaccaatctctgcaagagtaacagcagccaatctaaaagccttgatttttttaaaaaataaataataaggtcagaacataagaaaagaagttcaccttgcagatgtcaattagttcatcaagagtcttatttatcagcgcaagagcttcattgaccttcttctgccgcggggaaatatctttccatatgggtatttcccaagttggtataggagaagtgctccgcatttctgcttctcgcagtgtcacatacactgcctgatcatcaatccaaaaaaaggtaaaattttaagaaaacaaacatgaacaaatagaatgtataatgaattccaaaattacagtacaagactgaatactaacctcaactattccattatcgtaagacaatgagtcgaaatcataattgaagactgccttcccaatgacatccagtgttagtcgagagaacaaagattccatctccacatcctccccatccgttgctgccttgtccaacttctggcagagccgatctgaagcatatccgaagagacttatcattgcggtaacgtactgcaaagcgaaattcagatcagttcaatcacaacccgaagatcaaatcatgctaaacctggtacagaaatgatgtagaaccttctggtgcattgctggtacaatggcgcgcctcctaacacgccaaatctccccatcagcagggatcaaacccgtacccatcacaaactctaaaatttctgccagaataccctgcacccaccacaatcaaaatgcaggccgttaatttctagagcacagcctagaacacgtctacatccaaaattgacaacacaaaaccttggaataagccttggagttgtccctcaggatgtgcttagctatagctggatcagagacaatgaggaaagactggggaaaacaagaaaagaacaaagtttaggccatcaataataacacaaaattgggagttgccgagttggagagcaaattggtctgattgtgcatcaccttagggccgaaattgaggcgaaagatgccgccataggtaaggaagagatcatagagcgggatgaagaaagcctgccctgtcaccgcactcatagaccccaccgcctgcggtatctccggtccgccgccaccggcgaccttggtgagcagcgcggcggcgagctcccccggtgggccgagcttggcaagccccaccgcgaggggagcaatccacctgaaaaagagagagggagctctccatcagatcatcaaaggaggaaggaaaggcggccgcaacgtgagagagagagagagagagaatgagcactgacgcggggccttgggcggtgaactcgccggacgcaatgcgcgccgccagctcagcctggcgccgccgccgccgctcctcaagaaccgggtcggagccggagccgtcgccaccaccgcctttcccgttgccgcccgaggcggcgcagcggaggagcaggcggcgacgagctgaagcagcagcagcagcagcagaaggaggaaggcgcaggtgtgcctgaccggagccgagtaagcggcacggaggtggagcagcggcggccgcagaggaggtagccgccatggcaaaggcactcactgacgtcgctgagctcatcgcgagaactcctcagtggtggagtggagtgatgaagtgagtggagtggcgcgaggaaatcaatggtggaggtggaggatgaggtggtggtggacgtggggcctgctcctccgtttgttgagctgcctttcccgcgcgcgcgcgactcccggccggccaaccagacagacaagacaaccaagccttcctccagagatgctactggagtgtgtaacggaatctttgcagcatcctcctcttcttctccgttgctacaattgaattggcagctaggatcagtctcaactgataaaacatactccctccgtctctagatatttaacactggtgatttttttaaacatatttgactgtttatcttattcaaatttttttataaatattattcaaaaacttgagtagtaatagtatatttaagaacgaatcaaatgataggaaaagaattaacttttgaataagacgaacggtcaaacatgtttaaaaaaaaatcaacggcatcaaatatttagggatagagggagtactacatggaatagaagttatatcttatacttcatccatcctaaaatatactctatccgttttaggttataaaacgttttaactttggtcaaaatcatattgttttaagtttaactaagtttatagataaatataataatatttatagtactaaattaaatttatcaaatcaataattgaatatatttatttttttctacaaacttagttaaacttgaagcagtttgactttgaccaaagtcaaaacgtcttataacctgaaacgaagggagtagaagattttagataaatgtggcatatccttgaactataaatctatacaagttaagaaaaatgaatctagacaaggtaggatatgtaatatttaccaaaaaccacttatattttgggactgactgagcagtaactaggagcaagattttctttgaaaattgcactaccaaaagactgcagtgaagaatgggaaatcagaatatagagataactgcagactaatcatggtaaatttgatataccgacagaaagtgcaggttttcgtgtggcggcagttggggcttcaagataccgtgaattggatggtattggcatttttataccttcaagtgcaaacagcatttgtcctggagttggatgttgttgccagagtataaaattggaacacgctgtagcataacagtgatggcaacgtgtaaaacaatcataagaggttcgcattttaatttttttcattttgagatgatcaaaggaagatcatgtacctggtaggtataacacaggaaacagtctccatatcctatcagctgcagctccaattgaacattcagatgagatgaatccaagtgcagcctcttctagtacaaactgtacaagagcatgggggctctctgaagagatgattccaatgcaactctttgcaagttttcgaaggaagacattgacacgtccatttccatcatccaagtcatcgaatgcagccagaagaaaagtagttttcacaaggctccaactttgcattcttcctactaataaatggagcggaaatagagaggcaattttatgttatcttcaaggtggaatcaatcatgtcgtggagaaaagaaagccatctgtatgtgtttcaccttttttttttaaaaaaaaaaatctaattggtaactgaaggaacacggcgcatgtcgataagcatcctgcagcttggagccttgggcaaatcagctggccttcttcagataatgcttccctcctaggcattggcccattccgttaatcacctgaagaggacatcacctgaaggggacaatagtagttttaggaacaggttaagacttaagacgttcaaaaacttggaaagccaaatgcagtgagtccagatgagccgagctccgaaatatgtaccttcgaatttaaaacagttttcacattgaaattgatattttttttccacattcgcctcatctgattgtggacatgggtagaattggatcccatatccaagtacagaaagtgtgcaacatctgttggtagttacactaaagtgccccccagactgtttttaaagaataataacctctacagagaattggaacagtgaacatcagggaatgtcagtaaaatttaacagttgctgttgcaacagaaacaacatgttcagaagctcaatggctaaaaggatctagcactgcaacattgattcgacacgagtggaactagtgcgcgctagtggtggcgcagaagcttgaagcaaagaaaattcagcatatctcaacatctggtacgcacacgcacatcagctaatggaagaaaagccaaattaatgagcagtcatactgcacaaatcaaaccactcgcacacatttgttaagcaattattaacaattagtattaatttgcccagaatgtgttgttactgatccgaagtgcaaatgcacacagatttttgccgtgatccaaacaatagctaaatcggagcaccaaatcgaccacacccaccagattttgtagcagacacagcaaaagcagtaatgtaggagtaccttggaatgaaggagatcgatccatcgttgaagccctaggatgctattcccttcctcctccaccgcctcctcgctcgaaccgcatcgttgaagtaaatctacaagttcatggggtccgtgggcacctggctcgacggcggttacgtggagagacgccggggcgtcgcgccggaccgtgcagcctgcgggtgggaggagatagggggtttgggattcggagaagacgcaggaggagaaggagatcagttgcagttgcggatgcagcgagctggagcgattggaggaaggattccttcgagcttggtttcgtgggagggcgccatgggtgttcgacgaaatgctcgagcgaatcagaggaggctattttttttttcaaaaaaaatgaattaagaactcattaacgtataattaattaagttaatattgtttgtaaaatgattaatatgaatttaaaaaacaaattttctttatatatatatatattaaaaaaataatgtttaatagtttaaaaaacgtgcgtgagttgagttgggaaagtaaaagaaaacacagcggtcgaacggacttggcagagaacgaatacaatccatatcgctgaacttgtcaaaaaaaataataccgtatgtatatctccagaagaacaatggcaatgtagttcattagtacagcatcggcgtgtaccattcataagaaaaagagcagtattagttcatatccaaatctcatgctatagcttgacatcctagagaagtcttgctgccatagccccacatcttcaagaacaattatttgtgcaaacgttaatgtcgtctttaaaaattacatctacctgctatacaggatgatatcagctaggaatcacaatcctccagcagcagataaatggccatggattgcattgtcatatatgcatatatttacaaaatagcatgaacatggagcacagtcagctttgtcagccactgtaacaccgaaatcttgtgtgaatgaaatgggataataggcatataggattacttaaacgtcgtgggaacgctggaagattaggagcgctacatcagctattttttttataaaaacccttgcgctttcggttaattatgtgccggtccccgctgttgtccaccatccaatttcgccatagggtcgatctggccgtccacgtgtcccgttgtgccggcccttccacgcccgtgcgatcgtcggattatggatggacggcctggatttcgcgaaacggtacaaaccatagccgcccgtcctctcctctccccacgcgcgtcggttcgcccgcctcctccgctcgcgtgcgccgttgccgtcgcagctccctctcctctaccgtgctgccgccgccgctccctcccaatgagccgccggatctcccagtgaggaggctggggccgccggatccggtgaccccggtctcctcgccggcggatccggcgcccagacgcccaccttctccgtcgctgccacagctcccttctcctctaccgtgctgctccagccgccgccgtgtcactctgcggccgccacccttgctcccgatgccacacgacaaaagtggtggctccttcgccttcgcctcctccgctctgttcctctcctctctccaactctcctcaccctcttctcctcactttttctacacctttgttgacgagaaaatcgaacacatcggcctgggagatctacttagctcctgtgcaggtccaaagattaatgagatgcgggcgtgccagtcagtttgatcctgcaactgacaagatttgcaaataatagatcaaacagccgatcagctgacaagccgatggagtagttccagccgatagccgataatagatgatgccgataccagccgatggcgatagggtttaagcaatcggctatatgtccaatgtagataatgatataaaggcaatcggctgatgataatataatatagcaatataatctagtataaaccaatcggctaacaatatgaaatagtagaacaaatattgatctgtaggttaaagcacacatcggctgcaggtccgatgtcataagatccacaagattagattaaacagtgaaacctttgttgccatcggctaaatccaacttatatgtatatgcaatccctacaagccaatgcaacgtccagataacttatcggctagcaccccgataaaacattagcatgaacctatcagcttaacaagacttatattatcaacaacaatctagtagatcgaacctaaccgatgcagcatgagattgtatatgataatctaatactcgatgagccgatagatctgtctaatatgatggatataacaaatctatttagaaaaacattatgattgtagagatatatcggctaagacaggagatcaaacctaaccgagacagtcccaactaaaccgatgcgtctctaaacacaatgcaattagagatagaattgagatatcaggtaggcaaatatatcaaccaaaccagagcgatccaagagatcgaatcgatgcagccttgaacaacaccaacatagccgacagattcacagggcccgacagaacgtaggacttaccccttcgctggagatcgaaagccaatgcagccctgcgtcaggtgcccaagttccgccggaagacaagtaaaaacctcagggaagagggtggcgatgtgccgagagtattattgatcgatagattgatagattacaatgaccccgggtgtacatatttatacccatagggagatactagtccttgtcggacaagaaagaaactaaaaaggaaaagataaagtccttatcgaacactaaacacactttcctaaagataaaaggaaactaacaaactatgcctaattaataaataactgtcatgtcgcatccttcttgaactcgaactcttctagataagcttcctttgattgatccgactccaccaagaacacgacatcgtggcgacttgactcccatcggctgattctagaactttgaagccgatactgactctaaatcgatggtaactttgggcttaccaaatttcactattaacaaccttcaacgttggctcgtcccgcatcctgtcgcctcgccccaccctttcacgctctccgccaccgccgccctctattcctctattccaccgccgtcgctgccctctcctccgatgtcgatcccgatgtcaccacctccgtccaaactgcctttgactgtgtgccaggcgtcggcacaagccgccggtggtacttgccgccgtcgatcctcaatcccactcttcccctccacaggttagccctaaactcccttgctccccatcctccatgtccctcttctctcttttccattggaggcaggtgcaaggagcatttgtttttgtttttttctcttcgcaattttgtaacatagaagataggatgactaaaccattgtggatcccataatattaaacatgccagttctattgaactttttatatcttgatgaatgtgtatgatgatttacttgatactactttgatcaaacacacatattgctatcatggtcttcttggatgctatattgctattggccaacttaagatgcttgaattaggtctttttaagacttcatcagaatagttgcacctaacaaagtaaaaaccagcaactttgatggtccctaaagatgtcgaatagccgtatccctaattcgtcacattaaatctgaatgcaataaaatttgtgaagagaacttgtggattaaggaagttgcgcttcattttgatccactatcgtggcctacccactcatgagtggactatatatatgtgtacatgatctaatttattatccttgtgattggctgctgtcattgtgctccatatggataacacaaaaacacacacacacacacacacacacacacacacacacacaaaacagaagcatcgccttgcagttgcacttgccaattattgtatcttctatttggaggtttcgatgctcttttgttgtaaatgtttaatactaagttgccaactattatagcttctatttggatgtttggacaacgaggttgacgctggcaaggccgtgctcgcggcgtcgcttcctggtacctccaatttcttctctggcccttacctcatctctgttgccaaagatttccttccaatcggcaacccttctttcgcagtgctaacaaggacgcccccatgtggttccccgcttgcagttgggcctttcctccatttaataaagcctaggatacctttcaaatgtatgcaatgattctctttgcttgccaaggtaaagttcctttttagactgctttgagattaatatttgtgcttcttcttttttgccagcataagatgtacacttagaaacacaaatagtgtggatccatctcaaagcctttaggatcataatataaatgccctactgtttttttattactgcttattaagcttctggtatccctccactgcatatgaagtgtgacatgtctatgtgagttctgtttttccaacatataaaattataaagtcatcatgacctatttaaaactgaaattttagctatcattgacctatgctgaagccatgtgactttttttggtttacaccaccttacatgaggtgcatattaaagtctgtgtaccttaatttggttcttcctcttagctagaggtatactaagacatactagctaggagggcctacaatccattgataatgtctcactgaatgcaaattaaaagagtcttaagtatctatacagatgtctccagattttaactatattgtgcaaagatagaattaactaatagaacaacaaattgatgtggagaaaatctctgtaataatcaatgtctgctgcaattgcttattataattcatgctctgtacttgcgcgtgatgatttaaatttcagaataagtgtacagaaaataagttgcggtgaactgtgatttaaccatgaccagtgcccgaagaacagcatggagattggagagatgactggtcagacaagagcctttataggaacaaaatgcaacaccgtttattgttgattgggtcatatacaaataatgcaatccgcttatggacaaaaatcaacaaggaagatgcagtacatactacattctggagaacttgatagaaacaagcaagcattttaggtcatcaacaccaccaacaacaacactactccagcacgtcgcagcagcagataacggctaacttgcaaaatgaatacccttatactatacttcctccgtttcacaatgtaaaactttctagcattgcccatatttatttagatgttaatgaatctagacatatttgtttagattcattaacatctatatacatatgggcaatgctagaaagtcttacattatgaaacggagtgagtactatactacctatgtatactacccatgctataagttcattagtatagagttaatctgaattgttggatcgatagtacaatccactataatatactccctccgtttctaaatcttttaacaccgttgactttttagcacatgtttgaccgttcgtcttattcaaaaaaaacttttgtgaaatatataaaactatatgtatacatataagtatatttaacaatgaatcaaatgattggaaaagaattaataattatttaaattttttgaataagataagtggtcaaacatatttaaaaaattcaacggcgtcaaatatttagaaacggagggagtgcgatggtatagagcaccgcaaagtaactctaagggagctcagttaggccatttacaatgcagtgatgtgtcattctccctcgccattccacgtcggcaaagcaggagggcacacgccacgtctgcttctaggcccaccagaatgaggttcgagtgtccaaagatggccactggttcttggcgaaaaagaggacgaatgaagctgggagacgacgctgcttccgcgttgtggagtgagtggcatcgccctccttcccatgccagccgtcgccctccagccagccgcctagcccaccgtcgctgtccgcagccatcgagctcgttctcgtccctgccatcggagctcgccggccacaccgcccccgatccgctcaacccgaagctcgccggccactccgtcgctcgattcacgccggtcggaggagagccagaggagaggggtcgccgccgtgggagccgaggtcgccggccgcgccggccttgcagggccggaagaggaggaggaggggaggcgctcgagcctccggttgcgagtggcatcggagtgagaggcgccaacggtcgtgggggac

SEQ ID NO: 3012 - DNA, 4135 bp, Oryza sativa
  unsure (1)..(4135): unsure at all n locations
ccaagctctccgccctgcaaaaccgccgccgtcttcgcctccttgctgccgagcgagtggcctccatgccaagaccgccgccatcgtctcctccttgccgccaccgccgtcgtccccagatccaccgacgctccgcccggccaccccagcgccgtctccgctcgccactgctccgcccggccccgtcgccgtcgaggccgccgctccgctcgaacgcctcagtgccggctccgctcgagcgtgagagaagggaaggagcaacgttgggctcgaggaaagggagagagagagagagagcggaaaggtggagaaaaaaaaaggaaaactacatttttgtggaccccacttgaggtactgcattgtgcagcttgtgcctctcagtgttcctcagcatatgtggcagctcaggtccggcattttaggtgacgcattgctattgcccttaaaataaaataggttggtttggattccgagcaagctgttcccggattttcttcttcagttcaccttccttgcgccttgcttcctgttcctcttccgcccgggcagtctcataatcagcgcccgccgcgcgcgctgctcttatccttttctcatcgaagtgaaactcaaatctgagctggacttcgttgatgtttaggagaaactctagcccagaaaacccaatttcattttttattagcccttcgacctgcagccgctcaagtttgagcattgttccttcctcaaacttcactgatttggtgccccataaatctgcaagcttgagcaccttgaggcttccaaaagcagttccagtctgtggaggcttgaaatgaaattcttcaccctgaaacggtgaaatcactagaatttccagcttcggtagtttcccaaggaattccatagcaacatcgtgctccaatagcctagcgcccactagttttagcttcacgagatgctggagctccttgatccattccggcaacgttttcagattgccgtatagcttgaggctctgcaggttttccggaggcgaggatatatcatccaagcaaccacacaaacccgacatccctgctgaactcacagacagtgattccagcttgccgaggttggaaatggccaacctaaacgctcgtccattcttcttgttgatgccagccactcctaacttgtgtaatcctgtgagcattccgatgtctcgtaggatggcatttccccttccgatattcacgtcccttagtgtgtacaagtctttcagatttctgatcccctttggcaccatagtgccattttcttcatatactcccctcatgagagatgggaatttcacgcagcaagcgaaagtgcatgcatcacgcctggtaagggccttatggagagggccatcaatgtcccgaagaagaggaaggcaacatgttgcacatagataccccactttacaacgcctctccattaaatcatcctttatccccgttacagtctcttttgagcccaacatggatgtactgtagcttctgcagcttgatgatagtttttggcaaagcctctacatatgtacctctgatgtctagcatctggagttgcctcaggttgcccaaaaaatctggcagtagatcaataccagcgcatcctcggagagaaaggaattttaggtgaataagcttccaaatctgatcaaggtgatgatagtttaggcctctagtcccttcaaagtcgagcactcgtataaacctcatcttgctagaaaccaaaaatggctcccaatacccaaacagagatagcgatcgtattcgggacaggtccactatgcccttgaattaatccttatctcccttccagttgctacttatagcaagatgacgaattgcgccatggatgtacgagctgcagccttcctccatcctaaaaacaaggtttccctccattgactttgagatggcgatgtcacggatgagatcatggactttgcaagagtcaattgatttcctgctgcgagctgattgctggaatggtaaaatcatgcttctattcttgagttccatgaagtagtcgtcagctatttctgttagatttaattgggtaattaatccatttaaatcaattaaatcaaataaattccaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggctagttgatgacaattagttgctctattcctcttcctattccattggtaacttacatcaattactcttaattgattgttggttgatggttgtgtagtggaggatggttcatggctagttgatgacaattagttgctccattcctcttcctattccatgactcttactcttcatcttccattcctcttataaaatgagaatggatttgatctcccgcgagaagaagaagacacactttcatccattttcaaaagctgttgctgctacggtaatcccatcccgacgagtgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggaccattcttggggtataaccttattacattatttcaattagaagttttactgttaatgttcatcgcaatgtcaacattgtgtcattatgtgattgttgatgcttattcaacgttaagcatgctcatattgattacattcaccactgtcactggatcaaatcctattgtaaatatcatgtttattatcttgttattttggattaaaatatgccgaattatgaccaaatttccaacaatttcaacggcagacttcccatgggccgcagttgagtaaccttctgctgcccaccgatgcaccaaacgccttcgactaatgatctggtcttcaggaaaaatggacagatataaaaaacatgacttgagatggtagggtaaaccatcatagcttttttcaaggacggttcttatcattccaagctctggattcatttccaactcagcactgatattctcgttcaattttctccactcttctggggtctttggtcggtttgccaagaatccacctatgacaactatcgcaagggggagtccatcacacttctttaggatttgttttgcttctttaaccaactcaggattcttctgctcatctaaatatgtagccttctcaaatacctgacattgatacaatttaagctttattgtgctctaagtaaaacaaaaaaataattaagtttagaaatatgtctttactattaaaactagggaatgaagaccaccgtcacataccaaaacaaggtcacatctaacatccatccaatgcaggtcattttaggaagtgcatcgctatggttgtttttttacccaacccgctattgttgtgagaacagattaaattgtatatgcatcatgtgtatgctatttctgtctgcacaaatatcatcttgattggattactcaaatgaataaagaatatcaaaccaagaaaaatggagcacgcctatattaccttctcactcaagaggcacagtgcatcattaggtttaagaactagaaggttgtgcacagttccatttttccctgagcaatgattggcaatattttcttttcttgtagtcacaatgattaggcttgtcttttccaacagggggaataacattggttttatctggtcccattctgaggtatctgagaaatcatccagaacaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3013 - DNA, 18000 bp, Oryza sativa
cttgttgtttatgaggtctgatatgagatgagagatgaaaccaccagcaacagacagcaattgcacgatccgtgtggcgacggccctcgggcgcttcccccagtatgcagaaatgatctcaggactgtacacgagaggcagcgcctcattgttgttcatggatgaaacctagagccaagaaaagggggaaatgaaaattttgttcttctattagaccttagttgaaataaactgttaattaacgtgatgattgaattgtgtggttggtggggcggacctcgacgaggcggaggcggacgttgtcgtcggcgaattgggagtcgcggaggttctggccgcggaggccgcgcatgagcgtggcgagctgctcgtcctcctccatctgcttccgcactcgctggatctccttggacacctccccgaaccgcttcaatcgcaaacacacaaaccacaccaacacaatctccacaatctcagcgagatgaaacaggtgtaagaacacggaagatctgactgattgagcagagaggcgatcggtcttacggtggaggagatgtcattaggggtcctcgtcctcgacctggagcgaggcgccggggcggaggcggagggcttgggctccgtggcgacggcgaggacgcggcgggatgggcgccggcgccgacggcccggcagcgacgccgcgagaccaggcagacggccgaagccaccgcagtgcagcaggtgcggcgccgccgacgccgccgccgccgcggcctccatgggcaagaagaagaaggaagaagcttagcttcttcggcgaagaccccgaggcggaggaggaggatgaatttgccgcgcaataatcttcccttgcagtgcagtgctctagttgtagcagtaaacgcgggaggcgccggagcccggagtggacctgaatgtggagtgagatggctggctggcccccggccacttggcgtcaccgcgggcacacaaggttcgtgtgcccgggaggcgcggacccatgggcggcgcgagagcggccacccccaccaaaaccggtgaggagaggacgaagcgcgatgtgtccgctttggattcgaccaccagattcccaccacctcaggtaaaatgccaatgcacccaataatgctagcacagctctagtgattagtgattcctatctccggcccattccataaaaaatgaatttagcatagaatattatcggagagtgaactcctccaccaagaaaccgtgaggcccccatttgtgagttcggtcaggggcagcgggtgagatttgagggcttggtgagcggaactttgtgatcttgagggtgttaggcccctccaagacgatgagacaaaagaggtttatacaggttcgggccgctgagaagcgtaataccctactcctatgcatgattgattgaatgtagaacacaagtgcttggagttgcgagacccaagcgccagttcgctcggaagtcccccccccccccaactaggcctggacctccttttatacctcaaggggttaccacatgggcccaacaacctaacctaactccggtggagaagtattataatctttgcattaaatgcatgtcttgtctcttgacttgggaagccaagcacacgtcgtcttgatgatggggcctgtcaaatcttgccgcctgacacgcaagcagcgcacaggcgcactacccagtcccatcggtcattcgaccggtcacagactggttgagtatactgcacgccgcatttggcgcgaccgctcgggtcgccataaatgcgggtaggtgggcacctgtaggcggacacctaacccaccgtatgcggtgacctagagagggggtcggggggagcccaacccctagtcacgggagggggtcgccgctgcccgaccttgggcccgatccccccttgggggagggccacgtggcgcttggggcagccttctccttctagtctcggccagggagtggccgccgccctacctcgggcccgacccccctcgggggagggccacgtggcattggagggcagcctcctccatttagtctctgggaaggagtggccaccgtcctacctcgggcctgactcccctcgggggagggccacgtggcatcggggggcagcctcctccgactagtctttggggaaggagtggccgccaccccacctcgggcctgactcccctcaggggagggccacgtggcatcggggggcagcctcctccgactagtctttggggaaggagtggccgccaccccacctcgggcctgactcccctcgggggagggccacgtggcatcggggggcagcctcctccgactagtctttagggaaggagtggccgccaccccacctcgggcctaactcccctcgggggagggccacgtggcatcgggggaggaggcctccctctaaacctgatacccccgggcccatatcatcgacaaatgtgatacattacagtattatgaatctagacagatatatatccgaattcataaactatgatatgtcatatcctgtagaaggttgattttctatgggacggagagagtagtgcgcaatgcaatcatcttttcacgcttatactgatggtaagatgtggagtaacggcttattactagcaacttaaaaatttgataatttacaaatataatttttatatgtgttcttaataataatgtaaattataataaaaaaaaccattaaaattaactctaaatttaagttttcatatttaaattttagcttttagcttataagcttgaggtaaacaatgggagtgcaattctttaccgcaaatggttcaacggacagatatcacaagtcacaatagtaagcacgaaaacaagaaagagtggtcgaaaaagatgagctttaatttttttttctacccagttggtcttttactagagaaacagaagaataaaaaatggatctagacaacaacaacaacacgatgtacaagaaattttacagacaccaggagaccaccccacgtacagcagcagctccaggacacccccaaaggtgatgtgcagcaatagctacctcccaattcatcgcgttttcgcagctgatgaggtcccgttcttttcaatcgcccgctgcctcgcacgctccatcttccgtttgcgccattcctcaagagctgcagatgtttacacaaaatggtaaaagaaaaaaattagcatcagcttctacatattaccgagggaggtagaagagcaaaacgctgctccagcaagcatgcaaaataaaccgttgtgtacagaccaaatcacactgctattgcataatggtatattaccaattgctagcatatgtatatatatgtacacctgatgacttcaggatatgatttgctatgatcattttgtgtctctgcatcaactggcaggatagaatggaatggtggtgaaatcacaatagcttggtattgcaagcagttgtttcattctttcagcttttcttttcagccctgtcctgaagctctctgatctatagcccatccaactgtattattgaactgttcggtttaactgtgcaactggtcttttttttctttccatgaaatatatactgtcaaatactcgcagcacaagccacaactaaagggccacatattgacagcaatatgatggtagtactacaaagatgtaactgtcacaagactcacaaccatgtttgcaagcatctaacttcattttgttcacatcatatgctcctcggatccgaacagacatagtacagaagataaactgaaagaacaatgcagccccaaaatatgaggagtggtaagaaaccaagaatgaatttacgaacctttttggctgctaccatcattccctgcccttaaatcttgcaacctttttgatgcatcaacagcagctgtctgcttggcatcttcttgtgtcatcatgccatgctcaccataagcttcttgttcgatttccttcacctatgtagcagaaatagcgaagttctaactttgattagcatcccaatgaattctctttcaaccaaatcacgagaaacacaatatacaatatacagtgacttactctcctgatcaaatccacaggctccatagcacgacgtaactcttccgactcccatataaaccgtagctgagctgcggaattgtagcacgggatctttcactgaattgagtatataacaggactgatctcacatgatataaaggaaaaactagaatttgtactaaacgaagaatggttgatcccattctataggttttgagcgcagcttatagtgctgttctctacatttggggtttccccatatgctcagagctcatgaggtatttcgattggaaaaaaaaagagtgatttttgtcagctgctcggattcgtaaagaaattccctgcatttcctgtggcgtggtgttagcagaagcccttgtccacatttaatcagaagaaaagacctgaactttgctagtcagtctagatccaattcactaaccagtttatcgtactatcatttgggtaccaaatcgaacaaatttctaggcccaaatcatctaacgagagatagattgttcaatgagagtgaaatgaacaagagtacaatgagttcgtaccagaatcgaactggtggtcgccggcgatgcgcggccaggacgagtagtagttgcggaagaggagagcgcacgcgaggaggttgattgcgcacaccgcgacggtggcgttcttgtacgatatcctggaggaagcagaagccccacccctccacgccccctgcccgtccatcccgtcgactgcggccatgcggcggcgcggcccgtcgagctcgccggagaagaagacgaggaagagaaaagcggacgcgtccaccaaccaacacaactcccttcctcacgtagaatggtaaatgggcctacggcccattaattagcccataaagaataggcccattaatgagcccataaagaattgggcccaactacctcgcgactaattgggcctccactaacacctagattccaaccctacctcgcttttcaccagtcaccaccacttggccttcctcgtctccggccttcctccaccgcgagctccgaccaccaccgacggcgacaatgcaggcggcggcggcgtggaggcgtcacctcctcgacggcaacatctcccccaccaccgcggcggcgatctccgccttcagatccgcctcccagccggcgctcgcaccccaaggtatggaggaggcgcccttccgggcgtccgggaccagccctgaacatcgcccgcgggtgccccccgagggtagatcttagaggtggtttgggttttcgatgcaggattgggtggagcggatggcgcgaggtacatgtccgcgagggcgccggcggtcaaggggacggggcatctcgtccgcaagggaaccggagggaggtcgtctgtgaggtgaggagctcaggctggttccgttcctccgattgattctatcgggcattcccgttgtcacgagtctgcgtctaggtttggccttcccaatgatttggtttaggttcattaggttgtgataatgttctgatccatccgtactgtcatagcagatatgtgttccttagaatggtcttcctgatgcttagatcgtcagatttgtgcagttcgtatggttgcatttgcgatggacctgttcttgtatacttgtgcatctcgtggaatttggagttacctgtaacacagctaggccttggaaattctgtgccctgaaaaaacagagagtcgattttagttattatgagctgaattggagctctggttgacagatatgtgatgttgttctaccaaatgtatttgatcctacttcccacatttttttgctaggtttgagaaaattcatttgccatttgcatagggtgttgagtgtacgaattgtggtactaatatttatcttaaagagtgttacttgcacatttgctggtgtttgttgcatcttgggagcaatgacgatcaaattaggttaatgatactcttaacctgcaaattttcctttgaatttataacaagaaatttcgtgacagtggaatcatagctacggtgtttggagctactggatttcttggccgctaccttgtccaacaacttggtgagatgataaggctttagacctatagtactacgttgtaatgaataatatcttactgagttatattaccataaaaacaaagtgaaatagtatggtaactcaattatttatttctattcagcaaagatggggtctcaagtgcttgtaccattcagaggttctgaggattgtcaccgacacctgaagttgatgggtgacctgggtcaggtactgtatttttgtagttcacaaattacaagtagtgaagtcattaactcatttttcctttttttttcccttttatgtattctacttttttctcttggcagattgttcctatgaaatacaatccaagagatgtggattcaattaaggctgtcatggccaaatccaatgtggtcattaacctaataggtatgtctaacttggtacagcatcgtattcagagtcaaatcccttcctgactatgtcaactcaatttcaacaggacgcgagtatgaaacaagaaactatggatttgacgaagtaaatcatcatatggctgaacaacttgcaatggtatgcattgtgcgcacatccgcttttcttccaactatatagataattcctaatacaatctttgagaattaggattgaatgaaattcaaagtagcaaccagcttgatttctcagtgcactggcttgcttgtgctcatcccaagattgcagcagcattgacaagcaaccatttggctggtttatttcaccagctataacttcagagggtcacataatccatggttgtgattagatttcaaacttttgcctgcttaggtgaccttggctaggtttcatctgacacaatacaaagcacaatatatttaagcacactgctctgccatcggtatataatccgtctagctgtccttttggttaacattaatccttctttttcttgtttcagaagccagtgttacttagctcctagatctggaaatggaaatatcttacttttacattttgcatgaaaagtatctttttctactgagctgttagtcttttaattcagcatcacagttactgccttcaatgtggaattactattctctttcctctaatttgtgctgtcctgggtaataaccatgctctataatttcattcaattggatacctgtacaaaggggaaaaaaattcactatcatttgtaactttctttttgctgcatcatgacaatataattcccatcaagacttcttttgtggctggctattaactgtgttatggactatgcacagatttcaaaggagcatgggggtatcatgagatttatccaggtttcttccctaggagcatcggcctcttctccttctagaatgctgagggccaaggctgctggggaggaatctgtgttgaaagaatttcctgaggtgatcatctacattaggcaatactgaactcctgtttctacattaccgaaagttagaagcaaacatgtcccatttatgttggcagttactttaaccaaaattttgtttgcatggatcaacaggctacaattatgaggcctgcaactatgattggcacagaagatcggattttgaatagatgggcacagtttgccaaaaattggggtttcctccctcttgttgattctgggtctacaaagtaattgaactttcctgttggctgctgttgtaatgccttgacttaaaatttagtctagaacattaattgatcagagaatacgggcctcatcatttgccctatggcttataagccattgccaaaatttgaattttaaaacttgattttgaagttgattttgatgctaattcaacgtagtttctttttcatcattagcttttaagtcgctaaagacacatgtaaaagtattactcataaattactttttatcagtaataagccgttacggcttataatcagtcgtaggcaaccgatggggacctacataaacttccacagcaggtgagataacatgaatgcaaccttttggtttttgcaggattcagcctgtttatgttgtggatgttgctgctgctattgtcaactccctcaaggatgacggcaccagcatgggaaagacctacgaacttggtggaccagagatttatactgttcatgagctggtaattatcatgcacaacattttgttatgcagcaatgaacgaatcttcaagttggttggtcgagtttttttatataaaaatgttctggatgttacaggctgagctgatgtatgagacaatacgtgaatggccacggtacatcgatgttcctcttcctattgcaagggtatgaacttaaataatatcttgtgttggtcaaggcaacctgagtattggattgtctcgtcttttaacagttatgcttcgggttgtgcaggctatcgcatctccaagggaaatgctgctaaacaaagtgccctttccgttgccaaccccatcaattttcaacaaagatcagattaatgcattttctgtagacaccctagtgtctgataatggtaagcatgatatcttatgattgatctgtaacctattgtttgcacaagctcacatttgtttctggggacataatacagctctcaccttttcggacctcggaatcgtgcctcacaaattgaagggttacccggttgagtttcttgtgtgctaccggaagggcggtccagcttttggttctactgtcagtgagaagatacgaagttctgagctgtagtcttccactcctgaagacactgtagaattaatcttttagttgcagaaacgttgttgtgtttgttttcttactatctgctgctgctgctgccagccgcccaacagcgagcaggaccatattcgatgcatatgttggttcctgctcatgtttttcaccaataagacgcacaaaatctttgtcaattttttgagttgcaaatgcaagtgaggcgaatcgttgcagtcctacgacacaataacaaagatatgtttctttctttaccctatacatatatgctcgctggtttgcattgcttgcaatgatgctacggtgtgataatgtgataataatttgtttagtgtctaatttagtattaggttactatgttgtaggagtagttgattagcacatgtacaaattcactgtataccattttgcttgtgatgccctgtccataggccacacagcccatcaaagctgcaaacacctctctctgcttcctggctgttaggcctccacaattctgctactcctggcccaaaacgcttgtacactgatcagatcgattgattgattggtcttctaatttcccagaagaaaacaaaagggagagattgattactgtgttcactggcactgtcatgagaaatggatgtgccagccaccagctgagctgacagccgaggacaagcgagccaagcaaagcaaatgcatggaccagcaactcgattacaacggcattaccggtaatcaagcaatcaaccacgcgtgcatgcagctaccgctttgccacatcactcaattcacaactactacctctaccagactaccagtcgtactgaattcgaacttgtggggtttaattccagagtggtgattttgatcaatctgaattcgatcaatgacggggacgcgtgacgacgtcgcccttttggcccgccgattaagccgctggctgagcttgcattgcatgcatgatgcatatatatggacacccagatgtgcagccctggacggacggaccgacgcatatattgctgcttggaatttctgacgacttgatgcatcaaccaacgagctcaagtaccaccgagatgcaagaggccgtcgtgctgcatgccatgcatgcacgcacgtttcatctgtcataatcactccggctaattataagagagaaattaatttgtatgctcccaccatttcatattataaatcatttggctttttggtacaactgataaattttcatatgaaaattgtttatttgatcacctcatggcagccatttatatatactccctccgtttcgaaatgtttgacaccgttgactttttagcacatgtttgaccgttcgtcttattcaaaaacttttatgaaatatgtaaaattatatgcctatataaaaatatatttaccaatgaatcaaatgataggaaaagaattaataattacttaaattttttgaataagacgaacgggcaaacatgtgctaaaaagtcaaccgcgtcaaatattttgaaaccggggggagtgggtccaaccaagagtcagtacaactgaaacaggtatataaatgaccgtatcgtattcatacccgcgctcctacagcaacagcactaacaactcatgttctctctcaaaaaaaaaaaatcatatagtatcaacttggttggtactcggagagattaacgtttcaactcgagcacaaacaagggggaaaatgggcaaatgagagagatgtgattggaattagttgactagcttgctctagggtgtgtttagttcacaccaaaattagaagtttggttgaaattgaaacgatgtgatggaaagttggaagtttatgtgtaggaaaattttgatgtgatgaaaaagttgaaagttcgaaaaaaaagtttagaactaaacaaggccctaattaaatggagtgaatgaatggaaaatgagtggctggtttgcataaaagcagatgcactaacagacagctgctagttttgatgacacatagggtgtgctatccagctatcctatgaatgctagacaagaatggcatcctggacactgttaaactagtatcaatgaaatctcagaaatcatcttcataagtcataaagtagaaagatttgcaattttcagaggatgtactccgctgagaactattacttgcaaaatctgagaaagtttatgatcaaaatatgtatgtctataatttgtagggattttttttacggtgcccctttcaaaacatgacacactaaattaagaaaagtgattacaaacatgttattaatttacttgcgcctacacacatgttactcgtaagtcgtaacaggagtaataaaaaaaactggtatatagtctccactcctagtagagttcaatctagacctatcttctttcaatggatcatatttatttttactatcatcttaactactatctctatccgacatttttctcagtcctttgaaactagataccatccaaattcttatattttgataccgaggtagtactaattaataacctcaactgtttagaactcctaaatattaacgatcgagattatttccacttctaatgatgagggagtactgtagtgtgctgataccagccggcttaagacaaactgcagatcaaggcaggaagagagatactgtagagctacatctatcattgttattgtgtgccttgggagttagacaaaaggcagccgcatgctttgatgccctaatttttggtctgatgtgttcgtgtggcgattgttttcttttccctttttttttcttttttgcctcccaggtagatctttcaggttaagaaaagatgatcagacaagccattgattggaggttttgactctttccttctcccaacgcgtttacttctcttgcttgctcgcttccatatttgttttctctgcattctgattctgatgctgttgtacctcttgccaactttttaattgacacaagtgcgccttctttacgagtaggactaacaccgtccattttaaattactggtatttctttatatctttgcaataagtcaaacatattttagccatcaatttctacaagaaattcatatattttaacattataaattttatgtttttaagattcatcgaaagaaatactttcatagcatatatataatctaagtattgaataaagtgcagttctctcctttgtggagcaagataagcagaaagaaagcagatagttaaagtatatagtgcacttacttttgagctctaacttttgaccactgcaatttacttgcgtttgtagcttcctaatgcaaaggatcagtgatggctttctgcgatcctaccctatatatgcaatcagtttgggttcacccattggaaatgtacaaaacgattggatacattatacagtagtattgctgtccatttacagatttcactgttcagtatatttaatttggagctgtaccagtcgctggagattactgtacgtacaagggattaattttctgtactggctacgaaagaaggattgaagctaccttgtttttactgaaggtgactcttgtgtcctactaccagatcgtacaagacggtaagacggttaatgtcaatcaaaccgaactccgaaccatgtgtgcttggttaatgtcaataaggtgattgcaggccgtagtactgcttaaatatccttggcctgataattaatttctctaatagtaaatatatgatgttgttgatttttcagcattcatcttatttcaaaatctacgtcaatagtatttatttatgttattcttttttatcagtaaatgtattttaagcatactttattatttatttttacgtttgcactgtttttttaataaaaccaataatcaaacactatgtttaataataaacaacatcctgtacttaaaaaacaattggtaatactccctccatttcatgctataatactatttaactttttttaattcaaactttcttatatttaaccatacttatagaaaaatgtagcaacatctataatactaaatagtttaactaaatatagcattgaatgtatgttgatgctatattttgttctatgttaaaaacattgctataattttttgtaactttaattattaaggtggtgtttggatctagggactaaattttagtccgacactaattagaggcattaaatatagactaataataaaactaattgtataaatgagaggtaattcgcaagacaaaatttttaagcctaattaatccataactagcacatatttactgtagcatcacatagactaatcgtggattgattaggcttaatagattcatctcgcgaataagttcaggttatgaaataggtttatcattagtatacgattaatatttttaattaatatctaaatatcggatgtgacagtttagtcccttatctaaatagtacctaaataaatgatttagaaaaaaaaaggttaaagcatcggagggagtagcagttttggtatataaagctgggccccgcattaacgcgcttgattatttccatgcccaactttttcttagataatgatctccatgtccagcctaggaggtaatcaattgatccggccatgaaattctgctcactttgatgcttgaaataataataaaaaaatagcagatgcatagagttcgattgatccccaccaagagcaggtaaagtaatatactataaatcggttataagcttatacggataagataaaagagaagagagaagacaagtgagttacatatctgtatatgtgggactaattattaataatatagtatatatttatagttaattattgtataaattagctattaatttaactatggatggtattaaacttgctccaagtagtgctacaggataatttggcgaggtaggtgctgcagcattacatctgagtacactcattgttgagctaaaaaaaaggggctcccgtgaatggcggttacttgtctccacgttgttaggcacgaaatcatcatccaaattcacaagcaaaattgctccctaccctttgcagttgcagtgtttcatcattcgagcgcttttaattcacatcacatgcttgcatatgcgtatgagatgaagaggatacagtgctcgtttgtacgcgatgttgttggatgagagacatcggtcgagcacatttatgtcgcattctctactcatcaacatcatacaacctactactaactccagcttaaaacatgtagagctgtttacttttaaaacataatgctattccattcctttcatgatatatccattttgatgtgatttgtacgattattaaagatatttcaggtatgagttatatttttaaatacttccactaaatttttagataaaataatccaacagtatcccatggtgactttatcaatctcaagatacgccagctcagtttttttagagatgcttatagagatagggtgtgcgtgtatatatttatagaggtgagtgtacgcgcgttgtgagcgtcttgcatttgtactgtgttttttaaaaaaaatatttaaaaatcgagaaaatagaagcattctccgccgttgataaattcttccttggaaagacctcgtaacacttccttggaagcgttggcacacaaggtaggtaagcttagctttgagtctttgacaacccaagatcgatcacgaggcaaccgtccaacgtccagtcgtgggggccaacttcttctgatcgaccgtgtggctattttcgtcatttttctaatccgccgttggcctaatttgacaaggaattaaaaaatggatctcacactagagaatgaaataaatgaaattaaaggaggagaaacctcacagatacgccaccgaccaagcatcacaggctggaattccccgaaatgccccctccctcctcttctctgctgccatccacgagttggatgagttgtgaaaccgtgtaccagcacggaatcacgaggccataagctgccattaattaatactatattccaaattaaaactagcccctcgtatataagagcgagtttaatattatagccaactactaactttaaatcatttatatttaatttaatagccgatttatacaataattactacaaatatataatacactattaatacttgatcccatctgtcatacacatatcgtgtcttaagatccgtaatagagctagttataaatttttttaaaatatatttatagctgtcttatcgtttgcaattatgagtacttctctaatgccacagccacaaacgctgctgctctttccttctacaccgggtgttattctaccccaccgctcaccgacatggtggggcccacctaatgatccaagcctggtggggcccgcctatgatctaagcctaacggcgccctgggtcgttgggggcggtgacggtgaccgcgcgtttccagttttccgtggggtgtcgcgggccccaccgcgggtgcgtacccacgaacagcgggtgtaccactagaaaacaaaataaaagaaaaacggcaaatggttttatatttttcttttctccctctaccttatgacctgctaaatctggtttacccaatgagttggcgccacgttggatgcaaaaataaaatctacaggtgtcttagcggatccgggtttttgcgtggcttcgcgggtccaggctccgaactttctttctacagccacacaacacacagcacctactcctagcttgtccccaagaagtaagcttacccaccacatacaaggacaaacggtgtatacatgaattctgaattctgtactctgtatttcgtaaaggggaaaagttacatctttttatactttttgcacgcttaatactaatctttataaaaaaatatgttacgaagtgccgtaccttaaaccaagcgatcgtcgattaaataattatagatcaaacaatggtacgaagtgatgctccctcttggctatccaaatggtatatattatcagtaagctaagattatggtacagctataattcgattataaagttgtaggaatccagaatgacaagctgtgtattttaactttttaagaagttagtttagccatgaagcatcatccttgcgtgagggaatgtaagggaattcaactagctatacatagtgaggcacacgagtgacaaaaacatagtgttacttaagtttgagactgcccgaggactgaggttcacgtcaaacaaaaccgattacacgggagccacacagtacctactcctagcttgcctccaacaagtacatcttacccaccatgtacgaggacatacgatacggtgtatgcatgaattttgttctatatgtttcgtaaaggggaaagtttcatctttttatactttttgcacgtataatactaatctttataaaaatatgttacaaaattctataccttaaaccagatgattatcgattaaataattatagatcatacgatgataggatttaggaagtaatgctccctcttggctatccagatggtatatatgatcggtaagctatggtgtggctataattcaactataaagtagtaggaatacaaaaggataaaaaggatgcattttaagaagttagttcatcatgaagtgccatcttctcgtggtagtgatgagggattgtgaaggaataacaactagctatactaagcaaataagtcaatactatagtgtcacttaagtttgaaattgcctaaggttcgagtcaaacaaaaactgatcataagagcaaggtcaatagtatagtctacggttggctccaaaaacatccacatcagcaatacaattaactagtaaagataacatacacagtaatgagctattagctcttctatccataaatttgcatgtattacttttcaatattttaatctactttttcagttactgacagacctctgtttctgcatggtttcacttggaccccacctcacaaccgtgtggccagtagaagcttatctagagctgctttgcatgcgttggagcccttgtgtcgtcggcgataaattagtcgcccactttcactctctctccacttatttcttctccagatcatcacttttgccaccgtgtatagattatcacccgcttaaacaacctattgtacctgctctaagagtgttgcacgtatatgtgcatatcgttataatcgatcaataaatatttttttatatatattctcatttgtcactctatacgtgcaacaaatgtaaatttatagatcagtagtaaaacaacatgaatagattacatattaataaatggctccataccacattttaaatggctggcggtttttataaggtcatgacgtcatcaagctgtcaacatgatttcattttcccgcgcatttgtagtaaactaaccctctttttccacgttcgacatatagtcatatacaccttataactacgtgtgctataccattgctacttttccacatgtatgtcttgaatgtctcttatttatcatagttatcatcgtacactccaaactttagataccattttttccgtgctctcttcttagaatcattagtcgcgcaagagaaccatctaaccattttttctacatggtgtacagtcacattagtgatcacgcgccattatatatatatgtatatatacaagaaaactatatataaagttgtttcgtgtacacataacctattcggagcatacagaaacccaaaacccgctaagcaaatgagaagggaaggaaaggatgaaccgaaagacccggaaggagaaaaaatgcctcagactacaagcaagtagtactagtagtagtaaacgaaaacccgaagaaacccaagagaacaaaaaaaaaaaaaaaagcgcaggcggcagctgttcctcctcctcctcctccccgctcccctctcccctcgccattcacattccctttctccacgagagcgaggccaaaacatccggagaagagagaggagagggagggggtttggactttggagaggcgccgccgcgaaacccccgcggcgcaatcgcggagagctctcctcctcctcgtcgtcgtcgttgttgccggcggcggcggcgctctgtaaggcggacgcggtgcatttcgtcggggttgaacggcgggggcgggttcggaggcagtcggggggcggtgggagatacgagcagctgttgctgctttcgtgggtggaggggttcgggg

SEQ ID NO: 3014 - DNA, 19027 bp, Oryza sativa
ccccccctccgatctcgcggttccgcgtcggcgattcggcccccccgccggtgattggatctcgccggcggccgagtcgtcgcggctaaccccgcccgtcgtcctcgaggtctcgcgcggcggacgacatcttgacgtcgtcgtcgtcgtcgtgttcatcattccctcgggctaagtctggaggagtagcgtggagcggagatccgcccggacctggattgatttccttcgatggtaaggaagccctagctttgctgttccgttgctctagagtctagactagacgcgggtgatattaccctactgggtactgacgctgatagcacctttttgatttcccacactattttttgagttctaactatgccccacgttaggtccgcgcccttggatagttaggctgtttcagatgggaaatgaggacgatgttctttttgtcccgataaattattattgtgatattattccttttgatgaaaaaaattattgtgctatggacgttgacctgtgtgttgctacccttaagatcaagtgaccaatatgccacgctcttgttcgcgccagaaaacggtttgctatacaactgctgtaatgaatgtgggatgcatgggtttcgttgacattttaggtataacgctatttttcccgcgtcgagcaatatgcagctagcgtttgatggcataaatttattcctgcaggcggctcaagctaccattgtggtgggatcccaggtttgggttgaggatcctggtgttgcctggatcgatggggaggttataaaagtccatggtgacacggttattgtcaagtgttccaatgaaaagacggtaagttgttcataagtaattaggttttgctatagtatgaccagctggctactatattattgctagatttgtaacagctaggcagctaggagagaccatgtaaagatgagctgaactgaccttccataatagcggtatttacacttaagttcaaatttggtcgttttgttcaggttactgttaaaggttccaatgtccacgcaaaggatccagaggaatcaccatgtggagttgatgacatgacgaagcttgcttatcttcatgaacctggggttcttcagaatttgaaatctagatatgacatgaatgaaatatatgtaagtcttttacactgacataatgtgactacgcttctctatatgtttttaccaatgctaccattttaagtgcagccatcattcttctctaacgcatgttttcaacttatttgtgttgaaaccagacatatactggaaatatcttgattgctgtaaatccttttcgaagactgcctcacctgtatgatactcagatgatggaacaatataaaggggcagattttggtgaattaagtccccatccttttgctgttgcagatgttgcatacaggtaggctcattatgatatatatgttgataactacaaggtggtctacgatttaaatgggttagcttccataaagaacttcttttctcctttgagctctactgtgagaagaatgtctttgattactggtgtagattgatgcttaatgaaggaataagccagtcaattcttgttagtggagaaagtggtgctggcaaaacagaaagcactaaaatgataatgcgttatcttgcgtacatgggtgggaaggctgccgctgaagggcgaactgttgagaagcaagttcttcaggtgataatttctgagagccacctaattccagaaagctatttccataaccatctgttgttcctcttcaactgattacttcatattcatattcctctcagtctaatcctgtccttgaagcatttggaaatgcaaagactgtcagaaacaataattcaaggtaggaagcattcttcatacgatcattatgattcaatatctgtcactcaaccaaatcttcttttctctgcttttattgcagtcgttttggtaagtttgttgagatccagtttgatcagaatgggagaatatcaggagctgctgtcagaacttatctcctcgagagatctcgtgtctgccaaatatctgatccagagagaaattatcattgtttctacatgctttgtgctgccccacccgaggtgctgccccttgattattcatgtccttctttgattagacaaatttatgtaaatagcatcactatttttacatgctgcttacactatatgagctgttatatatagtccatttttcagtttgacatgacaatagcaccatcctaaatgttaccacccaagataacctatctagaggcttatctgtattatttgggaccaatagattgacagtttgatatactctttaaatcgattgattcccaattataccacaacttacatgtcggtcagcatgaaggaataccgtttcatatggcacacactgtggtgtgaataaaatgctttattaagcttaaaatttccagtttcccttgctgaagttctctcttcacgttgtatcctgttctctgttagattgataacagttatgaatctaattttggttcatgaaaaccttccgtcgacatgttcctctagaggttcttctccactttgtagcttcacaaaatactaaatgctgtaagcctgtagcagcttctgcagcctaaaatactgtgtttcatatactagtgctgaatgattcagtgttccatctacaggagcttaagagatacaaactgggagatcccagaacatttcactatcttaatcagtccaactgctacaagcttgaaggtctagatgaatctaaagagtaccttgaaactagaaaggctatggatattattggaatcagttctgaagagcaggtatgcacttggttctataattattaacacataccattttttaattacttgaagcttatttacccttctcaaactttacctcatgtttttcatgatgcttcaggaagcaattttccgggttgttgctgccatcctccacttgggaaatgttgagtttgctgaaggggatgatggagagtcatcaaaacctaaggatgaaaaatcactgtttcatttaaagactgccgctgagctcttcatgtatgcggtctttggattccttttagaaactcttgaatgcatacacttatctcacaagagcctcaaatttggtcttgtaggtgtgacgagaaagcacttgaagattcattgtgcaaacgtattattgtgactcgtgatgagaacatagtaaaaactttggatcctgaggctgctaaggggagtagagatgcacttgctaagactgtgtactcacggttgtttgattggtgagtcagttttgaagttttgcactggctgctaatggttgtttccacacatattttcaccttatgctcatgtgtcaaatgacctttaatcttaggcttgtggataagataaacaaatctattggccaagatccaaattcaaaatgcttaattggagtgctggatatctacggttttgaaagcttcaagacaaacaggtgcttcactggtacgcttttgatgattgattgcatgttagttgtaatcttgtcaacttattggccagcgagaggaaagctgttgggttagccccaatttagttcttggtaataaatggtgggaatttggcttcacgccttactatgtgctgttcagggcatggcttctagaaacttttcgtcaccgaaacacttggtcccagttgtactagaactaaagctatggacgcatggaagatgctacactcctgggcttttcctttgatataggattacatgttaaagattcaggatggctgtattttatggaaaatcttaaatattgcctgcaatatttgccttgaatgcagcactttctctgaaacatttcctgaagaagtgcaaaatgttggatccagagtattgctttttcatgtttagtgtgatcttactgtttcaaaaagttaagataggtagtagtgaagtagattctcagaactattgttattttaggttttatacactatgttcttctacaatccaagatattaccacattttatcgtgatgcatgggattttttgttgcttgttactccctccattccaaaatataaggcacaaccacccttaatccaaagaccaagaaataattattatcatcttgtagtttggatcatgctaataaatacaatgcatgcatccaatagaattagaggatgtgagagtgaaggatttaaagaattaataatttaatggagaagatgtcatagttaattgcatgcatgcttgcatgtatgccttatattatggaacatataaaaaaagtggttgtgtcttatattatggaatggagggagtaattgtttcttgatttttatttatctgttttttctattatttctctctaattttatgaatttattgtagttctcatatctaatgcatatttctcttgatattgatagtttcgaacagttttgtatcaacttgacaaatgaaaaactgcaacagcacttcaaccaggcaagttttctgttttttgttgttatcacctacgcgttcatttctgctgacttatattttttttaaaaagatatttccaactttgaatttcttcttttctgcagcatgtctttaagatggagcaggaagagtacactaaagaagaaattaattggagttacattgagttcatcgacaatcaggatgttctcgatctcattgagaaggttgctttcttggccttgaatatatatatttctcgaaccttgtgatatggttacgctaagacaaacctcgatgaaaacaagattgctctctctctctctctctctctctctgatgaatttatgtggtctcgttcaaaatcttccttgcataattttaccaaatataatcgtagatgcaacagaccttgcaagtagcaagcaaatgtaagtgctgttgctactataccttagctccaattcttggatatgcaggctgctactcgtatgtttttttttttcgtgttactgaaactcgctggtgatgtcatgcttttatattctgcttttttttttccactcccgtctaagtatttgattattcgttcacagaaacccggtggaattattgcccttctagatgaggcctggtatgtataactgataataaatcattttgttgtttatgctggtcttcaagcatacagcatttcagctttacaagaaattgatctataaacatgtgattttgtgttacagtatgctgccaagatcaacacacgagacatttgctcagaaattgtaccaaactttcaaaaataataagcgctttactaagccaaaattatcgcgatcagacttcaccatatgccattatgctggagatgtaagtatgaatacctttactttctttagttttcatagttcttttgatcaaatctaagttggccaccttttaatttgtaggtcacctaccaaacagaattatttttggacaagaacaaagattatgtagttgctgaacatcaggcccttttgagtgcttcacaatgttcatttgtctcgggccttttccctctcctctctgaggattcctcaaaatcgtccaagttttcatccatcggttccaggttcaaggtgcataacaagtcacataaaattcttcatttggatgtctattgcttacgattgttcatacttttaatacatatataatgcaatacagcaacaactgcaatctctcttagagacattgagtgcaactgagccccactatatccgctgtgtaaagccgaataatatactcaagccatcaatattcgagaaccagaatgttcttcagcagctaagatgcggagtaagatttcctgtttcacatatttttttgcttccaagttccaacttcaatatttacattattggcttgtcctcagggagtaatggaagcaatcaggataagctgtgctgggtatccaactagaagaactttctatgagttcatagatcgctttggtattcttgcgcctgatgttttgagtggaaggtattaccagtgttaacctgtttctttgttcagtttgttgagcctacttaccgatgtgagtttgtgttcattttactagctctgatgagattgctgctgtaaggaggctgttagagaaggtagatctgcaaggttatcaggtaatggatgttacacagaaagtagcttttgcattgggtgttattgatctgtgataattgatgctcagtaagtagtatgctctgttgccatattgttgattactccttccatccacaaatgcatagctttttggacaaacaattacttaaggcatcctcattctggtacacttatataataaactctaactgctgttgttgaaacagcagtgtctagcatctcagaagcgttggtccattgtggttgaggtgctaaacaaactgtactgaaccagaactactgtctgagtgtctgtattaagtatttggagccacatagtgtcgtgttagttataagacattaccacccgttgatcattataattcttaacattttttataaaaataatgcctcgaagtgcaagaattgttctctcctatagaaatatctacttgtgtagagcataggctgcagcagagctgaattgtttagaacaggatgtaacatatgcattgtaagtgaatatttggaggtctatctttaccagtattgatatgtggactaaactgcatgccttttttcaaatggattatgtagattggcaagacaaaagtatttcttcgtgctggtcaaatggctgagcttgatgcacgtagaaacgaagtgttaggacgttccgccaacatgattcaaaggaaagtccgctcatttctggcacagaaaaatttcattaaactgcagagatcagctgtacaactgcagacgatttgtcgcggtgagattttcatttgttattccaaattgaagcctctatgtccccagttaatttaaattttgttcatgtcataaaaatttctgacatggcttccctttcatatttaaaggggaacttgcaagaaaaatttaccagaatctccgcagagaagctgcttctctcaggatacagacttgctatcgcatgcatgctgccagaaaagcatacaatgaactttctgcttcggctgttactatccaatcagctttacgcgggatggttgcacgtaaagagctccatttcagacaacaaacaaaagcagctattgttatccaggtaaaactgagaaataaataagcttgtttcatgtgtgtgtgagcacatgcaaatcgatagtagcatggaatagtaatcaatataagtattatgattttctctccttatatttaaggttgatatttgattgacagtcatcgatagctctgaaactgcagggaacatgcttaggttgcatagattttttcttctagtcttagacttaagttgtaatgctattactgcctggacaacttcctcagataggggctagataaactgataaaaaaatatgaaatctaagtttcattgggaggtatagtttatgaaatctgtggtttagtaaatagtaattaagactagaacatacttccattcacctttgttagtttcatccttgaattcaatagctgaaagcctgtttgctatgcagagtttgccttttagactacaaacagtactccccgttgaatctttctccaaaatatgactaactgtacatatagtgcacatatagtccacaatactaacatgcagacaatctgcaataatccttatcagatcctatcgacgcttttttcttaaactttgtacttgttcaaatttctatttcagagtcgctgccgtcagttcttggcaaggttgtattattcaagaacgaagaaagctgccattactacacaatgtgcctggagaggaaaggttgctaggaaggagcttcgaaagctcaaaatggtaaactcaagcacaccagtcatttgttatgttctatctatgctatttcgatgaaaccatgttaaggtgtcccttagaaattttggtcaagaaaaagtttcaactggcccatttttttgcaacttctggaacctttatattgtatgtaggatagtgtacaatattgcacttgcagttacagatgttttgctatactgctgtgtacatttctcagtacatggtatgtttttataggccttagtactttgcctattacagttctctattgctactagtgcgaaagccccctagtgatagtgggatatatcaaggaccagcttttcttatccattttcattgcttatcaggctgcacgggaaactggtgctttgcaagctgccaaaaataaattggaaaagcaagttgaagagcttacatggcgactgcaattggagaaacgcatgcgagtgagtttatttctataaattctcttgttaatgtaacttgaagaatactggatggcattgttacattgttttctggggttgaaacaccaatctgtactctacgtgctatttaacatacacaattacacaaatatgatctcatggttcatggttgaactggctgtttggttaccttctacaaaaggactcagcccataactaattcactatattggtttaagcactcaagcacacagctgactgtccatgaatatcaatatatatatctttctgtccatgatatgagtgacctatgcggtatattcaccatatgacctaatagacatctgggaaatggcaagggagatcttgttcttccctggtagtaaaatgaaaaaaaaaatgtatagttaacttgtgataccttattattacttatgcatgggtctttgttgtaggctgatcttgaggaagctaaatcacaagagaatgcaaagttgcaagctaccttgcaagaggtgcaacaacaatacaaagaaacacaggaaatgctagtcaaggagagagaggctgccaagaaggctgcagaggtggcaccagttgttaaagaggttcctgtcatagatactgaactgatgaataagcttagagatgaaaacgacaaacttaaggtgagacctgatcatattctagattctcttttttgtctgccccattgacaaggaaatgcattttcttatttcttaggacttatactataaaataaatctaatcattcttaaagagatttgtttcctgctgccattctagctccatgcgatactacctctgctatggatataacacttgacattccattactgcagactctggtcagttctcttgaaaagaaaattgatgatactgagaagaaatatgaagaaacaaacaaaatcagcgaagagaggctacaaaaggcaatggacgctgagacaaaaattgtcgatttgaacatggcgatgctaaggttgttccattttctgaactcaactttattgtagaagtacagtggttgacatttctttttgttattctgcttcaggcttcaagagaaattatccaacatggaatctgaggagaaggtgcagagacaagcactgttgagctcgccagtcaagagcatgtctgaacatctgtcaattccaattgttccaaaggtacatgtaatggcttgcacattggttaacttttgttccctctggctgaaatgagaatgttcctttactcacatctcccgctttcttttctattaatcagaacttggaaaatggcttccatgaggttgaagatccaaaggtttgaagttttccaccttaaatattccttttgttttgaaacttaaattttctgtctatggtctcacaagtcacaacaatctgtcattttcaggaaccccaaagtgcacctcctgctattaaagattatgggaatggtgatccaaagttgaggaaatcttgtgtcgacaggcaacttgtaggtcaacatatttattgtttaaattgctcatacaaaaatggttacttgactcttatctttctgtaggaaaatgtcgatgcacttattgactgtgtgtcaaaaaaccttggctattgtggggggaaaccagttgctgcttttaccatatataaatgtcttcttcactggaaatcttttgaggcagagaagacaagtgtttttgaccgccttattcagttaataggatctgcaatagaggtaatctggaacctgtattgtggtctttcagcgttacttgagccagaagtacaattagacttcttttatatatatatatatatataaatataataagtggttattatttgaaaatttaatctgagatcctaccagcatcaaaacatctctaggctttatctttatgttatataaaagtagagctgctctcttaacaagtttccaatttcttttacaccctacattttccactctactactctagttgtctagaagttattctgcgcttgctccattttcctcaaggtattggagcatcagctgaagtagcaatatgccacttctacccttgaatgaaggcaaagccatttttgctaataaatcaaacaaaaaactcaacctgtagatgcgtgaaaactggcatggttttggaaatattacaagcatggagatctaggccacttcttagtacatggaagaacatgctacttatttggtccaacattttcgttttttccaataaagtagaagaaaaactaaaaccctttcagattcttgaaaactgggatggtacaggaaagacttgaaaacatggagagagaatcaacttcttattacaccaatctaattggtttttgttttctaaatttgtattcctcagaaatcaataatgacgtcactctgttctctggcatttcatttattccaatccacagtttatttcagtgatactgttttgaccttaaattgtaatctgattgaattttggaagttggcaagtttctttggcccccagtcagcttacgttgtgaagcccttgatgcagaatgaagaagataacgataatcttgcttactggctctcaaatacatctagcttgctgttcctacttcagagaagtctcaaagctgctggtgcacctgggagtgtttcacgaaagaaacctcctcagccaacatcattgtttggcagaatggctcaagtatgttactttcttttccatgcatgaaaagtggaaggaaataaaatggaaaatgtggtacgggctctgataatgtaaattcacttgtctagggcttgcgatctgcatcttttgtcaacatgcatgttgaggcaactgatgtcgtccgtcaagttgaggccaagtatcctgccttgcttttcaagcagcagttaactgcttatgtggagaagatttacggtatcatccgtgacaatattaaaaaggaattatcatctttgatttctctgtgtatccaggtatattttccttttggatctttgctgtttgttgataactggctgtaaatggattcattgtttaccattcattttgatctttgttaaccactaggctccgagaacaatgaaagctagcatgctgcgaatgtctggacggttatctggtcaagctcagagcaaccattgcagagaatcatcgagagcttggatatccttttgaagaaactgcaagataaccatgtatgtgtatttctttgtttctatgcgattcacttctgttggatgtatgcgctaactgctgctttgtttatcctcaggtacccccagttttagctcagaaagtttttacccagatattctcatacattaatgtacaactgttcaacaggtgaacctatatttcaagttttgtttcttgtatgccgggaaacttgcgcagtacatgagtacatgaatgttttttgttctgcagtttactccttcgtcgtgaatgttgctccttcagcaatggagagtatgtcaaagctggtctagccgagttggaattatggtgtgcaaaggcaacaactgaggtgatctgtctgtgtttgaacgctagctttccctcctacatgattcagtttactgaagctccttcatttttttttcatacagtatgctgcagcatcctgggatgagctcaagcatatcaggcaggctgttggctttctggtatgatgtccattctgcttgtgtatatttgtgttgaggtttggcaccaataaaatgttgtagttttgagaatgttatctgattgtccgattaatcacgattaatcgtcctgatcgctcccctacctccgatcaggcacaggtaagtcgatcagccgatcagaaagctgatcatccgattaatcgatgattagtcgcaattaatcgtccgatcagggtggaaaacgatcagttcatgggctacctccctgagaaaatataattttgggcctgccagcccagcccatgttccattttgggcagatgacgggcagcaaatgatgctgcttcttcttctttgaccaaatgatccttgctttttaccatatactacagactatagagtatttagtatataatatatagcatatttggcctgctggacactcttgctatactaaccgatcagcctcgattaatcgccctgatcgtcctggtcggtgcctaggcgatcagggctgatcgcccgatcagataacactggtacttttgacatcctatgtgcatgagtggcatcctagaaccttgctttatttatctttggctttaataagcttcatagctttccatgaataaagcaaatgataattagtgttaatccagactgatgttgccctgtgctgtgtgtaattggcaactattaatacattttcaatactcttttcaggtcatattccaaaaattcagaatatcttatgatgagattgtcaatgacctatgtccggtaaaatcacattaaccgcacttttcaattttgtcgagcatcttttctgtttttgttccttaagcaaattggtgctaattcatgctttattgttgatatctgtagatcttgagcgttcagcagctgtacagaatctgtacacagtactgggatgacaagtacaatacccagagcgtatcatcagatgtgagttccattcgttaaaaaaaatcaatatacaattatgcatgtggcaatgaaaatctttccatttgttgactgctaaagtacattttcttttcccccttttaaaagaatgttgtatatggaattgaaataacgtacatacacattactgcttaattttaattcctggtcaatgtagtatactgtgcaggatatcaaaagtgaaaagaaaacttaaggtcatctaatgtttcaggttcttagtaacatgcgggtgctgatgacagaggactctaataacgctgaaagcagttcatttctgttggatgataattcaaggtaacataagtaccatttgatttaattgtgtggatgtatctactgtttatattagtccctggacaaacattaacacacccctcaatttattgttgtgtttgcaatgcagcatcccgttctcagtcgatgacatcaccaactcaattcaggagaaggacttcaccgatgtcaaaccagctgaggagctactcgagaatcccgccttccagtttttacaggattagggctgtgaaatctcagagctttataccgttagataccttgtcagaatattccttgatttgttgtaaatttttttcaatcctttacgctggatggtgtaccctttcttttgttatatttccttttcttttccagctagttttttgtaaaatccttataggtagtcaatagggttgggatgggattcctcccttacatctaggaaaagcaatatcttttaaagcaaggcaggcaaatcattcttttgtagggcaaattcaaatcagtcttataatatccatgggttgtaggaagaggcaatgtcttggtggcctctcccagttatagattgtacaaagttacaatgtatatcaacagtgcaagaaaaggaaattcatataccaaatggcattatgctcatacatcatatcttggaggtgttgtcttgtttaccagatgcgctgcaatctgcagtgactttttgttactctttttgagagaactaaactgcaaatacagaggatgtttcgtaatttcttctgcgtctttttctggcttgtggtgtctaaggtgccatcgcatggaaggaagttgtgtagtttctctatgggtaacttcggtttgaaagtagtctgagcaatttgaatgtagccttgtgtaaactttgagtcgattctcatcctccatgctcgagcaggtacgtccgtcttctttcgatccgccgtgccttttccttccattcgttttgaatttttctggaagagttcttcatttggatttgaaggaaagttacttcaactggaggggagcacgggaaacccgcgaactttgctgcacagtcccaaatgcccacctgacacccctggcccacagctctaaagcgtccaacatcactagccaattccctaaactaccctccctcagaaattcctccatgcatggtttctcgggggtatttccgtccatccacacactgaacgagagagaagaagcaacaacaataaaccgatggcaggtaggcacaccgcactcccccattcccttccaccctctcccaccctttaaaaaaataatacaaaaataagaaaaagaaggagaagaagggagattctctctctctctcctcctcccgctcccgaattccttctagattatcccaaattcttcgctgccaagccgccatcccgcggaatcgaggtaatggttatcttccccccaagtttgttcgttcgttcgttctagctcgattccttgagcggattgtttcgtttgatttggtttggtttcttctagcgaggggaaagggtaggaggagcctgacttgctgtggaaggtggttagtttggggggggggggggagtggttgcatgtgtttcttttgcatggaaattttgctcatgcctggtgaaagctgtggcgctgatttggagctcggagtttgtatgtagaattgtgaggattgattatgcttcgtgggatggttgcaaggaggagatgttgtactatttttggagtagcaatgctctctagtgtatctaaacaagggaaagtgggatgggggaataccacgcatccggctcaaaatgtatgaggggttatctatttagggtaatgataatgcttgattgatgggtggggtactgggttaaattttcctaatgtagatatgtgcgtcactttctgaatggggttgtcttagctatctacttcttcacaaggtgttgatctgtatttgaatggaaaaagattgaggttcttgttcgatcactcaagtttaattcactgatagagataagcagctctacttttgtaattctagaaagttgaaagagaatgttttcaccaccatcttattccctgatgtaggctttcgcttaagtacacttgtcattgttgattattatcctgctcagggatctaaataatgaaatttcattcttgcataggtgctgttccccttgcctttgcttcacctcttttgtatcactaccggaactttactcacagctgctcagttgtttctttgctgtcagcatgggggaacataccttgtacattatatacagcttgatttttgttttatcacattggctctttcagggatgagcagcaagttcatgataacctacaagaggaagcgtgttacatcacatgtctatacagctgatggcaccaatctcaagtcttctggtgcttccagtagtgttcctgtcagcagtttatccccaaaatatggggttggtgccgataataacatgttagaggaagataattttgtgaggaaccttgacttgtcacccttactatctattttagcatttgatgttactctgttacattcctaaagagggtgtacaatacataactactactgatatgcaccacttccacaaggagcgcatgaaactgccatgtcaaacagtacaacatgatgtagatattcatatctagaaatgtcactagtcatgttttttcaggaatctaatctatcgtgctttataataaaaaatcgtttaatgaaaccatgatatatgtttatgttttaaaactgctgtgtgataaagttccatgccatactaaaagtttgttctgtatcactgtggtgtgttaatgttcaatgctggagtatatactaaaattttgtatttttgtattcataagttgatctaactttattcatatctgatacttattctcatctataaaattggcagtcgacctctacaaagcaacaggatgtatttgattcaagggagcaagtcatcaaggaagaatcacctaaacaaagtgcaaatgcaccaggcaaagaacgagcggaacttaagtcacgtgaatcattatctcaaaaggaacagcctgagatatgttctactcatactgcaataggagacgcatgtgagaataaattagaatgcatagatggcacacataatcaaagtcttgtttccagttgtgtgcatgctgacaggacaactaatcaggcagaagattctagtgcctctgtttctgtgggagtaaattctcatcagcagccgaataattctaccaggcctagccaatctaagagtagatttagtcctatgcttacatttcataggcgagttaaaaacaaaataggtttggaagagcctgcagcaggaagttgttcaagagataatgacaaacattgctcaaaactaagttgcaacccaccaagttcgccactggatgctatacccttgtgtagacaaactgctggcagttctttggatgttgaagataaggtatgtttctctctcatgacctcatcttcatgtactcgtacttgtacaataacagtactgctaacttgacaaaatttttgttaagcctatccatttgttttacttgttcattctatgcgactatgtgcaatactattgcaaggggacataccagtgtcaggaaataatgcatgttgtgactgcaatggctagaggcatccaacattgtccgtgtaacttcaactgaaagcttctatgtgattcacttatgcaccatattctagattcatgtcttttcttttataaattcttcaaataaaatccaatgtgtgtgtcattgcgactgcattctctctactgcttgcattgtctatacacaatgaggctacactcctgatagtttatgtgttcattgactatgtgcttttgcattttaccacgtagagcattcagaataactacagcttctatttaatactgaggaaaaggaatttatttacaggttactatagcgggaacaagcactggacaatctgtaattgttgaccacttgcttgaacaaaaaaggtaagacggtactatttgttttgttgatcagtacatgaacccggaactcattaatgctccttttctagttcacacattccgaaatcgtcggtacatcatatggttccctcgcagcctgctaaagatgcaaaccaaagttcaatcccagaagaaggtacaccagtatctgagttcactagggtgctagaaaccagtgagtcagatgcaagagtggaggactcaaacagaacaccagtagacgctattgaagtaccaaaagttattgaagtgaagagggatgaacatggtaatggacagactaattgtctacagtcaccaaggaaaaatataaatgttaatcttctgaaaccaacaaatagatctgaggcagctgatcttctggagtctcaagattcaacaaaaaatattccaattattgtcttggacgatgatagtgatgagaggggcaaagagcaggaaaaatcagaggtccttgatcaattaatccaggagaaaaataaaggtagattttctttggggcagatcaacctaaatctaaattgtgctgaattaccacaagagaggcttctcagtttggatgagacatcggtgtacaaactaaaagatcaggtcagaatgataatattagtctatatttcatgaagtattaccttacattttggctttagtccataatccacattcctcatcttatttaaagagagaacttctttctgcagtgaagtggtttgtacataatacattctgtaccgttcattttagtaggattgggtgttctgtttctttatacttgctctaggtgttcagtaaactgtatcctatgtgctctttatttgaaccactatctagtttacaagctattgttttgctgatacatgtgttataaaaaagtgcttacatatgctttattggataagtccttgatatttgtgctttgtattatctcaagcattttatttgcactatttacaggatcaatgtgttcatgaacgaaagcaaatgtcccatccagttgaaaggttgttttttacaaaggagaaggatgccatgcacggtaaaaaacatcatgaagaaacctcaaccatgcatagctcgtactcaaatttatttgatccagccccatcatcgtcgtggattactgggaatttcaaggaaccaagtgtcatgccatcagaactgaagttcagaatattggataaggctcctgaattcaatttagatctcaaattggatagtttcccagacagtagtgtattagcccttaggcacgataagttatttcgtggaggcacctccagtggatcccattttctgacagaaaggcttgggacatactcctacaaaaggcactcttccccgtggtcagaagaagaattggattttctttggattggagttaggaggtatgggacaaataactggaatgcaatgttgagggatagacggttacggttttctaactcaagaaatgccgaggatcttgctaagcaatgggacaaggaacaaagaaatcttctaggtgtggatttccttcaatcactcagatcctctgctcgaggtcctccaccgccttcacatataccagaagattacgttggaagcagttcttggactggatgctcaaaatctccatttctttttgctccaacagacctttcattgggtgacatgtacctttgaagcggccgtacttcagagagaaggcagcatccttta

SEQ ID NO: 3015 - DNA, 19369 bp, Oryza sativa
acattcttcctgaggggctgacaaaggaggccgagatggcgggcgtacgccggctgggatgcagatctgtggccgagcatgcaggctccgggtcattctgcagcagaccgactgaatgaaatgaagcctcatgttcttccgatggatcactgaagcgtgcgcccaagaggaaggcggagtggcgcgccttcagcaagaaactgttcaagtccggcgatggcgccctggatctaaaccagagggctgctgccatcgccggacccctcggtgccattgggactagtgacaccggtgcatcgtctgaagagacggtttcagacagttgagtgtatctctagtagtagtgatttagtccagaaaaccttgtgtcagtctgaagctgcctgtatgattccgctgctgaagctggtaaacagtagcagtatgatcaaaggtaaaatcgagttaaatttcagccaagtgattggattcagtttttgtaaacatgcatcgatctgaattctgattacatcctgtgtaatatattattggcttgtgtaatccaaaaagattgaaccatatatgctcgcatgctgaaaaggaattgcgagtttttgtgatttgccatgaaccaattggtgatcatccatcgatatgaagtttactgtagactgggcatctcgagtaacaagttttttttttcaatcacagtataatgttagctgatgctagtatgtcttgcacagcttagtacttttatcttatggcaggcttggcatcattggccataactgagtcgagagcatctggatgcatatactccctttgtcccatggtatagcatacagtatgttttagcccttaacatggctattaaggggagagagagatatatagagttttttattcttcttttttggtcttaggatgaatgaggtgtggtgttggtttggactagttggaatgataacaaaatgaggggttttttcaccaaatgatctaattggcccattgttaacgaaaaaaaatcgaacacaccggcctgggagatctgcttagctcctgtgcaggtccaaagattaatgagatgcgggcgtgccagtcagtttaatcctgcaattgacaagatttgcaaataatagatcaaacagccgatcggctgacaagccgatggagtagttccagccgatagccgataatagccgatgccgataccagccgatagcgatagggtttaagcaatcggctatatgtcaaatgtagatactgatataaaggccaatggctgatgatgatgtaatatagaaatataatcctgcataaaccaatcagctaacaatatgatatagtagaacaagtattgatccgaaggttaaagcacccatcggctggaggtccgatgtcatgaaatccacaagattaaattaaacaatgaaacctttgttgccatcggctaaatccaacttatatgtatatgcaatccttatgagccgatgcaacgtccagataactcaccagctgaaaccccgatgaaacccttattggcaatcaataagcaggctagagattatggttctaagcacgacttagtagatcaaacttaactgatgcagcactaagtataaaaagaaacacaatatctagacaatcaagccgttgactgattttcagggtggtagatgcctaggctaatctaatctagcaacgcgatttagccgataccggcagaaaccctaaagcgagagacagccgatagagctaaattgatatgctaagactagattaacatagacatgataaataggtaggcaaatatatcatccaaaccagagcaatccaagaggtcgaatgcactggtgcaaccttgaacgacgccgatgtagatgagacaattgcctggaccgacggaacattggacttatcccttcgccggagatcgaagacgatgcagccccgcgtcgggtgccaagttccgccggaacgtaaaaaacgaaagtagaagtaaaaagggtgccgatgcgccgaattgtattgatcgtagcgatatattacatagaccccgggtgtacatatttatacccatgggttgatacaagtccttgtcggacaagaaagaaactaacctaaagataaaaaggaaaatataaagtccttatcggacactaaacacactttcctaaagataaaaggaaactaacaaactattcctaattaatagataaattgtcatgccgcatcctctttaaactcggtaacttagggataagcttcctttagtagattgatttccttaaccgaatatagcaggaatccgactattgacgactttataactcctatcggctgattccgagatgctgcagctgataatgattataagccgatgacgtctttgccgattaccaaatttcactgttaacacccattagccctacccgagtttgttgggctgggctgggccgggccacgccaaaagcatttctccccgtggatcaagtccaagacaagagtaaacaaggcacagcaataatacaaataataagtacaatgataagtaaataaaatataggcaaatcggtttgatccatgccaacattcctactgtggtaccactgcatgcatgaattgttatgtagtacttctatatatggacaaggtagcatgcagcagtacaaaatgttccaaatttaaaagcaactaattaaactagtgcttagtaacaaattaagccctatagctatagctagctagctagaccacctgatcacctaggtacgtgtatgcctagtacgtagctcttagccatgcatatgcatactctctccctttaaaaaaactcaatctagaagagatagttcatattcattatactaggaggagccaaatctatttttagattaagttttttttaggacggaggagttatatcgatagagtgtgttctctgatcgatcagatgagcagatcgacgtacgcgtgtatagtgtaggtgtacgttcatgcatatatataggactaatatctgcctcggaccgtacgtgcatgattcatggatcgatcttaatctccatgtgtccaaagcaagtctcaaattaatatagttccaatgcagggtttactcgtttgtcaatgcacgcgttgatgatcaagtgggagatcgatcgatcgaaggagatgagctagtacgtaccctgcctgcgtcagggcacaagcctcattcatatatatgcatgtggtttacacttgattggacaaaccaaagtggatactgaagctatgccacttgtgcccagggtacttaccaacacagatagcttaacacttgcaggccaagtttgttaattaataatccatgtcccataataattgtatttataggatttgaatttatctcaaaataattgtcaaaatatagtactaattaatgatctcattaatcacttctcattcaaatttctccttattttactctcaactatcctgtacactcttacgtagtaccatttaataaggggcattatactctttcttctcaaatcttcgtatatgcgaaacaaactagaattataatcttaattagcaattgaatcgaacagaagcacacaaacatgcatgcatgcatcgatcgatcggtcccatatatatatcgcgcatcaggatcgggtagctaccaattgtatgtgtaaatgtgtgcgcgcgccttcccatatcgggaaacgatgctccatcgatctgcattttattgatgtgctccagcaaggcgagtcgtagttgggtaaattctaaaattaacgccagagtttgccacaagtaatttggccgtgtttgatcatgttaggatagtgtttgcttcatagacatatatatgccagtcatgcaaaacttcatttaaaggagacctgaaatacatgatgtaggaacactaattaattagatgtggcaatgttatagcttctgtttgagagagcttctaccagctacagctttttccacagaatctctaattaagcttctcaaacatttcagattctcaaccaaattctgatatagaatatagataataaattgcatttgaagtcaaaagctagaaacctatcttttgtctattctcactagttgattagtactagaaagcttctgcgctcagaaaatgtggcatcgatagtcactcggcctgccccttctgtgcttaggatctgaagacggcgaaccacatcctcctcaattgtgtgtttgctcggcaggtctggctccgcgtgcttttgcctcttggctgggctgccctctctcccccgtggcagctggttctaggactggtggccgagcaccagggcccgctttacctgagcatctcctcgccggcttcgactccctggtgcttttggtttcttggcagttgtggaaggaacagaacgctagggttttcgactctgcgctctcttctgtctcagtggttctggagtccatccactcggagggtcgtctgtggtctttggctggcattgccgcctttggggatttgttgggagtgtagcgtggctctgccccctcccgctgtttggagtcttgtttttagccgccgtagtttttctaagttttcagctttgattttgcctttttttccccttcgcctggcataagccggtctggctgagtgaagttgtgtagctattacttttttcttctaatatattgacgtgtaatcgttttacacgttcgagaaaaaaaaactagaaagctgcttctcggaatctcgagcttctcaaacaaagtcattgcctacaaacacaaacaagctaagttgtggcatcaaatttgatggccacaactttaacaattgggacacaaatgtttagatgttcttggtctatcaaacaaataacctctggtaataattcgcagccacatacatactggcaatcacgcttaatttggggtagaaacagaactagctagttagagatatactatccattctggaggggaacaaagtacatgtgccatgcagaaagtgagggagcttagcacaagaactatgcagaattaatccaaaataatagtaccaatatccttttgtggtcctgctaacccattggtgatggtgactaattaagtaccaattaagtagagtctaggtgtcaattaagtaaagcagccaagttacatgacaactgacaattgtcacaagggccaaggccatccccaaattctttttgccatggacaccagcaaaggacgtagtactagcttgaagggtcatcaagttcatccttggacttagccaattctttcctcttctcatgcacctgcgcgccgtttcatcttttccttgtttgattagacgttttcaaaaggattaataggggtccagttctagggaggagattatattacttgttgatttgatataacccctatttgcatgcacacaccacctgtactgtacacgtcttgaggttggggttgagagcttaggtacactcatatcaatgttttgacttgatgtgagtgtcgaattatataattactccagtaagcaaaattgtagtactccatatatatcttagtaccttcggtaggatttctgatttctaccaccacatttaattagtttcactgaaagtacattgctttcctactagttaatccggaaattaattttgttgtttttattaattagtgtgaatcatgactcgatgtgatcgtaacatacatgtggtgagtctcaaattttctgaagacgggataaaatgcgcaaagatgagtattatcagggtgtgtttagttcacgttaaaattggaagtttgattggaattgaaacgatgtgacggaaaaattagaagtttgtatgtgtgtaggaaaattttgatgtgatggaaaagttggaggtttgaagaaaaagttggaaactaaaccaggcctcagatgccaatttctaagcgggaatgctagggggcagttgcctgatcgcctacttccacaccatcctgccttctgactgcatccccgtccatccatctatccattgtgcaagatcaaatctggcgagatggtcagtggtggtgtggatgaagcgtatgtgacgaggatagagccaccaaggagcagctcatcacccccttggtctttcacattgttgggtgagcactcacttcgatctcccttttcatctctatcgtcttcttcgatggggaaagaaggaggaagtgacgaatggggaagtaggggagatgagatggtggcattggcgagcgtgatggaaggaagtcttatgctactcctctttgatgtgagctcgtcactaccacggttatcctctcatgaaatcgaataatcatactcaaccaaatgcatcaacattggtgaactgattggtagttataggtattaggcacgtaccactagtatcaggcctgatacaccacaagtatctagtatcaggccatgatacaccacaaatatctagtatcatgcctgatacacaagtatgaaggacgtcttatactgacgggtatcaattgatacctatgggtatcggtctggtaccgatggggtaccagatcgacagatctgatatctacatagtattatcatatttgaacgggatcgcgtatattatcatggttaattgagcaatccagatcccaacttgctagtagataatgagaacagatctagaagcataggccatccatctttttccttacaagttagctagctagctagcaatccttcattctaaagttttgccctccacagtcagccctcttgttcaagtaacacatgagagctaaacaatggtgcaaaaccctaacactggtcctccctttccacattagggctccccatatatcctgcctccacaattcccatcagatcaaagctactagctaatagccactgcacatgccatgctacccaaatcatcacctcccttgtacctttattatattattcctagctaatctccacttaattacagtagtgttcaatctcatataagcatatgcatctcctagctaccaagctctctcttcctctgatcaactccactataattagctatagcttagctagctgagtgatcagtgagcaggtcgatagcttaattagcttccaattaatttgattaagagcttaagatggtaggcaagccacatcaccatggctcctcctcgcttgtggcggaggagctcaacctcttgcacggcggcggcgatggcggccgcggcggcggcgggctggggcagtggaagtgccggctgctgggctcgctggccggcctcggccggccgcggcgggcgcggtgcgtcgtgtgcctccaggtgcagcacgtcaccggcctccccccggcggcggaagggcgcggcgtggtggtggggtggcgcaacaggggcggcgagggggagcacacgtcgccggtgcgcgcgtcgcgcggcgccgccgcgttcgacgaggtgttcctcaactatttcgtcgccggcggcgccacgctgcggagcttcgccgtgtgggcggcgctcgtggacgacctggcgtcgacggcgaggggcggcggcgacctcggctccttccccgtcgacctcaccgagatcgccaccgcggagagctccaacccgcggttcggcggcaaggccctcagcttcccgctcggcggcgcggccgccggcgccgtgctcaccgtcagcgtctactgcagagtgatggagcgtgaggaaaaccatggcggcgccaatggtaataaggaagaaacgaaaccctagctagcctagttaatcacttaattatggcgctaaataacagtgtagtggttaattaattgcgaattaagaagtaaatactaattaattactacgtgtatcgatcacgaacaggccatgcaagagcggagaggaagaacaaggggaagggatcctacgcgtcgtgcctgccggatctgagctgcctccggaaccggccgtctccggcggcggcggcggcgtcggggtcggctcggcgggcggcgtcgctccgatccgatcgaggcgggttcatcacgatcgagaactcggtggcggagatggagggcggcggcgcgttcgggcgcgtggaggacgtggacgaggagggcgcggggttcatcacgatggagaagggcaccatctcgtcttcgcggtcgcggtctcgccggccggcgggcgaggacgacgaggccggcgacatggaggacgagaagccgtgcctgctgatggagctggcgccggaggaggcggcggcggcgttcgaggtggagaaggtggaggaggagttcctggcgatgctggaggacaagtactgggcgaggagcaaggagatcgagaaggggttgggcgtgagcctggacatggggctcgatctggggctggacctcgactcgctcatcaaggacgcggagatggagctcgccaaggcggagcaggcgtggcggagcaaggtcggcgccgccatcgtcgaggaggaggagtacatggacctcgtccgccgctggagcgcccgcgacgccgccgccgcgtgctggccggccgccgccttcgccttcgggagccccatctaggctatcttaatttgttctgctcgatcgatcatcaccatggcctatggcatgtgctactgcttcactcgtgtaacatcatcagtgatttatgtctgttataagtgttaattaattgttgcaatatcatactccctccattttttaatagatgacgccattgactttttctcacatgtttgaccattcgtcttattcaaaaaatttacgtaattataatttattttgctatgagttgttttatcactcatagtactttaagtgtgatttatatcttatacattcgcataaaatttttgaataagacaaatggtcaaacatgtgagaaaaagtcaacgacgttatctattaaaaaacggaggtagtatcattgaagagacaaacaaattaatttgaaggattcatgaaactcctggatctcttgttagtaggttgtttgccataaaaaagggattcgctagaaaacttctgcaaacttttggctccaaaactttcagatttgtgaacatcggattgccttgagatttatccatgaaggaaaaaaaatactagaaagaaattttcacacatgtcacgtgtgagatctcaatgctaactaaccaaacgatagttgaatgcaagttttatataagttatatcgtagttacagtatagttaatgcagttacaatgtagttacaaacttacaatctaattacactttaattatactatagttacatctgaaagttttttaatcaaaaaaaattacgacagccatacacgtctctttaagggatgtttggtagagctctaaatctaacatttatctagagtcatggaatcagggaaggatagtcatactcgtatgtattctctgaagtatattcgcctgcacctctcataaaagattaaagttctagtagcgtttggtttggctctagctctacaagacgagaatccaagagctgagcctatctaccgtttgtgatcacttgtttagatcatcacaaacagtgtccctactacgttcctaatcctgatattttaggattttagttgaaaaaaatgctacgacaattctattttctttccctaacaatcggcattcccttcttcattctcgctctccacaagttaaaaatcattctcgctctcaattttcgtctcttgagcaagactgccgcatgacaaaagggacgagcgggagagtggccgtaaatgtatgatagcaagaccggatggcatgatctgataaggcctgggtggagaggcccacctttttatttttggaagttaattagtaaagggagatcgagaaagatggtggagaaggtggatggtggtgattggcaaagtggtgagagtgttgttcgagttgtaagaagatggcgagtgacaaagagatgcattgactggagagaagttagcaacttactatcttcgttaaaaaaatataaggaattatagctagaatcaatctcttatactccctccttccctaaatgtttgatgccgttgacttttttaaacaagtttgaccgttcgtcttattcaaaaacttttatgaaatatgtaaaactatatgtatgtatcaaagtatatttaacaatgaatcaaatgataggaaaagaattaataattactttaattttttggattaagatgaacggtcaaacatgtttaaaaaagtcaacggcgtcaaacattttgggatggagggagtattttgaaacaattttagaacagaggtagtagtttggatggcggcaagtaaaatactccaatgaaatgattgcgtgaaagatgaaattagtttaatacaaaggagatggtgcataaatttgttttatatggatagatttaaaaaaaaagaaggtatgcaagacaatggcgtcatggcgatgaaagatgtggggtggacatagcgaggatttatatgaagggagggagccaatttgatacttccaaaattttgaatgcttttcatgctaaataaacaggtcgataactgttcccttccacgactgcttgcttaacggtttcatgtccaatatctagctctcatactccctctgtcccatgaaaaataaatctagaatcggatgtgacatattctattaatttatatccattaatattcagtattagattagttttttttatagaacggaaggagtatatacttgtactgattacgatgtacgcatgcaagttggataggcgacagcacagtgagtgagccggcgtcaatcatgcataagagtcagtgtgcgtcagacatgcatgacacttgtattaaccacagaccgtaacagaagcgagtgatctacagtcgcctgtggatttgctgctttgatttggacaaaagcaaagtggatgcttcatggacgtacatccaaatttggccgccctggaggaatgtctcagataattgagcagatgagcatagatacatggggatccacgaacatggcaggtccccacaggccacatcgccaggacctgatttcatgctccttcatcagcagtaaattacttaagtacatcacaaatttcaaccaagcgagcctctcgagtccgcaggttccaacgtatatagcacatcaaaatcaaatcaaaccaaacaggatgacgagcaattatcatctgagcaaaagtgaaagcattcgggtgaattccacgtgtggttattttacacagaataccgcgaaacacttgggatgagatgtcgaatttatgtaattgcctagctaggattttacaggtattacacaatattaattcaagaccgagttactccccaaaaaaatgaagccaacttatagagatcccaatagcctctatgctaaagagccagctaaagaaatggtttgtgtacaggtacaacaaaaaacaagcattctcctccctagccctggatctttaaaacctgcagggctcgttgccattgtttccatgcatcaatataagttcattggatgtgattgatcagaaaccttccctggagctattttttaatgtcgatgtggttttctgcatcccataccacaatcttaccatccaatcctgcaataacggagtacagaatgttaacatagactgcctgaacataaagctggagaatttaggccgtcaacatagaaatgttttaaacctgacgtgctgaaccgtttgacaatactgtcgtttccttttctcaatggcacgatgcaactgtgaaatttacgaaattattagtctatatgcaactgataagagtccgcttttgaactgcaaaatggaagtagagggtagtacgttatgcaattctcatgaacaccaccacgaggctttgatggttcaacagtatcactgcttgccacttgctttgattggccatatagctttccgaaggcttcagatagctgatacataaattttattctgatgttagttcttgtggaatcgcaagttattcaaataaccatggaccacctgttctgattattgtattcacaactgaaggcaaagatcaataggatacttgtgttaatgctactgcctcagctaaaaagaactgagcagatactctatatagacttgaggttgcactgataataaagggtgaatagttcaggtttaaaatgctgaagacaagaatgtttttcttttccaaccaaggataattccatttcaattactgaaaccagagatgtaaatatctttttgtaaactgaaaatccacttttttttatataaccaatagactgtacttccaaccatgggctgcgctatatagtgttcgcctaaatacacatgacgatagaaccttgtgaacatagtaaatagtagatagcagctgcatataacagcacaacagcaaggaatgacacgatgaaatcctgcactaacatgaagtaatgagagggagggagaaaggaaacctgtgaagctcttgaagttgatgtagttacttttctttcatccaagtatctgacaaagctcctatgagagacaaacatatatattaacctaaaataatggtcatggaactcttaggaaacaagatgttttttaagaaaaaaaggttaaagtgccttaactattaaggtgaagctaggcagctagaaatcagatgtttttaacaggaagaagcaagtgctcataacaatgcattgtcggaataaaaaggaaaatgcaaccactttaacaagttgctaatttgctatctacatctttgcttaccaaagtccagtctcatctgcagaaaagatcataggattgcaatcaaatccaacaccaatcaccgtcctttcagaaagaaaaagaatctgaaattttgtggagttcacccaatattatgaaacatggaattatagcatgcaaataaatactagcagaagggaaaatgctgacccacatcacggagaggcagatcacgcagtgctaaattctgtgcagcaggagacgtttcaacatcatcaatgaaataaatcatggaattgtgccctagcaatcagacaataacaaacaagtcaatatatgtaaataattgaaaattatcttatctgtggatatatcagagggtatagtgtcccatctgtgggaaataaaaattgaagaaacaagtcataatctcaacggagctcaaaatactggagatgacaaaagatgaactacgcagaggccttggctagtgtttttattaattgaagttcaactagattatgtcagtcaaggtgccacagtatatcgacaatgaagagaacctttcacatgtaaaagtataagttggtaggaggctatgatgcatgcgagatgatgtggtaaacaaaagcaaaatagagagttaaacacacacttaggatgaagaaacaagtaggagggagaacctgcataggctagtgtctttccacttggcgaccaccttacaccaaatgcccacatagatgataggtcaagctgagcaatttgctgcaaccacatagcagaaaaaatgttacaaggatgatcagcactttgacaggaaacaaaaaatgctatagcagctaatataaggatagtatgccttgccaagggttgtgaatcataatgagttctcaagttcttagttaatggagtatttaataaaaaaaacactgatgctgatgctaaaatgtataattagcctaagaagttgtgtggtgacaaaatggagaggcatatttgaaaatcgcaaagggatatatcgtaagacattttcattccaacagaaggaacagtggaacactatgcattaatggtctaagaaatggcaaatacctctccaaatttccaatcagtagaagtgctcgcatgtgatcccctggtcaagaaaaagctatgagataaacaaaatatttagaagatcctgataggcataagaacagcaaggtccaccttgtatcgacacccttgatgaaagtggataacactctgcatttaccatcagttgatgttgttgcaagaagtatctgaagaaacgcgaaagcaagcaaaataaaatattgcctccaaagaaaaacaggtcccgcatatacatagatgttgcgtgtataaaccaagcagaattgcatagtggtgggattgggagatatgcatctcacaagtacaagaaaaaaaagcaaaacgaaagaaaaacacagctgtaatgaaagcacaatataaagagagacgcttacattgtttggatgccatgcaacactagtgacagaagattcatgcttcttcctaacaaccttgctaatccacctataggtgaaggatccaggcagttaagaaaaatacatatcaagagtggcacatcaacctacctacttgcatgaactatatcagtagaaaacatacaacccagttgtaatgtttgacgtagctaatgtaaaactaaggaaatccaaaagtagcagtcaactaatacaggtagcagacacaattaccagttgttgtcttgttcatagtagcaaatgcacacagacttagcaccacttcctacggcaaacttgttttctgcaaacaatataaaatgaacttcaaaaacttgttttcttcatgatactgcacttcaggttataagcatccgtttttcacacattttgttgccaacaaatatggcagcacggttgagacaatctgacaaactaatgcatctgaacatctcatctaaagcataattagggctaaggaacttacaagttatgacttgtgcagttgtaattattcatgagtagtgtagtggcagtttttaagtaagggtaaggaaagaagagagggaaagtgcttagaggttctaagatgactaatatttgggaaagagtttattaggcttgcacgatttatatttgtatctgagagagtaaagaactataaagcatatacactggttataaagagaatatattgattcagcaacgggagtagaaaaatccaatgcgccagtaagcatcaaggcaggttataaagagaaccttttgggctccactggacacataaagctgcacgatttagcttgagaataacaagggtaggaacccaatcatggccctcttgtgtccaaacatatctgcagttcatataaggaaaaaaggagaccaacatgtatttatacccttgtggaataggaaggtgattcataataagaaaattgagacttgatgtgtacttacgaatttctatcatgtgagaccgttacgatcttgttggaagatctactccaatctattccagatactatttgatcatgctgcaagatatagcaatagcgaaaataataagataatgaatcaactatcgattatacagtactgcattgtaaaaagatgatgagagagagagagagagaggtgctcaagatcatcgcacttgtaaaatataaataagaacatttacctttgaaagaacatgaagtttctcccacttgtcagtaaaaaacttatagatatgtacttcattgttgtttggacaaaaggcaatcactgaaagagagaaaaggttacatgtcaagttaaaaataagatggcatgggatgtgcatcataaaaaggggaaatggcatcattctagagggatgtaacagtgtctcatattacaaggcaagaaatgctgtattcttaaattacagtaggtgttttgccatataagcagataatatatcatctatggtcagtatgaacagaaatctaatgtattgctcacccctccaatgggactagcacacatcaagcgagcacgaaagagtatagccctctgttcaagtctacattatgcagagttcagtagtttcatctatccctctatcagcagcagacaagcaacctgggcttacactagaggagaactgaagaacattatatataattgcaggaagcctacttcattttccataacaatcatgtgggtgccatgtataatgtactggttgttaccatggatgagagcattcatttaccagtgcatgacagaacaagagctagcgctatgtagcaagaaattcccattcagatatggtgcagggaatggagtggcaggtaaaattcacaggaaacatggaattattcaggtcataattcaaagaaccaagtcagtaaatttcaaattacatatagcgccccacctacgaggggaaatccatgatgtaaacttgtgttacggacgcgatccatgtctcctagtatcaccctaataccgaaaccaccttagcaaggcatttgttctacagaaacccatacatcagcaggaaacgccaccgctggcaccaaaaccagcaacaccacggatcgaagatagagagggacatccctcatctccacgaaatgagcagcaacgacaaccgattcctaccggggggattcgaaacggagctcaatcacatttgcaggcggaaaccctagaaaaacgtggtcgcgaatcccacccgtaccgaccgcacgcactcgtagccagcgtcgtacgccatggccggcgatccagaatcgaatcaaacgggaacaccgcggagggcgcgagatctagagaagagaggggggaaggagaggaggagcaggaggaggggtgattactcgagtggtcggggctccacgcgtggcaggtgatgcactcggcgaactggtggatcgccgccgcggccatcgcgggcggcggcggaggggagcggcgcggcgcggctgtggcggaggcggaggtggagggtggtgatggtggtggaaatggttggaacttggaggcgaagcgaaatacactactactagtgcaccactcgtccgcactacggacggggccgttaggcacgcccactaccgcggcccacatcttcgccactacaactagtactttttttttccttcagttatgtatatataaaaaatgtacatttttcatcaaattttgaatgagcaaaatatattcttgccattgttaccctgtaaaatttggtaattgaagaggtttctctactttaagattctgccaaaatatgatagttaagactttaaactaggggtctatttggttctctaccctaccaattcaatggtaaattttggcactaccgtagagtaaagttcatataatatatgtgtttgtttgctatcatttgctattaatatgcttttatagtgaagaaaagttatagagtagtaccaaattagatatgggcattgccaatgctttgactctaatccaaaccaatcaaactattatttaaattgctaaacaattggtagggcatattttagcatcaatccaaaatggccccaaatgcaaccaacgctaccaaaatttagtaacatcaaactacatggaaattgagtattattgatttgttgtaaggttaataataataataaattgaacaagcacttaaaaatcattgttttggattactttaataaatatacgtcatgtttttattttttcttttggtgaaagggaaggaatgagaataagaatctcatcatttcgtatggtgatctccgccaatcaatgtgctcgagaatatgttggctgcagtcattttctactgcacactgattatagtagccccttcctgcgttaatgatcatcacgtctatcattattccccgcacgctgttgtaccaaccaaagatggccagagaaaaaggaaaggcagaagaaaaaagggagaagaagatgtgagacaaattaagattggcccgtttggggcccatctatgaggcccacgcccttcaaagcctggtccaactcaactcaatgccctcgcaaacactgttcctttcaactttcaactttcaagcgtgaagtgcttttatttattttttttagataatgaaatataatatcccggcatttactcaaaagagctacagccaattattacatagtagttttcatgaacatagtgtaaatctaaatgaatagaaacataccgaagatcactattattgaaaccagcctaatgtaaggagatcacaattattgaagtctatttgtaaatctccaaccataattggcaaatagttgcataaccgtggtctccaactttcggcatgcaactttcagaaactcttcatcttcatcacacctttgtagttgtgcccaaaaccggagccaatgagttgccctgaaaataacctgcatataggaaaatgatggtgatttgtcaaaaaccatatcgttcctactcagccatattgcccaacaaatggcagaagctccaacaagtatcagtttactcattttcttatcaactcccaaaagccacccattaaaaatatgagatatgctaactggaagattaaaaccaaaagagaactgaactgctctccatagaaatttcgcaaaatgacaatccataaagagatgttgaatagactcattcttcaaacaaaaagaacacctcaagctgccattccagttacgccttgccaaattatccttagttaacacaacccctttaagcaggtaccacatgaaaattttaatcttaagtggcaacttaagcttccaaatacacttgtttctctcgatatagccattattaattaaagctaggtacatagacctcaccgagaacaagccattctgatggaaattccatctaaaactatcagacaaatcattcaactgaatatgtactatagaggtacacaactgatgccaacaaacaagattctgaccaattaaagctctcctgaaagaaacattaagcggaacatatcccataacagtggcaatagaagatgttttcctccgaacaattgcgtacaaagatggatatttatccttaaaagccaagttaccaatccatctatcttcccaaaatctgatttgttccccattattgacaatccaagaacccatatttaagaaagtacttttgacattcataagaccagaccaaaaatgggaatcaccttgtttcctgtcaacttgggttatagatttattataaagatatttcctcttcaataaatcatgccaaaccccatcctcattaattaacttaaacaaccatttacttaaaagatatttattttgtatctccaaattatgaatcccaagacccccctggtccttgggttgacaaacaacatcccacctagtgagcctgtattttttcttatggtcatccccttgccaaaaaaaccgcgatctataataatcaattttacgaagaacccctttcggcacctaaaaaaagatatcataaatagggctaaacttgaaagaacagaattaatcaacaccagtctaccaccaacagataaatgcttgtctttccaactactaagctttttctcaattctctcttcaataagtttccaatctttattagaaagcttcctaaaatgcatcggaattccaaggt

SEQ ID NO: 3016 - DNA, 618 bp, Oryza sativa
gtgcctgcaggtcgactctagaggatccccaggcttcccagatagtatcaaggaagtgaaacttaccagatcatggcatctagagaatgggatgccagagtcctcacccatcatgactgcttaaataagcaccagctttctgttggtgaactcctcttccctacctctccctaattcctgtttccccgcacatggttacatttcttccctgctttagaaacccctaatggtagtcagttagggaagtgaatttgagactgatctcccatatcctcaacagcagcacctgattaaagccttcttccctggcaatacttgttgtctcagtgattggctttctgtggagtgaacagcaggacttagaccaaacctctggcattttggtaataaaatgatgctgtgcaactttcaaggatagatcacaaaaaatgatgcaacttctacgtggatccctgaaactctggactgcatgtgagaagccccactctcctgaggctgccctgctgtggaggaagccaggtcacacagagggggcacatggaggcaatccagcctacagacctgctcaggtcctagctgacagccaacatcaccctctaaccatgctgatgaacatgc

SEQ ID NO: 3017 - DNA, 175 bp, Oryza sativa
ttcctcttcattgggcacgggcacatccaaggctacatccgtatctgaaagatggaggggatacaaatagagaataagatgatgctgggcgataaggtacgaccttaaatggaatttagatagcaacaaatgcttcaaagcaaccgaaccgccggcaaccattcaccatccatcc

SEQ ID NO: 3018 - DNA, 455 bp, Oryza sativa
tccccctcgtcggccactcgacctggttgaatgcccactggagctagtacgcccccgtccactcctgtgttgacctcctccacagaagtctcatttacttcagcgcttggttcctcgccatcatccatgttcatctgcacacctggatccttcgggtgcacaaacgaaaccaaagctagaggccacccacgttgcattgcattttccacataccatctccacacttgagagttttgaactggcattagttcccaataaaaaccctcagttgcccgacttactataacattgattgttatgtcacttgtctgtggatcaactttcaagcccctcattaaccatccttttacagaaggtacactcctctcagccggtctctcaattcccctttctgatacaataaaatctgacagatctaccccagttggcccgtaacggacgtttcctggtccatg

SEQ ID NO: 3019 - DNA, 7205 bp, Oryza sativa
ggaatcggccggcgaagtggggcgccgacgtggggtggtggaggggttaaccggcgccgattttcgcggggagagtgggggaaatggtggagggcgtggaggggatcgtgcccacgtcgttggatgcgagctcgggtgcgggagggcgccggattttgcggcgacgtggacggctatggcggttggggtcggccggcgagaggtaggaggaggagctgacgggtgggaccgccggtcccacctgtcggcgaagggagagaaggagggacgcaaaacagacttttgcgagcgggccaagtgagaggggagccgacccgagagagggagaaggcgcgcgggccgcgggagaggaaagaagacttgggccgaaaatggcccaaagagaggaagggggaaattttatttgttttctttttattttaattgatgcaatgatctttgtgttattaaaattatttcttgagctccgaaaattcacggaaaattccggagagtattttagggcacaaagaatattgcaaaatattcccggccaatgatttttaagggaaaattttaattctcccattatttcacttgattaaattgatttaacttttatttaatttctagaaaatgcattatttaatgatttttaaacccgaacgaaaatcggggcgttacaaatctaccccccttacaggaatctcgtcccgagattctgggatggctagaaagaaagccggtgctggtgggctgtctgtctgatctgcaccttgaactgccacattctgcttcgaactgattgattgactggttgatcaaacctgcacgattgaactggctggaatcaacctttctgctcctttgctttgccaaaactggaccgactcgttctgcttgaactgacctaggccagaactgcggatactcctgaaacttacttatcttggactgaactgttgaggttggcaattttggtaacctgagaattcaccacgctggctataagaggatgaaaatggaatctggcatttgtaaatcatttaccctatgtccgcttcgactggtcccaattcaaatgacaagtaattccaggaaaacctgcttgacctgtctttcgtctgaactgcaaccgtccctgatgctgcttctcaaagctgagctattgacctggcctcaccggtgtacctcagaattcaatcagataacttgagatcggtgtaactctgctgacaccctgtaactggctacttcaagtactacccggattgttgcactgggttgaaccttcaactaaaacagtgatgaggtgagccaaaactcgtctccgagacctatcccccttacagggagtagtcttactttcgcctgactgggaacaattggactattgtccttgaaaaaaaaaataaccaacacttctctgacttacaaagaccctcactttgaaaactgaaacttcgtcgattcatcaaaatagagcaatgacgactcactttcatcccagcaagatttggaacttaaccctcagttgctgataggaaattccacataaagaaattctcatttagctcctgatcttactaactcttaactgactttcccatcagtactaactgctggcatgactgtccttcttctgacctgacttcggtgtcgtccacctaaatgggttgtgtagttgatatctcaaaactaaactgaccgactcgcattggaattgacacaacttgaggaactggggtgctgcgagtagagctgttgtcttgatgacgctaacgccttgccgttgaacaaccttgcaagaactgaccttgtaaaccataaccactatagatagcacttgttgcctcagggattggtggtgaccttgctatgctggtctactgaagacttggtggcgtactgtcggaggttgcaggtgcttgctcttggaaaacaaactgactttcgctctgatcctgattccggcttgcatctgagcttgtacttgttgttggagacattgtcgttgcatctgctgctttggactctacggttgcggtatcaacatctgacacatccatcattagatcttggctagccaggatctgaccagagcgaggtgctcctactcagctggtagcttgttgtcttgaactgatccactgactctgactgcaacacactactgctagagttgcttccgctacattcgaccttgcatcgagctttgcatctcctgcatcaatacacccatctactgatcctggataccaaatgttgatcacgagcaggggttcttctggcatcgggagtacctggtagctttcgactgatccattgttctgtgactttcatacaccgttgttgttgctcttctctttgatactgaccatctgctgccagaacggaagagaggtggaagagaggggttgctaaagataaggtactaaaccacttgcctattgatctgttgtgagtggattttatgattcaagttgtttaagcaaacaacctagtatggtcgcatccccaccaatgacgcaaaccatacccctacacacaagcaaacaacacacgatctagaagctaacgaaactactcttcgggacagattgggtttaggtcaacttcgggaaaactcttcatgatcttcgcggaacgacgactctgaactgatcttctcgctccttgcacgaagcttgaggctcgacttggcttgacttccgaacagacatgaagctgacggctggtcatctaggtgtgacaactaaaagaattggagagactgggaggagaattttgaaaaaccgtttcgcaaagaaaagccgaagggcgaggggagacattttgcaaatagggttttcagaaagcttgtccttagggtttgcccatttggctcaacctacagtcgagttggctctgataccactttgtcacgcccagaaatttagcccaaatttccagactattttgtgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaggcgatcctagcgggcttcagctccactccacaggcaaaactcaactgaggtctgagccttggtcttccaacttcgtcttcagctcagaagcactacacttctgaaaagggggaataatagcaaggctgagtacaaccaccgtactcagcaagccacaccaatgatgcagacgtgcaaagggatacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctgtactacagtgtattgggtcgatttattaagtgtgagactaatcacggtgaatctggtcgatcgcccataaccgcaggcacggctattcgaatagttttactctggccagaggtgcacaactgtacccacaagacacaacccaccgacatgtcaccgcgtcatcatgtgcccatgatgcacacgtcaccatgtcgagtgattgtgacgagatccttcgcataaccctcccctaaccatccacaccacgctaaggtttcacccccacccctcaaaaggcagtgggcagtcccctcttgcgccgcggtgaatccggcagctggacaaccggacaccccggccgacccaactccatcacgcccaccctcgccaccggtgcctaggaaagggtcgagctatacttcagatcaagcagttacccattcccgcttgtgacaagcgctgtaagtcttccagggtttcccgtgaaccggtccttaattgccatgggtgcgactcacaaaaccatgcacccacagcccaccattcagtcgcattttagttggataattacgaccataaaacatggccagatgtctcgagcacgcggctcaacaagatactagaatgtctaatactgcaattatcccatcgactgagctagtggtaattaagcatggctaagcatatagttctagctaggtcacataagtaacatgagctagtcgatttatcacccaaggttgacaaaggatagatatcaagtaaacatggcacaagcgagcagataggtaaaccctgatcccatgtaattagcaaaacatgcatatttatttgcaaacggtaaaacatttataaattaggatcaacatgctcaagggggaatgtgcgacttgccttgcttcttcactttgatcttccgaactcttttccttgcgaccgcggacctccgaaacgacggaaactacacgctggcacgcaaaacgaggaaaaactctaataaaaaccaaggaaacagtacataaaaactaaacaaacatgtagagctcaattttagatgaattttgcaagttgaatggctcaattcggagttcgaatgaattagatatgaattttagaagttttgagccatttaaatgaatttctataattattcacgaattattgcgcaattattatttattttctcaaaggaaatgacaagtgctgacgtcaacaaaggggaggggcggcgccggcaagcgggccccaccggtcagcggcacaagggcgccggtccaccgtggaccgggaccaccgaggcggtccaccgccggtccacgggaaccgacggcccggatcggcccaaagccgattggacggccacgaggcagcgtggctggggcacgggcacggcatgaagccggctcggccgagacatgacgcggcggcggcaagggggaggcggcaagggggaggcggcaaccggctgcagcagccggcgacgtggaacggcggcgggcggccggaggacagcggcgcgcacggggacggcgacgcaccccaagaggcggcggtcggcaagaaaggggacgggaaaaaaggaagggaggagagatcctcaccggaagcggcggccgacgtggaggaagaggacggcgacgacgattgcccaatggcggcttgcgaggacggagggcggacggggtcgcccttgaccttcaggaggagaagagggagttagggaggggaggaccgatgcggggtgactggaaacgaagaccgatggcgatgacaagaggtagagctcaccggcgaccgaggaaggaggagctccggcggatttccggcgaagaggggcggcggccgaggtcctcctcgtccttgcggagctgagggaggcaacggcgcgagtcgacgtcgaccgaagcggcggcgcgacgcggctggaggcggtgaaaggggcggcggcctcgggtgtgcggtgggagtggtgctcgaggggtggagagggggaaataagaggcggccggacttccccttgcggtggcgaagctggcggtggcggtggctcggcgcggcgacggctgtggcggcgggaaacggcgaccggagctcgccggagtgtggcagcgcgtgggtgcggcgtggggagagcgagggagagtatgccgggctcgggaaaaatggggaaacggacgaggggagcacggggatgctttttatgggctcgggaaggcgggatcgaggccggacgtggcggaatcggccggcgaagtggggcgccgacgtggggtggtggaggggttaaccggcgccgattttcgcggggagagtgggggaaatggtggagggcgtggaggggatcgtgcccacgtcgttggatgcgagctcgggtgcgggagggcgccggattttgcggcgacgtggacggctatggcggttggggtcggccggcgagaggtaggaggaggagctgctgtcggcgaagggagagaaggagggacgcaaaacagacttttgcgagcgggccaagtgagaggggagccggcccgagagagggagaaggcgcgcgggccgcgggagaggaaagaagacttgggccgaaaatggcccaaagagaggaagggggaaattttatttgttttctttttattttaattgatgcaatgatctttgtgttattaaaattatttcttgagctccgaaaattcacggaaaattccggagagtattttagggcacaaagaatattgcaaaatattcccggccaatgatttttaagggaaaattttaattctcccattatttcacttgattaaattaatttaacttttatttaatttctagaaaatgcattatttaatgatttttaaacccgaacgaaaatcggggcgttacacaaactagcagatctacgttgttaccgatatctacaatacgcacttctaaattagtacaactaaaaccataaaaatataatgcatttattcaaacaaattttttaaaaatacacactatttaactcaatagtcacatataggatctgcgaatattacctgaaatcggcgtctgaatccggcagggcttcgccccttcttctcttctcctaccctctcttcttttttttcactggagttgagaggtgagaaatgagggctggggctgggcggcaggccttttataggtagcgaggcctgccgcccggccagtgggcggcaaggggccgcctgcaaaatggctggccccctgcggctcttttgcattcggaccccttgccgccccaccaaagggcggcaagggttttcatgcaaaatacccaccctccgtcacagcccgttcctcccccgtttgccacgtcagcttgctgcccaccattggggcggcggggtctatttttgcaaattttctcgccaatagattatttatgtaaatattaaaaaaaaatctaaaaacgaaaaaaattcccctacttacctcccaaacggctgcctaggtgaatatgtttcctctagattctagtcccatcccatcgttttagcgtggttctaattcgtgatatttcctacagtttcatatatgcacttaccgtataggctagttctttcttctctcataaagccgtacatattgaatttgattattatcacaaggtttatatagaacgcgatgatattgttgagtccgtggtatagtttgaacactgagatcaacacgaaaatccttgatattttggaacgaattttgtttatattttaggacagatgggttatttgggaagtgctatacccagaaaccatcatgcagtggcggagccaacgtgggggtgggagggggg

SEQ ID NO: 3020 - DNA, 12528 bp, Oryza sativa
  unsure (1)..(12528): unsure at all n locations
agggggctggaggaggaagaagaaggctgagcccccctctcctccaaacctagctcggccactgccatcatgcaagtagcgctttttcacatgattgtaattaaatatgttcctgcaaagtactaatacatcgtcaaaaagttgtaaatacttgccaggattacaaagacgtcattactagtaaatacatctccataatgttgtaaatgcatcctcgtgtaactttaatcggcgaggaagcgatagcacccaagagcttactatatatctacctatcattctgtattgtttatttaatatatatttgtgtcttcttttcttcggagttcaattcatatgccaaaaaaaatgctaaattgctaacttttttcataataaatttcttctattcatgcaataatttccctatatgtaatcattggggtagatattgatgaatgcaaagccccgaagaaatacccttgttatggaaactgcanaaatattaccaggcatttcgactgtacatgccctaagggtacccgangaaatgcctnntgtgaaggagcatgccanaaaatcatcttaacatccggagtacgaatagcaattggtacgcacctataccaactctatctcatcacgtacatatactttcaatataggtgaagctttcaacgtcttgaatccattgcaatataactaggttttgttgacctctgatgtgtttcgtgtggaaatgtaaacaaaactcttgatctacttgatttggttatggcttacataaacgtaaaacaatactgatgttaacatacttgcttagaccataaattgattaccaacttccaatttgttcgttcaggagttgttgcgggtgcattggttggcctctttggtttccttggatggggggtgatcaagtacaaacagagaataaaaaaacaagctctattaagacaggctgatgagttttttcaacaacacggaggtcagctccttctagaaatgatgaaggtagagggcaatgcggggttcaccctctatgagagagagcggatcaagattgcaacaaataacttcaacaaggcacacattattggggaaggaggacagggaactgtttacagagcagtgatagatggcactaccatggcaataaagaggtgcaaggagattaatgagagcaaaaaaatggactttgtgcaggaattggtcatcctttgtcgcgtcaaccataccaacatcgtcaggctgttgggttgttgccttcagtttgaggcacctatgcttgtctatgagtttgtgcaaaacaaaacactacaagagctgttggatctccagaggagcaagaggtttcatgtcacactaggaacacgtctaaggatcgctgcagaatccgcagatgcatttgcacatctctactcgctgccacgtccaatactccacggcgatgtgaagccagccaacattcttctcgcagagggattggttgcgaaggtgtccgactttggttgttcaacaatcgatgagaaaacccaagttgtgccaaaaggtacaccaggctatattgatccggactatctactcgagtaccagctcacagccagcaacgatgtatatagctttggagtcattcttctcgagcttctcactagtaggaggccattttcaaaagaaaggaagagcttaacatcaatgtttcaggaagctatggcaaatggcacacttgtcgagctccttgatagcgacatagttgatgaagctagcatgcgagtgatccaacaagccgcggttctagctaatcaatgcttggttgttccaggtacaaccaggtccacaatgatgctagtggccacagagctctgacggctagcattagcagatgaagtgcagcagtacccacaaccgccattggtgcttgaggacctaagctttacggggatagggagaacatcgatgtctacatggtacggtgggagcaaaacaaatggggtttatggcctctcgaagaaagctgtgccgagcatagagtttgcgagatgattgatagacatcatttcttatgttgtcgtttgtaggtgtgtgagagattgagttttcatccagagtggaggagctggtcagttgtgtatgaccatgcctatgcattgtgaggaataagagtacaagaacgtacatgtaaacccgtgaagcataattgtattgtgagactgattagcgaatcctaagaaaataactagttgtgggagttgtataggtgaaacaattatatatcagttggaaccatactacttcaataatctacttaattatttttaaagaaaactctcaatttgctctcgaaagtgattgattccctcatttgctcacgtaaaattggttctccctgatctaatgctcctcattcccagcttttatcctttatttgacatttcggttagttttatatatcaacctagtaaaatgatagttttctaaacctagtggcatgatagttttgcccttaacttttcctgtgcgtggttagcaattttcgtaaacctacatgttattttagcaaagaagtgttatggaaaattatttaaatttagtatattgcatgaaattaattgccatggttgcttgttaatttgtaagctgtaccatacttttaattttagaacttccactaccggggaaaggctcttccggtttgtaactctttttactcctgagtttcaaaccaggatgcccaatccgggactaaagatgccggttaaaataaccgggagttaaaatgaatccttaccaactgggactaaagatgtagccaggcggcaggtttcttttttcctttttttattgtttttaacatcgaataatgatttcactccatccacaaatcaaccccaaatcaatcaacacagatcacagcacaaaagatatcaccaaatcctcaaatcaatcatcaccaaatacatcacaaagtgtaaaaaaattacataacaagttctacaaaaaatcatcacaaatacatcacatattcacatcacacaaatacatctcggatccaatcacaaattcttaaaaaacagaaaaaaaatcaaatacatcctcgatccgcgccggccggctcccctccgacagaggcgcaaccgccgcctgccgcgccggccgcctccgcgccagcgcctccgggccggccgccgcccctccgcgaggcctctccgccggccgctcctcgatctgctgccggagagagaagtagaagttgtagagaagggaaggataaggataacacatagagggaggtgaggagaaggagaggataaggataaggataaggataagagatagaagaagatgaggagttgggaggataagtcatagggattatatcctgcatacggaattttagtcccggttggtaataccatacaggactaaagatcgaaataatctttactcccggttggtattaccaaccggtactaaagtggtgatctttagtcctagtttgtgccaccaaccgggactaaaaatcctcggtcccctgacaagcccttggcagagaatgaaccgggactaaaaatcttctttagttccagttggtgttaattaccaaccgcacaccaaccaggactaaagatcaagatttttttaaccgggactaaaaatgattttttgtcccgatttttatagaaccaggactattgtagtttttggtcgaccctgcaaagatcagttttatagtaaaattaaagatcaattttacagttgatttatttaatttttttatctttcagtctttgcttccaaaccgtatgaacataagtacaaattagaagtctccccctttactacggagaactaaacagttggtaagtactccatcctcttcatattataataagtcgtttgactttttacctagtcaaacttcttcaaatttgaccaaatttatataaaaatatactaacattttcaatacacaagagcaaaattaccatttcacctatcgactagatgtatgttagcgaaggactaatgagaagagcaaaacaaatgataaaattcgataatgaatggtataagagggagggccgatttcacgtggaaaaatgaatgtatcaattaatggataaataaatatttttctcttatttttgaggctagaaaagaggtcatcaccagttaacacactactctgtcaatttgaatgggctttctcacctttacgactaacaagtggaggtggttgcatgatactctcatagctcgtttttctgatataaacaatgaaaatggtcagaagcaatataacattctttccatgggaataatcctcgggcggtcggtaactttttatattttaactgtccagtggtgatattgtaacataacacaaaaagatagttgaaaattaaagtttatgtatgactatagaactttatagtagtatcttctagatcagtaaaagggtccctatgctatagattggtgtagaatctcttctcctggtttcatccctttcttccatcgacgtgattggctttcgatgtgtttggcttggacgacagacttggaggtgccccgcctctgtttggatgtcgagaagaaaagtccctggtgacgacttgactcgtgaaggttgtcagggttggccgcggatcgcgccgatgctggaatagtcgctgcagatcgagttgaagcgacatcaccgagcgcacggtgcgacaacagcgacgacgcgacgcgatccgaagacatcactgcccgcggtaactgcctcccagaactggcctttcgcggcccactcgcaattcacaaagcggccctgtgggctatgcatataggaaaaggtccaatttgactccatcaaaatatagctcaaatctaatttatatctctcaattgtaaaactgaatatatcgactcctccaacactcaataccgtcgaaaacaacctcctcaactgttttgattgtggtttttgctaacgtgacaaccatgtggaggcctagtcatcatgatattaacagtagagtgaggcccacgtgtgattcctttccaatctccttccttctcttcccctctcccccttcctttgttttcaggcttcacgacagctagtggctacagggcggaggaggacctcgagggagctgggtggcagcgagttactccccaccttgcaacgagctcgagctccacatccatctccatcgaggaggataaggagtgaggagccaaggaggaggtgcttggggcgaccgtgcgtgagtgggagaagagctccgtcatcggggagaaaggcgctcaaggaggtgttgacacgccgtccctaagctggcccccatcacccctatctcctcttggcgccaactaggccgaggccatcatagatcccgcctgcgactgtcgcctagactacatgttcaccctgcacgtggactcggtggacgacctcccctgccgcgcttgataactccctgatctctgtccacttccaccgtcaaagaagacccggtcggatgggcaccatcccaattggaggggagtgctcgccgccaccgccgcttctcctcgccatttcgcctcctccgtcgctatggagaggagggactagtctctttcctccagggagggtcaactggccagggggaagaggaggagagagatacgaggaagaagggagggagagaaagggaggagaagaaagagaagagtcacgacaggtggacctcacatgctaattaaccaagttagattatgtcaacgtgcctcatcaacgaaaacatttaaaggagtcaactaaatcggttttaatagtatagcgtttcatactctagtattacggcagagggtatgaatcaaattgaagacgcattttagggacttaaagtggacttattccatatatacacagtctacaagcaatgaccgacgtatctgatgggctggtgaaaaagatgctccccgtggcccaaagcagtgaatgctgccgtcttcccgttgtcaaaagactctccgatacttcttctttttctttttttttcgaacttcaactctaacacagttaggcccatttggaatggaatgacagaattttctccgatacctatcaataaggcggtcacacacatcctatgacttggtatttcacaagtttctaaagaagaagtatgcttcccgcgttctatcagtcaacccaccctgtaccacctcatttacccgtcctataagtacatgtcaatcaattaagagttctctttgttcactactagtaaaaaacaattttcctgcaaaaggagctctttagatcgtagaaagagcgtttccgcgtgtgtctgtaaaaatcggcatcccattttcacgtgtagacctttaagaggcctgcacgtgaaaatcgattttcgcagacgtgcctcttaacggttcgcacgcaaaaataagcctattttcgcatgaggacccttaagaggctctcttaaaggcccgcctactagtctatcattcccttcttttcgctcctcaacactttaaaatttttcatccttatcctctcactcctctcactctctcacctctccctcactctcttaatctgtctcctctcttattctcctctcgcggtctagtgtgtgcggcgagtgcggccagcggagggcacagacggcggtgggcgcggacggcggcatcgagcggcttggcggtgggcgcggctggtggcaccgatcggctcggtgacgggcggatccgcctcggcaagcctcctgacggtggcgggcggcgtggtcgacggcgaaggcggtggctccctcgcgaagctccggcggcgatgacaatgaggaggcggccggtagcggcgctgatggccccacgcatacgtgcgctggctggatccacgctgccctcgccgccgacgacgaggaggcgatggcagccgggagcggtgccgccggcttcgcgcgcacgcgcgccgccgccaacggattctccggtttccattttttgaatttttattttattttttggaattttatttttctatgcaggcgacattacccgaccgcacgcgaaaatccgattatcccttgcgattgggccgtccacatgcgaaatatatattttcacagacatgggacctccacatggaaaaaaccctttttgaccgcacggaaaaatccttttttattagtggttggagctaattcttaaacatgatattatggttaagcatgatcacctaattttttatacggaattaatggaagagtaatggccggtgcctgatgaatccataggaccgcttaaactcgtgtgtggcgttgtagatggtgcagtagtggtataccatacatggtgttggtaattttttgacaagttgacaagcacgatcgtagcatcttaagtcttgtggtgatcctagagtcgccaaccacctcgatctagcaaaaagctaaacctagatgggttttgataactaaaccggctagcggagccgatttctagataactacccgtctcgtgggcaaacggaaggttttcaggacaaacctacaaagagatgtcgcactctcgcagcagcggcggacggtttacagcgcaaaccgacaaagatggacaaactaagagaaaactaaaagcaatatgaaaagaacgattcgattgattgatagtagattgattttacaatgaaccggccttgtcccttatacaggggttggtcttgccctctacaggccctcctccacgtccaactcggggtagaaaccaaaggaaacccaaaacatgccttcccgagcaaggaaacctcgagacccgacgaaacagggtcggactcggaccagccggtgtgcggccggtcacaccgccggtctgaccggccctcaaccggcggtctgaccgcccaacacaaggcctaccccagaggaaaccggtagacttccaaattttggcaatatttcctattttaatctaggtgccaaatttaggtgtaaacatatgatactccctccgtttcacaatgtaagtcattctagtatttcctgcattcgtattaatgttaatgaatctagacatatatatctatctagattcatttgcatcaatattaatgtggaaaatgttagaatgacttccattgtgaaacggaggaattagtactacacatggtgtagtagtaaactcccagacttctcgagtagttatagccaaacgaggttctcagaaatctgaatgctattgtgttcttacacaatattgtcactccatttcgcagtggacataaagaaaaaaccctgaaaactagtgatcgaaggccaaaagaaaccaaaatctgcacactgttttgtccctttggacacaatttacaaacgcaaccattacaggcatctcaacaagaactgcatctctgaccatcaaggccccaactatctgcatatgattgaaatcaaacaaacaaaaccagcactccatgggggaaaaaatcaatcaacctatccctctctctatacaggaaacaacaaatcaatcatcatccagttaaaaacccaattccaccatcttgtacaagcaaacacaatattgatcaggtcatggctctttcagaacctcaataaccaaatccctagccctgtggaagcacttggcagagaatctctcgtacaccatctcgtacatctgcaggttcaaatacgcaaacctcatgtatctgtcaatgcattcctcatacttctggtacaatgcagggatggtcagaacagcaacaatacctgtcagcatgaggcaaagaaacagggcgtgcttacgatcaatcattccaatgccaaaccattgtacaagtggaactaaatgttggaaaattataccggtaataaaatgatgggagctgcttacttgtgtaacataaagtggtgaaatcagtcaggctgccaatgatagaaatgatccacaggctaaggaagacttgataaaatagcaccgagtctttcccgagtgcgatgtcatggaagacagagaagaccgtgttcatgccagaatgcagcagggctgccacttcattcacaacctgctgcgaaatgcgcatctctggaataggtggctctggcctgcaacctcatttgtttgcacaacacaaccagcatcgtttaaaatatttgccaaatgtccacagcgatgagcaattcactcatctgattgaagtaaaaaacagtaagctgtttgcaagacaaagcttatcattgtctacccttagcatttcagttaaaatagtttacagcacgtacctaatctgacatcagtatcacctggctggttgttagattgtcaattagcataaatttggtcaaagttcaaagcatccacctaatcctctaactgaagtaataatgattaaattgatggaggaatgtcaaaacaacagtgaaagctgtgatgatgataagaattaagtgcctggattgttccttccattggttaactatcaactgaaatctgtatcccaaaatggatagtagagttcaacacaaattccgttcctgtgcgaaatcgatggctaagagtactatgttgatgtaatgagatggctaggattgaggagctgagatcccaatctcacctgttgaggaggcgggcggccttggcccagaggaagaggacggtgaggaggaggaggaggacgttggaggcgagggagaggaaggtgtagccgccggagccgaagagcagccagccggagacggtcgccgccagcaggcaggcgctcacgtcgccccgccgccacatcaccacgtccccaactgcaaccatcgaatcgatttaatcctcgatcaaacaaagctggaagcatacctacccatcatcggatcgagatgcctaccaaattctccgatcagagatgagacgccgccgccgccgccggggcagcaagaatcgtcacgacgatccatggacgacgaatcgaatcaatccgaacaagcagcgaatcagcaaccagctggctagaccgcggatcgaaggaggaaggggcaagtcaatgccttttcctacaaggagaagaatcggggatttcggaaactttccccaaatgagatttctcggtgcgctagctggactccactcaaccaccgatcaacagctcaactccctcccaggctcccagctcgatgtcgcagctcaccctgacaggtgggcccttggccgttgtacagcgtggaaagttgccacgtcggacgctcgtggccacgtcagcctcgcgtgcatggcgcaacggtaaggccattcacagtgcgtatacctgtactagttgagcactttctacgagttctcacgttaattatataccccatctgcccacgtcgccagcggacaaaggcgcacacattaattatataccccatctgcacacacgttaattatatatcccactttctacgagttttcacgttaattatataccccatctgcccacgtcgccagcggacaaaggcgcacacattaattatataccccatctgcacacacgttaattatatatcccactttctacgagttctcacgttaattatataccccatctgcccacgtcgccagcggacaaaggcgcacacattaattatataccccatctgcacacacgttaattatatatcccatctgtccacgtcgccagcggacaaaggcacacagccatggcaacccgtcgtcgtatgtggcggtccagcgtgcgcctcgacacatcatcatcctctccagccgcttgttagagtgcgcagcccggcccactaaccgtgggctacccaggtcacattggggctgctccaccacaggctcaaccggagccacaactttaggttctgggcctacacaaccaaaagactagtctgatgggtgaggaccgcccccaccttttaagtcgtgctcctccatcatcaattaccgatgtgcgactaaacccaacaccgcacgtgctccagtaatctcggacccccggaatagagcttgtggatggttaacgtatatactttctctgttttacaatgtaagtcattctaacattcttacattgttaaacggagcggagggagtacctgctaacttatatacttgcatgcgttcttgcagttcgagtcctgcttgcagaggtacgtgtgggaggtcgacagagctatcgagccccaggtgaacaactcacgaacttgctgtcgacggatatctgcttagcttaatatgtcgtgtcctgcatgcatgcatatgactacattacatacaagaactacaaacccaaatatttcaatccactattaaaataatatttctacaataatctacacgataagaagaaagtttattagtatagttcactgttagctttaagcccatattaaaattgttttcaccttttcttttctctatctttctcccacttacgcatttaatttatttatttatgttgaagcatgtgtgtagttctaggttattcatgagagtgaataccctttatattttttctttttccaatccacgtgagttttacgtttatagctggcttatagcccactactatctttgctctaatccttctcatgcattcatgattgaattcatgaatgaaaatctatagcaaaggtaaggccccagttaaataaccaagattggtttctgatttggttgttcttttgttcacccagaaatcttttgcatgcttgcacctaataaaaagacagatccatataaaatagttgcatctgcagcccatttatacatgtgttctgtactttaacattttcttgatctatgattttgattaaataataaatcattttttttacttttccttatataatatgagtcgtttcacggataagttgaacagcaaaaaaacaccgtaatttactcaatgaaaattgagaattaatcatatttttgaagcagtgaataattttgaaacagtgaacatatatatcgacccataattttttctgcatataaactagcaactaatgattaattttcccatgccctatctctgaataattaagtccataggcaatgtatgtactctacagcctacgtattactggccgttcgattttgatcctaatgttaatattttcatcacatgtaatacctatattaataataaatctgtcccgtacttcgtccaaatacatttcattgaatgacgatatatatataacttatcagccttatcagcctaatccatagttctttttaattttcaaagttggagtataacacaatcgcatgtctatggctaaaattattcaaattaagaaggaaacatggaaaggcaaggtcagagaaattagactaggggatgtggtaatccgaacaacaacctatggtcctatcactagtagagatatgtcataggtgccggtttgcaagtgtctataggtgctggattttcacccggcaccaattagttggcaccagtagcaaaacccggcacctatacaaaaatagaaccagcacctataagttcacacgagccaaaaaaaaaaaaaggggaagagccggctcgaatcgagccgagctcaccaa

SEQ ID NO: 3021 - DNA, 8518 bp, Oryza sativa
atgtgattctaggtctttttcagagattaaagataaacgaaaatgactctgatgatcctcttttagtaatgtgtagttggagaggagatggttgttggatttaagattgggtgaaaattaaataagaagtggtctgatggaggaagcagtactctaaaatctcttatatttatggataaattttgaacccaaatccattatatatgtttgtgcaaagaaggaatacttattagcctcgacatgatacttattcatttcacgcacggatattattaatatttattttgtttgttgcatgtcaccatgatatatggtacgcagtaaagactttttttgtccattaaggtggtcaagtgtacatgataacagacttgaaagtttcatctgtagcattttattgccaacttccaatgataattcagtcaacttcttaaacatttacattttcaagcattgagagtgtttccaaagaaagtatatttatgtggtaaggtgttggtttggagtttggaccattatttattggcaacaaaattgattgctatcatagtaaaagtttcttataaactttatattgacctcatccttttccttatgcagatatcgttgtcttaacatctcacttagctaggactgattgaagaaacacagtaaagtggtggaatgagaaatatccatgaaattatactctaaactgcgtaagtttaattaatatcatttaatccttataagtattgggagcagtttatttgaattttaagcatatgcatatatagttgaaacaattcgaatcacactatatatatggagtgacaagaaggggataaagttgggttttttttttaatcacgagcaagagtactgtttcatctattttactggaagaaataaatttctattcgtaccttgatttgtttatatatatctagatttaattttgcaatgcattgagtgatacacgatgacataatttatattctcaacatttttcaaaatcttcatggttatttagaaggcatgcaaataatcaataatctttgccccataatgcttcacgaccattttatgataatttgaagctaaactgcattacaaataatgaattgagtggaggaacatgccatgaaacttgcccataaataaattagggaatataagaaaattgccacatttgtcaaaatagcatgacattattttgacagtttatatatatcttaggtagatcgtactatcatcacaattaaatattaaatcatatccataattcatattaaataaaacaagaaaattcaaatatcatggattatgaatttgatatctgttaatttaacccaaaatcaataattgtacaatttagctaacatgttcccctataaaacgtgttagcttacattgacttttgtttatcctgagttatgtaatttgcaaattaacaagcatgtttagtctatgattaagattttactatttataaaagaatttgctatataacaaaatcctgtgcaatgcacgggttagcgactagttcttctaacaaatcaaggccgagcggcgtgggggagaacaacgcagatgcgttgtggaggtcgtggcctcgccggttcgtggctccacgcgagtgttcccctccccatcccccgagccggcgatggaggaagaggaagagatggcggtgaaggaggaataggaggcggcaaatctggtgcctaccttgatgacatccctcgagtcatgttgtcgcccatcgtcgtgcctcgcttcaagccgccggacccgtcgtcgtcctccgatttgcgccaccgctcgtcgtcatcacctgctccaagccacagtagcctcctcgacccctctgtagcctcgacggcggcctccatgacctgtccggtttgatgtgccaccgaggaggcagaagccgcgctgctgctcgtcctcgttgcccccaaccgcgggcgccaacgaggagagagaagggatttggtgccggcgatgagagaggagaagggatttggcatcggcccaagctactcaggtacgataacatggtctatcataggtgtgttgaactagtgggttgattgttcagaagctaacacgggactttgtgataaaacaagttccgtggtatggcttgcttgggaactatgacatgctatgtgctaaggacataccttgctggatcaagtgagtcatgccttctcgaaactagccgtgcgtccttctctgagaaggtcaacgacccatagtccatctggcttgccaggggaacccctcgaccgcccgagaagggctatcattgtgtgtccgccgacctaaggacgatggtgtcgcctgtgggtttcacgtcccagttgatgcagtgcatcagctgccgagcccatccatcgcattaatcatagattctcttcggcagtcacgttactatatttccaaagtcaggatttcacactgcctcttcataagttataggatgctgcaggtgggcttggcgtgacatcccacggtggtttttttcaacggcagatacacaggcgctggccttgaaggacataatgcaagctcatgattgtaaaacaatgttttatgtctctcagcagagtatgcatgacagaggtgatagggtataaaatcatggcggcaagtgcataggagagattatgagattcgcccaaagttatgtaccagacaacacatgacttgggctattatccagtaggaggcctgaacccgtatacttgttgtgcgtgtgtttgttctgtgcttctgagcagctcagagtacggcaagacgcctcagagcccctctagatcctaaaccgttgttccccacaactgccaagctcatctctctggtagcgggtgatggctagatgtagcccccaagtctagatttgcactagtaatgtcagcattgctcctggtcgcacatggtggtacgtggggagaagaaggctaccatggatgtattgtgctatgggatgctcccgtgcgatggccagtctgaattagggagggtggatcttttctctctcaccatcttcctccgcaacccttctcgcaatgctgggaagttgttaatgtttcaactgcttagaggcctttgtgggcggttcggtaatagccctttgcatgtttggcagcattagcgacagtcggttcagtgcgagttttgagcgtcgacatgtgggatgtgtgtttgtttctttttccttgtcgcaattatagtttacagtaatatataattttgtaaattttttctgctatatcaatatgaaacatcgaaatgtacaattcgtttggagaaaaaaatttttgttggaattaggaagcttggcattgttgaactaatttgtccaaaaacatattgttccaacatttaattagaaagttatttaagcagacgttttcaacactggagtagaaagtttcttcctactaagttttagagcaaaaagttataaatacaacattctaaaatcagggtccagtcttgcacccggcctcccgggttcaacggtaggcatgcgtcctatatgtgatccttcagcgtatccactggttgatcagttaaactattgatgactggtttgcccgtgacgcacggtatttctagtgtgcttccctataaaatagttgttcacttcttctagagttaaccgtaatcaattgtcttagtggtgaaagctagcgtgtacctatgtaccgcacatgcaatctgtccgtgcctttatcatgatttgtttccataatataatcaagtgtttagaggggacttcaatagtccatggcccttctcagggggtagaattaatattttggccagcggacatgttgtatcgttgtgcttttcgtgcatacacggttgttgcttcgaaaaatcctactagcctagtttcagcgtgtaaagttttagcgtggcatatcggatatacggatacacatttaaagtattaaacagaatctaataataaaataaattacagattcaacctgtaaactgtttggtgaatttattaagcctaattaatctgttattagcaaatctttaatatagcaccacattgtcaaatcatggcataattaggattaaaagattcgtctcgcaatttacacgtaatttgtctaattatttttttctatattaatactctgtacacgtgtcaaatatttgatctgacagggtaaaaagttccatgggaagtaaacaggacctaacttagtttgtttggacgagttgatgtcgttctcaaactactagttgactgactaggaattgactagagaaggtggcaccatttacgtgagaactacggtttatcttacctcgtgcattccaaagtcaaaggactaatccacacgtaaacctaccactggatttattaattagagtaaattgtattagtaacacacgaacttattacactggtggagaaaccctttgtagtcccggttcgtaacccccctttagtcccggtttccaaaccgggagtaccaatccgggactaaagatcgctatctttagtcccgggtgaaataaccgggagtaaagatcgatctaccaaccgggactaaagatagagctgacctttttttttttcatgcccctgttgctgcatggtttatatatatatatatatatatatatatatatatatatatatatatatataaaccatgcatatatatgtttcaatacatatatatgcatacatatatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgttagctcagaagctaaggaccggtgaattgtgtttccgtcgtagtagaattcacccttgggatcaaggatttcttcgttgatgaatcccatgagttgttcttgaaccgctgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttctttgttgcccttgtgtgggcaagcggtggagctgggggggcccttgactttgaaggtgccggaagaggagcttgcgggggagtaggtgtaggagcacgaggaggagtcggtgcaggatcctgaggagtcgatgctggagcctgaggtggagacggtgctggcggagcatgaggaggagacggtgcaggatcctgaggaggagatggcggagccggaggagatggtgcacgagacgccacttgtcgcccagggaggatgatgtaccgcctgcgccatagaataatggcatggcatgtgtctcgtagatgcgtctcaccgtctcctctagggtaatccagctcgaggtcctcgtacgcgccttcgaccaactcaacttcgaccttggagtatcctgctggaatcggcctgcagtggtaagtacctgaagggtccgttgggatggccatgcccgacgccaccttcatgttgtgagagattatttattagtaatcaacatatataagcagcaactagcggaatgggtaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgcaacctcctcttcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcctccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgccttcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcaagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttctgttatgatgtgccgaccctcaagcttcttcgctgcacctcgttgccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccct

SEQ ID NO: 3022 - DNA, 830 bp, Oryza sativa
tatatatctatatacatatgcatactgcatcacatatatatgtatagatacatatatatatatgtatgcatatatatgtattgaaacatatatatgcatggtttatatatatatatatatatatatatatatatatatatatatatatatataaaccatgcagcaacaggggcatgaaaaaaaaaaaggtcagctctatctttagtcccggttggtgttaccaaccgggactaaagatagagctgacctttttttttttcatgcccctgttgctgcatggtttatatatatatatatatatatatatatatatatatatatatatatatataaaccatgcatatatatgtttcaatacatatatatgcatacatatatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgttagctcagaagctaaggaccggtgaattgtgtttccgtcgtagtagaattcacccttgggatcaaggatttcttcgttgatgaatcccatgagttgttcttgaaccgctgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtct

SEQ ID NO: 3023 - DNA, 1133 bp, Oryza sativa
caggccgtgtatttggccacctttccggccagagccaactcggcctgctgtttgttgccccagaggaggacaacagggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatgggta

SEQ ID NO: 3024 - DNA, 488 bp, Oryza sativa
tttgaaaagaattccaagtggttatgggggggagtttaaaaatgccttatttggaccaattttacaccaaaaaaggccttgaacttaaatttttttctcctcgtgttccccaacaaaccagtgttgttgaaagaaagaatcggtcgttggttgagatggctagaacgatgttggatgagtaccacactcctagaaaattttaggctgaagcagttaacactacatgctatatttcaaatagggttttcttgaggtcaaaacatgcaaaaacttcttatgagcttcgatttggacgtcaactcaaagtttcacatttgcgtgtttttggttgcaaatgctttgtcatgaaatgtttcttagttaccccgccattcacgtggctatcgtgtacttgttttggaaactaacaaaattgttgagacttgcgaagttacttttgatgaggctagtccaagtactagaccagaaattgcaggtacgttatcact

SEQ ID NO: 3025 - DNA, 592 bp, Oryza sativa
atcacaagccacggcgtcacgttgggttgggatatgcccgtatttttttttcattccgtctacccaagggtgatgccgccttcagtttgaactttgaaccgtatcgaagcactatcgaacaaaacagtcaacttctttgcgctcacatcacaaagccaaatcaaccaaaagaattttaaaaatggcagccttttcattcgctatccatgttcgacgcttctagggatcacgtattttattttatttagataatgatcacatattccatattttaattaatagcggaatcaaacaatttaagcgcatgtgattaatcaattaacagtaaatcaaagcgtggtttgcatctgctaagctcgtacgtaccttggcgaggccgagggcgtcgaggagcgcgacgaggtcgccgacgacgtggaaggcggagtaggactcgatctccggcggcgcgtcggtgtcgccgtacccgcggaggtcgggggcgaggcaacggaatccccggccggggaggtgctccatctggtgccgccacaagtaccagaactccgggaatccgtgcaggaacagcaccggcgcgccatcgccgccctcg

SEQ ID NO: 3026 - DNA, 661 bp, Oryza sativa
aaataccctcgatcggctaccatctgctagctctagctctcctcgatcaattcagattctcccctgatcgaggtgaagctagggcaacgcgagagctagcgccgccgacatggccgacgacgacgagatcgctcttgagccaggctacgtcttccacccttccgacgcggcctcatcaccctcttcctccgccccagcatcgccaagatccccttcgaggaccgcctcatcaaccacgccgacgtctactccgccaatccggccgagctcgtcggcgagcacagaccggcgccgggcacccatgggagcagcagcgtctggtacttcttctgctccccgcgcttcaccagcaagcgcaagacctccgggaggcggcagcgcgcggtcggcggcggcggcggcggcgagagcgtgtggaagtcggagggcggcaagaaggccgtgatcggcgccgatggccgccgcgtcgggtacctccagaagttctcctatggcgtctacgagtcgtcgtcgtcggggtcggcgcgcacgttcacgaggctagggtggtgcatgacggagtacggcctcgacgacgacgccatcgacggagcagacaagcaggtgctctgcaaggtctaccgctcgccgcgcgcggtctgcgcggaggcgcgcacggcgg

SEQ ID NO: 3027 - DNA, 352 bp, Oryza sativa
agcccctgtgctttgccatcagataactcccaaccaaacaaataatttggaggaatggaactcagtaaaaatctcacgggcaatctatacttgtcagatagcgcttgaacaagctcactctccgaatggggtgggggtggatccacctgaacggcgacggcggtggcgacggagggggtgggaaggagactgcggtgggcgatcggcgacgaggaggcggcgccgaagatcggatggggtggatccaccggagcggcgatggaggtgggcgggataccgatcggcggtgaggaggcggcgccaaagatccgctggggtggatccatcggagcggcggcgaactggcgatgga

SEQ ID NO: 3028 - DNA, 644 bp, Oryza sativa
gaaatacctcgattccaacacaaataggcagttgcgggtgcttgtcacctttcccttcagaactcttcttgtcatccagatacatggaatagccgatacatccatatctgaagtcggaaaggttgcaccttcctggatagcttccatctcaatttctccaaccatgtgatcagggactgatgcagaaacatagaacagtcagccaatgccaaccattgcgaccgaagaaaacaattcagattgagcatttaaacaatccataaaaattaggccaacagttaagtactccattaaatgacagcaaattcagagtaaatgacaacaaaacatttcaaaccaagcaaggagttacggcgcagtgcgatggcatgtaacactgtccagatctgcagttctgctgctattaggcattagcagtggcagtggcatgctaactagcaacaagtcaggatgaatacaaatatcgatcgtgcgttgtggtgtgtggtaaggatcatggttacttccaaaagttacagttgctactatgaccgcgccaatccagcagttgcgattgaacatctacgttccccattgttcctgcgtgcgtgcgtgcgtgtttgcagggtcactggaataaggtgccagaaaaagctccggcgctc

SEQ ID NO: 3029 - DNA, 416 bp, Oryza sativa
attattccccttgtcttcgctgcttgcgccctaactccttctttcctgtgccctaccttcgccacacgcgctcgctcttaatcttctcttcctccggcgccatggcacggggttccgctctgctcgatggtagcgtgctgccgccttcccggatcgtgagcgagaggcaggctgggctgccgcgccgcttcatgccggaatctgccaccggccgggagatagtcacgctgggcgagggacgcccggcgccagactacccggggcggtccgtcttctttctcccctttgcaatggcagggctggttccaccattttcttctttcttcatggatgttctggagttctacgatctccagatggcgcacctcacccccaacgcggtgatgacattggccatcttcgcgcatttgtgcgag

SEQ ID NO: 3030 - DNA, 941 bp, Oryza sativa
atccgcgacttggacatccacaggaggtgtagaagggcggcgagatggggagcgtcgcatcctcgtctacggcgacggcagcacgccccagggcgcgctccaagctgcgggcgcgctcatacgtcacccgcccgtcgcccatgacccggagtctccagcccaacgttggctggacgatgtggccaaattggtcatgactgcacggcagcgcctagatgctggtgggcggtcctccgccaccaaggcctctggtgctgctaccaccggctccgcgtcgtcaagacggagggcgcggcgagcggcagccgctgttcgccattcggccgccactccttcgtcaacgcctccgacccgggaagatctgcgtggggaaccggatgctcgcatcagtatcgagcgccggcgtaatggccgacgtgctccccacgcaacggagggcgcctcctcgtccggagtgtcgcatcaccacggacgcggggatcagccctccgtgcccccggttggtggtgtcggctgtagagcctttgtggcgagccttcggaatgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaaaggacaggcgcggggttggctaatgaacttgccacccgcgtctgtccactcttgggaggatttgtgccaacagttcaccatgaacttctaaggcacatatccgcgcccaggtgaggaagcggacttgcacgcagtacagcgaagggatgatgagtcacttcgctcgtacattcagcggttctgtcaagtccgcaacaccataccatgcatccctgcacacgcggtgatttacgcgctcagggggg

SEQ ID NO: 3031 - DNA, 629 bp, Oryza sativa
tattaaaggtttaccaaagtcagagagattcaattgcattcttgtggtggttgacaaattttctaagtttgctcatttcattcctttagcacaccctttcactacggcaacagtagcataagctttcatgagaaatgtatatcgtttacatggcatgccaaaggtaatcatctctgatcgtgacagaattttcactagtcagttctgggagtgtttattcactatggcgggtatcaagttacatatgagttcttcatatcacccgcaatctgatggacaaaccgaaagggttaatcaatgcttggaaattttcttacgttgttttattcatgccactcctcgcaaatgggctgcatggctgtacttggcagagttttggtactattcgtcttatcagtcgactgtgcacaaaacaccctttgaagtggtctatggttatcaacctagtcattttggtataagtatggaagattgtgtagttccggatctagctgaatggctctctgacagaaaattcatgcaccatttgattcaacaacatctgcatcgtgctcagcaacagatgaaattctatgctgacaaaaaccgcagttttagggagtttcagttacaagactgggtttatctca

SEQ ID NO: 3032 - DNA, 523 bp, Oryza sativa
acagtagttcatcattttttgtggggacttaccccaccttttcataaaccgacggagacttgtatggtggccgtccgaatgaccttctgatgggacggcccatacctacctccacttccgccggaagcaggcgcgacgtggaatcgtggctgtctgctgacgacatgaccggtatcagaccagtcacgtcggtcattcttgtcaccacgtgtcagcttagcaacctacatgctcgcccttcttcacacaacatcttgcctgtaatggttaggatgaagcctggcatatatctgactaggactaacgtgccatctctgggaggtaacacgctagctccagctggggatgagcgcctagaagccctcgtcctgacgggatggggcgaggcgtgcgtcagatcgcctgtcgccacctaacccgcgatctgaccggtctgtgactggtcacagaccggataaacgagtgcactgcactgcgttacatgcggcgtgacacgctcagccaaaccgcaataaatgtggtt

SEQ ID NO: 3033 - DNA, 57182 bp, Oryza sativa
aatatgaagttcggtgtgttaaggaaaaagatggttgtccctggagagtgcacgcgtacaaggggaaatggaaggattattggacagtgtcagtcgttaccaagcatacatgttttctacctggtgttcagaaataccacaggaacattacatgtgcatttgtcgcatctgagatgtatgcgcatgtcatcgataatctcacatacgaaccaaggtcaataatccgacacatcgaggagacatacaagtatactattagctatgccaaggcctggagggccaaacagaaaataatagagatgagatttggaacatacgaagcctcgtatgacaatttgccacgcctgcttggtgttatcgaggaaagaaaccctaggagctcttacgaagtgaagaaattcccatcaattgaacatcctggcaagagtgtgctgcaaagggcgttcttagctctacatgcatgcaagatggcattcgtgaactgtcgtccagttctctgcattgatgggacattcttgacaggaaagtatcggggccagatactgacagcaataggggtagatgggaacaatcaggtattgcccttggcatttgcttttgttgagagtgagaataccgacagctggtactggttcctgaaattggttaaaacaaaagttgttggtatgaggccaaatgtgtgcctgatacatgataggcacgctggcattctgcgagcgatagaagagtttctgtttgggagcatggaacgaggataccctggtgtttgggacgatgtacagagtaggtggtgcatgcgtcatatgggagctaatttcttcaagcaattcaagaacaaggagctcatgaacatgttcaagaggctgtgcaatcagaaccaggagaaaaaattcaatgagctttggaagagattagatgagttgacagccaaatgcagtaatcagcgtgcagcggctccatcgactgccgttgatgaccctcctcaagctcttggacctctcccaacagatagtccaactttggttagaagaactggattggagattcggaaattttctcagtggattctgcatgaaccaaaagagaaatgggccaaggtgtatgacaccggtggtgctagatatgtaataatgacaacaaatttggcagaagtttacaactgggtgatgcgcggtgtccgtggactgccactagttggcatagtggagttcattttacatgggacatgcaggtattttagggatcggttctaggcagttcttccctctatgccgaacaacagcattttgtttggaactttcatgcagaaaaagctagaggagttgcgtaaaaaggccatgaaacatcgagctctagtgcaaggtacccaacaacataggttcgagatactatgtcaagataaggcaggcaggggtatctaccgcaagagagtgaagcaggagtgtgttctcaaagccgacggcacatgtcattgctcttgttcaaagccgaagctgctccacaggccatgcacccatgtcattgctgccgcagcggagtgtggcataccagatgcagtatatgtgtcgcagtacttcagtaagcaagcaatatatcatacatggagcggcgagatttacgggttcggcatagctggggagttcacagagactaacgatgaagtactcaatattcctgacccatcgaagctccgaggcaaggctggaaggaggaggactcgtcgcatccgcaacaatatggacgagtcggaggctggcagggtgaagcgttgcagcaaatgcgattaacgtgggcacacctataagcattgtcctaaagacaaggagaaaccaagtgcggcggaggcaggactatcaggatcagcagcagatggagctcgccctacgggtgaaggcactacctccactcgaccacgtcctaggcgtcgtcgtgccacgtctggctacatggtgtagttcttatgttctatgttggcatgtgggtttgcttgtaatttgtttcgaacttatcgatgtgtttatgtttcgtcgtgtaatttcagacttcggcttgtcatgtctttagttctcgtgatgtaacgtcagactaaggcacatagtgtctttaggtatgctgatgtatgtcggacttcgacacgtaatgttatgttatgttatgttatattatcgaactctacatatatgttaaattgcacgtcatcgttatgtaccattactaacgtttgctttatttaaataagctgtactcttgttgtacgtaattattctcatgattttttgagtatttcattaatttgcgagtcatcttttgttttacattactactttttgaattgttctaacacgaaacactatatttttcagagatggcacgtcaggatacacctcagctgttggacccggcgatagatctccgacaccggtctcaccttactgcggtgcagggggctcagcttgggacgttccgggcacggacgtgcggtgagctactcacggttcacgactcctttgtcgagaggtacgaacagtgttttactataagttagttgcactgtaatattttttataattacatattaatttgttattgcaggctacgtgaggccggcctcctaccgatgtgtcggctggtggaggctgcggccggcgacgcggacccgcccagacgatggaccgtggacaggtccctcctagcagctttggtcgatcgatggaggccagagacgcacacttttcacttgccgtgcggtgagatagcccctaccctacaggacgtatcgtacttgttggggctaccgttcgcgggagacgctgttgggccagtgaccatggctgtggactgacaggacgatctgacggcacgtttcgcactattacagcgcgcaccgcacctcccgctcgagccgttggcacaccaccgcaacaccggacctacgaagaggtggctgcttcaattcaccgtgagtgtttttgtaccgaaatgacaatcgtattacatatttagtccgcagttaaggtgcctaacattttatcgacggcttgcaggttgagcagctacaggcggaggccgacgagtactcctacagccgatgtttggaggcgtacttgctctggctttttggctgggtgatgttctgtggcggtcacgggcacgcggtcgacaagggactcgtgcactacgccaggagcatcgccgacgccgcggtaggcgaggtgcctcagtggagctggggttccgcgttgttggcggctctgtaccgtgcactttgtgagtcttgcatgaagacggatcccagcgcgacctttggtgggtgccctctctttctttctatctgggcagctgagaggattgcgatcggccgccctgaggtggaccagcacgcgtacgaggagtcactgtacgaggagcgaccagaggtcgactaccctacgatgggtactctgtggtgccgtcgtcaggtacgttgcatcgatcttatcgtattgttaagttaattgctaagttcattgtacatcacatcgatcgtctcgtattgcagcgccgatgggctcacgtccaggttaggcggtcgtatcctgagtttgttatggagttcgaccgccttctgccgactgacgtcgtgtgggagcccaacagtgccgcagctacccaggctcgtgcgccgttgggtctgtccacactctgcaccagggaccaggcgtactggatgactatggttccgatggtattcgacatctgcgttgagcctcacgcccctttctgcgtaatgcggcagttcggcttccgtcagccctttccagtaccgtttccgaccaccgtcccagctgctgttcaccggtaagatcttgcactacgctttccgttgttgcattaaaatccgcctgttcacaataatttgtaacatctgtcgtttcacactaatattacacattaattcgcaggtactcgcgcaagggtcagcagtcagctggcgactggccccgccaagttggcgacttttgttgaggactggttgctcgcaaccgaggaggtcgtggaccacgagggagagccacacactgaggagtcgtaccaggcctacctacgctggtaccagccacgcacccgtactagggtcaccttcgctcccttggagcagcagccccacgttgcgagcactagagacctctatgccaggcaccgcgaccaggacttcgctcgtgctatgagtaccctgcatcgcaccattcctttatgttttcatgtctttctcttcgtcaaattttacgaatatttacgaacaaattaaccatgcaggtcgacgacatcaaccgggtcgtcgttgatggttcaacgacgatccaacatttagatgcagggattccggtacccgtagaggagcacctgacgacgtacacgtggatggtggagtcgatgcgctcgattcttcgagtgctcacctgtcgtgcagacgacgttgctcgggcagacgcagctgtacagcggccacccgaaccgactggtccccatccagctgcgcacgttcctaggccgagaccccctccgcacggaggtaagtatttttattactatttctgtacatgcctcgcacatataagtgagtcgtttcacttgccgattgcttcagggtttcgtgcaccgttcagcaccccgccttcctcggctaggccttctgttgtgccccccacaggtacttaaaaaaagaatattacttcgacaatcaatttacatgcattttatgtcttagcttacaagggtcccgttgtcgatgtgtaggtttcgcccagttcgctatgatgcaggccgcccacttctcccaggctgcagggtcagcgtctcaggcagctgtgtcgacctcgcactcagcgcagttctggcagtacaccgggacttcgtcacaggcagccggcacgtcgagtcagggtccaccactggaccatgctgggacctcgtcggaccgcttgctgccttccaccttcctcttcgacatcactgacttcgacttcgcttcaggctcgacagaggacgtcatcggcccctcacagttgggaggcgcaccgccggtgcagacgcaggatcaggcgcaggccactcctccgcgggacactcgtgctacccgtgctgtgccaccggatcgtttcacctactcctaggaccacgtgcgagcacaggcccggaggaccaagcgtggtcgcggcgcggggcagcgccagtagagcagtcttctctttgtttacttgcttcactttccagaactgtatgcttgtgtaatgactacgttgttgttatatgtgcacgataccttttggcgcatgcacgatacctttcggcgcatgcacgactactttctgccgcaccgatgcagcctcctttattcgcgtgtgatacgagtatttgcccgccatttggcgcatacgaccaatgtaactttcggcgccgatcatgcatgtatctttcggtgccaatcaagcgtacccaccataccccaccacgttcacatgttaggggcatattgaaatttctactgtcatgcttccttgtcccattactacatcgtcgttgtgttcaactattgcactacctccctcctagttcgaatctaatatcatctatgtaaccgcaatgcaaatagttgtatcatgttcaaattgtactactatttcttcatgttacataattctccttgtttaagtccatataatgtttctacgacccagactgcgataggcctatataaattatccgagtactaatacgtcgaataaggaacaaaataatacctcacttaacatatgaaattgcgcaacaaccaacttcaacacatttttataacaatattaacaagttttaccaataaatacttctttatttattattaacataacatagaaaaatcttttggccgtacttttttcatctgggtcctttgccgccctctattgaggcgaagggacccagatgaaaaagtacggccgcaagctctttatgggcggccaaaattgcaattagccccttgccgccctctgtatgggcggcaggggctatttctgcaatttttttggtcgatagattatttctgtaaatattaaaaaaaatctaaaaacgaaaaaaattcgtaagtagggatgcacatgggtcgggttaacccagctacccagcgacccagcccatgaaacatggggtcaaaacctcatgggcttacccatgaaatttcatgggtcatcatgggtcgaccctcagtgacccatggagcattatgggccgacccattagctaggtttcaggtcgagtaccaggcggcacgaccagctccgccgccgccgcatcgcgctggggctctccgctcctccgccgcatcatgttgtggagctccgcccctccgccgttgccgtctaccatggaagagcgagatgcgcaccctcaagatcgccgcttggatgctccgtttctcctccctgcagcgccatgcgcacccccaagattgccgcgtagccgccaccagcagacctcccaaccggccatagaagaaggggatggatcagatgggcggatgctccacctttcagcgccacacccagcatcactctcgccgcgccgccgccaacgacggacctcaacatgtgttgatgctgcaggtatgcaagattctctatttgctttgaatcaagaaattgggaggaattgattggacgtgtgcattatattgggaatttggcatagatttagaatcagttcctgaagggcaaagattcaatgaaagctaagtcaggttccaaaaggaaacgtgagtatcatcagattatagtgagaactgtgattcagtttgccctggaccttgatctgtttcttttggacctgtttaagcagaggtagattttgtctccttggctgccttaagatttttctacagacaatgagaaattggtcttttcctgcctaatatgtctctactctctagtgacctcctgaatagtatctagaaatttctgcttggccttatgtttgaatactaatgctagcaatggtacttggttcctatcagtttgtcggttttaggttgattttgtacggcagcagagccaacaatgatactactcctccttaatagatactactccaaaagaaactctagttatatctttgcaagtatgtgctacacgcctacacaacactaaattttgctggtaggatgctttcagttattgccaggccagccggtgactcgattagccggtggccagggtagaagtgtgtaaatggatcgtattattccttggcattaacaatttgtatttttttttgctgatgttgattaagtgcgtaataatgaaattaatttttgcaatatgttatgttgttggtatgcagaaggtggtcaaagcatggagacccctcagatcgttgttggtgctatactataaagaagatatactgcctcgagttgatgattttgatatcttaacctggtggaaggcaaactcactaaaatatcctgtactctcacacatagcacgtgatgtgttagccattccagcatcaacggttccatctgaaaatgctttcagtacaggagggagggtaatcaatgactacagaagtagattgacgcctgagatagttgaggctctcatttgtctacaggattggatgagagtcgttgattgtaagtctatccccttttctttgaaaactattagtatgacagtgccaattgagtttatgtagttaattgtttttttaatgttctaggcccttctgttgggatggtcttatcacaagaagaagaaacttgatgccttgataggtaattccagtgcattagtaatcgtgttgtttaccggaaattgttatgtaatgaggcttttactgttcgatagctctgtttgtgctccaggcttttacctgacatataattactattggcatcaattagctgctactgaaatgcacctgtataactgactctggatgagagtgaaaaaaatctgatattctagttattaagacagaaatgatccatgaaaactgcattcagatattctatctagtaccctgtacatcatttctagttatgctgatgtgtagaactgtttttttccattgttctagtttgtttgtaaaagattcaaacctcatttgtctgttacttaggactgttttatgttgattttgtatctcatccaaacaagttgaacaacattatattgtactctcagctgttctgaatatcacttgcattctcatccacttggtaaattcttgatgcaaactagtacctttgacatactcactgttttgttttgtaggttgtggaaaatttcagtgcttcctggtgtggaccatgtcgtgtcattgcacctatttatgctgagatgtcaaagacttatcctcaactcatgttcttgacaatagatatgttgatgacctaatgataattgtaaccatttgtttggtcaaatctgctattgaaaaatgattagtttcagttttttatgaaccaagaaaccccttatgcatctgatggcgatgattttatcaatagtatcatttacctgtataactgactctgcatcctcagctctacaatttgcttgtatttgttcgatttcagctgatgtcaaatgattaatcatctacgaatttttggtttgtatgatgcctgcgcgctgctgtgctgcgtgctgctgtgctgctgtcattttgcttgtatgatgcggtccagtttgcttgctgctgttggccgcgggccgccccatggatggctcttgggtcagtgggctaagcatgttttgtgggtcgacttgacccatgacccacaaatcaccgccttgggtatcgtgggtcagaccttgggtcgacccagcccgacccacgtgcatccctagaggtaagggttgccctcgaatcccttggcgcagttgcagatgtagcctggtccgctggacgagttgacgcacgcactgttcatgctgacgcaggcttacgattctcggtttttccgcgcctccacgcagttgctcgcgttccggacggcccattcgaccaccacgggcactctcccgccgttggcgtcgaagaattccgacgatgtcgcgtagctcctcctgaagctaaagctcgacgactccatcagcgccgcgtagctgcagcggctgacgttgtagatatccttcgagctgttgaacactgtcgagtagttctggaactcgacctggtaggcgttaaaccccttcgttatcgttgtctggcagcagcctgccccggagcaggcgccgtcggcgaggcgatcgccgcgtcgcccgcagttggtcgccacgcacccgctcaggaaacgcacgatgttatcggcggaatctccgaccccgacgacggccaccgcctgacacccgacgacggcgaacgtgttgccggcctgagagagcctgtacggatcagcgaagctcaccacatccatgatggtttgggaggtgtcgttgcagtaggaggagatgttgttccacacgcgggcctgaccatcggacagggacacgccggccagctcgaagtgtccgccgtgccccaagaatggcttcttgccgccattgttggtgtcgcggcaggtgagctcgaagccgggcaacgcgcagcctgcagggccgatgccgaacgggtaggggatatcgacgccgccgcacgccgtcgagcagttgctgctgccaggaggcggcggcggcgctccaacggcggcgagcagtgccgaatggcctatactaattagcaacaatattgctgctaatttctggagctgcatggctcaataactcgtcaattgtcggatgatccggcgtcttcctgaccgtttatatgcactggcgtttatacgcactggcgtggaaatgaccaaacggcttgatgatagtgtatgtgtgaaacaaactagcatgcgtgacttgaattttcaagtcttgccagggggtataagccttcaacgtagctttcagtggattttagtatctgcaggagccttcacagtttcgtactagtactcaattttcataggagaaagtccaaataaccccctaaattttggttgaaaatccatctagcaccttgaccaggttttatagatagctttctatctgatttacgtatacgttggatgagagttttattacgtgatatatgaattggacatatgcgttaaaatatccacctaaatctttagttttgactttttaacccttatttttttgttctcatttaatgtagacagatgttaatataatagtaaggtgacatcactatagaatatatattggcgacctattattgacgatgatgtgtaaacctgctatattcaaaaccactcatttagtttccaagatacccaaaactaccatccaaaacaatgctagagagtaatttgaacggtattacaaagttagtttagaggaggttagatgtctcatttcaatgtttaagatgctagatagacttatatcaagagtttagggggtacatggactattatgcatctttttcttgcctagaaaattagggtgtatacgcaacatttttatgatttcgtacgtttttctgacggtaattttctgtcatatgtaaaaactttgtgccaataattaatacaagcagattttcattcccttgtgaaaacttgaatacccctttttttaattgtcgtcagtgctttagatgggaacccaatttttttactgctactgctactttgaataaatgggagtaaacacaccgggaaaaaacatgtggcctggcgagacgcctggtcgatcggcacggccagctggctgttgccggaactagtcgtggagctgtgacagggagttgggagctgagctgtgtgatgaatggacgggtggtcgagtggaatggctcatggaaatcacttgggagagttcttgattcgcttcctcctcttgttgcttaggaaaagacattgaattgatcataatccttcgatctccagtactcttgcgccaagtggtttctaattaatttgtcgcttgatcgatcgcaatactgcagagcgatatatattttcatgaagtaaaaatcgattttcatgaatcgaggcctttgaccagttcgatatccgagaaaatatatatagtgcaaaccatatatgttgtggaaacaactatcgttggatcgaataataaacgtctaagattcatccacgtcatgagtaaatctatgagtaaaattttttactcgttatgacgtggacgaatctcagacgttcaatttttaattcaacggtagttttcaggttattactatagatacgttgtttccaccctatatcttccgtcgatatccgatccaatcttgataactacactagaaaggacaggcaagtgagctatagagtgggttgctgaaagttgcaagcaagcattccaacaagaggccagcccattccagtcgaaaaagctaaggggcggctagttgcgcgcgccctcctccgcgcgactggacatgtgtcgcgcgcggagaggtcggcggacggcgcgccgcgactgaggagcgatttttccctttttttggtttttttcgtttctcttccgttttttttgtttttttcatttctcttccctttttttttgtttttttcgtttctcttccgtttttggttcccctttttttaagatgtacatattacaaagtttgtattcgtgttataccaagtttgtattcatacgtatacaaactttgtattcgtatttttttctctcggtttttaatatgtacatatacaaggtttgtatacatatatgcaaagtttatataagtttatatatacgtatgtaaagtttgtatacgcgtatgcaaagtttgtacacgtgtatataaagtttgtatatgtgtatattttgtatacatcgatttttggtacacataaaaattatatatacacgtatgtatatattttgtatacatatatagaaactttatattattaatacaaaatttatacatatgtatacaataatacaaatttatatgtatgtatacaaagtatatacatgtacatatatatatatatatatacatgtagtagtagcagtagtagggcctgtttggcacagctccagctccagctccacccctcctagagctggagctcagccaaatagtttcagctccaccaaaattggaagtggagttaggtgaagctctctcacaaaatgtgctagagttgtggagctgggtttaggcagctccacaactccactccagactcaactcctggagttatatttaggagttggagctgtaccaaaacccgtagtgtatgagttatagtagtagtgtacgagtagtagtagtggatctgatggtcgcgtgcccgcgtgaccgcgcgactgatcgcgcattaggggcgccccattccagtattccactgcttggaccactccaggcactcccgtccactgggccagctcgaagtggactcaattgggacaggagaaagaaaaaagtctattttgtagtgcccgagttggaatttttctcagccggcctatacaatcggcatgtgggctgcaacactgtgctctgggcctctggaccgccgacgtgtcctcggtcctccgctcgagcggtacgaatgtacgattgggcttcaaaagccttcaagcaactcggtgtacggtaaaatttcaatgtgtaaaaaaaatatatgcattattatgtgcgtatataaaatttgtatacgtacgtattaaaaaaccaaaagaacgctacttatacaaagtttgtatatgtgctatatatataaatattagaaaacaaaaaaaggaaaaaagaaaaacctagaaaaaaaagaaaagcgagaaaaaaccgccacatgtcaccttaccacgcgccctcccgccgccagggtctcctcgcgcgccacatggctgtgccgcgcgtagggtggatagcgagtcagctcaactcgatctaaatcgttaagataattaacgagttggcttagctcgactcgttaagtagttattatcacgagctaaatacccagctcggctcgactcgttgcaaagctcgagcttgatcatttagctcgtgagccaatgcatcaaatactgacctaacaagaggaaaatagcttgcaaataaaaaactcaaatagtgtacattaagaaagaaggaaaaaaaagcagcaaatcacataaaattcgtgcagagccaaaccggctcaagctccgctacattgcttcataccacgccagaaaataggagtgctttacacaaatccagtctatgacaccctgcattaattccatttcattacatattacaacttttgtacccaagaaggagatgtgcccaagaaggagatgcacgggcgcgtggcggcaaagcggtggagatgtgggggcgcgcagtggtcgcgctctgcaatgcagctacggcgctacgctagggcggcagagggatgaagagagtggagacagaggcacgatcggatggggtgactagggttttgatctgattgatgctctattgggctcggtcttccaaaaatatagccctacgtgctatgtgactgtgggcctgtgacctgctaaggtagggttagtctagcttgttaaggctagtagctcgcgagctagctcgagttggctcattatatataacaagttaaaatgtcagctcggttcgtcagaaaaatgaaacgagtcgatccaagctaagtccatcttgtcgcgagtcgaacgagctaacgagcgacgagtttcctgtccacgcggaagaaggacgcgcagccaactgctaattagcggtttcggcgtcacagtgtcggtgggcactaatcttcaattgtcaaaacatttcccatattgcctatccaacaagggactgttgtgctagaattcttttcaatcatttcgagtcccttaattgtactctcaagcatgtactatgcttctaagtttaataaattcctggttctcaaaaaaaaaaaaaaaaaacggtttcggcgtcacagtgttggtgggcactattgcgcgtcaacctggcccggcgcgcgtggacggtcattcccgtgtcaagtcaagtcgtcgcccgctagaggcttttcttgagacgcagacagagtacgcggcaggcacctctcgaagccatcaattatttctcggcaaagcaaatcagaacgtgggtggaacaacgagctgtgaaggccaccccatcaagctacctacctcgggttattttaagcagaaaggtaagaaagccaatcacacctaaacaagaagcgtatgttagctcgtcgaaacttgtatagcctcgatcagattgcatccacgactggtgcggcaacttgtttggctccacacgatatacaagactgatgagtgatgaacatggagataaagaattctctttcaactatataacttttttttaaaaaaaatcaatgtcaataagtacatcgactggcattaaaaataataattagccaaaaaatgagcagacacggaaaggcatgtcccatcataaataacactagtacataaacaatttttccagacggcctaaacaaattttcgcgtgcgggccctgacccatctgcacccaggtatgtgcaaaaatcgtcatttttccatgtgggtgcgggcgcttaagtcacccgtctgtgaaaaaacaaaaaaaaaaccaaaccctaccctgaaaccctagatttgccaccatctagtcgccaccgccactcgaaaccctagaccgctgcctccacctaggccgtctcgtcattgtcgctatcgaggtcatcgtcgtcgcgggggagggcagccgcctctggatccgcgcatggggggactgccgtcctcagatccacgtggcgggagggccgccgatgggtgcctcctccactgttctccccgtggggaactgccgccgcctccgttgcacacctcctatgccctcccccaccgccgttgctagagctcgcgcctgtcgcacgagccatccaccgccgttgggatggagtgggggagaagaggaggaggccaggagggccgagagaggagtggaggagaagagagtgggaagaggaggacttagtaggagagagcaaggaggggagaataaaagaaaacgagtgggtcttttttcacatgcagattacttaagagaaccacatgtgaaaataggcttatttttgcatgcggtcctcttaagaagcgtatgcgaaaatgggggggtcgatttttgcagatgcgggcatttatggtatgcctgcaacctattgggatgctcgtcctagaaaacatttgtgtagtagtgtaaccaaaccaattaaattgtgctcactttggaactgtataaataccatcactagttattttattacaactatgtttatctttaattctaaagcgcacctaaatgctactatgctattttacagattcagttcatcactaggaagaaaactcaatctaacacacacctacaaaccacgcgcgggaatcaatacaacaaactgtctatagatcatcttgcaaattctatgctcaacacagctttcttctcaaggctataaactccactggttgtgcttcccatctccacaaagctcaaatcctcaagtacaagcggcggttgtgggcattgttgcacttcatcagctagtgctaggcgccggagctccgctgccaccagcaccattgtcggccttgtcatacctggaacaaccaagcattgacttgctagaacagctgcctgatgcatcactctcatactagcttcatcaaccatgtcactatcaaggagctcaaagagtgtgccctctgccattgcctcctgaaacatcaaggtgaggctcttcctatcttttgacagcggcttcttactagttagaagctcaagaagaataactccgaaactatatacatcattcttagatgtgagttggtactctagtaggtagtctggatcaatataccctggtgttcctttgggtacagcttgagtattctcatcgattgtcgagcagccaaagtcagacacctttgcgatcaatccctcagcaagtaggatattggatggtttcacatcgccgtggattatagggtgtggcaacgagtgaagatgcgcaagtgcctcggcagattctgcagcgatcctcatgcgggttccaagagttacatggaacctcttgctcctatggagatctagtaactcttgtagtgttttgttctgcacgaactcgtacacaagcatgggcgcctcaaactggaggcaacatccaagtagcttgacaatgttgggatgcctgacacggcaaagtatgaccaactcctgcacaaattccatctttctgctctcgtcgatctccttgcacttttttattgcaacattaactccgttcaaggccgccctataaacagttccctggccaccttcaccgatgatgtgttccttgttgaagttacttgtggcagtctcaatctcccctctctcatagagggtgaatccaacattaccctctactttcatcatttccagaagtagctggccaccatgctgtagaaaaaattcatgagtctgtcttaatagtgcttgtttttttatgctccttttgtggcgtatcacttcccatccaaggaaactaaagaggccaactaatacgcagataaccgctcctggataaacaaatatctgacattagtggaaatatttgagcatgtgtaggttttaacatggatgtcgaccagatatgcagcagtaaaacatagtcttaaaaaaaagagattgtaaaacatgtgcctaccaattgccagtcgtgcttttagcggcaagcggaagtcttttcggcatccatctggaatggtagcatttcctttgctgcccgctggacagttacaatcaaaaccgccaggtttattacggcattctccatagcaatgatgagtcttggaatcttgacattcatcaatatctacaaaataaaaatgacgaatttgtaagatgtggggaaaagaatttggtaatctggaaaatggaaacgtgggagaatttcaaatatgaaatgggattaatggaaaaaagtcagaatcataaacagactatgtattggaaattttataaatggaccaactaaacttatttcttaaaaatatagccggatggagtaagaaaacaaaatcatgaaagctacacgctgaaagctatttcatatgaactgtcacaattttagaattctagatgtagtattgatgggattataggaaaattcacctcgacagccgttgggtccttcgaggtaaggattgccttcgtaccctttggagcagttgcaggtgtagccaggtccgttggttgagttgaagcactcgctgttggtacttttgcacgcgtaagagtccatcttcttccatgcctcctcacaactgttggcgctccggatggcccaatcgagcaccataggcgcccggccatcataggtgttgttgaattccgatgtagtcaagtaggtggtcgagaaggtgaagttggaggagtccattagcaccgcgtagctgcagggggtgcggttgtagatccccgacgtgttcatgctgctgtcgtcgaagaaggcctggtagtaatccaggccctttgggatggccgtctggcagcagcctatcccggagcaggtgccgtttgtcgccttccacacatcacctcgccggcacacggacacgcacccgctcatgtacttccccacgtaatcctggtcggcgatgtaggcttgtgtccggcagccgacgaccgtgaacttgttggagtcggagagcatgaacggcgtgccagtcatgttgagctgccacgtgtcggagtccatctccttagaagataagttgtagcaggaagaggagatgtgattcatcacccggacctggccaagctggagggagacgctgagcacctccacatttccgtagaagggcttgtagacgccgttgccggtgtcgttgcagtcgaattcgaaggcggacgcggcgcacttgtccaagctggtgctgaatgggtaagggatctcaacgtcgccacacttggtgttctggcattgcccctctgctctcccagcgaggagctctgcagcaatcgctatggcgaggcacagcgttgttgttgttagtcctctgtggctagtcatggtggatggatgaactagctagtcctagctatctgtttgtgtcttaaacctctgtttcttgataggtgattatggacttgtgcttgtatatgaagatgagtagagccagcgttgagaatttgagatgaatccaacatggacactagacaaactttcttttaaatataagaaaaagacccaacgacttgaacaagtcttcgcttactgtatctttagtgttaattttagagtaaattttagtctggaccactttctttgccctagcttagcttgctttctggcacatgttccaaattggttaattatctactagtttatgcgggagtgtttgaagaaaactaatttgaggtagagctgctaagattttacaacgacgatcaaattatctaaaaatccaccagcacatactccttgtaattaagttatccatataaatttagaacaggtaatatagatgcacttttaactggcaaaagctaacacatggatcacagatcatcgatgcctgaatgcacactgaccatttccaacaaagacgatgatccaaagactttgccggtcaaagtcaccgttgcatctcatcttcgatcgtgactacgacgtgagacctctccacgaccacgaggctggaagtgaatatttctttcgatgtcatcacacatggctgcccatcagatcagattccatgtccacgtcgcttgcccggttaccacacaaatattgacttttgtaatgccaactttttatgtaagtacgtatgtagcgaactaactaaatacaacaaccacctccgtttctaaatatttaataccgttgactttttaaaatatatttgaccattcgtcttattaaaaagttaattattaattctttttgtatcatttagttcatcgttaaatatacttatatgcatacatatagttttacatatttcataaaagtttttgaataagacgaacgatcaaacatgtactaaaaattgacgatgtcaaatatttaaatatttagaaacggagagagtacttcacaatcatttattttaactgggagtccaccgtgcttaggtgatcttgaatacgcttcatcagctcatgtgtggccgagggactaggccccggagcaggcctagctcacgggcggcgagccggccggcaacgtcctaggctctcgcggttgtggtagttgccgccactatacactctagtccctcgccatgtctgacctcgcggcggcattgctggaacttggaaagcgctagcttgctgttgtggaattgccggtgaagggtgtggtgcaccgcggcagtggacaggtaaacaggtttgccatatcaacgccaaggtcgtgtcaactgtcaaatgcaaacatcagggggctcaattgtcttagatgcatttcctgttgagatcgatgccattaatagttttcgtctgtaattttgtacggtgtgtccaaacggacaaaattgtgggcaaatttcggttttctttatgcttggggcttggctcaatcctttgcagtctttttatgtggacggcaaattggagtgactatggctctgttcgtttcttctacaagcggaggataaaattttagatactcatgatacattttttaaacggctaaacggtacttttcgtatataaactttctatatgaaagttgctctaaaatatcatattaatctatttcttaagtttgtagtaattaaaactcaattaatcacacatcacatcgttttacgtgatccacttaatatttacctttattttcatcttcacgaaatttaaacaccacctatattcactctacatagtattctttaagccattgacacatcaaacagagatccgctgcaatagcattcaaaagtctggcagcactgagcgtgtatttttcagaatgtttcccgacaccagcagattctaaataattcgatttggtacgattcactttctgaaaaatggctggattgtttccgtagctcgaccgttttttttccttgtaccagtgaaaccccacgtgatgctgtatgagaatttattatgataataataaataaaaagatatgtaagatagctagacaatataatttgatgtggtttatgatcatttaaatttatcaaagttaaattatgagagaagaaatggggaagataatttagatcatatattagggagcgtatcctatacacacaggcccttgcgtgtacacaccgtgtagatcaactaaaaattatcacaaaaaattctagaaaaaatcatacatttacttccaatagtatttcatctacgtgcaaagtcgcatcttcaatttcattctacatagagagtaagaaaaaagacaaaattctaacagaattataaccttaaaattatcagatttttttttgttacggctaaaaattataatgaatttgaggttaagattttatgcctgggtgtaatactattgaaataacatgtatgactttttctagattttttggtgatatttgttagttggtgtgcacgtgtgtacacgtgagagcttgtgtgcataggatatgtttcccatatattaatcattaagggctaaaaacaattgaggtgaagaaaatgagggagataatttgtaccataaattagtcatctagggactgaaaaaattatgtgatatggcttagagagaggagagaaatagtagtattaactgagtgatgatgaactaaataggtatatcggatattataaaaaataatagagagttatattgaaatattatgtgaattatatgccatgatgatttaacatgcaagcattttaaagctctaaaatttaataaattataaaattatagataatataacattacttgtatgatgtttaattgtagtaattgttaatgaatgatgatgttatatctttacattttgaggttttgaatttggtgagttgtacctgctagattatgtgtcgaatatactagtcctgtttggttacagttagacttggagttgtaataggtggcgcgggggtgaaattagagtcgaactctgtaacctggcaactctcttaaatagagagcaaggcactacaatataagcatggcaactaaaatatagcatagtcacgcaggaagaggatggcggtgagaccatttactcgtaacggctaagtactatattggttgggacgagcgtacataataagagctcgggagatgtaggattcgactgaacttcgttaacaaataatatcgtgtgttcctgtatcattatctggcatgtcttagatggtcaataattggaaggttagtcgtcgttccgctatatcgtgatgtattgtagtcgcctcttgtatagtgtgtaggtgactgtatcaaggtcatcgtcaggtatggtttgagtgttctgttgtgctttacctcccgtggcattatacgctgcccttgtaccactttgttccctcttagtgatccatctagaaattttttagagcccaggaaattctaatggtaacacacatgttcatactactttatgagtcatttgtcattatgcaacaaatttttttaaacataatgcaacaaaagtaacactattgaattgtgatttgtgagaaaaaaaacatttcaagatataacttagttgggcagtaagcactcatacattccttactgatttgccatgtaacctagctagggtaatcactggtttgtctcataatttagctggggcaatcactcgttcgtttggcagagcccgagcactggcccatgatgtccaggccttggctcggccactgcaatccccctatctctaacttgggaagcacgtgtatgttccactgaaaggaaaaagtacaccgaaggtccctcaacttatcatcgagtcataaaattgtcccccaaccacaaaaccagatatctgacgtctcttaacaatcaaaaccggtcacaatagatccttcggtgattttgactcgggttttgttctacgtgacggctgagtcagcgtgagacccgtatgtcagcctcttattccttcctctctcctgccctttccacgagcgacaggcgtgcacgggaggaggctgggcaggcagctgggtggcgtcgccaggggggggggggggggggccgccactggcgagcaaggcgaagtggctagcttgggtgccttgcttgccgatgatgggttgtgatgctcttcacgaggaggctggagaactcctgcaagagctgctgcgtcgggaggagggaccttgagccgcggagatgccacgcgccctgctgcagctgccacgtcgacgccgcgcccgccggtggcgacggctggtggtggaggtggtggtggttgtgctgctgctactgctgcatcagcagcgacgtcgccgcctccggcctgtggagcgagagggacagccgccgtcgccgagcgcgcccacacccttactctgctcgtgcgcgttctccgccgtcgtcggcatgagccccctaccatctttggccgccgcggagctccgccgtgcttctcaaaggagcgtgtcgctccgccatcttggcagcttcctcttcctcaccatggcagcagcaactgctactgccgcttcgacgtcactgccgccacctccggttgctcggatgacgacgacaacggcgaggaataaatagcaggacagggtcttggattatggagaaattttcggtttttttccacccacaccacaagcactgccacaaaggtccaagagcccaaattcgacttcctgctatttggtaagctaccagttattgcaaaatgttgctctccattgatttgtgccctcgctttcatcccctttttctcactaaatgtgaaaggtccctgatcctgttcttgcgtggggaaccctgcagaccgatgacaccctgtacccactgagctcggggtctcgcgtctcatgtcaagaagaataatggaggtaagatttcgcacgccgcctctccataacatcttcttgtcttcgatctgtccaggtggatcgtgtctaaagaaaacaattttgtttgaccttcgtccatcgacatattggaggaactgctcatcttcacgcgcgcccgccgacggccacccctgggtctgtctcgtcaccgacgttgccctccgggcctgcgctgctgctggaaagcccgccgaagtggaccgtcggcagcaacacgtctccatcatcgacgccgccgccgccacgcccacacccttactcccctcgtgcgcgtgcgccgccgtcgctggcatgagcccccctcacccatctttggctgccgcagagctccgccgtgcttccccactgcggccgccgtcgcggcgtcgcccttctctcccgcctcgcccaggcgggctcctccctagccaccggctgagagaagagaagagtgagagagaggaggaagggagagagatgacgtggcatcctgacatgtggggctcacgtgggtctcacgctgactcggccaccgcgtaggataaaactggggtcaaaaccaccaaaggatcattgcgatcggttttgattaattaagagacactagatatctggttttatagttgggggacgacgttgttactcgatgacaagttgagggaccttgcgtgcactttttccccactgaaggtaccggagaaaattcttgtattccaaggcctaaaccgtgttagaatcacaggccttttaacaaccggaggatagcccattccgctgttttggtcacctcccgcacagatcatggtggattcaactttcacttcttcactaagtagccggctacgctactgtggcattgctcgcaggctgtgtagggttgttcagtttggtaccactttccaccttagcagtttttcgtattacgaaaacattgtaagctaacaaactaaatattttattgccattgataccttaccaaaatttggtatttctagaaactcatacaaacaatccaagaattggtttgacaacaaattaaacacatccaatgctaccaaaaatttgttaacgtcaaaatatgccaactttttgacgaagctaaattttagtaaggttgattttgacaccaaactaaacaagcccatatagcccgtggggccgcttcgcatgtgggcagctataccatctagctagtcgtgcactcatactgcttccagtcagttagcgtaagggtagcaggcgacgacatcctcgaattgccactactacaaaataggtatcacctctgttggttcatttaaaacctatacttattagctattaacatttaattctcaccttatcaagataaaaaaaataaaactgacatgtttgagcaacaaggtgccggttagataaaaattggcacggttcttataaatcgaacagctacaaaaagaaaagaaaaatctgaggagccgagccgagcaaaaaccttatcgaagaggtggagggtggccttgggctgtgtccacggatagcaatggtggcctgtcccgagtgaccccgaccccggcgacggccagaagatctcctcgacaactggctcaggggggcagcctgatccggcctccacctgctcgtggaggcgtcgagatttgacaggtcacagctaggaagtggcaagcgattcctcggcaagcgatgtcacatcccctaccatgattggtgcatttaatttggttttttagacttgtccatttttattgaatgtttgattaggcgttatgaacttgttgatgaatgcttgattctgtgatccgtaatgtgaagttattgattctctttaattttttttggattttttaattcgattttggtggctttgaagcttcagctgagccgagctggctagtttttttcaaaccgtacaccccatacgtaccggttgggaaatcgaaatctacgaagagttcccaaacatatatatttcgggtattatagtactgcttgcggcaacatcttctccaaaaatgagtaataagtgattttctttatcttcccattaatcaggtctctttcccttatttgccgattttttaattaataataaataatattctttacattaaattattagtaattagaggataacatttaccaaagtaaggtggacgttactagaaacagcgtcaagatgtgtgcgctattacaattaacgtacaaatgtggacaccaattggatcgacgtccaggttggtgcggtcataacctggtgctgttcgttgtgattcggaaaaaagaaaaaagaaaaatcccccaacactaggtcatcttcggacaaatccttggaagcaggctgaagttctctcttaccgttaaaaatattcttctttcttctaaatgcgtgacgtagcgggagccacctccgatgacccatgtataccatctttcgtgatttcttcagccaccggcttcgtgtatgttccttgcagtcgaagatgccttttttccttttatagtttgttcggaaagattaccgagtgcagggtaatcattaatggtgcagaacaatagaactcttagcttgaagttctcctgaccatatgcatcccaagttttcacaccttctttctaaagaatctcaagatcattgataacaggctccgggaatacatcgatatctttgccgggttgccttggaccttggattaacaagcacaacataatatatttccgtttaaagcacaaccatggcgggaggttatacttcgcaataagaactagccaagtgctgtgagtactactcatgtaaccgaaatgattcatgccatccgtacacagacatatccaaatgtttctagggtcggcagctaagtccttgtgttttccatcgatattcctccattcaatcgaatccgctaggtgtctaagcataccgtcattccttctctccgtggcgtgccaacgtactaacttcgcttcgttggggttggcagagattctcttgaaatgatcaatgatagttagataccgcacaacctttgccggaccaccactctttgacttctttgcttcgtcagcactttctcttcgcttgtatcgagaagccttgcagataggacaagcatctaagtccgcatattgcttgtggtacaatatgcagtcgtttggacaagcgttaattctacggacctctaaccccagtggacatagaatctgctttacttcgtatgtcgtcttgggcaatgtgttctcaacaagaagcatagtcttcaaaattcctaaaagatctatgaaactcttgtctgtccatccactacttgccttcaacttcattaggttcaaggtcgctgacaactttgtgtgttttgctttgcatccggcgtacagaagcgtctcggaatcactgaccaacctgctaaacttcatgaaatctctctcattctgggctgggtcttcaacgtcacgtaacatgtcttgtagcagatcgtgatccacatttcaccgcccaatggagaaggtataaacatgtcatgctcatcttcatcttcctgattatgcgcaccacttctgtctgttgctgcaccacttcctgattcttgctctccatgcttcacccaacatgtatagtccttcatgaatcctcgttgtatcagatgatcgtgtacaacctcttcgctatcaaacatattctcattcttgcaatctgcacatggacaacgcatgtaatcattgtttcttcttttcctatcctcctctgcggcgttcataaattttattacgccatttctgtactccggaaaatgacgtttcacagttgtcgcatacatccaacttcgatccattgctacaaaataaaaaaataaattagaggcacatattataatatcagtattgctaaagtaagttatgatgaaattgctgaattcatcattagtattactcacttgagtgctccattttgatcacttttggtaatgttctgttttccttggaaaaaagacaaaaaatcgccctctatagcctcccaccaaaatagtgaacagtagtatacaattacactaggtggtggggggtatttatactgtgcaacaaatatttgtaagggccctaaaacaattaaccgtgacgggcatagaagtaatctctatctggccttaataaaagcccgtcaaataagagagtcatctgtgacgggcattaaacttatctcaatcggccctctagttgaagcccgtcacagatgacggtcatctgtgatgggcttcctttagggcccgattaagatattgaaccatcatctcaatcgggcctcaactatggcccgtcacacataagtgtcattcgtgacgggctctagttttatgccgatctagctgtctgtgtgcccgattgagattacttctttgtgacggcccacaaatttcaggcatgttaggggccgtcacagatgaaagaatctgtactagtataaaaatgttaatgaacaataatcattttatttcctggctgtgtcttccaaacgaactcaccaattaacaaaggcaggttatatgtctactagttgaataataatctatacatatatatatatatatatattcaataaaacactcatgtcatatatcaagtaggtatgaacaatgtattacatatcaattaatgctaattagatgagtgtgagcagagacatgctataagtgaaaagacatgcatgcgtgatataaattgcagggcaaacctgttgcctcacgacgagagatgccaatgcacacggtgccgtggccggattgcaggattggtggcgccgtaaaacacagacaaatcgaaggcaccggcgtcgacggcgagagtggcttggacgtacgacgaagcggatggatcaaagtcgtagagagggcaaactcgtatacgatttacgacggtgtgtggccggctgccggcatgcgcgatcagcgctcatcgcgacagttaggttttcttttcattgtcagggttttcttttgattgttctcgctctattcgtggcttggctgcaccagggaggtggacgctgtttccaacaccgtccaagtatggacgttgtttaaaacggcatccagtagttctagacgttttctgtagtgacgtccatcctactcctgtaaatcccccctacgatttactaattgtttaatttaagggtaattatttattataaataaaaaattcagccttatttgccccgataaaattcacttttgcacttatattatgcatcatcaaattttatgttttattgaccttttccagtaggcttatttaacacatataccgttagtagatgggtgaaaagtcatttttgtccttgagtatcatttttgcacgtgatttgctgtctatttctcccaatcacatagcgagcacgccgtgtggctttccatgccctggtcagctgcaagtatcgtgcaagtatcctgctttggcgcgatccgtcgcaacaccgctttggcccggtgcgcactgtcagtgtgtcaccttcatgcgtcagaacttgctgtgcaggacttttttcttttttaatgattgtcgtgattaatattttgtaacgaataattggttttgtaaatgatttatttgatgaaattggtttgagaatatgcgtggatgttggtgtgagtgcgtataacttgttgacgtcaccaccacaccgaggcaactcaccagaactccagattcaaccgatggtgccacctccacagccaccatttgaaccgcggtgatgggagaaagaagaacccgtcaccaccgtccttgcgcccatgggaacttcggcgacattctcgggtgaaagaaacataaagcaggagccaagaagtcaaagagttgatgcggcaattaccactactagttgtttcattacatttctgccaaaccatcagtagttctacagtacactaaatgatttattgtgtttacaggttcttatattctcattcctcacaacaaatacatccaaaatagagaacaacactcaatatacaaaaacctacaaatgacacaacgaagacaatcaagatagatctactgatcatctagcgaatgttgtgcttaacacggccttattatcaaggctgtaaatcccactggtgcttcccgtatccagaaagctcaactcctcaagcaccagtggtggctgcgggtatcgctgcaattcatctgctagcgcaagccgccagagctcctccaccactaaagccattgacggtctcgttgtacctggaacaaccaaacactgacttgccagcactgcaactcgatggattactctcatgctagcttcatcgactatgtcactgtcaaggaggtcctggagtgtgccatttaccatagcctcctgaaacatcaaggtcaagctcttcctttcttttgagaatggcttcttaccagttaaaagctcaagaagaataacaccgaagctatatacgtcattcttggctgtgagttgatactcgagtaggtagtctggatcaatataccctggcgtgccttttggcacagccggagtactctcatcaattgttgagcagccaaagtccgacacctttgcgaccaatccctcagccagtaggatgttggccggcttcacatcaccatggagtatagggtgcgacaatgagtgcagatgcgcaaatgccccggcagattccgcagcaattcttaggcgggttcctagtgtgacatggaacctcgtgctcctttggagatccaacaactctttcagtgttttgttttgcacaaactcgtacacaagcatgggtgcctcaaactgcaggcaacaaccgagcaacttgacaatgttgggatggttgacacggcaaagtatgaccagttcctgcacaaattccatcttcctgttctcgtcaatctccttgcacattttaattgcgacggcgattccacccaataccgccctataaacagttccctgccctccttccccaatgatgttcgctttgttgaagttatttgtggcagtctcaatctcttgtctaccgtagagtgtaaaccctgcattgccctctactttcatcatttctagcaatagctgtcctccgtgctgttgaaaaaactcatcgttttgtcttaataaagcttgtctttttatgctccttttgtgccgtatcacttcccatccaaggaaaccgaagaggatagataatatgcaggcaacaacaccttgagagataatgttttttcattagtgaaaaggtttatcaaggtactatttcaacatctgtgtgtctatacctgatcgagcatatcataatatgaggcaacacggtattggagtaagtacgtaccaattgcaactcgtgcctttcgcgttaagaagtttttttggcaccctcctggaatagtggcatttcctcgtgtaccatcacgacagaaacaatcaaatccgccgtctttattgtggcattctccatagcacgggtaactctcaggatgttcacattcattaatatctgcaatcaaatataaaccttttatagaaatatttataacgtgatgatatgcaccccgcaaaaaaaaaagtgatgatatgcacacaaattaaaggacaaagctacatggaaaaaaaagttggtttataaaaggcatgctaactataggaaattatacttggcgactatgcatgccgagacgacatgactttcatggagttcattttaatttttttatggtattaacagcactctgtactttaaaaataacaagaagcagcagcaacgcgcattcacatagttgagaggctaaagtacatagaaacacattggatccgaggtagagatggcaacagggaattcaccgtcggggaatgcatcgccatccctgcgataaaacaacggggaaactttgttcccatccccaccccgcacaggaaataaatccccgcaggatattcgtccccgcttaaagcaatatacacatgtcaaattatatatgcaatgcaacgtatatacgcactttatattaatatatcaacatatatctagaaatattatatactatttcacacgataaaaacatatgattatcatttatcaaatataataattaatataatcacattaaacttggatacctatgtggagctccacggggagtggggacaaggaatgaagaaccatccccaccctcgtgaaaaccgacggggacaagcctcctcccctttatgtccccatgaagaaccaattctaaccatgcctgctcctaatgggtgaattcaccacggaaaatggggccattgtcatctctaatctgaggagaaatgcagatgggtaaataagcagtgtgctatgctattttttaaagcctacgtccctctaataactaaaatgtggactcgtagcagaaggcattagttcattttagaacggagggtgtataccagaagtgggttcattaattgtatagatgtgtccgttaaatattgagagaaaaaagatagctgtttatacactctattgcaatacatgacaactctatattatacttactgtcaggaaatacctataattatttaaaacttgtagctttgatgagaataaatctataggcatattttaccttcacaaccatttgagccttgaaggtaaggattgccatggtatcctttggagcagttgcacatgtaggctgattttgctccactggaataattgaggcacacgctatggtcgcttttgcacgcgtacgatgtgagatttttctgcgcttccacgcagtctcggggaccccagatagcccagtcaaacttcaccggcgctcggccactgtaggtgttgttaaactctagcagagaagtcaagttgctggttgagaaagtgaaattcgagtagtccattatcgctgcatagctgcagggggtgtgttcgtagattcccgatgtgttcatgctctccccgaacgacaccttgcagaattccatgcctctggggatggttatctggcaacatcctatcctggagcaggttctgttggtggcgctcaccactttaccacccgggcaggaggacgcgcagccgctcgtgtagttgctggttgggtcggaaatgtaggccaatgactggcacccgacgaccgtgaacttgttggagtccgacagcatgaaaggtgtgtatgacaggttgaacccccacccgctggagtacatcctcttagagaaggggttgtagcaagaagaagatatgggggtgctcaccctgatctgaccaagctggagggagatgctgaggacctccacatctcggtagaatggttttttgttgttgcagtcgatattgtaaaaaggcaatgcacagtcgccgtcagatccgatgccaaaagggtaagggatgtctatgccgccgcaggtgtgcaggcattgcgcctctgcgccgccggcgagcaacgccgccccagcaacagctatggccgtgagacatgatattgttagctcaccataggaagccatggaagtatgaacttatttgtcgatgtgtttctcttctgatcgtacgcgtacttgtgcaccttagtccgacgaattaatgctagtatatacttcctccgtcccaaaataaagccatttttgaggttggcacgagtattaagaaagtaggtgagaatgattggaggaagtgtgtgattggttgaaaagagaaagtaggtgaagaaaaatggttgtgattggttgagaggaggaggtaggtgaagaaatagcttcattttgggacaaaacactgtgctagaaatagctacattttgggacggagggagtatatgaagaggagcggagcctgatggatcttacttggactgttggacactagccagccataaattttaaataaacgaaaaggacccaacggcttgaatgcaactcaacaaagtcttcgcactaccatttcccctaatatatatttatttatattcattgggcacttctcggttgctttcataattagaaaaaaaaattcatcgattagatgaatcatatatctttttgaacacatagatcgtatcgtatcgagagtttgtgttaaacaaaacatgccatacgagataccatggactcactaatttagtttctagaattcaaaattaatgtggtattaacaaattgaaatatttttttagcaaattgtaagagatagacccttcttaagaaataaatttaatgtcatattaatctctatttctatctttacttctttatctttatctctatctctatcactactacttaaaacattcaaaagtttctgtcatcggtcgtggacccatgtgagttgagatgaaattaataattagcgagttgtaatataaatggattctaattttagtatgaactgccccgcagaaaaaaattagtatgaactgttgttgtttaaataactagctgtgtggcccgcgcaattgcgcggctagcaccaaaaacaaaatcatatattttttagtatgattttacttcaaatttattaaatggctatatcattatcttaagactttgaaagagcaaaccttatcatcctcgtgtttctaattataaagtttttaaaagtcaccctggttgctaccccttatgtcatctccatatttatttgcttgctcgatctaccactatttctattcattcttcttggaacctttaaaaatgggattttatagtttttagtgtttattgtcacgttgggtttcatttttataatttatagatgtcccgtcaaacattgccattatactcctatacggtccgttcactatctcttctatttattgtcattgagattttgaaaattgaacataattatcgtttgggttcatttttactttctacaagtcccgccaaaccgtcagcggctttgccattctactcctctacggttcgcccgctgcctcccttctttattgtcattgagattttaaaatagaacatgattatcattggtttttttctttttagaagtttcagacctttaaaaattggacttgtagttctattttttataatttttagaagtctcgtcaaacaatgccattatgctcctctacggcccgtccgccgcctattctttattgtcattgtgattctaaaaatctaacataactatcattggaattcatttttcattttgtggaagtcccgtcaactgtcagcggctctgcaactatactcctatacaccccgcccgctgcttctcctttttattgtcattgagattttaaaaatcaaatatgattatcaatggggtttacattctagaagtcccagcaaccgccttactcgtttgcttcacggcctgcctgacgtccctccttttaatcgtcattaggattctatttggtgttttattaacaatttttatatgtcgtatcaaccgccaccactctactcttttataggcctattacttaatttatctcgtcatgtgttttagatggtcttttctttcaatattctctatttttatcacaagttttagttatttataaattgtattcataattgaaatcttatttttctttttctaatttcagaatttttttaaaaaattttagttaatacgtttttctaatgtttttattttttattttcaatttcagttgtttcaaaatggtattcctacttgaattctcttttagtttttctaatttggaattatttttaatttttaattctaaatttaaattaatctcgtattggttcttatatgaatttttctttcaatattacttatttttaattccgaatttcagctaattttaaattttattcctacttgaactcttattttattttcttttgctaatttcggatttatttttatttttattccgaattttaacggatcccgtatttgattcttatatggattttttttaatattgcttattattaattctgtatttcagctatttttaaattatattcctacttggaccctccttttcttttctaattttggattttattttatattaatttcgaattttgattaatctcgtattggattctcatatgggaacttctttcaatattgcttatttttaatttcaaatttcagctattttaaaattgtatttctacttggactctcgtttccttttctaattttggattttattttatttttattttgaattttgattaatctcatattgggttcttatatggaaaattctttcaatattgcttatttttaattccaaattttagctatttttaaattgtacttctacttggactcttcttttcttttttttatttttctccgattaatgtgggaatttttagccccacagcgaacgtggtgcctcttttcaaagctgttttaataatataatagatagatacatagatagcaataataatagctggcacgggttgacgaacaatgtttgtaatttggttattagttattgagtttacaactgggtttaggaatacacattctagtggatgcgcatacgttgttttacacgatcatgccaaaggtaatatatggtttgacgagaagaaaaatccctaaatcctacattgattatcttcacgtgagagctctagttgtttgtgataggatcctcacttgggcgagatcagctacaggaagtaactattaaagcaagaaagaagctgtgttagctaggagtatatatataaaacatacatatggaatttcactactggtatattacgttcatactgtgctgaaattttgtatacatataaacgcttggtagcgcgtggaaaacccaacgaaagattatggcataacgaatactgccataatcaaaaaatctctaccacatactccatgtataaacaaagcaaagtatacatctcgcacgaatatacataatactacttcctttgtttcacaatgtatgactttctagcatggctcatacactactgcaaaagtgttttttctgtacgagacccccatgatttttgcaaacggaccataactagtggcatctgcaaaaatcgagcggcagtttcgcatatggctgcttaagacgcccgtatgaaaaaatcgatttttccataggaactcataagaggtccggacgtaaaaatgaggtcatttttgcatatggctcacttaagcgcctgcatggaaaaatcaatttttccatacgggcgtgttaagtagccgtctgcggaaataaaatttgaaaaaaattgaaactagattatctcactcatatgaacctaaattggatgattcttttcccttaatgtttctaaaatcatactctgtcatgttattgtgttcttacttctattattttgggcactttttgtagtgactttgttttatcaattaaaaatttgaattttaaaacttcaaatactattttgaaggagtaaatgatttcagcggaaaaagtcatcaacaacaaagttgtataactcatcaagatctataacttctattttggtcatttcttcatccgataaagtgatggtaaaattttcacaaaatttacatatctctcttatagtttataaaactatataagagatatgtatattctgtgaacaatgttacaaatcattttatcggatgaaaaaaatgaccaaaagaaaagttacagatcttgatgagttataccactttgttattgatgactttttcagttcaaatcatttactatttgaatatgttgtttaaagttgtcataatttaaaattcaaaatcaaactgttgaaacaaagtcatatagaaaaatgaccaaaacaaaagttgtagatcttgatgcattttacaactttgttgttgacaattttttttatctgaaaatatttactactcgaaaaattatttgaaattcttatattttaaaattcatattttatatagttcaatcaaattcaaatggagaaataacctaaagaaaaatggtagatctcaatgagttctacaactttgtttttaacaacattttcataagaattaatttagtgccataaatttgatttaaaaattaaaaaactaatttttgcatgcggatccttaagtggtccgcatgtaaaaatgaagtcggctctttccctctccacagttcaaaagttttcaaccccaaccttatccttacgccaaccacaaccctctctactgagtctctctctcacacacacttatctcctctctctctctctcacggcatagagcagacggggcagaggcgcagggcggaggtggggatggggcagaggcgggcgccggcagccgagagcggcgcgtcgcgtggcgggcggcggccacgtcatccccatcgctcgggctgccccctccgcggtggcgaccctgacgacgacaaggaggggttgaccccgacgacgacgacgacacaagtgggggcagctggggcgaccccgacgacgatgacgagtgggcggcgacacgggccttgtcccgctcggatccggcggcgatggacctcatcctgcctggatctggcggtggcgggccttgtcccgcccagatccggaggcgagagcggccggcggcggaactggggcgtcgtcggcgggtgcggccggcggtaggagcgggggcggtggtgacgggcctcatcccgcccagatcaggaggcgggcgcgtctggcgggatcgggcggcggtggcgccgcttgcggctagggttgttgtttttgaaatttttttccctattttttctctttgcatgcgatcggcgtaagcgcccgtatgtgaaaattggattttcgcttgcgggtgccctggccgcatggaaagatgacgatctttgcagacgatttcgcgtatgcggatggcccaaccagatgcgaaaatcgtgttcgcccatttgcaaaaactcattctgtagtagtgctatttatatagacgttaatgaatctagacaaatatggcaatgctagaaagtcttacttcgtgaaacggggaatactagttatgttatacatcaattcatcgcaagtaattaattaagacgcgcttttaactgcgaaaagtataatattagtgtcgatcatccatgcgtgcatgaacagtgctacgtttctgtatggcacactgaccattttcaacaatttggtccaaagacctgcgaccggtcaaagtcgcttttgcatcttaatttgatcagtatgcatgcatcttcttgtagcaactgttgaaatgttccattgtacgaaaattttgtgggatattaacaatgtcttggtaaaagtgccttccataatttagtaggtaaaacaaacaacatagcttgtatactgcactttaaataattaattatgacaggtcgtatgcacaataaaagaaaaataattacaggtcgtatgcacaatcaaagaaaaataattatacatgtcgtatgcacatgcaatcaaagaaaaaatagaacgcaagactatgtcatcgatagtggaatatatattttggatcgaagaatcatctaatgacggcatacgaccgagtaagcacaaggattaatatatgcattgttggaaacacggtggtgatcagtgatggttaccgttgcttgaaataacttattgttataccccgtagaccaatagtttacagaatactactctagtttggatggatggatcgatgttgatggaatcaacttaatgaggcccatagacaattcgacactcaatgttgaaatagggccgggacttcagactttggtgcaataattcacgagatcggaattggatgatgcagaagtatagccaatgaggttgatctgagcaagacggttcaagttgtctttttggttgcatgatggaacgtgcatccatttgttcaattacaagtttacgtggctatattacatggaatggttaattggattcttgcatgtgtgtaaatttgcttgttttgaaaaatatcattagtatttgtataactagctgggtggcccgcgcaattgcgcggctagcacccaaacaaaatcatatattttttaatatgattttacttaaaatttattaaatagctatctcattatcttaagactttaaaagaccaaaccttatcatcctcgtgtttctaattatatagtttttaaaagtcacaccagtcgctactccttatgtcatctcatttatttgcttactcgatctatcactatttctatttattcttcttggaacctttaaaaattagattttatagtttttagagtttattgtcatgttggatttcgtttatatattttctagatgtcccgtcaattgttgccattatactcctctatggcccgtccaccgtctcttctctttactgtcattgagattttaaaaatcgaacatgattatcgtttgtgttcatttttactttctagaagtcccgccaaacagtctgcggctttaccattgtactcctctacagctcgcgcgctgcctcccttctttattgtcattgagattttaaaatcaaacatgattataattgttttttttactttttagaagttctgaacctttaaaaattggacttgtagttttattttttataatttttagaagtctcatcaaacgatgccactgtgcccctgtacaacccgtccgccacttactcttcattgtcattgtgattctaaaaatcaaacataactatcgttggaattcattttatttattttctagaagtcccgtcaaccgtcggctaattttggattcttatatggattcttctttcaatattgtttatttttaattccgaatttcagctaattttaaattgtattcctacttgaactcttattttattttcttttgctaatttcggattcatttttatttttattctgaattttaattaatctcgtattgcgttcttatacggactcttcttttaatattccttatttttaattccgaatttcagctatttttagattgtattcatacttgggatctcctttccttttctaattttggattttattttatttttattccgaattttaattaatttcatattggcttcttatatggactcttcttttaatattcattatttttaattccgaatttcagctatttttagattgtattcatacttgggctctcctttccttttctaattttggattttattttgtttttatttcgaatttttattaatctcgtattgggttcttatatggaaacttatttcattattgtttatttttaattgtgaattttagctatttttaaattgtattcttatctggactctcctttgcttttctaattttagattttattttatttttatttcgaaatttggttaatctcgcttatttttaattttgaatttcagctatttttaaattgtattcttacttggactctcctttccttttctaattttagagtttattttatttttgtttcgaattttggttaatctcatattggattcttatatggaaacttctttcaatatttcttatttttaattccgaattcagctatttttaaattgtattcttacttggactctcctttccttttctaattttagattttattttatttttatttcgatttatggttaatctcgtattgggttcttatatatatggaaacttctttcaatattacttatttttagttccgaatttcagctatttttatattgtacttctacttggactctccttttcttttttttttctttttctccgattaatgtgggatttactagccctcacagcgaacgtggtgcctcctttcaaagttgttttaataatataatagatagattggaacgatatgccacttcaacattataaaagctggatccataccatgatatgtataacctgatacgccatatgaatcattttttttgtctactgtgtattttcgtagggatcaaaataccccggctgaccttcttaaccctagccccaaatcgatcccaaaatcttgcccaatgcaggagcccagcattagctgcaatggatgttaagcaagctgcagcagctgtaggatcgaacacaagtaatcaagcataccagagagggggtgaatggtagattatttcaacgcaagtcaaatatccaaatcttgatagatcaaaacacgccacatcctcaaaaaccaatggaacacacgtccgatggtctatcctacctattaggatcggtctgaacacaggtcctctcgcggtcgaaccgtcagcctaggaataaactagacaaaccaaggaacaactccaccggagggatttgcaaactgataaacggtttaagagaaaataccctcaaaagccagctgtctcagaatttcagtaaatctgaacaaaccctaaaacttaagcaaagtcgaatctaacaagaatcaatcaacgaaactttgcagatttgatctatgaagtattataaaggttttggatggattaacttgaacaaaattgcagcaaaacaaagactcacaagttaatgccaaaaccgaacaataatgtaaaacttaagaaaccagaagagatcgtcgatgccttgatgattgaatatgttctttattactcaagtattgttcacagggtgcagccacagcacgttagcacccctcacaagtttctcacgaaaccctatctaatctctcaaacatggttttactcaaggcatagtctccctccctatttataccgaatatctcctgctcaaagtaggacaatatcaaaactcatccaacatgaatccaatccatatcccagtcgggctctacctttgatcgatctgctacacgtcatcagaaccgatcgaccttgccatccaatccatggcgcataagcctagactaaaacacgcactaaaccagcaacaaaaacttaaactaggactaaaactcaacactacagactctgaaaaagaattatgcaaaggctaaacactgtctgggatgggaagaaactaatgactacacttgttttttggcttttctgtagactctaggattacggcgaaaacaaaaactaatttagtataacctggagctctaataccacttgatgtggatgtagggtacccgatcttccgaaatgttgtgataaacagtcgatttggtggagtcgcgacacaaattgatccggcttctgaatgaacacgctcttgagccccgtaatcgcagcaccacgtctcctctggttatcaaccgtgtcgaaacccggttggcctcgctgagaaggctaatccctaattgcaaatcgaagaacacacaccagaacaagaaagaatacaaccaaattgtatatgaatgattaagctcacaagttgaggtcttacaaaccgaaggatcgatgaaactgttcttaacatattaatgtaagcaaaacccaaaccctaaaggtggaggctgctactaatatataaagtttagggtcgtgcaaaccctaatgggctccaacacgatacgcggccgaaaggcaaaaatacggcggcgcagtaccggaacagattctggacgttaacttgctcgctcgattcccgatgactaggaaagaatttgaatatgggactagaaccattggaaaggttattttcttagctttccatctgcataaagaacgccccaatccaagcatgaatgcgacctgggcgcccattttagtgcatactggtcctcgactccgaaacgtactcgaaatcgacttggtttgggcctccatcttgacttcgaaacatgcactttttgttttggcaaagacatgtccttatgggtttaaccgtttggcttgacctacaatcgagatggctctgatgtcaacttgtcacgcccaaaaattcataagtaattttcaaactaatttgtgcattaaatcctcgtccaggaatcaaccgaggtacacaaactgacaacttaatatacagattcatcataataactaatgcgataaatacttacataagaggtacttagttattaccacggagaaaactacagcagaacataaaatctagcaaagtttcaacactactcccacaagcagctcaactgggatttaagccaaaggtcttctccttctggatcctctttcttcaaccgaggtttgattgattattgcaaggtgagtacatggaatactccgcaagccacacgacaagtatgcaagtacatatggataccaaaggatggcataatatagggttcatttgtgaaagcagcatttagcaaagagttaagtatttgtaaaatagtacagcaattaattaaacattattaatccaacgctatacaacatactcgttgcataggcccaaccaaaccacctgtactaactcagttcaatatgtcaaattattaaggtgagaataatcacggtgagctggttgaccgcccataaccgcgggcatggatattcgaatagttttactttgatcagaggtgtacaactttacccacaagacacagcctcacaacacgttaccaagcgccaacatgccaccacgacatacaggaaagagactgtgacagaaccttttgtataacccttcctaaccaatcatacacacctcaggtttcacccccactcctcaaaaggcagcgggcatccccctcttgtgcctaggtgaatccggaagcagcatagaccgcagcacggaacatccatactccatcacgtccatccttgccttggtacattggctaggttaagctacactccaagtttagcctagagcccatgcaggtatgtggtaagtacaggtatatcttccagagatttcgagaatcggacgttaattgttatggttgtgactatcaaaccatgcacccacaacccaccatttaagcgtatttagtttaattaaatcaataccataacggtacatcatgatataattaaggactgaattagagtgaatcccatagtgtgctaatgtttctaagcatggctaagcaattatatctaatatctagctgaacaaatatgtaaggcccaagctagtcaaattataacccgtaggaaaataaagtcatcttatgccttaatatagggaaaaggctcacatcccgatgacatttgaaaataaatgcacatttgaatgaaatggagaatttaaatataggttcaatatactcaaaggattgtgtttaggatctgtgtgacttgctttgcaaacaagcgtcttcaattcgtcttcaggaacttctccaatggatgaacgagcctccgaaacgactgaaaactaaacctagaacgcaaaacgaggtaaaacactaataaaaaccaaataaacagtacaatgaaagttcataaataggtagatcttgagacttgaacgaccttattccaagttcatatgaattagttatgaattaatgaagttttaatcaattaaaacctataaagaaaacaactaagtaatttatgacatcatatttaattattttagaagtgataaaggaggaatatgacgtcagccctaggaagagagaaaaagggctagtgtcagatgggacccactcgtcatagatacaagcggtagactgggtctaccatgaaccaagtccacaaagatagttcacgggtccacgggatggatggctaggattgctttgacaggcctttgaccacgatctgacaggtgagatcaaatccaatatagcgtttaggatagcggccacgtggtgacacgtgtcgctggcgcagatgccatgtggatagaacgacaacgtggcaatgcggtggcggctaacagggcgatgacgtgacagccacgctggatcgacgccggtggctctggacagcggtggcggtggcgacggcgaacagcggcacgacgacggaagcctatagaatggggaggaagaggaggacacggcgatgcttaccaacacttacagcggcggtgaggttcgggatgatgacgacaccagcgttccagcgaactccggcggaggagaaggggtggacgggcttcccggggtccttgtgatgccaaaggacgagacgacaaggtctggcgaccatggagtccacggtgggtggtggctagagatcgaaacacggcggcgacccactggttcatggcgacgaaagcttccggcggggtttcggcgcaaaggaaccggcggccagggtggagctcggccttgcggagccgagggaggcgaaggcgcaagcccgcgttgaccagaggggcggcgcggcgtggctggagttggcggcgatggtggagagagagggcgagctgagggagaggcgactagggcacggcagcatgggaaaagaggggaaaaacgaagaggagacctgggtcatcctttatataggcggaggaggaagagatcgatgcgcattcgagaggaaacggcggcggaaatttagagtttatcccgagttcgtcgggataagaaccgagacgaaattcgagggcacgggacgggaggccggctgaaggaggaagacggcactgtgccgggtgggccccttgcgtcagagggaatggaggaagaagctaaagcagtcttcggccgagagagaggggctgcgggccaaggatgggagagaggagaggcgtgggccgaattcggcccaagactagggagaggatttcaattaacttttattttaaataattgctgaaatgatgtttcatttgttaaaaatacttccaatgctcaaataattccgggaaaaatccggaaaatacttggacactcaaattatttaataaaattttatctagctcaatttaatgttaaaatttttcatagattttattcaaacacttactttatttattaaataatttctaaaaatttcctttttcacaacaatttataatttagcgatttttagggtgtgacagttgaaaagcaggttgtgccttactttcttctgttaacctgtatagcttctccccataaagagattctcaacttttagcaatacgagaaggaatccattggttaatggtaacgtcccgccttcccccaggccgggcccacttacatctgatagcttttataggtcacagactgccctcacagaccaacacatgtcttttctgcacactttatcctcacttgtgcgcacccgggaagaatttcccggtcggtcacccatcccaaattgctccaggttaagcgtgcacactttgtcctcactcgtgcgcacccgggaagaatttcccggtcggtcacccatcccaaattgctccaggccaagcacgcttaaccctggagttctttggaaatcggtttcctgaaaagaagttgcaacttgttgatatgagtattctagtaatcctattaagccctaggctgggatgttacatcctcacccccttaagagagatcgacgcccccgtcgatcaaccccaggccaggaacgtcccctcttggccacgtccgtgtgtccagtgccagcgcatgtgccatgctgtgtgaccactccggatccacaccagccatgcgcaactgcgacacacacgcccgtgaaaccgcgagagaccatgcgcaactgcgacacacacgcccgtgaaaccgcgagagtcggctctgataccattttgtaacgtcccgccttcccccaggccgggcccacttacatctgatagctttcataggttacagactgccctcacagaccaacacatgtcttttctgcacactttgtcctcactcatgcgcacccgggaagaatttcccggtcggtcacccatgccaaattgctccaggccaagcacgcttaaccctggagttctttggaaatcggcttccggaaaagaagttgcaactatgagtattctagtaatcctattaagccctaggctaggatgttacattaactctagccggatatatattgaaaacgggatgtagtatatctcatgcgtccaaggtctgttttcctactctcatcaaatctttttcaccaattgattgcaacaggattgttgtcttcacactggacgatctagacctcgactcataatagcaaactcaaactttgtgcagataatttcgttttgatctatgactaccactacttgtgtttgatgcacttgaattattatatattgtgaaacatgattgtttcacttgttcctcacaatgcatggttacagccgcacacattgggaagcccgtcaaccaccacaactgggaagaattaactcataatctaacacagagataaaacaacacaactcataatctaacacagataaaacaacacattgtaacactcaataaagcacaaggggtctatggatcatctagcgaattctgtgcttagaacgacattgttctcaaggttataaaccccgcttgttccacttcctgtgtaccatgatgatgttgtgctccccatctctgtgaggatgaggccatcgagcactagcggcggttgtgggcattgttgtacttcatctgccaatgctagtcgtcgaagctgctccgccacttgcctcattgttggccttgatgaacttggattagccaagcattgactagctagtgatgctgcctgacagataactcccatgttggcttcatctactatgtcactgtccaggagctcaacgagtttgccactttccattgccccttgaaatattgggatcaagctcgtccgttcttttgaaagtggcttcttacccgttaggagctcaagaagaatgaccccaaagctgtatacatcattcttggctgtgagctggtactcaagtagatagtctgggtcgagatatcccggtgtaccttttacaacagcttgggttttctcatcaatcgttgagcaaccaaagtcagacacctttgcaaccaatccttcagcaagaagtatgttggctggcttcacgtcgccgtggagtattgggcgcggcagtgagtggagatgtgcaagtgcattggcggattctgcagcaatccttaagcgggtcgccagtgtgacgtggaacttcctactcctttggaggtccagtagctcttgcagtgtcttgttctgcacgaactcatagattagcatgggggcctcgaactgcaggcagcagccgactagtttgacgatatttgggtggttgacacgacagagtatgaccagctcctgcacgaagtcggctcttctgctctcatcaacctcgttgcacctctttatcgcaacagtggtgccgtcgaggacagccttgtaaacggtcccctgccctcctttgccaacaatgttctccttggcgaaattgtttgtggctacctcgatcttctctctgtcgtagagggtgaactcagcgctgctctctactttcatcagttctagtaagatctgtcctccgtgttgttgaaaatacatgtcagtctgtctctgcagagcttgtcttttgatacttcgtttgtgctggatcacttctcgtacaagaaaaacaacgaggccaacgatagcaaaaccggaaattcctgcagaaatgaatatttgtaaaggagactaaaggttgaattgaaacaagtgcttcagcactgcatatacagatactgtttatcttaagaaaaaactttcaaaattaaactgcatgcttgtgtactgtacatcctaaatgcaaaggcggggatgcaatcatcttcctattccaaataaataagttaattacaggtcgacatcatgtaacggactaacggtttagaactctatgtagttacactttcagttctttttctgaaaagttctgagagtgacgtatcggttggggtccatgactaatcaaacagattaaaattagtttttgttttcttttgtggagaatccatataaactggtgtggaacatgtggatgctatggcctaacataaggaaaatcttagctactgatttttggataaggaaaaagaacttggaatgataagcgaggataatggagtaccaatagctacttttcctccagtatgaagggtttgatctctctcgcatgtcccattgaatgcgttgcctttgggacgactgcgagggcataagcactcgaacccgccaggaagattatggcaagttccaggcacggaacaagggtacttcggatccgcacactcgtctatatctgcattaatcaaacataggtaaaaataaacagtgatttgctatcatatatacatgggcaatatgattttcttgtgggaaattgtgatgttttgtgtattaatcatatattaataatataatgaacctcagattctgtgactcatactaaactaatcaaaagataaaggcaaaaaaaaaattctgatgcatgttttctctcataagctatgttaaaaagtgtagggaaatatagtacatcttaactgtcttgatattacaactaaacaagttaattagatagatatatatttttaatttattccaggtgtcaccttctcgaggcgaatcgggtatatttaaatattttttaatctagctagtaaattcccgtaaaattgtgataaagtatatttcaaaatttaattagtgtagtacaaattttaaagtggtaaaattgaacttaaaataaatatatagtaataaaataataaattaaattgaaaaatcattccaaattacagtagatgaatgttaattaccttgcattggctaaactttttaaatgcttatgataatcaactgttatatatttcaattctgctagtaaatgagtaccgtaaaagcatttaaaatcaagaaatatccacaccaattctcacttggctatgtgattcatttgtttatgtgtatatattcacgtatacaattcctctctcacccttaaatggatcagttttcatacctgtgcaaccgtgctgcccgtcctgcaggtaggggttaccttggtacccttcggagcagttgcagatgtagcctggtccgttggacgagttgaagcacttgctgttgtggctgacacatgcataggtgtcaacctttctgcgggctttatcacaagtctcgtttccgatagcccaatccaccaccaacggcaccctgccaccgttgctgctgttaaattccagcgagctcacgtagctcgtccggaagctgaaggccttcgactccatcagcaccgcgtagctgcagcggctgacgttgtagatctccgaggtgttgaagcccgtgtcgaacctgacgcggtagtacttcagacccctggggatggctgtctggcagcagcctatcccggagcacgacccgttggtggcgaggctcgtcaggtcgcctccctggcacatggcgacgcacccgctcgtgtacttgcccatgttgtcgtcgtcggtgatgtacgccagcgtctggcacccgacgacggtgaacttgttgtcggcgtcggagatcgtcagcggcgtgccggtgaagttgatctgccagtcgttgtagtccatgtcgcgggagctggtgttgtagcaagcggaggagatggagttcgtcacccgggcctgcccggtcggcagggagatgctgagaacctccacattcccgtggaacggcctgtagacgtggttgtcgtcgacgtcgcagttcaggtagaagcctggaacggcgcagccgtcggactcgctgccgttccagacgccgaacgggtaggggatgtctacgtcgccgcacttcctttggcagttgccgggcggcggcggcggcggcggcgctcgtgctccggcgacggcggcatggagcctcgccgtagcagccgctacgcccagccatattgttacggctgatagtagcgtgtggaactggaacgccatggatttcgatcgatcggggctgagatttttcttgtgttctagctagtgtgcgatggattgagtggtgtttgccgctacgtacattggcgatttgtggcgttaaccggaggaggccatgtgtatatgtgtgcacaagttttttctcggcacccaacataattgcaacgagacatggaaagcgagtaagcgacgaccaggtttagcaatgaatatggttcgggtcttcgacgatcaggtctttgcatttcgtcgtcttaattctggtggttagctgccttgtaacatcaagggtagactgttctacgagtcatttgggtctttgcaatcatgcttgttcaaaagattggtagcgaaactgttttcctactgcttttttgatcttcacctaacctaataaacaggggatatctggtagtgttatactagtcgagttaattaattgttgggtggtcctatcgtcctcatatgtatcaacacgaaacagaacaaataggtgaacagatagctaggtttctcttcttttttctccccgtctcaatgatgaaaaagacgaagtcaaattttcgcttgataaaatacgcaatgggtaggaaactataccttcaatgatagatacacatctttatatgctatagttcgaagcagaaactcctcggttgcaaatattatgtgttatgtttcacagaatatttttttttagaaagctctagtagggcataacctgactaacttacataatttgtgtggttcaattgtgcatattcatttgacagaggagaatgatattttagatggaatcttcataaaaatggtcaattctcgattcgttctatgtacttagctttaattaataatggctacattgagaagaatgagtttatttagaaaattaggatgcctcttaagattaagatttttatataacacctgttaaaaggggttgtgttaataaaggataacttggctaggaggaattggcatgatagtttaaaatattgcttctgcatgaaaaataaaactatccatcatttatttatggagtgtcattaagcaaaatttctttggagagcactatagttttcttctggtttaaatattccacttagtatatcttatttttttagaataggcttatggggattgataaaaaaaaccagtaaacttattttttaggaacatccaatatatgttgggctgtatagttcagtagaaataatttggttttgataaatcaccatctatattttatatgcaggttctttttaggaaacacattggctccagtcctaggctcaactgcaaaagtgtaatgtagataacaagctaataaaagctgcaggttgtaatcttgagtcaatggttatgcatctttttgccaacttcggatgaaaattcacaaataaaattcaataatcttgtggtcttttcttgtgttgacttttagtagttttcgtgtgctcctgttctattacgcttgtgtttttatggtttgttgtgttgcgttttgtgtttggtcgaattggcgtaataattggctgtaactctttaagtaaaggctaggattctattccattatctaaagaaaatatgcaatgtgggaccaaattggtctactagagcctgaaccacctaattagtcactactacatgctagattttgctagacgccgcccccttttgtttccacctaattagtcactactgcatgctaaatttaactttctcgcatttatgcggcgaagtataatctatctttaattatatgacatagttctattagctatatgtttaatagaaaatcttaaattaatttatcctaaaatccacaaagacatagatagcataaaagcaattacttcctccatttcacaatgtaagactttctagcatcgcccacattcatatagatattaatgaatctagattcatatgtgtgtctagattcattaacatctgtattaatgtggacgatgctagaaagtcttatatatgagtctagattcattaacatttatctgaatgtggatgatgctagaaagtcttatattgtgaaacggaggtagtattacttaaagtatagaaatacccatagtacaaaatatatatagtttcatagaaaccaacttcattgtaataacacaatattttcttataaattcaaaattgcatgctttcacgcaattttagttaacaaatttttaggcaaaattggctacaggacatttaaaaaagtgtagtaagctaagagacactgcaagaacgcatatctaccggaggacaccgtaaaaaaccggtaattagctgctggacactcgcgatattattttattatttccggagaaaatagagggagaaatatccattaaagataagtttgcccctacggcttcctcaccaactcccttcctcatcggctcccccagtctgctcctcgccgtctccagccccggctgcatccatggcctcgtgggcctctcccacgccaccgccaatgcttggccgctcgtcgtggtctccactctctagctcttgctcccagccggacgccgtgaacgcttgacagagaggacacgaacgaccggaggatcgccacgaaggcctagggcccaaaactgctggacgcgatggacaacttgtggatcaccggtgtggccccagcgagcgacgcgaacctgtcgtccgagaggtgccggaggccacggagcttgagcctggcgagccgctcggacagcaatgcgatggccacttggcatgccgcgtcgtcggagaggctgtctgtcccggagccccgacgcagctgagcgtgagcttggtgactgccgtgaaccgcgcaaagatcctctgcgcggtgtagccgagcacggcacgagcattgagcgagagtcggtggcgcatggaggcgtccgcctccttccactgcgtgtaggtgagcgacgtgttgcattcggtcggggtgagcaacacgaacatccggggcaggtcctgcgtgttgtcgcactccggcggtggcgccacgagagccgcgatgggtggggtcatggggaggtacaggccattgtggaagaagacatgaagaagaaaggaaggagtagaataggagagaaaaagtaaaaaaagatccctgactggtgtgtcccacaggggagtgaaacttgactggattgaagggtaaaaccgtaattccacagctgtttatctctctattttcttctgaaataataaaataataccgcgagtgtccagcagctaattaccagtttttttttgttctccagcaaatacatatttttccggtatcccctggctaattacactttttttatgtcccgtagcaaattttaccaaatttttatgttgcaagggtaacaagctagaagaaaatcataaccaacattcatagaaatctcaaataaatttgaatagagtataaatgatatttcaataaaaaaaccaactgcacataaacacattaaacaaatgcccgcacatatgcgtgggctatcttcctagtttcacaaaagtcatatatataaatcacgaggctgttaagacgcaaatgtcgacggatcggacattattcggactagctagcggatctctgatacatgaggacagacagctgcgtataaatcgcttaactgctaggaggtagaggcagtgcgatatagacaaccggcagcctcatcgtctccccatccaccgccttgcccatcagcttttcgaagtcttccgcaaagtcgtcgtcggcgctgccctccaccctcttgctccgcaggaggaacgagtcgtcgcgctgcaagttggtcggcgcgctcgcctgcgctcgcgacgtcgcgacgatgtaccgcctggaccgcggctgcacgacgcccctgtccggcaccgcgcggtacttggactcgtccacctgcacggcgaacgccacgcgatcggcggacctgttcgtcagctgcagcacgcaggatacatccctgtccttctcaaatgggaagcgcacctccagagggtcgatcacaaggcgctccgatttacacccagctgagctctgtcacaacgatcagagggatcatactatatactcaagaagaaacctagcttgccatacatactagtccctgtgtctaggcttaatttggtattcagtcacttgtcacttcgtagtttatacagtcgctacaggggaaacgttttttttcccggtttacaaccacatttactaccggtggtagcaaccgagatgagcaaattgggattaaagatgtcgatctttagtaccggttaaaactaaaaatgcatatagcaagagaaaaaaaatatgtgggatgtaggattcaaactcaagatctctcaccttatctctcacgcgtataaccatctcaccaactatatttacacatctgacttgaatagagacgttttccttttgacctaactctggaggcatttttagtaccggttagtaacatcaaccgagactaaagttgtttatagggaattggacttttagaaccggtagtaaagcaactttaataccggtttttaatctacgaaagatcggttctctattagtgagttagcaaaactgagtaacaaaatgtggaaccttgccagaatctctcttaggcctttttcagttaatcctaagtgcatgtacaacggtttttattagtggtctctctctattgccatgcaagtaatttgatgacatggaagaaagagaaaggagtatggttgttatgcatgacaacggctcagagtcgactcttagcatttattagagtaaattttgttgcatgatagtgaaagaaaggaaagaagagaaaaaaaaagtatttggatacattaatgattaaaaaccatattatctctaactgttgtacatgccctaataagggaggagttggagtggattgaggggatatgattaaattcacaccttaggccctgttttttttcagattgggattattataatccagattatttggagtaagctgaaagaaacagacaacttattgctatagcttattataatctggagcccagcttattataatctggagcccagcttattataatctgataagctcatttaggtgagctttttctagattattgggtgcaaaattacccaccatgccaccccactccctctttagacttgcaaacccaataatctaggctctaataatctaggaaagaaataactaatcgcttattatactacagattataacaatctagcttatagtaatctgactcaataatctaaattataataatcccaaactgaaagaaacagggccttaatagatatggaattattcccctctaaatctttctcaatcctcttgcggtgtgggtgagattaaccaaataagtccttacttaaatatttagctaccaatcaacaaatgtatcctagcattgttttaatttcttccttagtaaatgtcaagttcattatatacgctgagtccgcataatttgacaaattaaatttaagtcataagctgaagaaaggaggaaaatacgcaattttctggtgaattagacataaccgcgatgtcgtgatggcgaatgtcacgttacctggcctataagtgccttcctcacattttctaactcgttcagtttatcaataatctccctcagagtaggccttttctttcggtcgggttctacacaccttacagctatttcgatgcatgtcttgacttctaggctatctgcctcatgtgatgatgtatgactcgaaatttcctgcatcctctttttccatttctcttgtaccttgcaaatccaaagtgaataataaagcagaaagtagaaagtgaatgataaaaagtttgagaaaaaaaaaacaattcttacagtatcaataaattgttggggagacatttcagcacttgtagaacggcccgattgtcctgccattatctctatgattataacacccaaactgaatacatcaaacttcattgagatatggcgtctctcaatgtattctggcggcatgtacccactgcatgttgttaatgattagaaaagggtatagaaatcaatggaactttcacaatgaatcaacttgcataacttacactgttccaataaaagttcttgtcgtaaaagtttgtgttgaaccaaagagtcttgacaaaccgaaatcagcaatttttggcattttgttctcatccagtaatatattagcaggtttcaagtccaaatgaacaatttgatcttctggacgaccattgtgaaggtaatctaaaccctcacaaatccccttgattattttgtaacgtgtgtgccaatcaagtccacatgtttcatctgtataattataaacaaaaataatag

SEQ ID NO: 3034 - DNA, 23759 bp, Oryza sativa
aaaaaatagaaatacaagtatgaaccataccttgtaaacaactccatacccaccactgccaactttgtgctcctcagagaaaccatttgtaatttcttctaactttttgtatgtaaggtccacgggcatcactcttgcatgctctaacgtgttctccttgtcatccatttatctcctactgtccttctataaagtgtgtaagcataactattgcaaagcaatattctcataactacatgttggggataatctgatactctctctgttttaaaatatttgacaccgttgactttttagcacatatttaaccgtttgtcttattaaaaaaattgtgaaatatgtaaaactatatgtgtatataaatgtatatttaacaatgaatcaaatgatacaaaaaaaataaataattacttaatttttttgaataagacgaatggtcaaacacgttctaaaaagtcaacagtgtcaaacattttaaaacagaggaagtatatagttaaacaattgataacacacggttgcactctcaatctcatagggtacttgtatgcatatttgtttttgaaacgcacatcaatgaaggccggacgatggagctattgtacccatgatgccatgactaggagaaatgagaaaaacaaaaaaaaaagtgtggatgcggatttctcgcatgatcaatctgaaaaaataggggaaaccatgcaaaagaaatggcgaggctatctagaagataaagctagaagatcagcttgattagcatgcatggaagaggggaaaaaatgcagttctcgcgattgactaacctgctgagacctgagaggaccagaagaagggcaagttgtctcgtacagaacacaaaacttgcacttgggtgctctagatatggatgcaactccggctatctatagcttgccgctgggcctgtgacacacgcaacagctagtgctatactcccaccgttaaaaaaagaaaaagaaaagaaaaactcacattttcgaagtcttccgcgcgcaaagtcgtcgtccgcggcgcaaccgacatcgcccaccacggcaccgggcaccaccctcttgctccgcaggagggacgagtcgtcgcgctgcaagttggccggcgcgctcgcctgcgcttgcgacgtcgcgaccatataccgcctggaccactgctgcatgacgcccctgtccggccccgtgcggtactttggtgtgttcggatgccttttttttttccaaccactctctcttattttcagcttttcaaactgctaaacgatatatatttttttaaaagttctaaacgaaagttagttaaaaaattaaattaatatatttctttttaaaaaatagctaatacttaattaatcacacgctaataaactgttccgctttatacctgcaaggcgaatgccacgctatcggcggacctgttttacgctatggttcttaaaagaaaaaaggttttacgttacaatggaaaatttttcttcgatggctgtgttgagtttgtgtgccaagtatatggacacctatttaaagtattgatcgtagactaataatataacaaattacagatttcgctgtaaactgcgagacgaatttattaagcctaattaatccatcattagcaaatatttattgtagaaacacattgttaaatcatggcgtaattaggctcaaaagattcgtcttgtgatttatatgcaaactgtgtaattggtttttttcatctacatttaatgttccatgcatgtgtctaacatttgatgtaacggaaaagttgtaagtttgaagaaaaaattttgaatctaaggatatgtttagttcacgccaaaggccgagtttagttccaaaatttttcttcaaatttccaaattttccatcacatcaaatcttttctgcataaataaactttaaatttttccatcacatcgttccaatttcaaccaaacttccaattttggcgtgaactaaacacacccaaaattgaaagtttgattaaaattgaaacgatgtgacggaaaagttaaaagtttgcgtgtggcctggtttagtttccaacttttttttcaaacttccaatttttctatcacatcaaaactttcctacacacataaacttctaacttttccgtcacatcattccaatttcaatcaaacttccaattttgatgtgaactaagggtttgtttggcacatcttcagcttcagctccacccctcctggagctggagctcagccaaacagtttcagctctattaaaactaagggtctgtttgggtggagctctctcataaaatatattagagttatggagctgggtttaggcaactccataactccactccagacctaactcctggagtaatatttaggagttggagctgtatcaaacagcccttaaataaatcctatgtagaaaagttttgacatggtgaaaaagttaaaagtttaaggaaaaagtttagagcagtaactaaaccaggcctaaacacggcggatgtcgatggcgaggcaaggaagtccgcgtcgccgcctcgccggtccgcgaatcatcctcgtacgtgacagcatgggcgcggcgtgttggccacttggccttgtcaaggtgaccacgcggcttcgcggctcactgccgccaagacaccaggaaaacgttcacatgtaatgtgcccccacattgctactggtactcagtgaggaagcttccgcgaagccgcgcgggtcgtgttaaagattcgaagtcaagtcgaggcctacaaatattaatttcctgctccctccgtacaaaaaaagtcacggtctacggtacgtacctttcgatcgaccgtccgcttgacggcgaacatgctgtccgcgagagcgattttcccttctttttcttcttgtttttttttcatttttattattttcctttagaacaaattacagtacaacacggatgtttgcacattcacaaaacttaattctagcctggtaccgtcgtgcttgaccggaaaaactaaatcttgcgttgccacgcgctggtttgtgttgagggcctgatacgaagcaaacgtttctttaagtgtttttttttatattaagcagtttacaataaatgaaagctatttaaacatttttttcacagttaatttttaattaatttgagttttatttaaactctacaattatttttaaatacttgtaaaatttgagaaaaaatttataagacgtttttcaacaaaaagtttctaaatttgaaaaaaaattatttttttacttaaaatattgaaaatttaactcgaatttttaaaactgtcaactcaaaatttaaaatttttaattcaactgtcgaaacaatcaaaattcagaactttcgactttaatattttaaaactttcagttggactcttagttatttacattatttttgttattataataagttacttcctccatttcacggtataagattttctagcattgcccacattcatttagatgttaatgaatctagacatatatatgtgtttatatttattaaaatttatatgtacgtggacaatgctagaaagtcttgcattgtgaaacggagagagtacatgctaaacgcgggcttagtaatacgcttgggcgagatatgctacctaggctgactggctgagttcgggaggagaagattagagcgagattaattaaatattagcttaaaagacttgaaaaatttccagtcaaaagaaaacatgaaaaatggattaacacgactttttaaagcaactctaccatagaaaattttaggaaaacatactccctccgtcccaaaatataacaacttttagccctcaggatttatcccaaaatataacaacttctccattaacattgtcttccgaaccaatcacaaccctccaccattcacttttgccacctacctccactactcatccaatcacaaccctgcaccattcacttctacctacttttttaatacctgtgtcaaactctaaaacttcttatattctggtgcggagggcgaataccgtttatcattttacaaaatgtgggcgcagaaaaagatagatgtgagttgagaaaaaagggtgaagaacacaaccttagagcaggtacagtagtggctataaacaaatgttgagaggataaaataggggagaagagtagcgggctacaaatttatactcatctatagtatagactctaagatacaatgtgtatatggtaggtaggattatatatttataatggtaattattgtataaattacatattaaattgactatagatgatttagagttagcagtcgctatactttcaaacttgctcttacggtgctgacgcacatgcgttaattgattattactcccgtctcgttccatgccttttggtcaactaattaatctagtaattattacccccgtctctcattcgatgctcccctccctcgtacattacaactggccgtggctactgcgcgaacgatcgctggcgccggaggccaacgatcagaaatcacgcccgcacgcggtttcctcacgtaaaaaaaaaaaaggcaacgacgttaggcgattagtcgtgggttcttcgtaaatttaaaatcaatttgaaaataagtgtgaaaaaagagaatgaaaaatatattacactaaaaactatttatttacatagactttatatatatatatatacatatacattgctaactttgtacatataaactatgtgtatataaatattttatataaaatataattaaatttgaattcaaatttaaatcgagtatataaacttttatcgtataaactttatgtgtataaactttaacagtacaaactttagatatgtaaacttaaaatatataaacttactaaaatagaaaattaatgtggtgccaaaatataagaaagcgatgtgggaactggaaagagaggcccaccaaccgattgcttaaaatatatttaaatttgaattcgagtttaaatccagtatataaactttcatcgtataaactctatgtgtataaagtttaaccgtacaaactttaaatgtgtaaacttaaaatatataaacttactgaaataggaaagtaatacagtaaaaaaaaaagcaacgtaggaactagtggaaactgggaagagaggcccaccaaccaatcgctatccacttcctcacgcaagcgatcgctcgttacgattctcggtacgggggtacaactcgaccgaaccagaaacaacacacgtacactctatatatacacacccggcacagaggcccagcttaatttcgacgatcgattttgctcactgatcagccgtgcctagcttagcttgcacgccgtattatatcatcctccgcgccaacgcccaccaaggttgctagctccaccaagcggtgaggatctgtttgtttttccttcctttttaagtacataaatatatatatttgaacgttgatttcatatatcgaatgtttccctatatttgacgagttctcctaattatcttttggatcgcaacgatttagatctgtgctgtgtggatatatattattcatgcatgtatgtgcgtgatgagagcttagctagcgtcgtgaaggacaggttaatgtcaagtatatgaaaacctattgtaatttgtaaatatgtgcaaacttaagcttttaaatcgatgtcttcatgaacatgcattccatgctatagctaggatggtgcatgatattaggcctcctttagatcgatcggaggaattctaaaggaaaattaattggagatttccctaggattggaggtctcggttactacagaattgatcgagttactattcatgcatccttcgaactggagggaaaaggtaaagaaaatttagggcatgtttaggtcgcgaaaagaaaatttttagatgtcacatcggatagttgattggatgtcggaaggcctttctgaacacgaatgaaaaaactaatttcataactcgcctggaaaccgcgaaacgaatcttttgagcctaattaagcagtcattggcacatgtgggttactgtagcacttatgttagttttttatttatctatatttaatgcttcatgcatgtgtctaaagatttgatgtgattttttggaaaaaatttggggaactaaacggggcctagacaaaattttcgtttggccttgatttcatagaaatttcagcatgcattaggacctcttgttttcttttcttgtaagaagtcaaagacataatgcgtgtcgcttcgaatgatcacggtttgaacacacattaaggaaacacacacacacccctatatacacttctttgtttagaaagaatattgtgttttactttattcttgtattcgaaacaacatttcaatcctatgtttttgcatgtacatttctatcgtatttctatgtttttttattgttgcgttccaaaagagccctgtgtttccagggactttataggaaatttgtaggattgaaatcctatctagccactatcctaatatattaaaattctattgaaaattttcctatggatcaagatattttttataggaattttgttggatttggctagacattttccataggaatccttcatttcctttttttttaggatttcaaatataagctcaaaccttggttttgatttcctttgagaaatccaatactatacactatatatctttatctttcctctcaactctatctaaataatatcatccctataattttactatgaattccctatgaagtattcaaacaacttgttcgacaaaatttagtgtttcaatttctggcgattgtatatgccatgactttctatttctacatttctcctgtttatatatattttttaatttttacgttccaacagactactcatttattatataggtatagggtaacaggcctgttgcacatgccatgagaccaattttagtgcattctttaactaagggtgtttagtttacgttaaaattggaagtttaattgaaattggaatgatgtgacgtaaaatttgaaagtttgtatgtgtaggaaagttttgatgtgatgaaaaagttagaagtttgaagaaaaaaattgagaactaaaccaggcctaagatggcaagccttagtaatttctagccacacttttgctgcaacaaattaaattggccataaaaaccaatagttgctttcaagaactcatgaaaaagtctactgccttgatcgtttttccattgaacggtctgagcgaccaagattctttttgggtggtcatctatcgtctacgagtgaaccaggatcatcggatctaccgcactccctcgtcaattaaaaaaaatcaatatgtaaacggtgtggcagatatattaaaaacaatctttctctctaccacatctttttctctctcttcttctctcccccactcctccacgccatctctctccactccctctcctcatctcttctacttccctctcccctctcccacttctcttctccggcggccaaggcagagacggtaggagcgagcgggcggcggcgggctcaagcgcaggccaacagtcaacagaggagcggcgcatagacggcggcagccttgccccgcgtggatctagcggcgaaggccctcccccgtgcgcatctggcggcaatagtctcccccgtgctcctccggtggcggcggctctcccctgcacagatttagcggcggaggggtagtagcgacggagatagtgatgacgagctgcgggtattcggtgacggcgacaacgacaatgtcttcggcagatgggacatagctagctagagtttcgagttctgatttgttttgggattgtgtgcctgccaagaaagaacatgaactcggtggactacgagcccccacccaaaagaaatgccagccttggacgccaactctatgcattcttttgaacacagatttattaaagttaacatatacactcttttttttattgatctcactactagaatcctaagatttgccaagcgtccaagcaaaaaatcctacagaccgtcaggaagatttaggtagccgaccgtttgaaattttaataagggtagttacgagaacattcggctatttagcatgtggccgacgggatatatcagtgagtgagagttataagataccactcggaaatggttataagtggccgacggggtatattagtaactgagaggtttaatttaactctagaaaattattattagtggccgacggggtatattaataaccaaggggtttaatttaactctcggaaatgattattagtggccgacggggtatattagtaaatgaggggtttaatttaactctcggaaatgattattagtgtccgacggggtatattagaaaccgagggttctcaatttgacgggaaaataaacctctcggtgagaataagaataaccgacggtatacgctcgggaaatgtgtcggcaagaaagaaccatgcgtggtctctggaaaaaaagaccgaccgtaaccctcgggtacatggttaccgagggtaccctcggcaatatgataaattaccgaccacatgtgcgtgttgccgagggtaaccactcagtaatatgtatggccgacagttttataggtggccgaccttaaacccccttggtaaaagttaggaatcttgtagtagcatcttgaaaaactaaatcggtatatcttaaattacctagatgcatatcgataaatatgtagactactataatgaaaataatttagtttagatgtataatgcaaaagatactagctagttcgatctggagaaaaagatgtacatgaggaaagcataagaacattcacaatacgattctattatcagattatagaagaaaaataaattgttatcagattatatatattatgaaactagtaaataacactaataccatatacttcctccatcctaatctccctgcatcttctaatataagggattttgacattttacttacactgtttgaccattcgtcttataaaaaaattagaattattatttattttatttgtgaattactttattatctaaagtactttaagtataacttttcatttttacatttgcacaaatttataaaatatactccctccatcccataatataagggattttggagggatgtgacatcctagtacattatatctggacaggctctccatatagatgtattttactggttgtgtcacatccctctaaatattcttatattatgggacataggaagtaagatattttagttgaaagaaatatatcttagtattatgaatcttacgcaaacactaggatatatcttatcgaaccaaaatctcttatattttgaagtaatatacttaggctgtgttcaccattgcttgttcccaaggaacagtgcgcaacgggaaacggagtggtccattagcgcgtgattaattaagtattagtttttttttcaaaaatggattaatttgatttttttaaacaactttcgtataaaaacttttcgcaaaaaacacaccatttagcagtgtagaaaacatgtgtgaggaaaacgagcttgggaaaaggggcatccgaacacacgctgtgtttagatttcaacctttttccttcaaacatccaacttttctgtcacatcaaatgtttagacaaatgtatggagcattaaatgtggaagaaaaaaccaattacacagcttgcatgtaaattgcgagacgaattttttgagcctgattacgccatgattagccataagtgctacggtaacccacatttcctaatgatggattaattaggttcaaaatattcgtctcgtagtttatagttcaaatctataatttattctgttactagtctatgtttaatactttaaatgtatttccaaaatttgttggcaccgaacaaaacacagccacagccttaaaagtcacgagagctatgatgacggtacgtgtttgcagacttggagcacgtcccatcacaagtgtcaagtctccaaagggagtggtgtttcttttttcaaaccgattgctttactgacgtcaaatattgttgaccctagtaccagtggcaggtcgtgttcgcatagtgcacgcgctggcgtggggctctcgctcaggcatgtacatccagctgcagatgcattgaattagagggtgcttacatgtactgagtgtaaagtctcagcatatcacatcggatattatataggatatgacatgagatatttgggcactaaaaaaactaattacagaatctgtcagtaaactatgagacgaatttattaagcctaatccatcattagcaaatgtttactgtagcaccacattgtcaaatcatgaagcaattaggcttaaaagattcgtctcgcaaattagtcgcaatctgtgtaattagttattttttagtctatatatatttagttcttcgtataggtattcaaacttttgaagtcatagggcgtaaaatttttggcagggatctaaacaggcccaaagttttggcgtgcacatcgagtattatatagggtgtcgcatagggtgtttgagcattaataaaaaaactaatgacataatccatcatcaaaccacgagataaatttattaagcctaattaattcgtcattagcaaatgttcactgtagcaccacattatcaaatcatggagcaattaggctcaaaagattcgtctcacaaattagtcgtaatctatataattagttatttttagcctatatttaatacttcatacaggtgttcaaacattcgatgtgacatggtgtaaaatttttgcgtgggaactaaacagggccttaatcgacaacgagatgtcttactcaggtgagtttgcgcgcgaccggtcgttgcttggttaaggcggcgttctaaacagctagttcaccttatctattcctcgtttttcattagcatactttttaaactactagatgttgtattttgtgcaaaaactttctatataaaagatgctttaaaaatcaaataaattcaattttcaaaattttataattaatatttaattaatcatatgctaatcatgtttctcgttttacgtgtagctaatcagcaaacccaatagcccgaaaagaatgcggcaatcacttcaacctactaaattctcttttagctaaaaacgtatttttttaatctttttatgacttatatcttcttaatcatatattatttttatgatctatttgcaccatgtacttcccttaaaatatgtgacaaaacaagatgatcttgaatatattcaaacatttatgcaaccttgctatgtaatagaagtaactctctatagtattagaagtaattacgtcatgattgagttgaaataagaaactatatggagtaaattcacaagcaaagtgtagagatgattttcaagtaaatacatatattctttattttaagtaattactgtattattttttaaaaaatataagtcatcaaaagactctatagcaaaaagaaaatgtactaatgcaacggtagttagcctcgataacatacacttgaatcaatatgacagctagcagatagcgtgtggtctgttttacttgcaagtggtctcgtgtatttgtttctttggttagtacaacatccacataccacatgtttatatctcaaaccatcatcaattgatcgaaagataagaacaaataaagtgtatgcactgaataaattttaccttttctctacgcatgatccaaagatgtcatcctagtaagttttctatggtctttacaaagttctaaaaaaagggtctttacaacattttttttaaaaaaataaaaaaacgggtggggaaattttggcactattacgaagaactaaatttgaaaatatacttttcgtttaattttgaccgcgcggtctcgcgcggcaacagcgtgagaccacacggtatcgcggaatgaaagagctgagactgaacggttcggtcaagcaatcagcgacactgtccaaagggctccatttgattagtaattaattacttgattaacaattaaataataatagttagtgattaattatccagattagtgattaattaattattaattaatcgctaatcaggataattaatcgctaattaaatcggctaggaatggtttcgctctttgcttgtgcgatagcgctgattgcttgagcgagaccgcgcggtctcgcactttcactgtatgataccggccacgatgtcattttcacgtcattctcgtgcaatggttgtgcgagaccgatggtatatttgtacaaaagattttgcatcctgaatatttctaacaaaaaaattgaatgaaaaatatatttttaaatttaataggaatttgtacctgtgatattttatttttcgtaaaatgttcccttacattattcccatgttttatataatttcaaattttgttacagcatcaaaggttataaaattttcaaaatgcttgggaacttccaaattagtttctaatgacacacaaatcgagacctctggggaaggaaggggaccaatacagcataaaatggttaattaatagataggattatcataaaaagaacaactttgttttaaattaatcctgatatatattatttatataattaaaagactacccagaaactatgacaataaatgtaaatatttatctttaggttttatatctagcttgggtgaaaatttcgttaataacgtgcaattcactcatcttaatttaaggtatgtaaactctaaatattcttatacgaaagttttaataattcatgtgtatatataggtgaagaggtagcaaatctgtaaacaggagaagttaaaccatccaagtacaatgccaactgatctaccggtacattttctagaagatattacgaaaaaattctccgatcaccaaatagttggtagtggtggctatggtcaggtttacaaggtttgtgagatatgatactcatatctttgtttcaagtggtatcaataatgaactccgataacccacttacggcgtacccttgtagtaatacatattaatgaaataatgagatcgaaatacaactgcaacagggagtgctgacaaatgggacagagattgccgtgaagaagctatatgacttgcgaggacttgatgatgtgcaatttagcaatgaattcagcaaccttatgagggtgcaacataaaaatatcgtacgatttataggctattgcaatgaagcaagacatgaactcatggaggttaatggggaagatgtactttgtaaaatgatatacaaagttctatgctttgaatatctgccgcgtggaagcctggagaattatctgcatggtgagtatggtggtaatttgcgaactctatccaattatttaacatgtaaacaaaaaaaagtaatcctcacatttcaagaatattttttgccactttaacagaagagtctcgcgggcttgattggtgcacacgctacaaaataattatggggatttgtgaaggtcttagttaccttcatggaggattggaagaaccaattttgcatctggacctgaaaccggccaatatacttctagataataacatggtgccaaaaatagcagattttggggtatcaaggcccttcggtggctcgcatacacataccactaaagtttgcgtaggttcagagtaagtagagaggacgtcaagagatatgtcctctttctttcttattagtactaaccgaatgatatggtgtttgtttaacatcactgatgatatgatgcaggtactacatggcaccagaatacttggcacaacgtaaaatatcaaataagaatgatatattcagcttaggtattataatcatccagataatggtgggacataaaggctactcaaaatatggcgaaatgtcatcaacccaacaattcgtcgatctcgtaagaaattaccccctctattcttgtttatttatcattttttacaacaaaatttgtttgcaatttttttcatattattaccccttatctaataataatttcacctccaccaacccatcaatgtattcactctgtcccaaaatataacaaattttagatatgaatctagccaaacagttttccttgttcagattagtagctaaaagttactcccccatctatttttgatagtcatatttcttcttgtcacaatgaccaaggataagtaattctacttatcatccatttaaatatgctactagttattcatcgtaaacaagcaattcattatatttacatttctcgatgctcatataaccaatcttaagtggaagaatggagagcaacgcattaaatacgagaaagtcattaagatggtaggtggttagattgaaatatgcctatcaaaagtagtttttttaatttaaaaaaatacctataaaaaataaatggagtaagtactatatattttaggatccagggagtactagtttaaataatcatatcaatgccgaaactagcatattgtgcaaaagttatgattacctagttatttgtgcctagtcaaaagtgaccaataaaaaaaaggcataacaagcacgggtcttttgtagctggagaactttcctttcaaagagagatgtcgtccatcccaagtaaaaaagaagtgcatggctagcggaacttgtctattcgtaggttgtgttcttcccctgcttttccaactcacaactcttgtattttacacgcaaattttttaaattgctaaattgtattttgaaaaaaaattctatgtgaaagttgttttaaaaaatcttattaattctatttaaaaaaatagttaatgcttaattaatcatgcaataatatatgctttgttttgcgtaacggggaggataggttgccaacccctctcgtagctttagggtagtctcaacccatagtgtccataagtagtgtctatggtgccatgtcaataagacatcacaatagaaactacacttcataacccgtaatttcttaaaatgggccattaataaatacatcatctctcttctttatcaatcatatttattcttcatctattatgaagacactattatctcccaatacaaaacttgatagtgtctagtgcataggttctcgtgttgaagctgtatcttgcatgagacccagtttctttcttttttcactctctctcttaattaatatagtgccacataagttaaaagtcctacatgccaatgtagttaataccatagacaccatcctaggtggagggttgggactgcccttagagcacccgcaatggtaaagtaaggtgctctctataaaacatgtgcatctcagcaatagactagattaatagtaaaccacctcaatagtatgtctacatgggtatctatagctttctaatgcattgcctcgtttttctctatagactatctccaggttagtagatagttttgctctctctcttcatttaatctcttccatgtaggaaaatatactaacatggatatcttgtagagagcccattgcgggtgcccttagaagaacaagttcagttttcatctaagcagacaccatgcatgcatggcggaaccatgtctatgtgtactcaatcaacaaatgtattgctcatattttgattcgtaggttgcaaataattggaggaataggatcggggacacatcaatgcacgcgaaagaagagtgccagcaagtgaaaaaatgcgttgaaatagctgtacgctgcgtcgaggttgatagacacagcagacctgctataaatgacattatccatgagttgaaacagacagaaatttatactagagccgtgtcgtcatcacaggaccaggtatgataaattcataattatgacgatgattgagatgtatgtatatgttagctttgcgggaggcgggagataataaatactcaattccatttctaattgatccacacattttatagaagtacatgaaaatcaagaaaagccaataactctccatactatatttaatttggtaacaactcgatcaatgcagtgcactaacagaccaagatatttattattctcacacagagatattgaataaacttagtgaatgaatactaatatgatcatcatttgaaaataacataaaaatatatgatgatcaattgggaatattagaggaagtagttatttaatgccacatatataaagtcagtgaaactatttccacaatcataaaagtcagtgaatgcaaaaaaaaaattcactcagaaatataatacatactctacttgccatgattgaaatccttatgtttacaaatacgtatgtgtacatccttggtgaaatgccagaaatattatacctactttgtacaaaaaagaaccataaaaactaattttggtggtaagtactatcgcataagggtgaaaatgatacatatatttctgaccataccgataccatttcataaaactaatgtaaaaatgatatcatttccgatcgttttcatttctagccatatataaaatttagatttttttctaacttttatcaacatcatatcgaagttgatgctaaatagttaaattcatgaataccaaaaatttacgaccataccatgaccgattccataaaagtaataaaataatgacatcgtttctgatcattttcatccctactactgcatgaattgattacatttcacaattgtggacttgcattcaccattgcatagggtgaaaatggacgggtatttccagatagcttgcccgatctgagactcgcgggaagaatatggaagagaaaataaggattcccgatactatccaagtttgaattcgaatcctaaaaaaaatgggttatgatacaagaagacttgtatccactcatatgtcccatattatagaacacatatgaaaatctattacaagtccacctacggacatgcatgataaaaggattggttaatcactattttacgagctcacgtgcaatattgtataattttcccgtaatttatctcttttgacactataattggttcgttatatttaatatttatgaattagagatgcaaatagatatccgtacccgaagccgattcgaaggaagtaatattggataggatacgggatgagtgatatattgtccgacactacccatttcaggttccaaatttaaagtaaaatataggttaggatatccgaatgctataatccaatcgtacctgcccattttcaccactacaattgcacactaaatttccctttttataatgattgataagtgttaaattcctatggcaaacaggcatgggtatgttattctatcgtttatttaggatatgagatcaagtggtctatatagatgggtcctacaacaggtgatattagttgtggtacatacccaacaatggtatgaacttgttaggaaataaggtgggccccacagatataaaaatatcacctaatgctagcatgtaggagagagttttgagcaagcaaggttgtcagtatcgggatacttgttagtatcgttttgctcaaagtaatatcgtatcataggatcgtatcgtagtatcgggatactatgagattttctttttttaagtttaattaatatttatattaattatatgtagccattctatataaaaaaatgtagtaatggtatatgtcatgcaaatataggcatttattaagagaaaccaagttggttttgatatatttaactgatttttatataaatttaagcatatttatttatattattttcataccatgttattttaaataatattttgtagtatcgtagggatcgtagaatcgggataccacctaagatttcgtaggatcgtgtactaatgaatagtaggatcgagatactatgaaaattaggatactaggtgggatcggtatcgtttcggcttggtaggatcgtagtatcgtaagatactaggatacgtatcgggatactgacaaccttgtgagcaagtgagcaggagagagaacagagatgaattatttattccttatgggtggtccttatacctaatgctagctcatcataaggtcatctataaagattaatttcataatgtatactacccaccctaaagccttaattggttaagacccccttatggcatacattgtggatgtttttagaataatccttgtgtaactcggtccccttagcaagctattggcctggtttagttcctaactttttcttcaaactttcaacttttccattacattaaaactttcctacacatgccgtgtttagttccaaacatttttttcaaacttccaacttttccatcacatcaaaactttcctacacacacaaacttccaacttttccatcacattgttccaatttcaaccaaacttccaattttggcgtgaactaaacacacccacacacaaacttccaattttggcgtgaactaaacacacccattgtttattatattaatagttaccaatagtatctttgtgaactatgcatgcgtccatatgacattaccatttttcttttgaaagccttctcttctcagctactacatacaccccttattgtttgcactaaccaacgtcaaagctagaaaaaaagggaggaagtatatatagatatatatatatataggacactcatatggggcaccatggtgcccgggcaccatggtttcaaatgcacaaaatcactcaaatttttcaaaattttcaaattgtgagtatatacctagttataagaattcgatttcatacctataccctatcaaccaaaaccaactcaaatttaactttatttcacaatccatgattacatacctaactaattatagtatggatgctatatacctagaatcaaaatctaacaaaaacaagttcaaattcagttcaaacttgctttcaactagttagtaaagtaattaatattaatacctaaataattgaaaaagtttcatgctcatttgaattgggtatatacttaatttcaacaatggtgcccgggcaccatggacaccaaacaaatttactctatatatatatatatatatatatatatatatatatatatatatatattggaccgggatcaaaattcttaaccctactgttgattgctctaagatttccttttccccctaaatcttcccctagctgaaagttgaggcgttatgatagaagtactcttatattttacacttctagtagttcatttacacacgaagaacaacttttttactaaccaaccgagaacgaatcagtgaaggaagtaattttgttgttctcttgtaatgggacatttatctacgggacagtcaaataattctaaggtaaaaccctgcgctgttacgggaatttattatgataacaataactaaaaataatgtaaaaataatgtgtaagataacttaaataacataagcttatataaacatgattttatataagttgatgcgatttaaatttaaatagtatgtagaataaagattcaaatgtaaaagtaagatgatatggtttgatgagagaagaaaagaagagagccaatttgaaccattgatgtgatatgacttaataagataaaagaaaaatgacatgaactaagtgaggatgaactatatatagtatataggatgttataaaaaaataatggagagatatattgaaatattatgattatgtgggatgatttaacatgcttacatttaaaatctttaaaatttaataaattattaaattatagacaatatagcatgtttgtatgatgcttaaatgtaataattgttagtgaataatgatgtgtcatctttgcatgtattcttgaggaagcagtgggttataactttgtagtaacagatgattggtctgcacgacaccattaacaaaattaccaataaataattcctttaaatatttatatacataacttctattttcatatttggtgttcacaatgtgtttttttccccttgatggcttaacacataggctaaggtagccaagattgggctgtggggtggagctggtggttccagtcactatgacattgaggtggcaccccgccggttggaaagcttgataatttctagcggtgaggtcatctactcacttgagttctcatacattgaccacagtgggcagcagcacacatcaggcacatggggcggctatggcccaaataaagggaacaaacgtactaaggtgactatgaatcttattattcaattcttgcatttttcttttagataaaatgattggtatacattcattatctctgcacacaactagtgaaatttataataggtttactagtagtattatgttattttgaaacttttcttgcagattcagcttggtcttatagagtatgtaacggaagtttctgggacaatcggaccatttgatagggcacccgctggtgttattacatcgcttacgtttatcactaataagggaagctacggaccttttggagaagtaagaggaactcctttccacatcccacgtgcaggacaatggcagcattgttggcttttttgcacgtgctgggtggtacgtggacgcttttggtatctatgttaaccctaagcagaaaacagtagaagacgatgatgatgaggtgatcaatatatatataacttctaaaatgagaagttgtttccatctatctatatgtgattttattttttttctcacttttatcgaatgtttatatactcgttaggattccctcgcgaaaattgggccatggggttggaacggagggagtcatcgggacatcaaggtggcaccacggcgtttggaaagcgtgacgattcatagtggcaatgtcatcgattcacttgagttctcctacagtgatcgtgatgggcagaagcattcgataggcccgtggggcggtcttggtggaaccgcttatacggtgagcactccatttgtcaaaaaacaaaaaaagatcggatgtgacgtcacctagtacaaaaaatctaaccacgtacttccttcgctaaaaaaaaacaaacctaattaagattggatgtgacataacctaatacaatgaatctagatagattgtatagattcgggagtacatgcttaactcattaaaatgtattttaccaagcccaccaagttctagtccatttttcctattgctggattagtattttctttaaaaaaaaaagaaacttgtcaccttatactccctccaatctacgattttagagtgtttgtaaatgcttgataaacttttataaaaagaagtattaacatctatcacttcaaataataaactataaaaatgatacatatctcatatcaaataatatagttctctttataaatttagtcaaagttaggatatgcgttaaaagagtgtttcgtatgtgctcatagagttaggatatgcgtgtgagttaatagagataactatgtatgcgttgtgagcgtctatatttattttattctgtgtttctaaaagaataatctagggacggaggacgatttaaatttatcttccacgagactcgacgtagagcaagcctgatgcaattttatttcttacaattttttttgtccatgcagatagagcttggccctttggagtttctaactgggatatgcgggaccatgggcccatttaacgaggcaccggatagggatgtcgtcacatcactcacgctgatcaccaacgcccgtaggcgcggtccattcggacgaggcggaggaagtcctttccagatcccgatgcgcggcaacggcagcatcgtcggcttcttcggctgcgcggactccttcgtccatgccattggcgtctatgccaacccccacctgcaggaagcaccggcaccacaggtacaaatgacagaaaggatcgggcccgacgacccgactcagggcacagggtttggttcagtctagatatggcacggctcgactggtgtccaaagcctcatgccggcccggtcagattgttaggccgtgactaggcctctgtctcggcatgctgagctggctcggcacggcacagcccaaaatagacttattttagccttataaggcacggcccgaagatataaaggatgcaagaatatacttattccaggtatataagatacggcccaaagagatgagggagaaaatagatttataccgaggagcactgcagtcttctgtgcattcgtgccggcccggtacaacccgagtcttattgggtcgtgtctgagccgttggtgggcctagactgatgtttaggtcagattgtgctggcccaactgatctcgggtcagagcctggtcgtgcattggctgggcggggccagacagcctatttggccatcaataacaagaagtataggcatgactagcactacaatttgacattctgaacatagctatttttaccattattctttagaaaaatagaaggagtgtcacaattttcagtattaaacttataacttgtttggtaactcgagggaaggggattgggagtttacacgagggaattgatgatgagattaagatgtgaatttgattcttaatcccaatatcttgtttggtagaggtgatggaaattaatagggagtttagttgaagattaagtcattattaaaaacggatggatgagatttgcttagaaaaagtaaaggaggaattccctcccaattacctgcccctacccaggtattgaaaaggagggagttcctttctcaattcccaatctccatcccatcaaaattcccatgtctcccaaccaaacaaaacacttaatagtctcatccctctaaactcccaatccctcctaaaaattctctccaaccaaacggccgttaatatagcaatgcatgtgatacctagagatataagtagcgtaaaattttgctgttcctatctatctcattcctctgtgctcacacactaatccttcgtttttcttcatttttggtaaattagactgggcttaccaggattgggccatggggtagaagtggaggtgagtcccactacgtcgatgcaccggagccacatcgtctagtgagtgtgactatccgtagtggtgacgtcatcgattctattgagttctcatatgccgaccatgacggaagtgagcaagttgttggtccatggggtggtcctggtggcaatgcgtataaggttagtggacgaatatatatattttttcaatcggtctgtcatcgatatatactctctctgttcctagatatttgacgtcgttgatttttttaaacatgtttattaaatcttattcaaaagtttctgaataagaaaaacggttaaacatgtttaaatagtcaacggcgtcgagggatagagagagtatatacatttatcttggggtagaatgtaacgtaccccattgcattgtctctcgcagattgaactgatgcctctggaatcacttcaggggatcaccggaacgttcggtcccttggatgcagcgtcacctgacacagtcgtcattacctcgctcacgttctccacgaaccaatgcctcagctacgggccgtttgggcaaggcgccggaggcggagggactccattcacggctccgggggagagcgacgggtgcattgtcgggttcttcgcccgggcggggtgttacctcgatgcgctcggggtgacaatggcacggacgcccaactttactagctcttgtcctctgttcgctacttcgctgtggtggtatcctgctaaatttcaagcttttttatactggtgtacggcatcttcaagctaaccagcttggttgtcgcctgctacctcattctgtctctaaaagac

SEQ ID NO: 3035 - DNA, 29227 bp, Oryza sativa
aaccaataatgcaacatgttttttgccaataaatagttttcaatgtatgatgtttgtcaggaaccaacacgattaatacagaggaaaagggaattcagacaactataattttgctccaatccaacagggttgacccttccgtcgccaccgagctgccagttctcagctcttgcttttgtgctacagttcattttttgccgatacatctctcgaccactttcaccatctccctcacacatatgcgccactcagcggcagaggaaaaaaaatagatgtggctcatggcaagagctagcacagaacaataataaaggagaaaaacaatcacgctgcacgatattgtaggacataacattgtgacaatcatgttgttcattgtgacaatcataaaaacaatcaatgccaagaccattctcttcctcattctttccattttctggttttttctgccttgctcctaggcttcctttgcaacttgctcctgccgctgcggctttgcctgccgatggcagcagcccgtagctgcgccctgcgccgagcgcgcctctgcctgcttgcttatcggcgccaatagcagaaatctcaatctgtaaactatataaaaccatgtaacttggtcacacgatagtatagacccaaaaattttcatgtttacgcttgtcgtggcagatgtctgggcctacttgtcatggccgtcacgctgaaccctgttggattggagcaaaattatagttgcctgaagaggacaaggcggtagttgctccggcgagaagcctgctcggcgtcgcgggtgtcgtcttctccaccatgaacgtgtggcgcctagaccaggtggcgctcgggcggagctgcacgggggtgttcctaggcaacgtggtgtagagccatggcgaactcgtgaaggatgctggtgcaggggctcacgtcgcacggcaagccgccgtatgtccggccaccgccgagctcgctgggtctcccggcccacggcaagtcggcgtcgcatcctcagcaggtgcgagttaatctctgggtgtcgcagtgtgcacgtagtctgacagagtttggcacctggagttttttgttctgaatgcttcatcgcttttccccttttttttcaacgaaaagtccatccatttatcccaagatcgatcaatggcaaaccaattaggagggcctatgtcccaagataatcattcttgcaaagttcttttatgcttggaatactgcttccttttttcccgagttagttagaggcagagtgtgtccattgtccacagaacatctgtttcatcacacacaaatgcaaattaccaataggccctcctaaagaccaagattaaaaagggggcacgcaaaacaagaaagatattaacctgtgattaattaagttttaattattacaaattgaaaaatagatttatctaatattttaaaacaatttttatgtataaagtttttacataaaatatattatttagtattttgaaaaatgtactaacggaaaatgacgaaaaatctgtacagaagaattaattccacgttctaccaacctgtcaacgttacagttcagtacaaactataaaatctataaaatcacatgacacttcgacaagtagttaggagctttgcaagttttctcattggattagaaacaatcatccaatttccccttgatgttttcataaataagttgatataattgtcaatgataatcatatgcacatttccatagtgggggagaagaacatgaagatgtagaatttgtgccgaatataggtacaaaatcggttgcagtttaaaacttatagttgcactagacataaaaatagagtaaaagtcgaactctactctgggaacaagcatggcattcaatctgagtgatttcctcaaagaacaattgatttgtcctatttggtggatcctttttcttctcaagagatagatgatttggtaaagtggacgcctgttgataaagctcctgaccctgatggttttaatgggtatttcttgaagaattaaatgttggcccattgttgcccaagatttttatagtctataaattcttctttcatttctttagtaccaaagaagataaacccagaatcagctaataattttagacccatttccttaagaatataagtctcaaacttctaactaaggctttagctgatagattacaaggagtgatcactgatttaattcaccaaaatcaatatggttttattaaaggcagaacaatacaagattgtttagcatgggcttttgaataaattcatcaatgtcagcaatcaaagagagaaattgttattataaaccttgattttgagaaatcttttgactcaattgagcatgaagcaatcttgatgatattgagacatataggttttcctgctaaatgcttaaactaggtagaaatgatttttaactcagcaaatacttcagttcttttaaatggtgtacctggaatatccttcaaatgcaaaagaagggtcagacaaggggacccgttgtctccacttttgtttgttctaggggctgagttgcttcaatagagttttaatttctaagcctattcagcctgatgaagaaagtgactttcaataattcagtatgctgatgatactattatacttaggaaggctgatcagaaggattttttttttgtctcaaagacttagtttgtacaagctttaatagttattggacattttatatctgattttatagttgaggggcaacgtatgatactcgaccaacagttaatggatccaaagtgaacgtttcccttagaagagggcctaataaggtctatacatgcgcttcagctttttatgcggccgaagggctttgggcctagtgggaggatttttctttgccaactctgtgacagtgagtatgattttcatacttaaaccgcaatactagatacaacgggttcctcaactattaaaaccggtgcaatattggtcccaggacagtttggatgacggtttttagctgtcgtggcacccacgtggctaatttgaattggtcttcatctaacgtggcattgacgtggtacatgaagcaaaatttaatagtttaatattaaaacaaaaattgtggacccatgtgttagttaaacaatatggttaacatttcttccacctaatcctttctttgacatgtacggccaagcctccgcctccccattccccggtgtctttggcaacactaattcctcccgccacgccttcgcctccgtctcccttgacgatgacttcaagcacatggagagcaacacccaaggtgcctccgccgacatccattgaaaagagtcctctgaccaccgcaccggacccttccccacatgatgacgtcttctcctcccctcatcgacccaccattcatgccttctccgctgccgcttccttccctgcctcttgaaccccagcttcgtgcctgccttgcagatgcaagcggtgatgacattgtcgatgggaaggagaaggggaaggcccccgctctggctggctatgagcgcgagtggctgcgcaggatcttcctccgattcaagctcgatgtcgatgggagtctcaccaagctagagcttgccgcgctcctctgcatgctcggcctccgcctggcatgggttattgttcccgatttcacaaaagcgcagcaactccgacttcactagaagacaacaaccaaaccctgcctgaaaccaagcgaaaggttcaattcatcgttgccaagctcatcaaatactcgacgtagcagctccgacttctcagaaaccctccttggtgtcaaaatggggaataacaagagaccgccatggatttccttgacgatacgtttaactcccaacatatcggagtagaagatctaccatgcatgaagttaaactagataattaaatttcagtcattaattttgcggtacacttaatgctacattattttacatgttagtgtactcttattcctcacaatgaatgcctctaaagtgtggaagaacactaaatatatcataaacctacaaatgacacaaggaagccaacaatatagcatatgatctatcgatcatctggcgaatcctgtactcagaacggcctttttctcgaggttgtaaaccccgctggtctggctcccattgtaccaaatggacactgtgcttcctcctgtatccgtaaagctcagatcctcaagaactaatggcgactgtgggcatcgctgcacttcatctgctagggcaagccgccgaagctcctccgccacgaccgtcattgctggtcttgttgtacctggaacaactaagcattgactcgctagcatcgctgcacgatagatcaccctcatgctagcttcatcaactatgtcaatgtcaaggagctcacggagtgtatcatgtgctatagcctcctgaaacattgatgtcaagctcctcctttcttttgatagtggcttcttacctgtagaagctcaagaaggataactccaaagctatatacgtcattcttggatgtgagctggtactcgagtagatagtccggatcaatataccccggagtgcctttgggcacagcctgattttcctcatcaattgttgagcacccaaagtcagacacctttgcgatcaatccctcggcaagtaggatattagctggcttcacatcgccatgtagtataggatgcggtaggcaatggagatgcgcaagtgcttcagcggattccgcggcaatcctcaaccgagttcctagtgtgacatggaacctcctgcttctctggaggtcaagcagctcttgcaatgttttgttttgcacaaactcatatacgatcatgggccccttgaactgcaggcaacagccaagcaactttactatgttgggatggttgacacgacaaagtataaccaactcctggacaaagtccctcttcatgctctcgtcaatttccttgcattgttttatcgcaacagcaactccgtctaaatctgccttgtaaactgttccctgtcctccttcccctatgatgtgtgtcttgctgaaattacccgtggcagtctcaatttgcactctgtcgaagagagtgaacccgacattgccctctactttcatcatttctaacaggagctggcctccatgctgctgaaaatactcatcagtttgtctttgtaaattttgccttctgatacttcttttatgctggatcacttctcttatgaggaagctagctagggcaaggaaaacaaaagcagagattcctgtcgatgtgaagattaattagttgttagtatgtacgagaatttaaataagcagtcactttgacattgatgaatcgaacagtccctgttgactagatcaaaatgacccagacccttttccctaacgtattgggacgacaaacaagaggattatatgctcttattagaaaaggagaagatggcagacgaaattaagtcagtattaacacacacactctctactatatggcacgacaaggtgctacgtactaaatggtactgatacagcccccagccccaccctcacacactccccaccctgcccccactaaatccatagcatgctgttaaaatttaactcaccgacgaccaatctcaatcccacccctgcgcccctcccccactcccataatccgggtaatttttttacttgatgttatccaatgtgtgtctttgtgatccaacggtgttcgtacattgagctattttttaacttaaccatacaatgaattgttaaatacgaagccagtttttttaacggttagtgagatagtcaatgtgtgtcttgtgatccaacggtgttttcacattgagttatttttttacttgacatactgactttatctggtatatatattacgaattcccatcgaagaaaccgtccacccactcattactctccttctccacattttacggatctgcgacggcgtgcggttcctcgtggagagaagaggaacgacgacggcggttaagggatgaggagtggcggcgaggcggttccggtgatgggttggcaacgaggaggagcggcagcagcggcggcggttcggggatgaggaggagcggcggtggccgttcggggatcaggaggagtgatgaggggaaggagcgacggatttggtggcgccgaggtgcgtggacaggtgcagcgtcgacgggcgaggtggccacgggcggctgcggatgggaggtgaggtggcggcggatccggccgccgctctgcaccccatgcgcgcggacccggccaagatggggcggatccggcgtgactacgggtgtggcgatgacgggcgactacaggcgggaggcgcggaggcgcagcggcaacgagcacatcggcggatcagccgccactccgcgtcccacgcgcgtggttccggctacagcagtgcagatccagcgcagttgtgggcgtggatcctgcacaggtgacgacggcgggctgcaagcgagacggcggaggatccgtccgctgctccgccaccacgcgtacggtgtcaaccttcgcggcggtgagcttgtcctccggcatccatggaggagcagcggcgggcacctacacgacttgccaccgtcgatgtccgttgtgatgatcgattgtaataatatgcatcgtaaaataattattatccacgttgtgattgttgaaattttttactaccaattttatttggtgaaataaaaatatcagtacaaaataccgtttattccgggcctcctctaaccacttatcaaattaatgccgaatcaatacacgctaggatcatgtagtttttggaccattacgattttcatttttaacctcccagttactatgacttggggttgatttctatccgatgaattaaacattagttagcatgtgtatatgtaatatccgagatacgtggctcggtctaatcacacacattagcaggcccctatttctatatagaaattaaaagatctatcgatttttgcaaggtacaaaaactccaagttattttttaactcaatatcctcgacaccatagtccacatcccaactgtatcaagttaaacattaactccacaacaatgccttcacaaccgaccacccatgtgtataaaacttaaacgtttactaatactagctaaatctaagttaaactttaactcatcacgaatggcatcgtaatccatcaccaactgtatgtaagttaatttttaactctgagttcggttggttgcaccagtggggggacattcccgctgtgtgtcgctccattttggtccctggcgcgctgcgcccgtgtgtcgcgccgtgtagcgctaccaatgtatgtatgtatgcgcgttactagtaccatggtactgctaactcgtacattattgtttcttactactcccttcgtcctaaaatataagtatttttagacttcgacacagtcttcgagatactactttgaccaacaatatttataaaaatagcatgttttaaataaaaagtgttgcatattatgataatttgtttaataataaatctagtaacatcaattctatatgattgatatttttaatttctttattattaatagttaaagttaaaaatggttgacttaccactatgctaaaaatgttatgtttatatttcgagacgaagggtgtagtttgtactaaaaataacgttacgctctccaagactgaagaaaaaaaagctagctgtcgcactgcgaaaaagctagtagtagcttcatcatttcacctggactagctatgtgatacgcataactagaaataaagtctattgggagaattatccaatatacatagttagagatgaagtcattttagacagaggtagtaggaaaagtaaacattggaagaagcttaaaatactactacctccgttttttaatagataacgctgttgactttttctcacatatttgaccattcgtcttattcaaaaattttatgcaaatgtataaagtataaatcacacttaaagtactattagtgataaaacaactcataacaaaataaattataattacataatttttttaaataagacgaatggtcaaacatgtgagaaaaagtcaacggcgttatctattagaaaatggagggagtagtacattggaagaagcttaaacaagtgctaatgtgcaaaaaaaaaaaagaactaacatgttgtttcaatgtgcaaatcgaccattaaaagcatctgaagagtcttcctgtccaatctagtgggtgatgttgtatgtgcaatgtcggagaaggctagcagtaaaatgtacacattttgtaagttaagcatgggtaataaaaaagttattaaagatgattgggagaaagttgtaattggctaagaaaataaagtagatgatgaaattaaattggggatgtttgttattggttgatataaaaggtatatgaagaaatacttttattttgattaaaatttaataagtagaaaatacgctactggagaagtgatctttgccgggtcgggcaaaaaccacatttgtcccggttcaacaaaaaaccgggactaaaaaccatttttactcccggtttaaaaatgcaacgggaagaattgatctttactaccaatcgggactaaagatggtttgccgattgtcaggatgtgtcaggtcccccggatctttaatcccggttggtaacaccaacctggacaaaagatgggatatttagtttcagtttgtgttaccaaccgggactaaaaatcttggccatttttagacccggttggtaacaacaactgggactaaaattaccctccatatatgtcatcttcttcttcctctagcccgagaaggcatcaaaattttcttgagttttgaggggaggtgctaccaaaatttttggttttttgttttggtgataatatacaacttggaggtgtcaaaaaggttagcaacttcatcctcctctcttttgttgttagcatttggatttagagatatattttgtatactattttgcctctagaaatttggattgggtgatgatgagagagaaagtttgtgtaaggatgaagtaatgtagaaaattaatctaaaagaatataaaacttaattaagttaatttaaattaagtaaaacacattaattatttgtttacaactttaatgtggaattaaaacatgattaatttgtgctattattattataattattgttcgaataattatatataactgttgtatgcttgtttaatttgatagaaaactaagttaatttaaaatcaaaaataattacaatacattaaatatttgttaattaaaacatgaataatatgtggtattaatttataatcaaattagtttatttagaatttgaaaaaaatcttgtgataaaagagatgaggaagtaaaatatagaagattaatctaaaagaatagaaaactaagtcaatttaaattaaattaagtacaacacattttgtccaggggagatacccgtagatgtcacaccctaaaaattcaaaatatataaattgttgtttaaatggaatttttagaaataatttttaaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtcctcttttggctttgggccgaaagtcggcccaaaaccctctctctctcctcggcccaagtcggcccagtccgccggccgctctcctctctctctcccgctgactggtgggccccacctgtcagggtcgtcgtcttcgtcgcgccgtcgccgcccgaaaccctagcgcgccgccgccgccgtttccttccaaatccggccgctcctttccttctccggccgaattgatagaggggaaatgatcttctcgatctcctcttccttttctcttttggaaacatcggctaattcgttttggaagttcgtggaatcgagttcgattcggatcggcctctttcctccgaaccccgaagtttccttcccgtcgccggccgccgtgggccttcgccgctgcctcctagcccctttaaaaggctccccggtgtctcctctacccgccgccaccctcgccttcgcctctcgtcgtcggaaacgccctagcgccgtgtgccctagcgccgccgtcgccgccgtcgctccaggcgtgcgccgccgccgttccggtcatcgtcatcgctcgggaagaccgccgtcgtggtcgccaagtcgccgccgtcctcgtccgccccttcgccgtcgccgaagatcaccggagcaccgtcgccgccgtcgacccgatctccgccgccgtttcaacctcgtcgccgtcaccgtcgccgtccgttggtcttccgccgctcctttggtcaccggtgagttcgccgcgtcgcgctctacccgttggtgtcctccgttcgtgccgaagcgccgccgttcgccggcgagcgtgcgccgtccgagccgccgccgccggtggtgacgtcatcgccgacgtcatcgttgccctctcccgtgagccggtcatagaccgatcgatctcggccgtccgttttggatgagtcgatctctgccgtccgttcgtgtgaaccgccgccgtgcgcccggtccaccgaaaccctagccgctgacgcaataaatccttttttccttttcaaaaataattcattattgcgtcataattcaattaaaatcaatataagtgttttaatccgatttaatcttcaaaaattcataactaattcatcttagctcggatttagttggttcaagtatctaagtttttctaaaattgagatctacatgttaaaaatatccacatgtactgttcatgcttgtttatgtgctgttttggtgattttgcttctttctgtttagattccgtcgtttccggagagtccgtttttgcagaagaagaatttgaagagttccaaggccagcaaggcaagtcacacagatcccaaacaaccctttgagcatgttgatcccgtttaaagctattgtttctattcaactaatgcatttattttcgaatgtcattgggtggaattaatctattgtttgctatagcccttttgttcttgattactttattccttgataccttgggttattaaaacttgactagttgagctttatatttactggttcaactagatattagacataattgcttacccaagcttagaaacattagcacactattgggataacttatgactcactattatttaatgatggcttaatgatagttcacgatggtcaatcgtgattggttaattaattaatgtgccaactaaaacctgataattgtgggttgtgagcacatggttttgatggtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagtccacgggggtcgctggggagtccatgccttgtttataagggggtgattatgatccaggaaaggtgcgctgtaatggattgtgttatgcaaggggtattgtcacaactcctttccgaggtaccgtggtggtattgaggcacatggtgacatgatgtggggctgtgtcttgtgggtacagtggtacacctctgatcagagtaaaactattcgaataggtgcccgcggttataggcgggtctaacaatgtctttcgtgattagtctcacacttttcaccatattaaatggtgctataattggtaataatttgattagctcctggtttggaatggtatattcctggtttagagatagaactgtgcagccgggttggttgttcagaatggttgggcctatacaacagggtatgttgtatagcgttggattaatattgtttaattaatacttaactgttttattaaattctcaaatgtttgctaaatgctgcttttgcaaatgaaaccctattatgccattctttgttatcctgtgcacttgcatatttgctgcgtggcttgctgagtatgtcatatactcaccttgcaatcattcatcagaggaagagttctacaatgatgctgatggtgtggaggattaggtgtagccttggtcaagctgcctgtggagtggagccgtctgcgccgtttatcttaattttccgctgcttagatctttattgattgagaggaactatctacctctgtaatgacattatattcgcttattaattagagtaataattgtactctattatcaatttgttattgtgtgcctcggctgattcctggacgagggttcacacacatgtaagcgtttggaattttggatagaaattccgggcgtgacagtagaccggatataaagggtattggggtacgctggtacgaggatctatgtagtatgacatcaagcaaacaaaagacaagcattatactggttcagaccccttggtaggtaatagccctgatccagttggtatgggattatatgatggaaactacagattacaaagggaataacagaactcgatgataccggcgagaccgtagtcgagttggtccgactagatctcccggcgacttggctcctgtaggctctgacttcataggctgtggtggatgtgtcggcggtcagattcgatgcgttaggtcctgcccaggtggtcccttttataccgcgggtcagttgatctccaagtaggactcgaaaatatcggacccctcacgatatggtaacgacctagtcttgttcgagtaggactccctgcatctgtggattctgtttctatcacgtgatagatttccttaatgtatacaggaactatccgtatacgcgcgggtataccgtatcagtatacaacgtatatccaaggatagagggtataccttatccgtaaccctgacacattcaatatttgtttaaaactttaatgtggtatgaaaacatgaatattttttgttattattttataatgattgtacgattaattatatgtaactattgtatgatgtttaattggtttgactttcgtggatcggcaatggatgcgcgcggactgacggtcgaaagagtttattgacggcgtgcattattttctaagagtggccgaggctaaaaagcagaataatggttttatccgttgtccatgcactaagtacaaaaaccagagggagtattatgtagtaagaactattcagattcacttgtctcggacgggtttcatgccgagatataatgtttggacctcgcacggggagcaaggggttcaaatgaagatgatgaagtagaagacgagaacattccggactggctcagtacagtggatttgaaggaaatacaacgggcgaggtagaaggtgctgttgaagataacgatgctgcagatgatcttggtcaaatgttgcaggacgtcaaggaggactgcaaaagtgaaaagggggctcagaaattagagtgtatgttagctgatcacaagacgccgttgtacccaggttgcgaacaggggcacaaaaagttaggtacaactctggaattcttgcaatggaatgccaaaaatggtgtcagtgacaaggcatttggcgagttattgaaactagtgaagaacattcttccggaggaaaacaagttgccagaaacaacatacgaagctaagaagatagtctgccctctaggactggcggttcagaagtgtagacactgataaaaagaagatcagaagatttttaaaaggaatggatgcgaaactgcgagtgaaacttttggctcacgactttccgacgtttcggcaaatggtcgataagtccttgttactagaagatgcagaacaagagatgcaagaatacaagagacgcaaagtaatgtccctagagattcaagcaaaagaaggtttgtgtcgaaaaacaaactcgccagcacaatactatcagaaagcatctcagcattcaaatggttccggttctacgtctcgttcgactatgtcagaacctggtcagcaagccacaatgatcaacaataatagccataaaggaagcaactccgtaccatgccctacaccttcaaaaagacgtggttataaggcaggagtcgaatgtttcatctgccatgagatgggacactattcatggtactgccctcagaaagtcaagtcaaaacgagtccaaccaacaacaagccttcctaacgtatctggaccaaaaagttcaaagccaccaaatagtggttctgcctcgttgacctcaccgcccgttggacaaggtcgtctgaaccatgtgcaagtagaaacaaatgaaaaagttgtgaatctcgagcaagttgaaggagcaggagaagaacaggttccacaggcaagagcaaagccacagtaagatgaagaatgctaagtgaatcaagttaccagaccgttttgtggcaagtatgcaacaataagttgaagaaagactagcagagtctgaagctgtgaagaagtctgaagatccctttttggtttcgtgtgtgtggtccaccgtcgaatctcggggtcgagattcttgtaaggggggtggatctgtaacgctccacttttcgtgaggcgttaaaaactaattcggcaaaatcctaattgcgaaaattttcgttctttgtgtgcgagtctaagtcgtgccgtggatctcagtttaaatccgtccttgatccctctcgtcgccatcaaaatcatcctcatcgaaatttcctcttccaatttaagtctccaaaatcaaattccgaaattcaaatccttcctttgaatcctcgccaaatacttctacgaatccagaattattcaaatcccgcctcgaatcctttccttgactccaccctatgttcccgagaacaaatacccaagtattccttttgaatcttttccatgacttctccttgagtttcccttgatacatccctaaaccctcgagtttgaatatcaaatttgaattcgaatccaaaccctaaatctctccaattctatccaaatcagttttctctgtaaaagtctactttaccaccctgtgtttttggatggaccgattctcctcccccggcccatctcccctcccagcccatcatctccccccctcgcacgtgcgttgcacgcatgcgagccgagagagagagagccgtcgctcgctctctctgtctctctcgctctcgctgtttctccctctctctctctctctctctttctctctctcgcgccgacgccgcttcccgccgtcgccgcccaaaacccgccaccgccttcgctctttcccgcgcttgcgcgtggccgaccggccggtcgttgccgccgtcagccctgccgcgcctgcgccgcgcaaccgcccggtcgccgccgccgttagcgcctgcgtcgtgctgccgctcggccccgctgcctgccgcaagctctgcagcgcgtgcccaagccgctccacccgcgtccatccaaatcccagaggcagagcactccctctcccacctcctttttcccaaaccggcatggtaaagcccccccttcccaccgtcctcctttctctttttccctcccaagcaacgacgccacgcctccactccttggccgctagcgcttggaggcagagacgcagatgccagcgccagctcgccgcccccaccttgactgcgccagcccgcgctaatcctcccgctcccgcggttcgattttccgccgttcgatccaccgccttcgccgcccaacgcatccacaccgtcgctgccttcgcgctgcccacgaaaccgccgcagccgcccgtgaacaccagccgagctcccttgaccgccaatgtcggtttccctcctccaaaccgacctctcctcctcgcctataaagcccgcgccctccccaccgtgaacccaaccaccgccaggtgggtcccgcgcggtggaccgcgtccacccgcgtcggcctctctctccccgcgcccctaatgggccgaccacccgcgcccgcgccggcccaatggcctgaccgcgctgcgcatgacccttgggtcgagcccgagccgcccaaagaagtctaaatcccatccctccttcaatttctttccaaaaagggtttaataaattattaaatcctttttcctttggttagtaaatccaataaacttcgaaaatccatatattccaaaccgctcatccgattgactccgttcaacttccagtaattccgtaaaattgagatctatttaatggcactactaattagtctaaataggatctttcttttggtcctttgtttaggttttcgattgtttgcgtatagttgcggttatcggattttcgtcgatcgcgggttttatcgaagattcgtgaagcttcatgaagaccttgagcaaggcaagtcaccctttgatcaattgcccctataattgaaaagtcattattattttgtttgcaacatgcattattagaatcacacacttaacttgcttggcctcggtttgcgtgccaaaccgacggacctacccagtagtcgcactaatttctgtaggtcgtactaccctgattccttgtcgctccacccttgtggtacctcggtattcgtgctctctgagcgcgtataccaaatatcccacatacaccgttgtttgtcgaaaacttgggaaatgggtttgtgaagccttcaaaacccgacatgcggtgtcggtgtgtttgaaaataaaatgaattgtgaaaactcgcgatgcgggggttgtgcctatgtggcactgtcccgtattcgcatataaggaccgattcctgtgggaaactcatcaaacataatcaaagtgcaaccacaaggtggaatgggacaccctagctaagtaactagtcggttcagggaaacctcgcatgccaatagttggggaacgccggggcggggtcgattggagccaacccgggttcctggtaaggccagaacgcgaagcttgccagattaccgatcgaggtggttggagtttgatttgtgaaaactaaaatggcctatatttatgtgaggatttgatccttctatgtggcatgaggtaaccctgggtcagcttgggaaaggctttgttgcgaacctccgatatcgacgggtgttcggaataagttcgtatcttgtgggtaaagtgtacccctctgcagaggttaactaactgttcaaacagccgtgcccacggtcatgggcggatgtgaggtggttcccgttgcgtagatttgtttgcctgtgctttgtgaaaagttgttgttgtgtgggaatcgtaacctgaatcagcctatgtggcagatggacaacctgagtggtcagaaacgaatctgtgtgatttgggatgtctgcgggcatcatagactaggcttcccgagtggaagcggattgttgtgctgctgggcagctggactctgggagtccgagaaaatgaaaaaggctctgggagccgattaatcaagtggaatggctctgggagccgagaagtaatgatctgacccgggaggtcggtacattactaaatgagctgttgaaaagcatctcttaaagtcgaatcgagacgcaagtctcttttcgccccaaacttagaaagaaataaatcacttagtgatttcaaaatgtcttcaaataaaagatttgtaaaacaaccttgcctctcttccaagcttgcattaaacacctaagttcccgtgacttgctgagtacgaaagtactcacccttgctctatataaatatatatagtttctccgccctgaagttgaagatgaggtgaagtgaagattagggtttcgtcctggttcccagccgtcgcctgtggtgttgggtgttagaccgttggttccgctgctgctgccgttgttggtgttcgcctcgtccgtgtcgtcggttgtattctcgggctgtctgagctgcaacctaagctaaggtaaataagtcctctatttattttaaggattgctatgattcatttttgtcaccgtgggtaccagcactatgtcctgggactggtaccgagatcgcggtttcgtaggaagcggttcacgccgttttccctacgacacgctcctgtcaggtgccgttgtacggcggtatcagattggggtgtgacaagaagatacacgcatgtccgaatgattgtatcctctatcgcggtgaggagtacgagaacctagaagcatgcccggtctataatgcactacggtacaagattagaagagacgatccaagtgaagttgacggacagccctcgaagaaaagagttcctgcgaaggtgatgtggtattttcccctaataccacaacttatacgtttgttcaggaacaaagagcatgcaagaatgatgcgatggcacgcaaaagaacgtcaacaggacgggatgctaagacacctcgccgatgggtcgtagtgacaaaacatcgatagaaaagtttaaagactttagaaaggatgcacggaatgtaaggttcggtttaagtacggatggataaatccattcggagagatgagcagcggccatagcacttggcctcttatgatgtgtatctacaacctccctcctggctatgcatgaagaggaagtacatcataatgccgattattattcaaggcccaaagtaatctggtaacgatattgatgtgtacctaagaccactggttgaagatctataactgttgtggaagaaagaaggcgtccatgtgtgggatgaggacaaacaggaggaatttaacctataagcgccgctgttcgtaaccatcaacgattggcctgcccttagcaacctatccagacagtcaaacaaggggtacaaggcttgcacccactgtttgcaagaaactgaaagtatgtatttgaagcattgtaaaaaggttgtctacatgggccatcgtcaatttcttgctgcgacccatcttgtccagaagaaaggcaagcattttgatcagaaggcggaccaccgtaagaagcatatatttcgcaacggtaaaaccgtgttcgatatggtgaaagatctgaaagtagtgtttggaaagtgacctggcagccaacccgtagccagcgaagatggtcacgcggcgatgtggaagaagaagtctattttttgggagttaccctattggaaaatcttggacgtccgccacgcaatcgacgtgatgcacctcaccaagaacctctgcgtcaacttgctgggcttcctaggtgtgtacgggaagtcgaaagatacacttgaagcacgcaatgatctcaaagatatgaaacaacgtgaggacctccacccggaaccaaaggagaaagaaagccagtacttaagcccagccagctacactcttagcaaggcagagaaggaaagtatatttgaatgcttggagagcatcaaggtaccgtctgggtactcctctaatataaagagaataataagcaggaatgataagaagttcacgaatctagagtctcatgactgtcacgtgttgatgatagcaccggtcgaggcaaaggtagggctgaaggactacaagcgaacagtgaagaaggctgacgaaaagtccaaaagacagtccaaagaagtccctcagcttggagatcaaccacagcccgagctggatcccggtgacgcgtttcttacacctaaaaaacgacagatcaaactattcatgaaagaaaccggtctatccttggaccagttgagggagtccaacgacgcagagatcccagtggctgaggtgaaataccaatttaagctgggtaaacctctcgtcaagcctgatcaggtgcagaatctctccacgcaaatgtaccgattccatcaatggtacatggaacaatcagcgaaaggtagaacgatgttcgagtaagggctagaaacgctgagcaaaatctcttcactgcaaaatctcttcgctggtggaccagttgcctgcctaggaaaatcatgatttctacagggattgtggtacaggcgggactgtggtacaggcggcattgctagtcggtcgcttgtgaaaacatgttttgtccgccttcaaaaatactttatctcatagtgactccgaagatgtagtagcgtgaattgaagacactataaagaatgaatgctattatatgctcgcgaaaaaaaaatgaacaatattactactcgttatgtacgggaaataaaataaacagtccaaacatgtagcatgagacggaagcatgatagtaccaatagcgatttttgccccagaactgagtggtagttgatctctctcgcatgtcccattttgggcgttgcctttcggataacccggagggcacacgcacttgaatgcaccgggagtgttaacgcaagttccaggcacagcacacgggtacttcgaccaatcagtgcactcgttgatatctgcaaccaaatacatgtttaaaaatatgagggaataagcgaaacggcatattttgcaaacgaaaaataatttataaataaaactttcatatacgtgttcttagcggtctaaaaacaatggctgaaaaataaatttcgatgaaaaaaaccccaaaatcaacttcaaatttaaggttgaaaatttaaattttggctaataagcatacgcgaaaagatgaggctatctgagcacgtgcaaatatgattacaaaagctaaaaggacctatcttatttgtaacgtgactaagtttattcttgtctatcaatcactttcaaacactacatcagtacctttatatttttctccctgtggtgaagcaaatattaatgttgtaacctaaaaggtaaagtattatgctttcgtctaactccttagcagaatggaaactagctagaaataatgatttatacaagtataataattcatctagaaagaaaccaaactaaagtcgcacttcatttttaccgaatttgcagtttttcaactgtgcaagtttagcaaatggcttgtatatgtaactgtagtaaatgtcttgtgcaagttagcttgaatgacggataagaaaatatcagacagactgataataggaaagcagaagactgaagttagaataaggagcatcctatataaattaagtaggcaaggggttgacgcggcatatactgatacggtcaacacagagaaatcgttcatttcgtacctttgcatccaagctctggatcatccaggtaaggatttccatgaaatccttccttgcatttgcagatatagcctggtccattagacgagttgaaacagtcactgttgttactgatgcacgcgtatttgggatcgggattgggattccgccgcgctgcctcgcacgtttggttcccaatggcccaatccagaagcaacggcgcctgcccggcgtatgtgtcattgaacgctgatgacatcgcatagctcgtggaaaaggtgaagtttgatgcttccacgagtgctgcgtagctgcaacggctcatgttatagatcttcgctgtgttaaagcggtcatcgaaccagatcccatagttctgaagcccctttgggatggtggtctgacagcagcctatcccagagcaggttccatcggagagacttgcaaggtcgccctggctattacatgtggccacgcatccggtggttaaactactgctttccagctgttgcggctttgtgatggtgatgtaagcaagtgttcggcatccgatgaccgtgaacttgttgccagtatcagataatctgtatggtgtatccctgaaggacagaaaccaatttatggagtccattgttctgttaatcgtgttatagcacgaccaggatatatccatctttatccgaacctgagattctgctagcaagatgccgcgcacctccacgtcatccgagagaaacggcttgagcagcaggccgtcccgtttgcagctcacctcaaagccaggaatggcgcagcctggctgatcgtctttcatcccgaacggataagggatcgctacgtcgccgcaacttctacggcaggaagatgcaacggcgggcaggcatgccaccgttgccacagcaagccatagaagagctctagttatcccgcggggagatggcacgggcgatgtttcactactcatttgtgctgttcgagttagcctttatcagcgaatgctgcaacaactgcactatcttcgagtgatctcgagtcttgtatatatatatggtgtattccctttgagagatgtagatcgacagtagcccgtgcttgatgtctaaattaaagttacgtgcgatatgatacacatatgccagtcatgaaatataataactcataattaagtcatacttggactagtataagtcttccccgcgagtaggattaggtcaaggtcttcgcgcgtgcgagcaactcggcaagccggccgcctagcgtacgtagagaacttcattccgacttttcaaatcatctgcggctctactgtatattacgtggcataatttggtccctacgcatttctatttaaaatgtcgacaactatcaaaaaattatgcaacgtacatgaatatcgttacactagaacggataccctcatctcaatcgggcggtaagccccatctcaatcgggcacagcgtccgtcacaggctagaagtcactgatgtgaaaagttatcccaatcgggcaaacggccgttacggatgaatctatctcaatcgggccctaagtaaagcccgtcaccgatagctttgacccagacgcccagtcaaactatagcccgttacagatgacctatctcaatcgggccacaactagcgcccgtcacagatgactactaacctttatcgggcctaaactagagcccgtcacagatgatactcatctcaatcgggcctaaactagagcccgtcacagatgactgctgacctcaatcgggcctaaaatagagcccgtcacagatgattactgacctcaatcgggcctaaactagagcccgtcacagatgactcctgacctcaatcgggcctaaactaaagcccgtcacagatgaccgtcatctcaatcgggcatttagttatggcccgtcacagatgactataatccaaaaaaaataaatttttttttttggctagcctcaggtcttctttgctagccatgccggctacaaaaatgacaaaaacaaacacagatatctaatatccccagctctccagcatcacccattcatatacatatgcattcacatacacaaacatcaacatatttcacacaaccacacattcacagccatctcatatttcacatccattcacatatttcacatccattcaaatatttatcatatttcacctgcaaaaccaagttagttggatcaaatatttatttagcaagtcttaacataaacatatgaaatatatacataaatataaacatcacagttacatcatcacagttgcataataagtgttcatcattgcctaaacataaaagttcaacattgttcatcattttagtttaagcctaaacattcctttggggttaattatttcgcggaggatgaagctggctatctcctcgcgaacctcctcaaagctggtaggcagagacttggttattgtgccctatattgtcataattccagattagttgatcgatcatatataagtactaaaatgtagttagtctatcacaattgagaccaccgacctcaaactcagccaaagtcttcaccttttctctatacagaaggcgcatgttgtggcacacatggaatccgcactggtcacctatttgttactttaccgggaagtctttttttgtggatgagggtgtcatgtcctgtcttcctgaggcctcctctttgcacatattgggcccacgcttcatctatcgctagttgaattggggtccaatcaaatgcgttcttatcaattctggagttcaggtggtgacatgtactccacttaggtgttatgaccagaaggatccaatgggcactgcggcattaatatagtgaaagttgattaagtacttaaggaatgtgtcatgctgttgtgtatatttagttaacacacttactattgattataggcgcacataatgtactccttgtctcggcgggaccacaaggtgtcgtagatgtagttgaccattccttgacggtcattctggagatttgtgacagtgaccacttgtggatcaaggaaggcaacttccggtgcatgcttctgacaccattgccaactttacctacacacaggataaatgatcttgtaagcaagttaaaccgattgttattaccagattgagttgggctacagtacttacaagaagtagcacttaaggaggcttgtgtccaccgctcggagcctgtagtggtcgaaaagatccttaaagtagaccatgatataatttgttgaaccaaggaatggctttccatcgtgctctccaaggatatcggtagctttattcggcttcctgacgttagatttctccatgtagtataagtgaaggtccttgcaagcggtgcccattgcggcaagcacgtcatctccaaccaatggcatgcctagttggaactcctgtggagcgacgtatttcttcttgacctctttgcccttagtctcttcctggcccttgcccagatctagcttcctcggagctagaagcgaggcctgcaccttttctccccttcctctcccctttgcttcgggtttatcgagagtaattctctgaggggaagagtgtgccttcctgctcttcttcatcggtgggggttcatgaattgctttgctgtcggcctccggcccgattgagattacttccttgtgacggcccgcaaattccagtcttgttatgggccgtcacagatgaaaggatctgtactagtgttactatgataccggagaactgatctttgctggatcggttgaaaaccacaatagcaaggttccaaaaaaaagactaaaactacttttttagtcccggttaataactccaacgggactaaccgcccggttcgcctcctgacagggcctgttagggtcctgtcagagggccggggatctttagtcttggttgttaacaccaatccggactaaagatctaaagtggtgatctttagtctcggtcaagtgggactaaagttacccacctttttatacttcttcctcctccagcccaagtcattgatgcaaattggaggtgtgagggacggaggtgctaccaaaatttttggtgaaatggttttggtgataatatacaaattgaagggatcgataaggttagcaactccattctctaattgtcacgtcctgaaaatcgcctaatttaataattcatcttttaaatcatttttagaaattaatttaaaagcttacaagttaaactctaataatctatgaaaaatttcaacataaaattgagctagataaaattttattaaatactttgcttgtttatctattttttagatttttctaggaattatttgagcaagggaagtatttttaataaatgaaacatcatttcacgaattattttaattgaaaaagttttaaaaatcctcccctaagccgttgggccggttttcggcccaacatccctctctcctcgcgcaagccgagccgccccaccctcctcctcccggccaccgacatgtggggcccacatgtcgaggttgtcttcaacctccagccgagccggccgagcccgagcgccgcctccctcctccaaattcgccctatccggtcgccccgagtccgattgtttgaggggaaagcatctcctccttatcctcttcctttcccctaaggtttcgagaatcaattttgcccggataaaccaaatcgagttcgttttgagtttatctctccaaactaactttagattttcccagctcgattcctctcgtttggagtccgatctctctaatcaccgcctataaatagcatcccctagtcgtcctcttccgtttgcctcaagtcccaagctccctcgtcgtccgtagcatcgccaccgcgttgccctagccgccgccgcctctccagtcgcgccacgccgccgctttagccgtcgccgccgcctcccgtcgccaccgtcgggtgcgcacggaggaggagaaccccggccatcccttcgcagccgccgaagaccaccggagcgccgttgccgtcggggaaccgagccgagccgccgtcgaacctcatcgctggccgtcgttcgtcgtcgtccgtcgttgtttttcgcaccggtgagttcgtgacgtcgtcctcttcgcgttggtgtcctcggtgagcccggccgagctctctatcgccggtggccgcgtcgtccagtgctaggtcggcgatgacgtcatcgtgacgtcataaatcttttatttaattcgtaataattttctggattagatgaaaatcgattaaaacttcggaaattcataactaaatcgtcgtaactccgattcgggtggttcaagttgctaaattcatctaaaatcaagatctacatgttaaaaatatccacatgtactgtttatgcttgtttttgtactgttttgttgattttgtttatttgctttagtttccgacgttccggaggagagcgtttttgttgaggaaggatcggaagcgtttgaagaagctcaaggcaagtcacaaagatcccaaacaaccctttgagcatgttgaagctatttaaagctaatgttttatttcaacttatgcattattttcgaatatcatcgggtggtgagcttttccctattaattaatggccaatgatgaatttattttcctatgggtaataaattgaattagcttggagcttatatattggtttggttcagctaaaggctatatataggtataattgcttagccatgcttagaaacattagctcattaatgggattaatcaaattacattattatttatggttatttaatggtagctcatgatggttaatcatgttatgttaattaattaacacataaacctgattaaaggtgggttgtgagtacatggttttgaaggtcgtgctcatgacaattaaggaccggttcgcgagctactgttgtgaaacatttaccgtgccaaccacaagccagcgtgggcaacagctttaccttttgtatagcatgattcactatggggtgccagactgtgaagcggcgagaagtccgtgggggtcgctggggagtccattgcctctggttttgagggggagattatgatccaggaacggtgcactgtggtgagttgtgttgtgtgagaggtattgtcacagttcctttccaaggtactgtggtggtactgaggcgcatggtgacatgttgtggagttgtgtcttgtgggtacagtggtacatctctgatcagagtaaaactattcgaatagtcgtgcccgcggttatgggtgagtttaacaatgtttttcgtgattagtctcacacttctcattaatgataatattgtgttaattaatttgactcctggtttggaatggtatattcctggtatggagatttgatttgtacaaccggggttggttgttcagatgaggttgggcctatgcaacacgggtgtgttgtatagtgtttatttaatactgattaattattcaactgttttattattctttaaaatgtttattaaatgctgtttatgcaaatgagctttcctatgccattctttgttatcctgtgcacttgcatatttgctgtgtggcttgttgagtatgtcatatgctcattcttgcaatattcattcatcagaggaggagtatatcaatgaaggtgatgatctggaggattaggcgttgttcaggtcaagttgcttgtggagtggagtcaccatagctgttcagtctttgttttattttccgccgcttagaattttattctatgagaggaactatccacctctgtaataatttattttgcgaatattaattagctgtttgatagtactctattatcaatttgttattgtgtgcctcggctgattcttggacgagggttaaacgcacatataagtgtttggaattttggatagaaattccgggcgtgacactaatgatgtatgcttagcatattacatttatagctttgttggtatacaatatagtctccaacaaggtttatggtggaaaatgatgagagagaaaaatttgttgagggaaaattaggttaaaagaatgtggataaatatgttgtaaaagagatggcaaaggaaaaggccgaggaaaactaagttaaaataatagtaaaaacttagttaatttaataaatggttagagaaaagtacaatacattgaaggtatggttagaaatttaaaaataatgaaaaaatgaataatatgtgcgatttttgtataattattttatgattatttgtataaaagaatgggaaactaagttaattgaaaaatagttaaatagctataaataagtacattaaattaaaaatgacaaaggaaaaaactaatatagaaaattaagatgaaagaatacaaacctaagttaatttaaaaatcgttagaatagttagaaataagtacaatatagtcttccgtctcggcgccatctttgtcgctcttgcgataggcgccttcttccatgtcatcccaaattcatttaaaatatgtaacgtcggttttgagtttaaggatgatgttttaaattattgtatgattatttatttagtttacttttgtagattttatttttacgatttatatgcatttcaggttgatggatcagcaatggatgtacgcagacaggcggtcgaaacagtttattaacggcgtgcattattttttgaatgtggccaatactaacaagcataacggttttatgtcttgttcatgcgacaagtgcaaaaactagaaggagtattccatagtatgaactattcatgcccacctgtttcagtgggggttcatgcgtagctataattgttggacctcgcacggagagctaggggttgcagtggaagaagataaagtagaagacgataacattctagactgggcttagtacggtggatttgaagaaaacacaacgggcgaggcggacggggctgttgaagataatgacggtgtagatgatcttggtcagatgttgcgggacgtaaaggaggactgcgaatgaaaaggaggtgcagaaactagagcgcatgttagcgggctacaaaacatcgttgtacccaggttgcgaacagggccacaaaaagttgaataccacgttg

SEQ ID NO: 3036 - DNA, 2201 bp, Oryza sativa
tcctctatcgcggtgaggagtacgaaacctagaagcatgcccgttttgcaaagcactacaatacaagattagacgagataatccaggtgatgttgacggacaacctttgaagaagagagttcatgctaaggtgatgtggtatttccctataataccacggctgaaacatttatttcaggaacaaatcgcatgctagaatgatgtggtggcacgcagaagaacttcaacaagacaggatgctgagacaccccgctgacgggtcgcagtgacgaaatatcgacagagcatttaaagacttcggagagtatgcaccgaatgtaaggttcagtttaagtatggatggaatggatccatttggagagatgagcagcggccatagcacgtggtctgtcaccatgtgcatctacaacctcctccttggctatgcatgaagcggaagcacatcttgatgccgatcattattcaaggcccgaagcaacctggtaacgacattgatgtgtacctaaaaccattggttggagatctaaaagtgctgtggaggaaagaaggcatccctgtgtgggatgaggataaacaggagcaatgtaatctacgagcgttgctgttcgttgccattaactgttggcctgcacttagtaacctatatggacggtcaaacaagggatacaaggcttgcactcactatatggatgaaactaaaagtacgtaactgaagcattgcaggaaggttgtgtacatgggccatcattgattccttgttgcaaaccaccttgtatggaagaaaggcaagcacttcgaatagaaggcaaaccaccgtactaagcctaaacatcgcaacgaaaaagccgtgttcgctatggtgaaagatctgaaagttatatttagaaaggggcctaacagccaacctatagaaagcgaagatggtcacgtggcgatgtggaagaagaactctattttctgggaattacccattaggaaggcttggacgttctccgcgcaatcgacgtgatgcacctcactaagaacctttgcgtcaacctgctgggcttcttagatgtatatgggtagtccaaagatacactcaaagcatgtaatgatctcaaacatatggaacaactcgagggccttcatccaaaaccgaaggtgaaaggaagccattactttagtccagcgagctacaccctgagcaaggaaaagaaggaaagtatgtttcaatgcctgtagagcatcaaggtaccgtctagatactcctcgaatataaagtgaatgataagcatgaaggaaaagaagttcacaaaccaaaagtctcatgactaccacatgttgatgacacaattgctttccgttataatttgtggtatccttcctgataatgtccaggcaacaataacaaagctatgtgctttcatgaacgcaatttcgtagaagatcatcaatccagacagtttagcagcccttcagggggacgtggtgcaatgccttgtcagctttgagttgatatttccaccgtcattcttcaatataatgacgcatcttctatgtcaccatgtgaaagagatcggtattctcggtttgatacagaaatgtaccttgaggtgtttgcttaatttgcaatcccaaaaagtacgataactcacccatcatgctcatctccaattccctgcgcatagtctcaccaaactccacaaccaaagcgtgagttggacaaccaaagatgatatcattcacataaatctgaacaaacagttgattatcaccatgcttaaaaacaaaaagtgttttgtcaacctttcccatttgaaaacctttcgcaagcaaaaagttcttaaacctatctaggtgcttgtttcaagccatacaaagatttagacaacttaaaaacatggttgggaaaatcaggattttcgaaacctggtggttgattgacataaacttcctcctgtataaaaccatttagaaaagcacttttcacatccatttgatacaatttaaagccttttaaagcagcaaaagccaacaaaagtctaattgcctcaattctagcaacaggagcaaaagattcaccaaaatccaaaccctccacctgggtaaaacatttagcaacaagtctagctttatttctcacaatcaaaccatcctcattttttttattttttaaaacccacttgtttattatgtccagaaggtggttcaactaaagt

SEQ ID NO: 3037 - DNA, 515 bp, Oryza sativa
tcggccactggacggggcactaggcggacacggatcagtcgtctcatgctcgggggccacattaacgcccagttcgccggcatacagcgactcgaggaccttgggacccaacttctccacactaccaatggcctggttgaagttgaagctcggcgtcagatcctccagcttggccttccgcttgccctgctcctcaatcaaactgatgttgggcctatcccgggtgttcacgtgctccgtttcgatgttgttagccagagatccatcggtgttcaagtagacccacgccaaaccgctgctcttggtcgaggattcggcactgtgcggcgccagcagggtctggaagatttcgcagctggctcgggtcacgatgtgtccctggatgcgcagatgtgggtacttcttggactccacggtcagcaagagtttgccacgcgacatcagtcgaagattctgtatggaaatgggcgacgacagctccaggacattgatctccgcagaaggtttgcgcacac

SEQ ID NO: 3038 - DNA, 1424 bp, Oryza sativa
gtcgactctagaggatccccatgcttcccagatagtatcaaggaagtgaaacttaccagatcatggcatctagacaatgggatgccagagtcctcacccatcatgactgcttaaataagcaccagctttctgttggtgaactcctcttccctacctctctccctaattcctgtttccccgcacatggttacatttcttccctgctttagaaacccctaatggtagtcagttagggaagtgaatttgagactgatctcccatatcctcaacagcagcacctgattaaagccttcttccctggcaatacttgttgtctcagtgattggctttctgtggagtgaacagcaggacttagaccaaacctctggcattttggtaataaaatgatgctgtgcaactttcaaggatagatcacaaaaaatgatgcaacttctacgtggatccctgaaactctggactgcatgtgagaagccccactctcctgaggctgccctgctgtggaggaagccaggtcacacagagggggcacatggaggcaatccagcctacagacctgctcaggtcctagctgacagccaacatcaccctctagccatgctgatgaacatgcctccagatgattcttccctctgagtcattccttgcctttgagtcttcccaaatgaggctctagaaaatgtggagcacagacaagattttctttctataccctatccaaaattccaatactaacaatctgtgaacttaataaaatggttgctttacatcaccacatttctgggtgttcaatgcaaaaatagtagctggcatattcagttttctcatatgtaaaataaggataattttacttacctgttgtccaataaagtctctataagtatgctaaattgcattacacagtaaagtttttttaaaaagtcaaatttaggccaagcgcggtggctcatacctgtaatcccagcactttgggaggctgaggcaggtggatcacaaggtcaggagatctagaccatcctggctaacatcgtgaaaccccgtctctactaaaagtacaaaaaattagccaggcatggttgtaggtgcctgtagtcccagctacttgggaggctgaggcaggagaatggtgtgaacctggaaggcggaacttgcagtgagccaagattgcacaactgcactgcagcctgggcaacagagcaagactccgtctcaaaaaaaaggcaaatttaaggcttgttctgtgtcatgaagaatatctttgaaacactttaaaggattttgcatgtatagttgtccctcagtatgtatgaagaattggttccaggtgtccactgaggttactgaagtttgcacatgctcaagtcccttgtatgaaataacactacagctggtcctctgtatctctgggttctgcatttgtgcgggta

SEQ ID NO: 3039 - DNA, 9120 bp, Oryza sativa
  unsure (1)..(9120): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgaagaccttgagcaaggcaagtcaccctttgatcaattgcccctataattgaaaagtcattattattttgtttgcaactttcattattagaatcacacttaacttgcttggcctcggtttgcgtgccaaaccgacggacctacccagtagtcgcactaatttccgtaggtcgtaataccctgattccttgtcgctccacccttgtggtacctcggtattcgtgctctttgagcgcgtataccaaatatctcacatacaccgttgtttgttgaaaacttggaaaatgggtttgtgaagccttcaaaacccgacatgtggtgtcggtgtgtttgaaaataaaatgaattgtgaaaactcgcgatgcgggggttgtgcctatgtggcactgtcccgtattcgcatataaggaccgattcctgtgggaaactcatcgaacataatcaaagtgcaaccacaaggtggaatgggacaccctggctaagtaactagtcggttcagggaaacctcgcatgccaatagttgggaacgccggggcggggtcggacaaaccgggttcctggtaaggcaaggacgagaagcttgctcacttaccgatcaaggtggttggagtttgatttgtgaacgcctaaaatggcctatgtttatgtgaggatttgatccttctatgtggcatgaggtaaccctgggtcagcttgggaaaggctttgttgcgaacctccgataccgacgggtgttcggaataagttcgtatcttgtgggtaaagtgtacccctctgcagaggttaactaactgttcgaacagccgtgcccacggtcatgggcggatgtgaggtggttcccgttgcgtagatttgtttgtctgtgctttgtgaaaagttgttgtggtgtgggaatcgtaaccagaatcagcctatgtggcagatggatgacctgagtggtcaagaaacgaatctgtgtgattcgggatgtctgcgggcatcatagactaggcttcctgagtggaagcggattgttgtgctgctaggcagctggactctgggagtccgagaaaatgaaaaaggctctgggagccgattaatcaagtggaatggctctgggagccgagaagtaatgatctgacccgggaggtcggtacattactaaatgagctgttgaaaaacatctcttaaagtcgaatcgagacgcaagtctctcttcggcccaaacttagaaagaaataaatcacttagtgatttcaaaatgtcttcaaataaaagatttgtaaaataaccttgcctctcttccaagcttgcattaaacacctaagttcccgtgacttgctgagtacgaaagtactcacccttgctctatataaatatatatatatagttcctccgccctgaagagaagataaagtaaagtgaagattagggtttcgtcctggtttccagccgtcgcctgtggtgttgggtgttagtccgttggttccgctgctgctgctgctgttggtgtttcctcgtccgcgtcgtcggttgtaatctcgggctgtctgagctgcaacctaagttaaggtaaataagtcctctatttagtttaaggattgctatgattcatatttgtcaccgtgggtaccagcactatgtcctgggactggtaccgtgatcgcggtttcgtaggaagcggttcgcgccgttttccctacgacacgctcctgtcaggtgccgttgtacggcggtatcagattggggtgtgacagtagcccgctactcttctttttcaatttttcatctcattaaaatatatttatatcttgctaatagtctgctatactgtacctgctctaagtagatgatgggtcatataatttaccctccttcacaaatgtgttatttgtgacaggtggtaagttaccacttgctattgatgactcattttgactggtcatatataacttatcatccgagtcactaatgacaagtcatgatttttaaatttggaatgaacaaaaaactataaagaatattttgaatttttctagttattgaaacatcactactcataaaaccacaatttttcattttttaaaattttataaaatgcacaaaaaactagaaagaatattttgagtctatataattatcctatacatgatcacacatcactacttgtaaatccataatttttttcaattttaaatgcatagaaaatgtaaaaatatattttaaattttactaaccatcctatatacatgatacataattttcagataatattcacatatattcggctatggagttcaagacataatatctccctctcttcacaaggcacgcccttaccaactcacctataaaactcacgttatcaactccttcatcattattcgttttactgttcttatatatccaaatcatgtttcacactccagatgacttcaaatgaaaaggtccttaactacaaagttaccgatcttatgtgttccgcgacttttgtataaggattttctctatcaaagatcgttcgaagaatttaaatttttattttttaaaatatatttttttaaagagtatgtaaacaatctgaaataaaaattaatattatcgcttttaacattatagacctagacattcttaacgagttggatcaacataatacgtttgagatactcatctcgtacagttaattataacattttggttgcttattacgacgagattgatggatgaagggatggatctaccatgaaggcaacgaggtctcgagtcttcggtattgacgcgagaatcacggaagcctccacgaagctctcactaaattttttttgatatatgtaaataggaagtggagggggggtgagggtagttttgtctaatttgtttggatgaacattggtacgaacggcacgtttcggcttccttgtctatatgtaaccgtatatatatatatatatatatatatatatatatatatatatatatatatatatatatatatatatatatatatatatgcatgcaccgtctttctggttgaatttataattttgtgctgtcttattaattacatggttaattacgtctacgtgcatgcatgtacgtgcaaacacggatgatggatatcgtacgccgacataacgtacgcaggttgaactcttgaccgaactcggtgattcggtgtgttattcacgaaaaagttcgctgcctctatatctatttatgtacctatgctaattataattggttatttaatttctcgaacgaactcgatcgatcggtgattcggtgttattcacgaaaaagttcgcggcctctatatctactatttatgtacctagatatactaattataattagttatttcaacttttcaagggagctgactaggggtgttgattagacgcatcataccgggtgttgattagacacatcataccagcgcggaggcgcggaaccatgtagggttttatcaccacttttccaagtcatctgtctcatttttcacgcgcccacttattaaattattaaatggtatatttttttaaaaaaattatacgaaatttgctttaaaaatcattataatccatttttaaataaaattaactaataattaattaattatgtattaatgcaccggatttgtcacaaaatttatgacgttttttttaaaaaaattaagacgtatgatgctgtgtcaagatttgtcctactacattttagttaaaaaatatattttaatatattaaaaagtactatgtaacgtcgtacattttagttaaatttcttgtaactatattataacctctatataataaaaagttgcatatatttgcgtatatataagttgtattatgttgtggtatagttatggtaaaaggtattataaatagtttttcgttaaaaagaaacttgtggcagttttttaatagccccctatatgaagagcctgtattagactgaaaaaaaactacgatgaactctttaattgtagtttttttttccaaatttgtaattaataaacatggatttattcccatattagatttctactactacaaaatcgattttcacggtcgaggcaccctataggttacaacctggatataaatgcttccacatgcaaaaatcgatcactcccccagggtcgattgaagagccacatgtaaaaataaattatcgcatgcatctttaaaattttccaagtcatcatacttatctcctcacctcctttccccctctaatttctactctccactctctcccttgcctccccctatcaatcggtgggcgagagcaaccagtgacagcgggctcgctcggcagcaacaccgacgcatgtgacgactgcagcgacggcgggtagcaaatgagggtggccgattcggcggcgtggtccttggggaggggcggatatccaccgcccttggcattatgaggggcgacggcagagctcgagggcggtggtttaggtggcaccgtccttgggaggggtggatccgccgtcctcggtctcaggaggggcgatgccgacggtgaactcgagggaggaagctagggtttcgaccaaatttgttttatttttatttttatttttttcttgaaattatttttgcatatggttggcataggggactgcaccagccacatgaaaaaatgtggactttcgcacacacctgagtgtaggcgggccacctaatcgcttgcgaaaatcgatttcgatcgcatgcaaaaatcgattttgtagtagtgttttagtttaccaattttgaatatattccaaaattcgaaattgatactgattagcaaattgcaagtgacgtggactgtgctttaaatctaaatatctaatcccctataatttagaaataaatttagaattaataaatatggaaatgtagctatcttggatttattttatcaacttaattctaaattcgaacttaacaggtagtaagttataattgacgtggagtcttctgtttagtcgctataatttcaaatatataccctacaattttttttagacagagaagtcgaagcctccatcatttcacaacgaaaaacaacagaaagccgtcatgttatttagagtaaaaaaaagatagtacttcctccgtcccaaattataggacgtctcctttgtaagaaaaattaaattcgatagcttttgactaataatcataataactatatttatactaagtattacttatgtatgttattatattactagatttatattttaaaatactttcatgtgatgctaatttcatatttattgggattatagaataaaataaaatactggtctaaatatattattgaaaattatgtgagaaaatatatatcttttaatttgggatagacgtagtatatctgtaataacagcacgcgtaacgttcgggttggcaactggagtatagctaatatgtgatcgtcgagccgtgtcatgtcaactgtctcaggttagtgataaaatatttttctccgcgaattccttctgccgctggcttggctagccctgtagctacgcgtccacctgagactggcacctcaggttagtgattaaccaactgtacacgtagctatctgcgcgaatgttagtctgcataatcatgtggttaaaactggaaccactagtactactgtagtaaaccctgtgcccatcggggtgcaaatgtcatatacgtgggtacttatggaccaaatgatagtggcacatcgtgtcatcattcatatcacgctctcaaagatctctaagggtgtatgtgagggagagaggattgggaagatacgtaaaatgaggtaagtcattagctcatgattaattgagtattaactattttaaactttaaaaatggattaacatgatttttttaaagcaacttttgtatagaaaatttttacaaaaaaacgtaccgtttaatagtttgaaaaatgttcgtgcggaaaacgagtgacaatctcccctatctccaatatctccaatgaacgaacgcagcctaaaataagttgcggtcgccgcccttttcaatgcccttctgatcgatcttccagcgaaatgcggtgaggttgatttcactggttgcatactagtacgacaaattaaattaaagctcgcgccccccactactgctatgcagtatacagcgacgacgaatttaatcaaatctgtcaaagcgagcagacctaaccggtttcatgatatttgttcacacctaacttcgcgtggagtgcatgcgcacgcgccggcgaagtggcgaatccatttcaggtccagtcctgcgctcaggaggggcttctgagttctgatgaagtctagggctttttggcaggatgcaaatcctccagtgttctgtacctgtagtagtgtcactgatgtgggtcccacctgctccgggcccatatgacagtgacacatactgcaatatacagtactcatttggatcccctgctcatttggcatcggttttcagctcaaataaagcgctgggtgtttattcagcttagccaaagtactgatcagctctaatgctaatgggtaagcgtttaattggactcggatggggacgacatcgacaacggaacggtacgaagacgatgttattgtccttaagcgaagccgcgatgataccatcaccataggcacagtacgaacactacggagtacttcctccgttttacaatgtaaaacattctaatatttttcatattcataatgatgttaatgaatctagatagatatatatatgtttagatttattaacatcaatatgaatgtgaaaaatactagaataatataataacttacattctaaaacggagggagtattaattttgaagcagatctcagtcgtccaaaagcttctccacacaacgcgcgaagccaccgtttcccccgaaaaacattgaagaaatcaaacggttggtaaaaaaaacatgtgaatatattgcattatactcgattcacatactaaaagccaggattatttgaccgctccttccggcctcatcgcacgagagcgcaactaatcccttgaggaaaccaggaaaaccctaaatgattggttaatactccctccgttctgtaatataagagattttaacattttgtttgcattgtttgatcgttcatcttattaaaataatttagaattattatttatttttttacttactttattatccaaagtactttaagcacaattttttgtttttttatatttgcacaaattttgtgaataagacaggtggtcaaacaatgcaagtaaaatattaaaatctcttatattacaggatagagggagtagaaaattactggtaggattcattgctttatgttcgatccacactctcagctagctcgtctacaatatgagcccattgcaatgcaccagcatattcctagtaattgagaaaatttaagtactattaaccatcaagatttgttcacatacatcgtaccgccatgttgaattatagacatcttttttttttttgaagtcgactttatagacatcttacgggagggttaggttacccatcgagagaaggatggtgaagtgaaattggcagatctggacctgaacaaacagtaaaatgagtttgttattatttgatatacgaaacaatactagacaatttagctgtaatatctacttcatatgtcttaagatataaacatgtgaagttgggtgagtaaggactaaatgaatttcattattaaaaaatacgggatatatagttgcgattggttgagatgagtagcatatggttaattatattttggataaaatttagacgttgaaaaaaataactatattttggaaaagaggagagaactagtagtttgctacgtgcctcaagaacattgagtaatttattgtagcgctttcgtccggacggccggtccatgtcaaattaaatggtaaactctctgcgcgtacaattccgtacgttcagccctgccgtaactagtactagcaacggaagagggtccaatccttagaaagggagtcactagaggagccggcatgttatattgtagaagtttccacgaagtggattatacgtgcggattatattgctgagggttttccatcatcaaaaaaattattacggaggtttcgaaaaggggattttgatggaaatcatagcagattatattgcagaggttaattttcacgaggatccaatattctctatattcattttggacaataagaggaaaaataatgatggctgatatatctgtagaaagaaaacaataggagggcgaatattccatataagtgtggggcaatgtgtatttttaccctttttgtattttagactacccactctctttgcaagtagatcaatagtcccagttacatccgtgccctcatgttgacgatctcccttatttacgtccagcccacattgttaatgaaaaaaaatgttggatgtggttagaaaaaccactaggatggtctaaattaagtaggtaaaaataattggtccaaagttttttttaaaaagttagataaatagtgatcgaaagtaaaacttatatagataataaaaggtggtccaatctagatactacagtccatttatgttttaaaacggaagaaatactattggacgacaagtccaccaccacagtcaacgtgcccactccggaggcaaggaagcacggtatatctatacacagtacgctatcctagttcaataatcaagtctgttatagctcctgctagctatatagtatgtgacaaccactctactgtaatgatgaactaatgatctagctctagtaatttttatatgtaaaagaactagaaccataaggcatgagaacttgtggttatctgtggatacatgagctagagcagatacaatagtaagttataagacaactataaacatatttaaaaagataaagaaagagagaagagcagtgagctacagatctgtagccagctacagcacggactccaagacgtaatgtgtat

SEQ ID NO: 3040 - DNA, 9588 bp, Oryza sativa
cccactattagctccaattcatccatagccaattctaatagctaattcatataatagttgccttactatactattaatatatggtcccacctgtcatacacatagtgtgtcttggagtccgtgctgcagctggctgtagatctatagtccgctgctcttctctcttatcgtttatcatattttcattaaaatatgtttatagctggctaatagtctgctattgtacctgctccaaaccagtacgagtagtttaattatagtgctccgcgccgtggcccagttaatcagagggtcgtagcatatatagcagcgcagtaaatgaacgatcgagccgtcgtccaccgccgacaacgtggtcgctcgcaaggccgtgaaggggacggcggcgaggcctcgcgccacggcgcccagccacacatacccccgtgcgcccacgtgcccccgtctccaaccgcaagtccacactcccctccctagctagctcgctcgctcgctagctacacgtacaccacgccgcccgtgctacttagctagccagccagccagcccgtcctcctcctcctcctcctcctatattacggcgccgtgcaggccgtcgtgggcgtggcgcagcctctccatactggagtactactagccaacgactgcgcgcttggacgcacgtacataggcacgcgtgcgcgaggagctagccagtgcatgcgtagccggacactacagggcgcacttcgaacgcgccggctgggagctgatcgatcgagtgagctgagtggccaacgcagctagctagctaggcacgtatacgccgtcgtccactcgggcccggcgccgcgcgcgcgcgagagcgagaacgagggtatagatatcgagagggatggggagggcgccgtgctgcgagaaggttgggctgaagcgcgggaggtggacgacggaggaggacgagaagctcgccggctacattgccaagcacggcgagggatcctggcgctcgctgcccaagaatgcaggtgcgtgatctacgcccgcccgccaccgccggaagtccggaactagctaatttcatcacacacatgatctgcactgcgtatcgatctttattacagtatatcgtcctttattcattccctgctgctggtcatcacaaagtctgcggttgattaaacagcttgctaattaaagccctaaatctagcaaaaataataaaaaaaagcgcactcttgcttcccagctataggagaactagtactatagccatagctactaacaagctccgactgtcacttgacgcgttggtttgattcatcgtgtcgtgccgtccggacatatgcagggctgttgcggtgcggaaagagctgcaggctgcggtggatcaactacctgagagccggcgtgaagcgggggaacatctccaatcaggaagaggacgtcatcatcaagctccacgctaccctcgggaacaggtacactgatcgatccatccctctccttcctttccttctctgcttttcttttccctttgtttctctcgatcctctccgacctgttctgcagcggcatgccaatatcagtgtggagtgcctgagaagcgtccgaccgagatcaagtaaaggcgatgtactattcctacactgatcatagtacacacgcactatactcctacagaaatcactcccacgtactttcaacgtaattaaaagaaatgggttccactgacagcataggctagctgtacgttacactaatagtgcaaactcaagcgtacgacgggctactattttagttgtcacgtacgtgtgccctctagagacatgagaccgcgcggtagctagttttaacaataacttccaacgaagacatcgcatttgacaagcctataaaagctttgtcgttaattaactatccttattttactcctatatgagcactttaagagttctgtctccgtcagtccttcggttgagagttgagacattactgtcaccacatataggcacatacagtaacagtattcagtagtgtgcatgtgttggctactctactgagcccctgtgtgcagagcagttgtatacagtagacaccagtagtagtagtaaaagatactggaaaaatatacatactccagctgcatatgcacgcgtgcatggtcccgaatcccttttagggcctgtttggcacaactccagctccagctccacccctcctggagctggagctcagccaaacagtttcagcttcaccagaaatgggagtagagctgggtggagctctctcacaaaatgaactagagttgtggagctgggtttatgcagcttcataactacactccagacccaactcctgtagttaaatttagaagttgaagctgtaccaaacagttcttaacttcgaggtagtctcagctatttttatactggtacctgcaatgcatgccttggcttacgtgtttatacgccatgaaagtgcacacagtttttgccggtcaattaattaatcaatttggtcactgtcacatgtgtcacccaagcgtgtggcggaagagcccggcgcgtctacagtttatgcatgcagttaatttctacgagcagtagctaggcaggatagcaacacgtcgagtgttacacacattccacgcttaaccctaagtagtgtggtcgtcttgtagagtttactagtaattaattacgagttctttcgtaaaacgatatacagttggtccaaaaatattttcatggcttatttatatttgcaccagtttgatataccctaagtattatttgtgttgtagtagcctctttaaatattagtagtgaaagcaagataattaagttttcactatatgattttcaaattaacttcactaatttttgagaaaatattataccatgacacttacaagaagcttaaggacctgtcctttctacagtactacttcgtacgtctataggttgtgtttagttcacactgaagtttgaaagtttggttgaaattggtacgatgtgatagaaaaattctgtgtatgaaagatttgatgtgatggaaagttagaagtttgaaaaaaaactttgaaactaaatagggccatagttatgtgacatgagttgttcaaataatggtgttttcgccagcaagtagtaataactaagtatatgttagaaaatgacctattttatacatgtatcaatttgcaacttgctataagagttcactattattcgggaccaacccaatcgcaagtgcatgtaggacaagttaaatccaaatcgacctaccttctaaagattcttagctaaatggctgtgcatcagatcatacaactataggattgcattatatatatgcccccacacagacgccagtagtagtctcctctattctctactcccataatataattcccatgaccagattgtccgctttatttttcttctatcaaaaggagatgaagcacgaggaaaatccttggtttggatgctttcccgtgataaaagatcgaagtactgctatccgtagaagtcgcgcgtacatctaatagtgaactagtgataagttgtcctttcttaataacatatatactacttcctctgtttcacaatataaaactttctaacattgtctatattcatttagatattaatgaatctaaacatgtatatatgtatgtctaaatttattaacatctatatgtatgtggataatattagaaagtcttatattgtgaatagtaaactagctaccgccttgattttgtcacgtcattcggagcgagctagtagctagttcctgcaggtaagctagcttattgctgtacagtactgaataaagaaaacaatacaggagtttctcatgacttgacaaacgaactatccaatttaattgcaacagtgaaatatggtacgtgtagtactaacatacttcctctatcccataaaaattaaatcctagactatgtctagattagatttgtttttttcaagtggggaagtactttatgtgtaacggattaactgctcattaacagtagacgattccacacatgtccgcaagttgatctgaacaagtctgccgcgagcgtcggtgcggggggtggagggatccaacgtacgacaaatgcaatcgataatccaaactcacatgtactgtagtactacgtatcgtgacaagtgtacgtttccccctcatgacgagacacgccctagctagctagcgagctaaccggccctttaatttactccctccgtcaaaaaaaaaattaaatcgtggatttccgtgtcaatgtttgaccgtctgtcttatttgaaaaaattataaaaaaaattaaaaagataagtcacgcataaagtattaatcatgttttatcatctaacaacaataaaaatactaattatgaaaaattttcatataagacggacagtcaaacgttagcacggaaacccacggtttgccttttttttgggacggaggttgtatgtagtaactagtacttcctccgttttatagtgtaagactttatagtattgctcacattcatttatatgttaatgaatatagacatatgtatgtgtttagatttattaatatttatatgtatgtggataatactagaaagtcttacgttgtgaaacggatggactacgtgtgtttgggcgcacgtgactactgcttccaacaaaacacacacgtacggtaaagccatgcataagagttttggtcttttggactatatatgtatatggcctgggccttccacgtctcgttgcgcacacacggccggccgtttgtgggacaaatattgttgtgcatgcgcgtgcttcgcgtggcttacgacgagcatgcggccgttgcctgccgctcgcgtacaggagctgtactatactactgtaaacatatgtaaagtttctaatagaatatataccaacacgtacatgagtagttgatccgagcatttatttgctgcacatactgtgcatgcggttgctagtataatcaattttccgtttgttttttgagggccggactcgcggcatgggtggggagtgtgcatgttgttggcgtctacctcggccatgtcacgttgtggctaaaacgaacgcagagatgcaatgcgtatgtgccgtgcatgcgtacttccgcggacagggcgtacgtacgtgtagcatcaaaaagctagctatcggagccatggctaagattaattagccccggttgatctgtcaagggtacacataaatggcaggaaaacgatcgctgggccgtcaggcttaactgctgacacatgacccgtctcggcagccatgtcacgctaccctcgcgaggtttttgcactttggacgcgcttttttttttccaagtgtatatttctccttcctctttaaagggggcatgtccctctcacgcagatcatcatcgcgctaatggcgccccctttttaattggctaatcatgtacatctggctcacctgccgctgtccgtgggcccctccaggattaattgcgggtcccacgtagacctcatgacttttaacttgacaaatcagaaatgcagattttgttgggagagccgagagcgaacgaaaccggccagcccgtgaggtcccccgggccggcctttgcacctgcctgcctgcgggcctcgcttaatttctctactgaactttccgttgctttccgcgctccgcaatcatacgaaccaggtcgccccacggcgtatcgcccgtcctggtgtccatgtacgggtcgctgcgcagttaagcggcgcgccactaccaacagtatccccacacaaactttattacgaagagcctagtagcaatggcatcgccgtcacgtgtagacgtgcagtaaatgcgaatactagtgtttctactcctatttgctgtgatgaatgatcatggatcgcgtgatacttagatcgaaacagctaaccgtgaaaaatctggtttgtctgcctgcttgcacaggtggtccctgatcgcgagccacctcccggggaggacggacaacgagatcaagaactactggaactcgcacctgagcaggcagatccacacgtaccggaggacgtacaccgcccccagcgaggccgccgtgaccatcgacgtgaccaagctccaggccgccgggaagcgccgcggcggccggaccgccgggcagtcgcggaagggcgacaagaagcgcgcggaggacgacccgcccaaggagaccgccgccgccgacacgccgttgccggagtcgagcccgcggcgcgcgcagagcgacgaggcgcggagcggcagcgtggtggtcgacccggaggagccgagcagccagcccaacaacggcagcagcggcggcggcggcggcacgccggacgggccgtgcagcgaggagacagccactgggccgacgtcgctggacccgatggagatgggcctctgggaggttgagagcgagttcgccgagatggaggcccttctgtgcggcggtgtggcgcccgacggccccgggataccggggctcgagccgctggacgtcgcggcccaggcggacgacctgctcgacatggactgggacggcttcgcggccgacctgtggggcgatccggcccagaggggcggccttgtccaagacgcgggcgagccaaacggctcgatgggctgcagctcggacgagctcgagtcgttcgcgagctggctcctctcggactcctgctgaattgaacctaaccgtgaccagcacagcagggttggcgtcgtggacttgtacaaattttgctagctttttagttctagtttgtttcgtagttgtgggctttcctctctcggtctctcgtgcaatggagagtcatttgcctcacacggcatgtaggctgtagtgaaaatcggcacttcggcaggtttcacgcgctgctgctgtggagtgtagagtggaggacacctttgaacttgtttgcaccgttttgtgaactgaactgaactttcgtgttgggctgttctagtttgtcgcacttggttctgtgatatctttgtgttttgtgtttgcttggttaagaggtagatgaagtcatagaaccgtggaaataacttgtaataaaccaatcatacaatccaattcacctatctacactatcctcacgctgcaagagaaatagagaacagaacacctgttgtgatactatatagtggtgtggtatttacccaatatatcagaatctacgactccatgtgatgtgacacaagtgtaggatcgaatcacaaaaactaagccaatcagaggggggtgaatggttggtatatccaaaaaccgaaaacttttagcggaaataaaagttaccctcgaattcgacggatcgcggtctgaccgaagtgtatgcgccggtctgaccgcctgatgaacgtcggtctgaccgatgtagatcgatcggtttgaccgtcgagatcagctgccgctcgctgtcgtcaccgccggtttgaccgccgtcagaccgcttgccgccggtcggactgccggtatatcgccggttggaccgccgaaactcggtgaaacacaaatcgaagaactcttaaagtggatgacaactttattgattctctctgtgtttacaaagtgcaccaacagcacttcttacaaaatttcgactaaactcgaaaccctaactcaaaactcaactcaattgctctgaaaagcgatatcgggaagcctcatgctcctcctctatttatacttgaggtaggcagcctaaagccacgaaccaaactcatatttatacttgaggtaggcacactacaaaaattcaccttgcttctacaaaaatccaaaaattttcacattacttctcctccttttgacaatgatttcatcaaacataggaattatgttcattaatatataagagcttagcatacatatagtatatcaggtcatgtgttgcaataaaaagaagataaacccatgtataatataacaagcatgcattaaagtataaccatgaaccaaagattttacaattaagcttgaatcaacaatcaaaattcatgatttcatacgatttataaagcaacatcttaacaagcatataggttgaaaataaacactaaacacatatacctattgcatttatcactctttctcaaataaactttagcacaaaataaccaagaaatttttttataacttttctttttctagagcctttttgctcatatttttctcttttattccgggtacgtccctgtcgtcaagactgtttccatgaattcggcacccattattttgctcatatcgaatacgtccttgtcgtcaagactgtttccaaggattcggtatttattttcttatattttttattctctttttcacaatgagcaattaaagctatttgaggaataacaattcaataaagcatatacatagagcatttacaaatcaaaccacatgctagcatcaacattgcatatttgcttaattcaagtatagaatttaagtgtcatgcatcatctcccttaaaagcaaaatctaaatatcatgaaaagactagaatacatacaaactatgctagagacaaataaaccttcaaagtattgctagcatgcacaagaaaataccatatgcataaacaaagctctcttttatcaatttttctcattgtcatattattgctcgataaaaccatgaggtacaaactccccctcaaaccatgccaaaaggatgaattatgcccaattcaccacgaagaaaagcaaagcgattagaatccaaaggtttagtgaaaatatcagcaattcgcaactttgtgtccaaaagctgcaattcaacatctcccttctcaacatgatcccttaaaaagtgaaaacgaatatcaatgtgctttgtgcgtgagtgttgaacatgattcttagcaatgttaatagcactagtattatcacaaaagagaggtactttctcaaaagtaagaccataatctttcaaagtagataaaagccaaagaatctgtgaacaacaactagcagcagcaacatattcagattcagaagttgattgagcaacactagattgtttcctagacgaccatgcaatcaatgatgtaccaagaaaatgacatgttccactagtacttttcatatcaattctacaacctccaaaatcagcattggaatatccacttaagcatacagaagatgaagtagaataccaaattccaaacccaagtgtatgattcaaataccttattattcgcttgaccacttgacgatgtgaagcacaaggagaagcttgaaaacgtgcacacaaacacacaacaaattgtatgtctggcctagaagcagttagatacaacaaagatccaatcatacttctatattccttttcatcaacagcttcaccatcttcatcaggatccaacacaactgtagaaccaattggtgttgaaattggcttgcaattctctatcttgaaccctctcaaaagatccttcgtatacttcgtttgatgcacaaaagtacctgaggtgtttgcttaatttgcaatcccaaaaagtacgataactcacccatcatgctcatctcaaattccttgcgcatagtctcagcaaaatctacaaccaaagcgtgagtc

SEQ ID NO: 3041 - DNA, 841 bp, Oryza sativa
acctttcccaatggaaaattttttgcaaccaaaaagtttttaaccctatcaaaccaagccataggagcttgtttcaaaccatacaaagctttaaacaatttaaaaacatggttggaaaaatcaggattttgaaaacctggtggttgtttgacataaacttcctcctatataaaaccatttagaaaagcacttttcacatccatttgatacaatttaaaaccttttgaagcagcaaaagccaacaaaaatctaattgcttcaattctagcaatatgagcaaaagtttcatcaaaatccaaccctcaacttgagtaaaaccttgagcaacaagtctagctttatttctcacaatcaaaccatcctcattttgtttatttttgaaaacccacttggttccaataatattatgtctagaaggtggttcaactaaagtccaaactttgtttctctcaaaattttcaagttcttcatgcatggcgttaatccacgattcatcagttaatgcatgtgacacatctttgggttcaaaagaagcaacaaatgcagaatttgcacaaacatcatgagtcgttaccttagaccttgtagtccgctcacctatattaccaataatttgttccggcggatgtcgtcgttgaatgtgcaaaggagcagcgacttctgaagttgatccacgttctgtatcagtactggtcgaagtagtaatctctggaggaccatctcgaacagcatcaacagaaccctcagccgacgaccctggccggtctgaccgcacctcctgtgccggtctgaccggaggtgtgccggcggtctgaccggccgagccgacctcatcgccgtc

SEQ ID NO: 3042 - DNA, 32400 bp, Oryza sativa
  unsure (1)..(32400): unsure at all n locations
tttacagactgatcataagcagtccaggaattacgccaaagacggacgaagatgaacataggagttacaatgtcaaatgtatgtggttatacatcttgaagtaaaatatgtcaatctggtaaagaaaatattgagttttgaagctgccgcctaaggcaacataatcatcacttttttatatagattataaagatggtgagcaattagaatcttaatatcattataattatatatgcggtggcagcttacatctagaattataacattttctttcccaactctatcgaaattaaaagatatgagccaagagcagcctgccgcaaaggataaaaccaccacctttaagagatgatcgaataccacatcacaataaaaaatcatacaaatgagacaaatagggcaattcaattagaaaaaaaaatattcatgggcgaaagagcgtgtcaacagaatgaatggccttcctaaaacctgatttccccaatggcacaatctatacattctaagctatccaaattatcttggccgttgtgtgatcttttaggtcgcctttacgactgaacaaatggcagtaacagcagatataaatgcctagtctaaaacagaaaaactttacaaaagcatgccgtttatgtcatcgatcacattgctgacagataagcagcatgatgaacagctattttcaacaagaataattgcccggagaatgacagcaattgctaggaggacatgaagggatgacaaccagcgtccccttgtctcgatttccataagcctctcatcgatgggcacattttactcccctgaatatgtttgtgggtttcttctgaaacaagcaaggacatgttagagcctatgaaacaccagaaaaataaagtaaattcctaaacagtgtgaactatactttcacttcgctacattggcatgcgtagcaaaattcaccattctttttgtatagtgaagtataaagaaatgacttaactagcaatttacctagcaagtacttgtactctgcatacatatttgcttgacaagttgctgttgctctagacaccttcagttccttggaagttgtttccatctacaaaattactgtgagcctgagtaaaagaaaaaccattgctgcggtttggaatgccatcaagcagagtttgtggactgttggctactggcggagcatgaaagttcatgtggtttggttcaactcttggtacagaactaccatgctctgaggcattatggcacaagtccggtctaatagtcgggcttggtctagatagcaacatgaaaaaacgttcataaatttgacgtctttcagaaagagctgcatgccttccaaaggaagtctctgaagtgttggcttctgacataacatggaagttctggcttggttcactttgtggtacagacccagtgttgtgtaaagtgtcagattctaatggtgcgcaaaagttcatgtggtctggttcagtgcttggtacaaaaccactctgatgcacaccattatgatgcataactggcccaagtgttgtccttggtctagaaagcaaactgcgtatccagtcatgcatttgacgtcttctaaaattcgttgcgtttgtctgccttccagatggagttgatgctcctgcagtagaagcttgagactcaacagaatgatttcccctaggaatctctcttggagatacatttagatcaatcccttgcctttcaaaagtgccaattggtgaaattgcaccaaacatcccagaattgccattcacatgattatggtatgaatgtgcttcgccatcgagtctacaacctccacagtaccaatttccttcaggtacttctcttcccaaaccaacacagtaagtatgtgctgaggagtcacaaatatcgcatagtaacatgagactgtcatcaccaccttgattgcactctatgcacacaacattctcgtatggatctagccaacgtcttatttcctcttccgtaggctgataaacctgtgcaaaaatcaagagacagcatatgatgtccaagaacataatcaaaccagggaattaatgtggtttacattgaacactccaacaacgccaactgtgcaggatgttacatgttcagatgttccaagattataatattattgcactgtacataacaaactcttatataaaacactagatctctggcattttagaaatcaacaaacaaaaataaaccaaacatgaagtttgccctttccctccatttttggaacaaaagaaggcgttgtcaagagcctccccatcatctggccacaagttggacctcagatatcctatgccatctcatccatcaaatagctttctatacttgatcgtaagagcaataaagatttgtctttatattgacagcatagtatgatgatggaaaatctccaccagattagcaagaataacttttctctgcaaagaccattaagacggggaaggctttgcaaactgtatatagctgaagtaccaggaaagctaatgcaaaaaataacattgcctatgatttgtaaatggtaaatgaaaaatagttccgaaaattagttctccaaataacatttgtcccctaaggcaactagttctaacatggaaatgaacaaacgcagtaacagtgagaagtcacataaaaataatgaaaggataagagtatttataagaataaatgaaacgtgtacagcagaatgacagtaaacatattcatgaatattattttgaatagactgcccatataaatcagaaatgaagttaacaaatttagctgtcggatttgatattatatgacaaccgcagcaaggaaaggttacctgatcacgttcttcaaccctaattacagaatttgtcagttccaaaccagtatcctcctttgacgactttgtgattgttgtgaaccgccgtttacacaacggacaccttgactcaaccttagaccattgcatgatgcatgcaaagcaaaaatagtgtgaacagcaatccagcacaccctgcacagtcactctctgttcttcagaaaggcaaatcccgcacgttgcccttccagcctcctgtggttcctttttctccttccccttgtgctccccattacctgtaacagaaatcttcctgggtgatgaaggcagcactttcagagactctggaggctcagactccttcaaattccccaattccttatctgatacaacgaattcagaatctgaggatgaatctgacacaaatacccttttcttcctccccttcttaataaccctagtaggctcagcaatggctgcttcctcatcggatgttacaaattcgaagtctgtcgtgtctgaatcaatagtaggccatatctcagcctcaaaaactggtgtcggaggatcaacctccatctgcttcctaattctagcctttttccttggttgccaatcagccataacctcgtcctccacaatgaagtcgtcatcctcataacgatcaagcattgaacgttttttctgcctccgtcttatagacgcagcgttccttgccttgactgaacccaccttccgactggccaccttagagctgctcttcatcttccctcgtcgctgattcaaagtagactttcgccgccccatattcttaaccctcaccttagtcgcttccaattcatcatcttcctcatcctcaaaatcttcttcctcctcgtcctccacttcaggatcgaaatcaacatcctcctcctcttcctcctcatccatgtcagggtcaaagtccatgtcctcctcatacctccggcgatttgatcgctccagaggaagcttcccctccacgttgcggccaccacgtttcttcatgcgcttggatcgtggcgcctcatcgtcctcctcttcctcctcctcaagatcctcttcctcctcctcaagatcctcgccgtactcgtcgacccgatcgtcttcttcttccgagtagtcatcgtcatcctcgtacttacgtcgacgagatcgcgcaacgggtgggtctgccttccccttccgcccattctcgcggctcttgacaggctgcctcggccgcggggtctcatcctcctcttcgtcctcatcaccctcttcgtattcctcgtctgtgccctctcctccctcgccggcgctcgaggcagacagatcctcgtcgcactcttcctcctcatcctcctccaccacatactcctcgtcgtcgtcgtcgcctccgtcctcgcccggcctcctccgccgccgcccgccgctctcccccacgggaaccgccccttcccctcccttccccatccctacacaccaagaggaagaaaaaaaacaacgaatcagaaccagatcgccggatccctccgcccaaatcacacgccgaaacaagcacacacccacctctccgatcgcaccagccgcgcgagaaaaccagcaccgcccagcgacggcctcgcaccaccaccaccaccaccacccactaatccaataccagctccagagcttatctggtggtttccctttccagcgcctagtggttaccccgtgggtttgaatcggtttaatatatacgaccacgcgcaggtcagagaaggcggcggcgaggagctcggctcgaaaacggaaaggggggcgagcgtgcgcgcgccgggacggggacgggggaacgcggaggctacgaggggacggaggggggaagcatcggatcggagtacggcgaggtgcgggcgctttatcctcgcttgcaacctctctctcctcgcacgggacgcgttggtaggggtggctggctggcttggccgggctggtggcttcctcctggctccggctccctagctactagtggttggttggcccgttgctggagttggactagtcgcccccgccccgctcgccgcggtatcgatggcgaacgtacacacgctgcagcccggttttctcacgtgctgctatgcctgtgcagctgtgcggatgattggtgtttcgggcggggcgtgtttttccatcggttttttggtgggtttcggccgtgtgcccgcgcgcgcgctgggtgcgccagcggtggggggcagtgtcgtgccgtgccgtgccggtggtggtggagactgacgtgtacgtgactcgtcggggagccggaaaaggagacgcgcggattgcttcgtttcggagcgcatcggccggccctcgttttttctcccttcccttgctggaatctgacggcatcgccttgtgcccgacccgagtactcgcagagttgcagtagctttacctgctccatggacagggcaggactcgagcctgcaggctgcagcactagtaggaatcagatgattggtcgccttggcaggtattgctattaaaacagaaatctgttttcatgtcgtggtctgggtgcaaaagattaatgagagtttcttccatctaggttagagacaactatggcatttcgtgatttcagtgaaggggcacaccaaggggaatcacagcagctatgatttgccaaaatcatgccgtctcaaactgtcaaacagcgcccaaaaggcaattcatcacgacccagaataatttctttcctaccagtcaaattataagcaggcattagaaatcgagttttttcagcaggcattgaacaaatcaaattcgacagaaatagaagtaacttgctgcatcgaatcataggatacatttttatgtcaactgctaataggttaataataccatcctgctgtttcaatcctaatattaatagctatattgtggcttcttctcttttctttgagcaattgaagaaatgattaaatgaatttaaattacagcacctactcagcctgtcagccgttgctgaatgccagaacagcgagtaattaaactgacattactacaatcaaagtaaccagagttgtgttgccatatatgcaattttcttagctcgacaatcaattcttcatatgcagcctcttaatccaaaacgtggctgaaataccaatctaagatgcttaacgattgctcagacatttgagtgtcaatggtgcttaacagacacaaatatgttagtgcagaccagtgatctctgccctctggagatttcaactgcttacctcagtagagtgccggagccctccatcatcaccggttcaatagaagagtgaattttaagtgatcttcagtgctcacagaaagtacagtagaactttatacaccagggggccaatactgttggaaggaacataagaagcaactacctgaccgcctgtaagctctgcagggcaactcttggtagaatttggaagtaatgaactaaacaaagaaggttttcataaaaaggaaaatccgaaatggctcattcaaattgttgtggactacatactggaaaaaaaaaacagcaagtacaagcacaacacaataccagacaatcggtgcccttattatagtatattccacataagagttgcaacactctcaccaatcctgatgtgttcactatgtaactcagggaatctatgaatacatgccaattagatagtttggtacgttttatactagtaaaagatgcaggtggttaccaactatgcatagttgcatgttgagttaaactaatttagtagtaggtagcaatcaagcataatagcaaatgtatcaaatccatgttaggcaaagtttctagatcaagttaacaattccatgtactattgatttatgattctgcaaaacaaagaatcacagactgagggactggatactagaactgtattgaactataatcaggcttggatttcatcttattgtcaagttcattcatggtttcagcttgtattcatccacttcacataattatgctacagagttcagttccatggtgtatcaggctttaatcatgctgttcatagtttttgtttatgctgttcaactcggcaagttttccttggtctctttgatatgaacagagaggagaaaaaaggataaaacggtgacgatttaaatatccaatattttgaagtatctttctactaacatgtacattgtgcatgcaggccatattatagtgagttgctgaccaatcactaaattgatatacgaaaatatagtgctgcaaagtgcaaagtaattttcattggcatggctatgtatacaagacattgagaagaagtcaccgccagagtgtctttagcttttctcttttttaattctaactacaaattgtaccttttacataaacctaaacctatagttgaaagaacacaaactctttattacataaaggagaaaggtatatggaaacatattaatcggttttcggttttgatgagaaccattaccctttttaaggagaagcacaaataaaacattgaataacaaccatggtgataaagccacgcttttgatttataccccccaacatccataatccagggacaacttttgtttattgttttaattttgctccagtttgagctttattatttcatctcatcgtgttttacaacatatatatatacctttgggcttcagcacgaattccaattcttgtgagcgctgatcaacgcggacagtaagccggcggacgccatgagcgtcgagctgccgagcaaacccttcccgtcggtcacgtcccctagcgccatcacggcgtccgcaacgtcctgcacaacggacatccgcttgagcagcagcttcacccgtagcgtcctcaccacatcgctctcctccctgcaaccttccttcagccgcatcttgacggaagactccagtttgccgatctcttccagcttaatcgtgatggaaccaacgtatcccagcagctcggcccaggcgctgagtcgctggaggcgtgggaggaggtgcgcgggcaggaggccggccttggccagccacacgaactgttcgaggaagtagtagacgccctccccgccgtaggcgaggagcgcgacggccgggggcggatggggatgggcgcggagggcgttgacgttctggacgaacttgccgaggcggaaggccttgcggctgaggccgacgctggactcgaacgacttgaggcgggcggaggcggcggggggcagcgggcccgcggcgagggcgaggcgggcggcgtagcgggagatcttgaggagcttgtcgacgccgtcgcggcgggagaggtaggcctcgacgtggacgaggaagtcgcggggcggcgggtgagcggctggcttgcgggaatcggaggagcccgcggcggcggcggcggcggccatggcggccggttgctgcgtggaagagagaggcggagcggcggcgccgtcgttgggtgcgcgcgagttgggcggtggttgcgtgtgcggtgcgggctggtcgtggtaggggagtgggcgtttcgtacgggtttggaacttggacttgacgaagggtgacgtgtcattgggccgaaccgcaatatgggtcccatgcgtcagcctagcaaatgggccttaaactcttacattggaccttcttgggccgctttatcatctttctggacctttgcttttaagcccagtgtttcctgacccactttgttgggattttcttgttatgtatacatagaattctgtcacaacaaaatcatctgtgattttttctagaaacacagtacaaatatagacgctcacaacgcacctaccatttgtgattttggatgcatagtaaatatcacatgaaattaagtagcctatcatatcgataaatcatgtttatttatactggcactgaccggaaagcctggcttcggaattcagacttcagaggatgtggaggccactcttttctttgaagaatgcatgatggcatcgcccattgattcttactgcgttaatatctccttggattagtagcatgatcgtgtttaatttcgcattagcttgggatagcatacattgtttgatcacaagccgtgccaattaatgaagtaatctaaaaaatcaggggatactagtacatctaagaacactttccgttgcattttcattttccctctgctttaatttttgagacatactcctatatacttggtaagcagctccacgattatttacttttggttgcttatctaacgaaagatgcttttgaagttagtattacagcagccttacagtgtaaacagtttatatatcttaaaaaagtttatacaggctatagttccagaaagaaataaaaaattatgaggaaacatattaatcggctttgttgatatacacttgttaataaggagaagcatgagcaaaaaattgaatgatcaccatggcggagaaagcccagtttttgtatccgctcaaatgcaccagcaccaccttttgattaatttataccccgacatccagagtccaggagtaatttgatttactaattcaaactctcaccactttaagatttaattattgttcaattacatcatgttttataacatgtacctttggtgggctttcagttcagcacgaattccagttcttgtgaacgctgatcagcgcggacagcaagccggcggacgccattagcgtcgagctgccgagcaaacccttccggccggtcacgtcccctaccgtcatcgcggaatccaccatgtcctgcacaagggacatcagcttgagcagcagcttccggctcagcgttctcaccacctcgctctcctctccgcaaccttcctcgagccgcgcctcgacgccacactccagctctgccacctcctccagcttgatcgcgatggagccgacgtgcgccagcagctgcgcccagacgccgatgcgatggaggcggcgggggaggaggcgcgcgggcaggaggccggccttggccagccacgcgaactgctcgaggaagttgtagacgccctggccgccgtacgcgaggaggacgaggagcgggtgcacgtgggggtgggggtggtaggcggcggcgcggagggcgttgatggactggacgaacttgccgaggcggaaggccttgcggctgaggccgacgctggactcgaaggacctgaggcgggcggtggcggcgtggggcagcggcggctgcccggcggcgagggcgagggcgaggcgggcggcgtagagggagaccttgaggaggttgtcgacgccgtcgcggcgggagaggtaggcctcgatgtggacgaggatgtcgcggcatggcagccgcgggcgggaggctggcttgcgggctgaggaggaggagggggagcctgcggcggtgaccatggcgctggcgcgcgcgcgaatgtgttatgtgcggttgtttccgtgtgcgacgctggctatagcgtggtagaggaatgggcgtttcgctgggaaacccggcgatcactttgagtcgtcgtctcgtcgcagcctgtgtgccgcggagttcgtgagcgttttgtgtttttgtacgacacaaagcttagacttgacaatgtactaaccctgagttgatgtatcgctatctttgttcgttttcccctctttctcatcttctgttctgctctgtcggtaatgccacctcgaccaccgacaatggtgtcagactgctgccattgctgtgggtcgcaactcgcaaccatgtggatggcccacaatcccacatgcctcctcccagtatgaaaaaaagtacaccgaagatcctcaacttgtaattgagttacgtaatcgtcctcaaccataataccagatatagaatatctcttaacttataaaaccatctgacggttgagtcagcgtgggacccatgacgcgacgattgagtcagcgtgcgaccatatgagccctacatgtcagggtttccatgtcacaccccttgctcttcctcttcttctctcccttcctcctctctctcatctctttgcgcaggctagtcagtgtggggaggaggccgacgagagaggagggtgtcggcagccggcggccggcggcggtgacagcggtgacgacgtcgttcgcggccagccacggcggcgccgccttcgcctgcgccgagacggtgagcagcaggaggtcgatgaagacgacccgaggaggcgggtgagcacgcggcagccgatggaggggagtggagcggcagcgggcgagcgcgcgaccagtggagcagagcggcggcgagcgagcgggcagtggagtggagcggagcggcggcggcatccgcagctcgacgaagtaccatggcagcgtctagaacacgagacagcacggcgcgatatagtagagcgaggtgatgggggttcagcgacttgccattggaggtgaccagtatctggatgagcacgagccacgtggcctcggcggcgacggcggtgagctgtagcatgacgccgaacgcgtcgaaccgcgcctcgccgtaggcggcgacggcgacggcgacgcccgcggagatgccgagcatgttgagcatggaggcgcggcggaaggagtcggtgtggaaggagacgatgagggagtagacggcgacgggcatgaatgccttgagcatctagatgaaggagacagagaggtatatgtatgcagagttggagaaccagagcggcagcggcaggctagtgagcggccgcgagcgcgcagcgggcgagcgctacagtgggcgggcgggcaggcggcggagcagagcggcggcggcaggcgagcactcgggcggtggagcggagcggagtagcggcggcatccgcggcggcgccggcgcagctggaggaggaagaggaggtaaggaagaccgcatcggtgagctctacagccttgtccagcccgacggctcggcccgccgtcaccgcccccgctccgctctctcgaccacggcaatggcgccgcacggcacgcggaggaggaggagggaaggcagacgaccgccgcagtcgtccctcgccagccgccggccacgacaggcctcctgacctcctccccgctgcgtcgatgaagctgtcgccatccacaacgcccaggggaaaaaggagagaggaagggagacgaggggaaagagagagtgtgcgctgatgcggcatcctgacatatggatgctgactcagctgttacataggataaaaccgggttaaaatcatcgaagtacctattttaacctattttgattagttaagagacgccggatatttgttcttggttgggggacgattttgtgactggatgacaagttgagggaccttcgttgtactttttcctcccagtattgctatctgggccaagttctctcggtcctgagaaggccgtgaattgggccactgcgtgagtagaatttatctctccggttatgcgtgagtagaattttgccacgataaaaccatttggattagcacgcgtgattctctagaaatcatattgcaaggaagcagactatcatatcgagacgacccggcgagaacgagaccccgagaaatcatggccatatacttactgattggaaaccccgagtgagctggaagccattctctcaatcctgtgcaatgatggcatcgcccactgattcttacattaagatccccttagattaggtagcctggtcatgtttaattttgcattagcttatcgtagcgctgtttgatcataacccgtgccaatcagtgaagtaatctatacatccaagaacactttccattgcattttcatttcgtttcccctgccttttgagatacatatactcagcaagctgctcccgcaatgatttcctttggttgcttatcttatctaatgaaagatgctctcgggtctcgaagttaatattacaacattgctgcatgatcaatagtttatcttgaaatgttcatacaagaattgaaaaatttagaaaaaaaatctctaaaataaattggaaaggagaaactttagcagtcaatcatttgagctttctgaatatacgaaccgagctagtagattttagtctctgaaaacatcacatgcaagcacaggccatgattcccccagcagaatacgcaagggatccaaattccaacatagctctccacgatgagcaaagcttcaaatgtacaggcaggatcgcagtgtcggcagtgcataggcattttgatagtttcatgttgtatgttcaggggaaaaaaaagaacatgacacgtaagtgcaactcctacttagccgctgcaatttccctaaattagtagtcgtaacatctttctcggtgccaacacatcgttgagtctttggaggcagctttcgccgtgaaatgagttgtcaagaggctatgtgtgcatttggataatcgcattgccaagctgcctgccaccaatcgccctcctcctctcctttacggtgctgagacaatgatgcaccccaaagctcttcaaggcctacctggccatcttgattgctgcacagagatgtttccaatggctcaagcagaccgggcagagagagttgtacagtccttgctcatcagggtagagggggaaaaggcaatggaaggatattggcatatgtttcttttgagtgttgcttgagccctatgtcatgtgcatctcagagccagccagctccacacccagcgaaaaggagccacctttggaccatcttcttttccctttccattttactccactttttatatccatttttcagaagaaaattggaactgtcggtaagttctgttaactacccacttcatagcagttaaaattccctgcaaattaatcacccaaaacgaaacaaaattggggcagaaattgagaaactgtcactgaaatgtacttcagttttgtaggcttgggctgaagagaagaacgcaccgataggcgcaggaccatatgttttgttcctatttgctctccaagttggcgtacggggaaaagacgagagcaatcacaaaatggcaggattcctaaagtggttagcgagtgcatgattcagtagaaaatttctaatctggactgttgctaagtaagcatggaccattattcaatccagtgaaagcaaggacgatgattgcgtttaacttgagtacaggcaggcaggccattttcatggccgccggggcagacgcttttccccccatgattttccctctgcccgacactgcattgcaagtagctgcttaaagtggactaggctttggacgcttccagtgaggcattgatcctctctgtttcttgtgttacccatggaagaagaaccagcattttccattttgacctggcttgccataggttgtagacagatatagctgaagattctgaacccacatttcatcagagctcagaataccgtgttgtcaggcataaagcagattgttcttatgctggttccttttctgccatatctgtaccagatgaagctagctgcagtctgcagatgtaagcagatcgttcttagtcgttcttaggttgcacatatagcttgttccttttgtgctcgtatctctctttgccagatgaagctagctgcagatgtaagtaacacataacaggtagagtagctgttgttgatggcaagcaaggattcaagatggatcatgccatgatcacagggaactaccgatcacctctacgacctaacaacaaccttaccaataattttctttctggagcgagatctcttcctcgtcaagctttgatccatcgacactgaataaaaaggctttggcgttagaacggtggatttggagctaagggaattcctcgctttagctgtaaggccggtggttgttgctgcttactttgtgctacacaacgctcagcactactgagcttttcttcagtttagtgcaagagacgtgtctcgtacccgtggaattattattaagctaagtaatgtgttagcttctggataatccagggtcaatttaatttggcaatcaaaacagtcctagagtagtagagtgcagagtatttgttgctgtcagatagaagacttactcttaatgggtagtactaaccacagtactataattaacctgtcctattgcttacccctgaatgttgcaacaacgcattatattacagtgcaagctaagtgattggacagagagtatatcaatcatccggaaacggtggcgaaataattcctgcaaaattcttcaaatagtttgttaaactgttgacgaaaaatgcttttattattttccaaaaatgaggaagcattttagattttgtcgtgaccacgggatacaaaatggatttggtaaagtacaagcttgcgaaattaattgatatattatcttctgtgtcctacgtacattagcagatttgttcatagcgtgacagcaacccaggcgggacgtggtgacgcacggtccatatgacacgctccaagtttcggacgaaatggacccccataatctgcacctaacgccggaaattgagaacaaattaaaagggacggcgaccattgccagtagtgcacttttaggcacgatgctatgccaacaaatgattcataggaaacaacattatgggtataggcttgtagcacactattaattagtttgggggttgttacatctaaagaaaaatgaacagaaaaaaaaatcaaggagttgccctaggtttttacgttttcgctgtcctcggttcttcgcatatgaacagagtatgcgggttggacgattatcaaaagcagtttataattttttggttctactaggtggggaaaaaaaattccgccttcttccaagttccaactactaccaatcaggacctcatagtttttttcaagagcaatcttcttttacggtctgccgtgtcaaattcacctggttatgttgctactcattgttaaagtcatcggtggttcagtactaggactaaccaatcccagctttggacatgattagagaaatgcccatttccaggtcggacaccttgtttaccatgtcctttacatttttctttccttttctttgtatagatgcttttcattgctttctactggacgctcgattgctctcggccccttgacccactactgttgttgtttacccacacaagtccagaccaccattcaccagttcaccacgcgtcgcaagtcgctacaggaagaagaagatccgaagctcccaccatgcgctctgacacggcgggccccacgcccgccaccaccaccgccggtagctttcatgggacggcaaccacctcgcctcccattttttctccttacctccggctcacggaggccggcctccctcccaaagacgcgcgccggctggggccgatctctgtggtggggccatcgctttcgtcgcgcgggcccgcggcggaagcggagccaagccgagcgggcggcggagtgggagtgggagcgtgccgtgccgtgcgatgcgagccccggtttaaattgtgggcgaccgttggagaggagattagcggagcgagagcgtgcgtggggccgcaggcgatcaggtccgacggggattcgactactcccccgttttggagcttttgggttacaaatttgaccgagtgcaatctaaatacttctcctggtttttctttataaaaatattttcggggctgtttgattctctaccttaccaaaacactggtagtagcaaacttttgacatgttttggtactacaattttttttggtagggtagagatttattatacatatttggattactaccaatatgatgccaaatattgatgatatagagaagaaggttctaaattagtgacaaattaatcattgacattaccaataatttggcttcaatacaaacccatactattactattcaaggtaccaataaaattggtaaggcacattttggtaccaatccaaaatggcccttcattcctgccacttgcatgccttagcgcagtttcctacagtatacaacacaacatgtaaatatattgtaccgtgaaagttggtactaatgttttatattcagtaatagtagtaagtgtaaggcaataactcgtattgttatatattcacaaacatttgtcattttttacataactgatatttaccaacaaaacgggtattgtatttaccgacagaactaagaattttactcttattacaatgttcaagtaacaaaaacatccctagtgtctcccattgatggttttctcatcacaacatattgcaaacggcaaaaaatctgtttttctttggaacaaacaatagtactgattatttttttcaaagaagccctaagaagaaaatggaaaaaagttcggtaaaaaacatgctatatgtaacaattactattgcaacctatagtactccacttaatttgatcacatatactaggcattagctagtcctttattgggacaacgtcccatgatcccatcttataaatgcagtacttcacttcagatcatgcttgaaatttaaggcaaagtacatgagaagtccgtgacacactgacacttgacctatcggcgaagaaatgttgtgaaccgatacacttcgtttttaaagctgatgggtcaagacaaatttgcaatgtgtccgaagaaatttgcactccgttggttgttacatgaattaatcgaactccttgtactgaactgttaatgttgttagttgacaggacgaacgaaaattcaccaaaacatacaacatgcaggtactactactactactactactccagtatctaggaatattcattaccaaacaaaaagaaaaaaaagaagaaaaaccggtgttacagaaagagaagtggcaatatgcactactgtgtgggggtggcctggtggatcaaggcaaggtcaaacatggtgagttggtgatcccgagacaaattgtacaacaaagttagttagtgatgaccacgtaggtacggctgaatggaacatttcacctctcttctttttttccctccaaaccagtaatatcaatatggagtcactttacttgccaaaaacatcgttctgtgcataaccttcacgaccccttgtcatttgagacagtcgttttcagagaatgcatgaatgttggagttagcggaaatgacggagtagtttcacacataatagcagataaaaaggtaaaaaaaaaagaacttattataagtttgaagaaatgctgaaattgaatgcactcgatttttttttagaaaaaaacattcccacgctagtctctttaaaatccactagcaattctactttaatactaggctattttagttttacacctgcaagtatgtgaagtgagattagctaaattggatgggttacagtgggatctgctcacctgggttcaagtttacaactaattattcttttagtggcatgtaacgtacctatcgatagcgagacatctgtggtgactttgtcaatctcaagatatcctggcacaatattttagaagtgctcgtagagacagggtgtgagtgtacgcatgtttgagtgtttgtgtttataccgtataagtatgatttgctaggaggtgctcatagcgtaaatctcaaaatataacggtgcagtcttttgaaaagtgctcatagtggtagaatgtacatgtgtgcgtttatatgggtggtatacacctgtttgagcgcctacatttgtacgtataagtatgattcactacaagatgacatatatgttttcaggaactataataccttgcaaaatcctcttaggaggctatatgaacaaatgtaattggttaaattcaataaagcttccattgtctttagaaaatatgaacaatattgtaaagtttagagagttaaatggacatttttaaagtttatggtgattagattattaacttaaagctaaagtttagaagtggtatatggacattttccaatataaaatatactagtacagcaataatcaaacacatatgcgaagtgagcatagcttgactggttaggttccttgtggtggaaccagcccacctgggttcaaatcctagacgggtgccggccttgtgagtgcctgcgttttgtattgtgtttctaaaaaaataaaataatcaaacacatatacataacacatttcaccaaatggtgcattttttaagaaaaacttttcgtattaaaagattaaaacaactcaaaattttaactttgtactagctagcagttagttaatcgtatactaattgagtgtctttcctgataagctaagcggctaatcaccaaaatgccgaaacgaacgcggtttatctctaaaatatttttgcattgtttttagctacttcaccgattattttcacgtcttagttgctccacgtagtctaaaccaaaccttaagtttcatagtgatcaatgctatatttgaataaagcacataattgtattttaaaaaagaaaataccatgtgcagcgtggaccaatctttatcatttcgttatgaaaaaaaaattaacaacagaaaaaaaaacaagcggcccgtactgtagttagggagcaccggagcagagtacactttactcaaacaaaacgctctgttttgtattgtgtttctcaaaaaaataaaataatcaaacacatatacataacacatttcaccaaatggtgcattttttaagaaaaacttttcgtattaaaagattaaaacaactcaaaattttaactttgtactagctagcagttagttaatcgtatactaattgagtgtctttcctgataagctaagcggctaatcaccaaaatgccgaaacgaacacggtttatctctaaaatatttttgcattgtttttagctacttcaccgattattttcacgtcttagttgctccacgtagtctaaaccaagccttaagtttcatagtgatcaatgttatatttgaataaagcacataattgtattttaaaaaagaaaataccatgtgcagcgtggaccaatctttatcatttcgttatgaaaaaaaattaacaacagaaaaaaaaacaagcggccgccgtactgtagttagggagcaccggagcagagtacactttactcaaacaaaacgccagagcggcgaaaacaaagaaaaaagagcagaagatgagaagacaaaaaaggggaggaaatgaaaactgaaatccacttccactaaccacaatttttaagcccgaagcagccgaaagaaaagcgcgcatacacgcagcgcaggcattggcgcatcgcaaaatcgcaatgcattgcagctaaccacaaagctcccacctctccgtctcctcccccctccattataaccacccccacaaaaccaccacgcatcgccccattaatggactcgccacctccctaattccaccgtccatttcaaaccagacagaccagcggagcggagcggagcagctgcagcggcgaggcggcaccgcgcgcgagccacggatggcggaggcggcggcgctcttctcgctctccgcggccgccgtggtggaggacgtgctgcggcagcacgggtgccgcctcagcgaccgcgacctcgcctcccgcagggcggaggaagccggtgcgtgtgtcgtgtcgtgtcgtgtcgcttcgcgtgttctgcgtggaatcgtggtggtcttttgccaatttgccacccgctatcggctggcttcgctcgctcacgcgacattgtttggttccgtgcagcggcgaggcggaacgaggcggcggggtggctgcgccgcacggtgggggcggtggccgcgcgcgacctgccggaggagccgtcggaggaggagttccggctcggcctccgcaacggccagatcctctgcggcgcgctcaacagggtccacccgggcgccgtccccaaggcatgcgcacacgttgtgttcgttaatttgattcgctcccgctgcgctgtttgccactgtagcgtgatggttggttgctgtgatgttgcgcgcgcgcgcgccccgcaggtggtggtgaacacggcggcggactccgtgctgcagccggacggcgcggcgctgtcggcgttccagtacttcgagaacgtgcgcaacttcctcgtggcggcgcaggagatcggcctgccgtgtttcgaggcctccgatttggagcaggttcgtgtcggagcgcgccacccggcccccatgcgccgttgcttgcagctgcagcaaagcggccatcaccctcatcgtcgattgctttaggcacactctcttgtggagcctgtgattttgacgcgcgccttttttttgcctttctgggcgcagggagggaagagcgccagggtggtgaactgcgtactggcattgaagtcgtacggtgactggaaacaatgtggtggcaccgggccatggaaatacggggggaatttgaagccgtcggcttccggcaagtcgttcgtgaggaagaactccgagccattccggaggtgccaatcgatgaacgagggcgaggtgccttacgaggaggctggattcagcggtgattatcatcttgattccggtgacatggttagctccgtgcttcaattttgaagctgctttgtatttgtcttgttttgctagacgatatgcggctaaacggttaatgcttcgtgcagtcgacgtcacgccctttgaaaatgttggttagtgcagttttgtccgacaagaggcccgacgaagttccacaggtaggccaatcaggttccccattttttagtaagctgtttactggttcaatgggatacatgcaagcagctttccctttcatgtgatgctttaccggttccttggagtttttatgctattgtttgcctgcagctcttggagtccatgctgagtaaactcgtcgaggaattcgagaatcgattgactagccaacatgaattggtagatatcatctttgtacacttcttatctgttgtttttgaaatcgttttctgcgtgacatatggcaatatgtagactgggccgcctggaaatgatataaacaatcaaatttttaattcattggaacaggtgaaggcggctctgaaaaatggtacagatggcaccaaatccttctcgaaatcaaaggttctggttgaagccaccccaaattctaatgagaaaaaggcaagctataaatttgctcttatttagtatgttcaaaatatttgttttcaaccgctgtaggaatctctgttgcaatcacaaaaatagataggtgtaggttgctagcagctactatttttagtttccaaccaacatttcttttgcttcctctatagatggatacgatagaggtttactccaaacatagacaaaccaaaaaggaagcatatggagaagttacactgaagcaatattcaatgctacaactacagtcaaagcatgttgaggtattattttaattattcattttatttttcattgtcttggtggtgattaaatatttatattactgcttgtggttcttttctttaggaactcaaggctgatattagagctacaaaagctggcatggagtttatgcaaatgaagtactccgaggacatcaacatcttaggtaaaatgggcatgcccgaggtgcttaattaaactaactattttaatataacgctaataaacaaagtatgcatttgcaaattttattccaggaaggcatctgtttagccttgcacatgctgcctcaggttatcatatagttcttgaagaaaatcgcaagctgtacaaccaagtgcaagatcttaaaggtatgcttgttatatcgaatattcatgccaagtgtttctggaccaattaaggataaaaatgtgctgtgagaagcagaaagaaagcatgtattttgattattttccatgtttatagggagtatcagggtatattgtagagtacgaccctttttacctggacaagtaagttcttgtgctgtgggttcaattgatgagggcaatataaccatcatcactccttccaagtctggaaaggaaggtcgaaagacttttagcttcaacaaggtgtttggcccttcagcaacacaaggttttctacctgtccatttctcaattttttttcgagctcttgaatggaagaagatcgaatggttttttgtcgtgcagatgaggtgttcttagatacccagccccttattcgctcagtacttgatggatacaacgtttgcatctttgcttatggccagaccggttcagggaagacatatacaatggtgagtacagtaacaatatttggtcaatatatatgactgatatcaattaatagtgtttctaaagcatatactaccatggattcccttcatgtaccattaacatcttctctatttcttttatgtagagtgggcccaagaacatgactgagcaaacccagggtgtaaattatcgggcactaagtgatctatttaagcttgccgaacaaaggaaaggagcattcatttatgatattgctgtgcaaatgatagagatttataatgagcaagtcagggacctccttgtcaatgatggtctgaacaaaagatatcctcacaacagcatgtttctatcaaattgtgccactttatttgtgttataaattgctttcacaagtaaattattttgtactgctgaagtaaatagtcttccttaacaagtatatacattagagattcgaaataattctcagaatggacttaatgtgccggatgcaagccttgtctgtgtcgcatcaacaatggacgtgatggaattgatgaatgttgggcagaagaaccgtgcagtcggcgccactgcactaaatgaccggagcagtcgttcccacaggtaacccaaccttttctgtgtaaaaaaatcacatgaaataatttgaattgataaatgaacataatgaaatattctcttaatcttgcagttgcttaactgtacatgttcaaggaagagatttgacatcagggaccattcttcgtggctgcatgcacttagttgatctcgcaggcagtgagcgggttgataagtcagaggtcactggagaaaggttaaaagaagcacaacatataaacaaatcattgtcggctttaggggatgtgattgcttcacttgcccaaaagagtgcgcatgtaccttacaggaatagtaaattaacacaactcctgcaagattctcttggtaagatttaaccttcttgcaatttcttaatgtgctgtcactgactgctgagtataatttatatttcctcgaattttaacaatgcgtctacaggaggtcaggccaaaaccttgatgtttgttcatataagcccagaaagtgatgctttaggagaaagcataagcacattgaagtttgccgagcgtgtatccactgttgaacttggcgctgctcggttgaacaaagagtctggagaagttaaagaacttaaggagcaggtttgtttctgctactatgctttgtatcatattttctcactgcatttgttgtttaaggtatgcatatattctatctctatccagattgctcgactcaaatcatcattagcaatgaaagattcaggatcagagcaaaacattaaccgtgaccctgaggcatttaacatgaagatgccttcacctggcttttcaaataggcgacagggtagttgtgagttggtgtctagccaaactaacttcagacaaccaatggaggacgttggaaacatagaggtactaatgccttgcattatttcttctataaacctttctacgattcatatttgtttgacatttacaagttacacaagtgatattagcaaattatgataatacaactgtcctttcagcggccatgctgttgttaacgtttttgtcccatcatgtttgatctggtttttatacaggttagagccaatccaacattaagacagaagaaaccaagctttgatctccaggacttattagcgtcaaatgattccccatcatggccagatagcatttcaagggcaaattttcaaatgggagaagaaagagtgactattggtggggaatggatcgataaggttgtagtgaacaacaataactcagtaggtgattgggaaggcgacagtgcagctttacctgacttcttttaccaaaggtaccattcaggtacaagagataagcaatacctgagaaataactcaagaaaaaaggacggaaatgagtttgagcagcaaagaccaagattttattccacaaatactgatgattctgatgacattgacattgcaacaagtgattcctcagaatcagatgcactatggcagttcaatgtccaaagcatcaatagttcaattagcgagaatggttcaaagatcaagaaaccacaaacgaagctaagagagagctcagataccaggtaaccattttttttacattaacaacttttttttacaacaaacattattttttaagaataacagggctaataactcccttgtcccgtttttgttgaagtaaaatcatcctacactgttttagcacccacaatactcatggtataaagcagatataaataatttaactatgatgaactgaacttgaataaacagtcatatggacttggatattagcgtattacttgggactacactaattgtgaattgtgggttatgactaatagtgcatggatggaaaattatctttatgttgttatttaaagatatagttcacctcatgcataatagtgattgctgtgaatttcaagattgtggtctgctaaggctagtcacagagttgctaattctctgaaatttaattagtatgaaaaatgtgtactggaagtacatatctattaaatattaatcccattaacttttggttcttttatatttggttgatactaatatttatttaaaaagaaaaatatataatctaaactataacatactaaactattcgcataagatatatcattttactccatgaaaggctgattaagatattccatgcttccatgtatttactcatcaggacaccactccattctcaaataccatctgcttcgagaaaaacctccaatggaaatagatctggacggcaacctttaagtggtagcgatagcaaaaggctctcatcaaatggtagacatgctggtacaaagtagggactactacaatgatcatgtgcatttttttttcttggctttctttcagtgtttgtcatgagagattgcgaggtttttctcgagtacagcaatgagtgacaataaacccaattgattgtctcagtgtggtgagttgtgatctcaacaactggtgtgtgaggccattaacctttttttttatttggcctatcaggctatgttgagttcttgctaattctttgtgtattgttcataatatatataatgaagagaaaagaaagagaattggttgatcaaaagcgggtgcataatttctctctttgaacgcttttatcttttgataaaggttctttccaatgtccttcgtttattattctccagtattctaacaagtacagcttttgctttggttggaattctcttccacgggtccacgctccatgaagttcatgttcatgttcttgtacattgatattgatttatgtcagctatcgtgtcatacagtgacactgctagccaaacttgtgctgctgatcatcctggaaacctggaaacatgtttttgctgcagaggtgatggtcctgaagtcttgccttttgcttaagttctggaagtgctcgttggattgtacataccacttcattcattcctgtaagtgaccatgcagaatcatgtctgttgtagctgtggtgcataccatctaatacattgcagtgacatgttttacaattttactgtccaacatatatctgagctttagacagaatgactacagtatagtagctttactttttcttttttttttgaagggagttgagcttacctttagtgcaataaatgttactccctccatttcatattactataatttataagtcgtttgacttttttcctaatcaaacttatttgaccaagtttatagaaaaatataatagtattttcaacacaaaacaaacatattatcaagtatattcaatgctagatttaataaaactaatttgatattctggatgttgctaaatttttctataaacttaatcaaacttaacaaattttgattaggaaatagtcaaacgacttataatatgaaacggagggagcaacacatttgttggaggagaagagcattgcttggaggaaattcattatgcagtcttggagttccatggaaaaaagaccttagccgagccccacaagaccaaaatcccaactatggcatgaaatgagagaagggaaagacgaggaggaagaagataaacatggtcttttacatataggtctcatggcattatttatttatgagtaaatttcagaaaactgcaactttagtgacaaaattatcagtttgttgtaacaatagcgtgggaaattatcacaaaactgtaacttttacgttatatgctgctacagtacatataggtgacaactgtagcagcatataatataaaagttgcagttttgtaataatttctcacgctattgttacagtaaactaaaacatgtcgctaatgttgcaacaaactgatagttttgtcactaaagttgtagttttctaaaatttactatttatttatttattttattgattgtaatgcaacccaagtgccacgtaggtgccagatgataccagtgtgaactgcataggaaggtaaaatgaagaattggtattgataattgagggaggttgtatacatgatttttcgattgcgaggaaactcagattgtaatatagactttctttttctaatactcaccaggaatctttggcccagttagtctagctacaaagcactgcctagtagttcaaggccagagactggtccactaagcgttgtgcccagctacataatcatggttcaatgcccaatgaggccttttcggaaacttagagcataatctagcaattttcggcgactatgcaacacgctgtgcatgcatgaagaaggatcgagttcagttaagattcaagagcaccgatcttacaagaaaaccatccgcgtattcaacgggcaagtagacaacaactacgcaaagtctaattaagcagcggcgacccaaagcccatgtttgccagccgaggccaactcaccgcagggaaaaggtgagctgtcctaccaccaacaaagccacgccgcgcgaccgtagaaagaaaagcctacgcggctacgccgtttcaccgacgactggacctctccttcacggcctcgtctcacccaaccctagttccttttaggacgaaaacggaatgaatacggaagtataatgctcatatcatatttgtttttatatttctttaaatacgaatacggacaactcaaaatagaaacaaatacagattacttcgaatacgaataaaaatcgaatatgatcggacacgaatacggaaacaattttttctcggaacacgaaaaatcaaatcaatttctaatataaacaaatatcaacatatataattagttcattttatttaaaatgtagtataatttataaatatttatttaaaaaattaaataatattaatagtgtggactagtattaagagatgaacttctattaaaatctaaaaatgtatattgaaagtcatagagttataaagatttggggtatgtctcatggcttctgcggatatccgaatagcattgttagtcggatatccgagttattatccgtatccggcggaaaccctgataccatatctgtattcgtatccgggaggaaatatccgtattcgtatctgtatccgagctatctgaaaattatccaaaccgaaagatatttgtattcgcttttctctgaagcagcgaaaactattcgctctgtttctaatagggttgtgattttgttctctcttgttcaccttaagttgagtaatcaccgccacaaaatgtttcaggcgattttgtttgcatgatcgtttggacttggggaatgttgtaaagtgaagatttgtttcgctactctctctattttttagcgtaccttttaaactgctagacgatatgttttatgttaaaactttttataaaaaatcgttttaaaaaataaaataaattataattcataatttaattttgaaaaatactcaattaattaggtttttcattttacatgccactaattagccattttcaacctgtggttgttagaacagcccttaggttaatggataaaagcatgctagttgtgtttttacagcccgttgtgtcaaaaactcggaggtcatgagcaaatttgcattttttgggatttgaattttagaattaatttgttaattttttcattgctttcattacctagacttccttttggacaactaagaattaaaatgtaaaaatataaccttaattatttttgctactttgataatctattttcgatttatagactgtagcaaaaagaaaaaagcttttcaagcagtgatctgggttcaccagctgtactcaccactaaggctatgttcttctcctagttttccctcttttattttccgcgcgcacactttgttttttttaccagggcgcacacgctttgtagaaaaattctatatgaaagttgtttttaaaaaatcatattaatttattttttaggaaaaaatagttattaattaattaattatgtaataatatatatttcgttttgcgtgtcgggaggagggcagcacctaactcatgctcctactagtttttgttatatttcttgttcattgaattttctcatagaaagggacattatgcttgatctggtggtgtttggatcagggacttaactttagtctctatatttagacactaatttagagtattaaatatagactacttacaaaactaattatataaatgaaagctaatttgtgagacaaattttttaagcctaattaatccataattagagaatgtttactgtagcatcacataggctaatcctggattaattaggctcaaacaccacctagcatgcataggacgaggcatttaattttacttataacgagacgtgccaaaaaatgatatccacataacggcataaaactaaacagctgcatatgaatgtaaagactaaataaaataattgcaccaaatcttaagtttttaaatgcatttttggaaaagcttactactggtactactattcttgtactcatatgtggagttgtggacttgcaagcaatagcacatgggtccataacacctgacaccaaaaccacctgtggtcagtcaaacatatccattttagcagctggcaaccatacattcaaacatgcttaaaaaatcttaaaaacattactagtagtcctcagaaccggacaacctgcggctaaatccacaatatgaacacacttttctttaatccaactcagatttcttaatccaaaagttgctaaccactatcgaccagctggcctcgctgctgctgcaagcttgcagaaatgcaggcatttggcaagcacatttgcaccgaggccccctatttcacctacgaattacaaaaagatcccacctcttctactatcgtcagctaattaaatcgttgttcctcagttcggtacttcttcttccttcactctccccaccaaattcccccaaatcgcagctgttcgccacccgcattgcgccgccattgcctccaaatccgagtactccttgagtaatctcagatccatctcgggttcctcccgccgttggcagcagccggagcttttttccgcggaagaaatggcgccgtttcggtgagttcttggcagtttgggatgatgcttggtgggtaggaggactaggagtgcggcggctcggggagaggctgcgatggagagcgccgccggggaggaggggaaggctgccccgtcgcttcccctggcgaccctgatcggccgcgagctccgcggcggcggctccgagcggccgctcgtccggtacggccacttcggcttcgccaagcgcggcgaggactacttcctcgtcaagcccgactgcctccgcgtcccgggcgacccttcctccgccttctccgtcttcgccgtacgtgccctccccccgtgtcgcgtttctggtctcgtctcgggattccgtgatgctgatggcgtgtcgggttttgttcttgttcttggatctgcggtttggcaggtgttcgacggacacaatggcgtgtcggcggcggtgttcagcaaggagcacctgctggagcacgtgatgagcgccgtgccgcagggcatcggccgcgacgactggctgcaggcgctgccgcgcgcgctggtcgcgggcttcgtgaagacggacatcgacttccaacgcaagggtgagagagatcctcgcaatgccgttgaaacttgaaagcctggaccatcgccgctgtgaagatgttaactttgggggatgttgtgtgagtgtgattgcaggggaggcatcagggacgacagcgacgctggtcgtcgtcgatgggttcacggtcacggtggcgtctgttggggactccaggtgcatattggacacgcagggcggtgtgatctcgctgctaaccgtggaccatcgtctcgaggagaatgtagaggagcgggagcgcgtcaccgcgagtggaggggaggtcagccggctcaacctgtgtggtggacaggaggtaagctgctagtaaatattcttggaaagaacttcaaggatacattcaatgctgtcaaagcatttctcattatgggttttgatgtgaaatcttgctgttgttttaggtgggacctctcagatgctggccaggtggattgtgcctttcaagatcgattggggatactgacgttggggagttcattgtgccaattccacatgtcaagcaagtgaaggtgaaattttaagagtttgatcaaatgcaaggagtagcttatcgcaatgaacttaactgtgtatgcttttcattctgggaaattgtagctatcaaatgctggagggaggctaataattgcatcagatggaatttgggatgcactgtcctcagaagctgctgctcaggcatgccgaggattgcctgcagagctggctgcaaagcttgtcgtgaaggtagtttcacgtgtggtttcagtttcttgtttatatcttactttatatggaatgcttcactatcttgatcatccaactgagatccattcatattgtacagcaagcactgaagacaagtgggctgaaagatgacaccacctgtgtggttgttgatatcatcccatctgatcattcttcaacacctccatcactatctccaaagaaaaaccagaacaagttgagatctcttctttttggtaggaggtcacatagttctgttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatgaactactg

SEQ ID NO: 3043 - DNA, 392 bp, Oryza sativa
ccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattc
